United States Patent 9,572,897 (MODIFIED POLYNUCLEOTIDES FOR THE PRODUCTION OF CYTOPLASMIC AND CYTOSKELETAL PROTEINS) - sequence listing, part 11

SEQ ID NO: 19143 - DNA, 465 bp, Artificial Sequence
  Description of Artificial Sequence: Synthetic coding sequence
atgacccactgctgcagcccctgctgccagcccacctgctgcaggaccacctgctgcaggaccacctgctggaagcccaccaccgtgaccacctgcagcagcaccccctgctgccagcccagctgctgcgtgagcagctgctgccagccctgctgccggcccacctgctgccagaacacctgctgccagcccacctgtgtgaccagctgctgccagcccagctgctgcagcaccccctgctgccagcccacctgctgcggcagcagctgtgaccagagcagcagctgtgcccctgtgtactgcaggaggacctgctactaccccaccaccgtgtgcctgcccggctgcctgaaccagagctgtggcagcaactgctgccagccctgctgcaggcctgcctgctgtgagaccacctgcttccagcccacctgtgtgagcagctgctgccagcccttctgctgctag

SEQ ID NO: 19144 - DNA, 7062 bp, Artificial Sequence
  Description of Artificial Sequence: Synthetic coding sequence
atgaagcagaggaagggccagggcagcggcggcagccggggcaggaagaagaggggcctgagtgacatcagccccagcaccagcctgccccccctggtggagggccagctgcgctgcttcctgaagctgactgtgaacagagtcatctggaagatcgccaagccacccacctgtgtgctggtgcgggtgcgctggtggggcgagaccagtgatggcaccctcttctgccccagagatgccctgcagacagagcccaaggctgtgaggaccaccaccaggtatgccatccgctgtggccccaagcagttcaccagctacctgacagacatggctgtgctggtgctggaggtgatcaccaagctggatggcctgcccatcggccgggtgcagatcaatggcctggcccagctgagccccacccaccagatcaatggcttcttcaccatcgtgagcagcaccagcaagaagctgggggagctgcaggtgtccctggccctggagcccctgtctgagacctatgacagctaccaccccctgcccaccacagacatgacagaaaatgtgctgctgagcaagcagggcttcagagaaaatacagagcccagcagcacccagttccaggtgcccagccggccccgggacatccacaccatcaagattgatggcaaggagctggccgccaacagcagccgcagcaccaccccccggggcaaggaccacgtgtgctttgctgaaaatccagacaccatcaaggacagcagctttggcctgcagcacagcctgaacagcggccagagcctggagagcgtgaccctgaagggccgggcccccaggaagcagatgagcctgctgaacagcagcgagttccagccccagatcagaacagtggccaagagccacagcgacagctgcatcctgagcagcaacaacctgcccaccaaggacctgctgagcgccctgctggagcagggcaacaagctgagaaatgccatggtgatcagcgccatgaagagcagccctgagacctccatgctgctggaccaggtgcacccccccatcaatgaagacagcctgcgggccagcacccagatccgggccttcagcaggaaccgcttcaaggaccacatcgaggaccacctgctgcccagcacagagaacaccttctggaggcatgacaccaaggctgacacccgggccatccagctgctgctgggcagcgctgagctgagccagggcaacttctgggatggcctgggcagccccccagacagccccagccctggcagtgatgtgtactgcatcagcgagctgaatgacccccagtatgaccagagcctgctggagaacctcttctacacagcccccaagagtgacaccagcatcagtgacttcctgtctgaggaggatgacatcgtgcccagcaagaagatcagccagagcacagccctggcccggagcagcaaggtgctggagagcagtgaccacaagctgaagaagaggtctgctgggaagaggaacagaaacctggtggagcagcagatgctgtctgagaccccagaagatgcccagaccatgaccctgtctgtggaccggctggccctgctgggccgcacccacagcgtgcgcatcatcatcgagaccatgggcgtgcccccagacagcccccagatgaccccaggcaagaagagctatgccggccccccacccaaggtgaccacagccaagaagaggaccttctttgtggagtaccacttccctgtgggcttcagcgagagcggcctgggcaagacagccctgatcacagaggtggtgcggctggccagcagcaagatcacagatggcaaggtgaagttccagcagagatttgtgtttcctgtgcagtttggaggccccatgattgagcactggtggaacagcaacctgaccttccagatctacgtgaagaagaccccccagaagaagccagaggtgattggctctgtgtccctgagcctgcgggctgtgatccagagcgagctgctgtccttcagtgaccagctgcctgtgcagcaggagaatggccagagccccttcggccccctgaaggtgaccatggagctgatcacagacaacaaggacttcaccggcatcaacaccaagctgagcggcaacacccactacacccccctgtgtgcccccaccagccccaacaaggccctgcctgagctgaaccaggacatgacctgcaccaagaacccccagaacctgaaccagatccacgaggagacagccaagaaggcccagaacctggtgctgcccaacaggaagagccccagccctgtggccccccaccccagcacctttgtggccaccccagccagccacaacctggtgaaccagaccaacggcaccaccaaggagagcgccctgctgctgcacgtgctgctgatggtgcctgatggcaaggacttcatctctggagagagcgagaagcagagcccctgcaatgtgtacctgaactgcaagctgttcagcacagaggaggtgaccaggtctgtgattgcctggggcaccacccagcccgtcttcaacttcagccaggtgattcctgtgtccctgagcagcaagtacctggagcggctgaagaacaacgtgatggtgattgagacctggaacaaggtgcgcagccctggccaggacaagctgctgggcctggtgaagctgcccctgcaccagttctacatgtccttcaaggatgccaagatcagccggctgctgctggatgcccagtaccctgtggtggccgtggacagctacatgcctgtgattgatgtgttcagcggccaccagaatggcagcctgcgggtcttcctggccatgggcagcagcaaccagatcatggccctgcagaggctgaagaatgaggagggcaccctgccccccttcagccccaggcctgcccacttcctggaccagcccacagctgcctctgtggccatggctgaagatagaggaaatggcctgatggagcactgctttgagatccacatcgagatggtgaagggcctggcccccctgcaggccaccgtgtggggcgaggccgactgctacgtgcagtactacttccctgtgcagcacagccagagctctgtgctgaagggccctgagttcctggagaatggcatcaccctgaagcccttcagaacagccaccaccctgtgtgtgcctgaccccatcttcaacagcgagcaccaccacagcctgctgctgcctgctgaggtgcctgtgcagaggctgctgctgagcgccttcagcgcccagggcctggtgcctgggggcggcgtgcagtttgagatctggtgccgctactactaccccaacgtgcgggaccagaaggtggccaagggcaccctgcccctgagccgcatctgtgccatggtgaccacccagcaccgggaggatgtgggcatccagaccttcaacctgcccctgaccccaagaattgagaacaggaaggagctgaggaaccagagcagcggcctgctggatgtgggcctgcgctaccgccgcagccccaggacagctgagggcgtgctggccgccaggacagtgtccatctctgtgcagatcatccgggcctgtggcctgcaggccgccgccaaggccctggccgagcgggagcccgccctgcagttcagcgccaccgtgggcgtgaatgcctctgtgaccacccacctgtccttcctgccccagggcgagcagaggaggacccaccctgtggcctgcagcttctgcccagagttcagccaccacgtggagttcacctgcaacctggtgacccagcactgcagcggggaggcctgcttcctggccgagctgctggagtttgctgaggtgatctttgctgtgtaccacgagaacaccaagagcgccagtgacatcatcagcattgagagctgcaaggagtacctgctgggcgtggtgaaggtgcccaccaaggagctgctgatcaagaggagcggcatcaccggctggtaccccatcatcctgcctgaagatggcggcctgccccacggcctggagctgatgcagaagatcgtgggcggcctggagctgagcatctccttcacccacagaggagaccgggagcgggtgctggaggccgctgagcacctgggctggagctttgagaacagcctgaaggactttgtgaggatggatgaaggagagcccgccaccgtgaccatcagcaccccccggctgtggctgcccatccactgtgtgctgctggccggccacaaccacatccacaagaacacctactgctacctgcgctacaagttctatgaccacgaggccttctggacccccctgaagaagcccaaggagagcgtgaacaagaagcagatcatggtgaccttcaaggccagcaagagagctgaggtgacccggggccccagcctgctgtggtacttccgggaggagcggctggagatccaggtgtggagggcctatggaaatgacagcgtggagcggccccaccagacagacagctggattggcagcgcctacgtggacctggcccggctgggggagaggtctgcccggaccctgactgtgtctggagtgtaccccctgtttggaagaaatgccagcaacctgagcggggccgccctgcgggtgcacgtggtgctgagcagcctgagcagccacctggagcccacccatgagctggacagcatggactgcagcagccacagcgagagcgagcagctgcccaggagaaatgatgaggtgcagctgagccccccagaggtgatcagctgccaccagaagagccctgccagcacccaggtgccctgcagcagcaccacagctgaggtgcggctgacccaggagggccctgctgacctggatggcacctttgctgtgtccatcctggtggagcgggccatgcacctgagcctgaagggcagccccctgacagagaggaaggtgtccatccccagctgctgcgtgtcctttgccacagcagatgagagcagccctgtgtacacccaggtggtggagaacacagacagccccatctggaacttccagcagcagagccggctgagcaaggagctgctgctggacccccagcagaccctggtgttcaaggtgtggcacaagggagatgaggagagggtcatcggctttgcctctgtggacctgagccccctgctgagcggcttccagtttgtgtgtggctggtacaacatcacagacttctctggagagtgccagggccagatcaaggtggccgtgagccccctggagagcctcatccacttcaaggaggagcggcaggcccggcggggcgtggagaccagcaagagcctcatccccatctacagccccttctccttccctgccagtgacacctatgctgccttcagcagccacatggcccggcagaccctggaccagctggcccacgccagcagcaaggagctggacttcagcagccctggccgcagtgacaccaccaggagccaggccagcagacatgaggagcacgtgcagaacatccgccgcttccacgagagcctgcacctgcagggcgaggcccccctgccctgtgatgacaagctgaccaccagccccctgagcagccagaccagcatcctgaccagcctgaggaagaacctgtctgagctggaccagatccagcgctacttccggcagaagctgaccaagcccttcctgcccctgagcccccagacccagacagccatcagccagcaccaggagagctgccgggaccacctgggccctggggccagcagcctggaccccggcagccagtgcatcctggagaagagcagcaacctggtgctgcaggtgagcagcctcatcacagacctgcagaccatcacccgggacagccaggccgccctgagcagccaccgggcccggagccgcagcaacaaggccaccaccctgcctgatgcccaggacacagaggccctgcaggagcgctgcaccatgccagatgagcccctggtgcgggccccagacaagggcacagacagccccagccccccacccctggaggagaccagcaatggaggccgcatgctgcacgagagcctgcggcatgctgtgcccatcaccaggatgcagagcagcgaggacacagaagctggccctgcctacagtgatgaggactatgaggaggacatcatcgagcccaggaccctgaatgagatcaccaccgtgacagacaagaccagcccctggagcagcgtcatcagtgacaccagcgaggtgatcagcccccagccagatgaggtgcagcgggagggccccagctgccccagccctggccccttctgccgggaggagctgatggtgaagagcagcttcctgagcagccctgagagagctgtgaacccccacctgccccggcagggcagccccagccagagcctggtggcctgtgaatgtgaggccagcaaggcccgggtgggcggggagagcgccagcgccaacccccagcccatcccctgccccaccctgagcggggcccagcagagcagcacctttgtgggctggagcagcccccagacagaccagaacaaggagcccaagtctgaggccccagcagaaaatgaagctgccaccagcgagctgggggacagcgctgacagcttcaagaagctgcccctgaacctggccagccagagcagaagagagaaccacaagggcccccccatcgacagcagtgacatccggcagaggcaggtgaccaccggcagcgagaccagcaccaagcagagcctgctgctgcccggccccatcgtggtgcccaacttcttcctgcccccccagcagctggaggccagcctgaggatgctgagcctgagcgccaccctgcccccagctgccaccacagaccaggacaagtctgaggccaccaggggggccctgagccagaggccctgccggccccggcccaacagcctgcccctgaacctgcctgaggaggagaccctgagaattgcccgcatcttcagcagccagtacagccagaaggactag

SEQ ID NO: 19145 - DNA, 219 bp, Artificial Sequence
  Description of Artificial Sequence: Synthetic coding sequence
atgaactactacggcaactactacggcggcctgggctacggctatggaggctttgatgacctgggctacggctacggctgcggctgcggcagcttccggcggctgggctatggaggcggctatggaggctacggctacggcagcggctttggaggctacggctaccgcagctgccggcccagctgctatggaggctacggcttcagcggcttctactag

SEQ ID NO: 19146 - DNA, 198 bp, Artificial Sequence
  Description of Artificial Sequence: Synthetic coding sequence
atgagctacaactgctgctgcggcaacttcagcagccacagctgtgagggctacctgtgctacagcggctacagcagaggaggcagcagctaccccagcaacctggtgtacagcacagagcccctcatcagccagcacctgcctgctggcttcctgagcctgcagggcctgagcggggacctgctgggcaacccctag

SEQ ID NO: 19147 - DNA, 384 bp, Artificial Sequence
  Description of Artificial Sequence: Synthetic coding sequence
atggtgaacagctgctgcggctctgtgtgcagcgaccagggctgtgaccagggcctgtgccaggagacctgctgccggcccagctgctgccagaccacctgctgctgccccagctgtgtggtgagcagctgctgccggcccagctgcagccagaccacctgctgccagaccacctgctgccggcccagctgctgccaccctgtgtgctgccagaccacctgccggcccagctgtggggtgagcagctgctgccggcccctgtgctgccagaccacctgccggcccagctgtggggtgagcagctgctgccggcccctgtgctgccagaccacctgctgccgggccacctgctgccggcccagctgctgcggcagcagctgctag

SEQ ID NO: 19148 - DNA, 318 bp, Artificial Sequence
  Description of Artificial Sequence: Synthetic coding sequence
atgggctgctgccctggggactgcttcacctgctgcacccaggagcagaactgctgtgaggagtgctgctgccagcccggctgctgcggctgctgcggcagctgctgcggctgcggcggcagcggctgcggcggcagcggctgcggcggcagctgctgcggcagcagctgctgcggcagcggctgcggcggctgcggcggctgcggcggctgcggcggcggctgctgcggcagcagctgctgcggcagcagctgctgcggcagcggctgctgcggccctgtgtgctgccagcccacccccatctgtgacaccaagtag

SEQ ID NO: 19149 - DNA, 3915 bp, Artificial Sequence
  Description of Artificial Sequence: Synthetic coding sequence
atggaggagatccctgtgaaggtggccgtgcgcatccggcccctgctgtgcaaggaggccctgcacaaccaccaggtgtgtgtgcgggtcatccccaacagccagcaggtgatcatcggccgggacagagtcttcacctttgattttgtgtttgggaagaacagcacccaggatgaggtgtacaacacctgcatcaagcccctggtgctgagcctgattgagggctacaatgccaccgtgtttgcctacggccagacaggcagcggcaagacctacaccatcggcggcggccacatcgcctctgtggtggagggccagaagggcatcatcccccgggccatccaggagatcttccagagcatcagcgagcaccccagcattgacttcaacgtgaaggtgtcctacatcgaggtgtacaaggaggacctgcgggacctgctggagctggagacctccatgaaggacctgcacatccgggaggatgagaagggcaacacagtcatcgtgggcgccaaggaatgtcatgtggagagcgctggggaggtgatgagcctgctggagatgggaaatgctgcccggcacacaggcaccacccagatgaatgagcacagcagccgcagccacgccatcttcaccatcagcatctgccaggtgcacaagaacatggaggccgcagaagatggctcctggtacagccccaggcacatcgtgtccaagttccactttgtggacctggccggcagcgagcgggtgaccaagacaggcaacacaggagagcgcttcaaggagagcatccagatcaacagcggcctgctggccctgggcaatgtcatcagcgccctgggggaccccaggaggaagagcagccacatcccctacagagatgccaagatcacccggctgctgaaggacagcctgggcggcagcgccaagacagtgatgatcacctgtgtgagccccagcagcagcaactttgatgagagcctgaacagcctgaagtatgccaacagagccaggaacatccggaacaagcccaccgtgaacttcagccctgagagtgacagaattgatgagatggagtttgagatcaagctgctgcgggaggccctgcagagccagcaggccggcgtgtcccagaccacccagatcaaccgggagggcagcccagacaccaaccgcatccacagcctggaggagcaggtggcccagctgcagggagaatgtctgggctaccagtgctgcgtggaggaggccttcaccttcctggtggacctgaaggacacagtgcggctgaatgagaagcagcagcacaagctgcaggagtggttcaacatgatccaggaggtgaggaaggctgtgctgaccagcttccggggcatcggcggcacagccagcctggaggagggcccccagcacgtgacagtgctgcagctgaagcgggagctgaagaagtgccagtgtgtgctggccgcagatgaggtggtgttcaaccagaaggagctggaggtgaaggagctgaagaaccaggtgcagatgatggtgcaggagaacaagggccatgctgtgtccctgaaggaggcccagaaggtgaaccggctgcagaatgagaagatcatcgagcagcagctgctggtggaccagctgtctgaggagctgaccaagctgaacctgtctgtgaccagcagcgccaaggagaactgtggagatggcccagatgcccgcatccctgagcggcggccctacacagtgccctttgacacccacctgggccactacatctacatccccagccggcaggacagcaggaaggtgcacaccagcccccccatgtacagcctggaccgcatctttgctggcttccgcaccaggagccagatgctgctgggccacatcgaggagcaggacaaggtgctgcactgccagttcagtgacaacagtgatgatgaggagagcgagggccaggagaagagcggcacccgctgccgcagccgctcctggatccagaagccagacagcgtgtgcagcctggtggagctgagtgacacccaggatgagacccagaagagtgacctggagaatgaagacctgaagattgactgcctgcaggagagccaggagctgaacctgcagaagctgaagaacagcgagcgcatcctgacagaggccaagcagaagatgagggagctgaccatcaacatcaagatgaaggaggacctgatcaaggagctgatcaagacaggaaatgatgccaagtctgtgtccaagcagtacagcctgaaggtgaccaagctggagcatgatgctgagcaggccaaggtggagctgattgagacccagaagcagctgcaggagctggagaacaaggacctgagtgatgtggccatgaaggtgaagctgcagaaggagttcaggaagaagatggatgctgccaagctgcgggtgcaggtgctgcagaagaagcagcaggacagcaagaagctggccagcctgagcatccagaatgagaagagggccaatgagctggagcagagcgtggaccacatgaagtaccagaagatccagctgcagaggaagctgcgggaggagaatgagaagaggaagcagctggatgctgtgatcaagagggaccagcagaagatcaaggccctgaacacagacagcctgaagatcagcacccggctgaacctgctggagcaggagctgtctgagaagaatgtgcagctgcagaccagcacagctgaggagaagaccaagatcagcgagcaggtggaggtgctgcagaaggagaaggaccagctgcagaagaggaggcacaacgtggatgagaagctgaagaatggccgggtgctgagccctgaggaggagcacgtgctcttccagctggaggagggcatcgaggccctggaggccgccatcgagtacagaaatgaaagcatccagaaccggcagaagagcctgcgggccagcttccacaacctgagcagaggagaggccaacgtgctggagaagctggcctgcctgagccctgtggagatccgcaccatcctcttccgctacttcaacaaggtggtgaacctgcgggaggccgagaggaagcagcagctgtacaatgaggagatgaagatgaaggtgctggagcgggacaacatggtgcgggagctggagagcgccctggaccacctgaagctgcagtgtgaccggcggctgaccctgcagcagaaggagcacgagcagaagatgcagctgctgctgcaccacttcaaggagcaggatggagagggcatcatggagaccttcaagacctatgaggacaagatccagcagctggagaaggacctgtacttctacaagaagaccagccgggaccacaagaagaagctgaaggagctggtgggggaggccatccggcggcagctggcccccagcgagtaccaggaggccggagatggagtgctgaagccagagggcggcggcatgctgtctgaggagctgaagtgggccagcaggcctgagagcatgaagctgagcggccgggagcgggagatggacagcagcgccagcagcctgcggacccagcccaacccccagaagctgtgggaggacatccctgagctgccccccatccacagcagcctggccccacccagcggccacatgctgggcaatgaaaacaagacagaaacagatgacaaccagttcaccaagagccacagccggctgagcagccagatccaggtggtgggcaatgtgggccgcctgcacggcgtgacccctgtgaagctgtgcaggaaggagctgcggcagatcagcgccctggagctgagcctgcggcgcagcagcctgggcgtgggcatcggctccatggctgctgacagcattgaggtgtccaggaagccccgggacctgaagacctag

SEQ ID NO: 19150 - DNA, 903 bp, Artificial Sequence
  Description of Artificial Sequence: Synthetic coding sequence
atggaggaggaggccagcagccctggcctgggctgcagcaagccccacctggagaagctgaccctgggcatcacccgcatcctggagagcagccctggggtgacagaggtgaccatcatcgagaagcccccagctgagcggcacatgatcagctcctgggagcagaagaacaactgtgtgatgccagaagatgtgaagaacttctacctgatgaccaacggcttccacatgacctggagcgtgaagctggatgagcacatcatccccctgggctccatggccatcaacagcatcagcaagctgacccagctgacccagagctccatgtacagcctgcccaatgcccccaccctggccgacctggaggatgacacccatgaggccagtgatgaccagcctgagaagccccactttgacagccgcagcgtcatctttgagctggacagctgcaatggaagtggcaaggtgtgcctggtgtacaagagcggcaagccagccctggccgaggacacagagatctggttcctggaccgggccctgtactggcacttcctgacagacaccttcaccgcctactaccgcctgctgatcacccacctgggcctgccccagtggcagtatgccttcaccagctatggcatcagcccccaggccaagcagtggttctccatgtacaagcccatcacctacaacaccaacctgctgacagaggagacagacagctttgtgaacaagctggaccccagcaaggtgttcaagagcaagaacaagatcgtcatccccaagaagaagggccctgtgcagcctgctgggggccagaagggccccagcggccccagcggccccagcaccagcagcaccagcaagagcagcagcggcagcggcaaccccaccaggaagtag

SEQ ID NO: 19151 - DNA, 390 bp, Artificial Sequence
  Description of Artificial Sequence: Synthetic coding sequence
atgatgacagacctgaagcagagccacagcgtgcggctgaatgatggccccttcatgcctgtgctgggcttcggcacctacgccccagaccacacccccaagagccaggccgctgaggccaccaaggtggccattgatgtgggcttccgccacatcgacagcgcctacctgtaccagaatgaggaggaggtgggccaggccatctgggagaagattgctgatggcaccgtgaagcgggaggagatcttctacaccatcaagctgtgggccaccttcttccgggcagagctggtgcacccagccctggagaggagcctgaagaagctgggccctgactatgtggacctcttcatcatccacgtgccctttgccatgaagggcagcagctag

SEQ ID NO: 19152 - DNA, 1257 bp, Artificial Sequence
  Description of Artificial Sequence: Synthetic coding sequence
atgcaccctgagcccagcgagcccgccaccggcggcgctgctgagctggactgtgcccaggagcccggggtggaggagagcgctggggaccacggcagcgctggccggggcggctgcaaggaggagatcaatgaccccaaggagatctgtgtgggcagcagtgacaccagctaccacagccagcagaagcagagcggggacaatggcagcggcggccactttgcccaccccagagaagatcgggaggaccggggccccaggatgaccaagagcagcctgcagaagctgtgcaagcagcacaagctgtacatcaccccagccctgaatgacaccctgtacctgcacttcaagggctttgacagaattgagaacctggaggagtacacaggcctgcgctgcctgtggctgcagagcaatggcatccagaagattgagaacctggaggcccagacagagctgcgctgcctcttcctgcagatgaacctgctgaggaagattgagaacctggagcccctgcagaagctggatgccctgaacctgagcaacaactacatcaagaccatcgagaacctgagctgcctgcctgtgctgaacaccctgcagatggcccacaaccacctggagaccgtggaggacatccagcacctgcaggagtgcctgcggctgtgtgtgctggacctgagccacaacaagctgagtgaccctgagatcctgagcatcctggagagcatgccagacctgcgggtgctgaacctgatgggcaaccctgtgatccggcagatccccaactacagaagaacagtgacagtgcggctgaagcacctgacctacctggatgacaggcctgtgttccccaaggaccgggcctgtgccgaggcctgggcccggggcggctacgccgctgagaaggaggagcggcagcagtgggagagccgggagaggaagaagatcacagacagcattgaggccctggccatgatcaagcagagagctgaggagaggaagaggcagcgggagagccaggagcggggggagatgaccagcagtgatgatggagaaaatgtgcctgccagcgctgagggcaaggaggagcccccaggggaccgggagacccggcagaagatggagctgtttgtgaaggagagctttgaggccaaggatgagctgtgcccagagaagcccagcggggaggagccccctgtggaggccaagcgggaggatggagaccctgccaccgtgacagcctgtgagggctag

SEQ ID NO: 19153 - DNA, 2472 bp, Artificial Sequence
  Description of Artificial Sequence: Synthetic coding sequence
atgggcaagaagaggaccaagggcaagacagtgcccattgatgacagcagcgagaccctggagcctgtgtgccgccacatcaggaagggcctggagcagggcaacctgaagaaggccctggtgaatgtggagtggaacatctgccaggactgcaagacagacaacaaggtgaaggacaaggccgaggaggagacagaggagaagcccagcgtgtggctgtgcctgaagtgtggccaccagggctgcggcaggaacagccaggagcagcacgccctgaagcactacctgacccccaggtctgagccccactgcctggtgctgagcctggacaactggagcgtgtggtgctacgtgtgtgacaatgaggtgcagtactgcagcagcaaccagctgggccaggtggtggactatgtgaggaagcaggccagcatcaccacccccaagccagctgagaaggacaatggaaatattgagctggagaacaagaagctggagaaggagagcaagaatgagcaggagcgggagaagaaggagaacatggccaaggaaaatccacccatgaacagcccctgccagatcaccgtgaagggcctgagcaacctgggcaacacctgcttcttcaatgctgtgatgcagaacctgagccagacccctgtgctgcgggagctgctgaaggaggtgaagatgagcggcaccatcgtgaagattgagcccccagacctggccctgacagagcccctggagatcaacctggagcccccaggccccctgaccctggccatgagccagttcctgaatgagatgcaggagaccaagaagggcgtggtgacccccaaggagctgttcagccaggtgtgcaagaaggctgtgcgcttcaagggctaccagcagcaggacagccaggagctgctgcgctacctgctggatggcatgagagctgaggagcaccagagggtgtccaagggcatcctgaaggcctttggaaacagcacagagaagctggatgaggagctgaagaacaaggtgaaggactatgagaagaagaagtccatgcccagctttgtggaccgcatctttggaggagagctgacctccatgatcatgtgtgaccagtgcaggacagtgtccctggtgcatgagagcttcctggacctgagcctgcctgtgctggatgaccagagcggcaagaagtctgtgaatgacaagaacctgaagaagacagtggaggatgaggaccaggacagcgaggaggagaaggacaatgacagctacatcaaggagaggagtgacatccccagcggcaccagcaagcacctgcagaagaaggccaagaagcaggccaagaagcaggccaagaaccagaggcggcagcagaagatccagggcaaggtgctgcacctgaatgacatctgcaccatcgaccacccagaagattctgaatatgaagctgagatgagcctgcagggcgaggtgaacatcaagagcaaccacatcagccaggagggcgtgatgcacaaggagtactgtgtgaaccagaaggacctgaatggccaggccaagatgattgagagcgtgacagacaaccagaagagcacagaggaggtggacatgaagaacatcaacatggacaatgacctggaggtgctgaccagcagccccaccaggaacctgaatggagcctacctgacagagggcagcaatggagaggtggacatcagcaatggcttcaagaacctgaacctgaatgctgccctgcacccagatgagatcaacatcgagatcctgaatgacagccacaccccaggcaccaaggtgtatgaggtggtgaatgaagatcctgagacagccttctgcaccctggccaaccgggaggtgttcaacacagatgagtgcagcatccagcactgcctgtaccagttcaccagaaatgagaagctgagagatgccaacaagctgctgtgtgaggtgtgcacccggcggcagtgcaatggccccaaggccaacatcaagggggagaggaagcacgtgtacaccaatgccaagaagcagatgctgatcagcctggcccctcctgtgctgaccctgcacctgaagcgcttccagcaggccggcttcaacctgaggaaggtgaacaagcacatcaagtttcctgagatcctggacctggcccccttctgcaccctgaagtgcaagaatgtggccgaggagaacaccagggtgctgtacagcctgtatggagtggtggagcacagcggcaccatgaggagcggccactacacagcctatgccaaggccaggacagccaacagccacctgagcaacctggtgctgcacggggacatcccccaggactttgagatggagagcaagggccagtggttccacatcagtgacacccacgtgcaggccgtgcccaccaccaaggtgctgaacagccaggcctacctgctcttctatgagcgcatcctgtag

SEQ ID NO: 19154 - DNA, 3204 bp, Artificial Sequence
  Description of Artificial Sequence: Synthetic coding sequence
atgaacagcatggacagacacatccagcagaccaatgaccggctgcagtgcatcaagcagcacctgcagaacccagccaacttccacaatgctgccacagagctgctggactggtgtggggacccccgggccttccagaggccctttgagcagagcctgatgggctgcctgactgtggtgtcccgggtggccgcccagcagggctttgacctggacctgggctaccgcctgctggccgtgtgtgccgccaacagagacaagttcacccccaagtctgctgccctgctgagctcctggtgtgaggagctgggccgcctgctgctgctgcggcaccagaagagccggcagagcgaccccccaggcaagctgcccatgcagccccccctgagctccatgagctccatgaagcccaccctgagccacagtgatggcagcttcccctatgacagcgtgccctggcagcagaacaccaaccagcccccaggcagcctgtctgtggtgaccaccgtgtggggcgtgaccaacaccagccagagccaggtgctgggcaaccccatggccaatgccaacaaccccatgaaccctgggggcaaccccatggccagcggcatgaccaccagcaaccctggcctgaacagcccccagtttgctggccagcagcagcagttcagcgccaaggccggccctgcccagccctacatccagcagagcatgtatggccggcccaactacccaggcagcggcggctttggagccagctacccaggcggccccaatgccccagctggcatgggcatccccccccacacccggcccccagctgacttcacccagcctgctgctgctgctgctgctgctgctgtggccgctgctgctgccacagccacagccacagccacagccaccgtggccgccctgcaggagacccagaacaaggacatcaaccagtatggccccatgggccccacccaggcctacaacagccagttcatgaaccagcccggcccccggggccctgcctccatgggcggctccatgaacccagcctccatggctgctggcatgacccccagcggcatgagcggcccccccatgggcatgaaccagccccggcccccaggcatcagccccttcggcacccacggccagaggatgccccagcagacctacccaggcccccggccccagagcctgcccatccagaacatcaagaggccctacccaggagagcccaactacggcaaccagcagtatggccccaacagccagttccccacccagcccggccagtacccagcccccaaccccccccggcccctgaccagccccaactacccaggccagaggatgcccagccagcccagcagcggccagtaccccccacccaccgtgaacatgggccagtactacaagccagagcagttcaacggccagaacaacaccttcagcggcagcagctacagcaactacagccagggcaatgtgaaccggccccccaggcctgtgcctgtggccaactacccccacagccctgtgcccggcaaccccaccccacccatgaccccaggcagcagcatccccccctacctgagccccagccaggatgtgaagccacccttccccccagacatcaagcccaacatgtctgccctgcccccacctccagccaaccacaatgatgagctgcggctgaccttccctgtgagagatggagtggtgctggagcccttccggctggagcacaacctggccgtgagcaaccacgtgttccacctgcggcccaccgtgcaccagaccctgatgtggaggagtgacctggagctgcagttcaagtgctaccaccacgaggaccggcagatgaacaccaactggccagcctctgtgcaggtgtctgtgaatgccacccccctgaccatcgagcggggggacaacaagaccagccacaagcccctgcacctgaagcacgtgtgccagcctggaagaaacaccatccagatcaccgtgacagcctgctgctgcagccacctgtttgtgctgcagctggtgcaccggcccagcgtgcgctctgtgctgcagggcctgctgaagaagaggctgctgcctgctgagcactgcatcaccaagatcaagaggaacttcagctctgtggccgccagcagcggcaacaccaccctgaatggagaagatggagtggagcagacagccatcaaggtgtccctgaagtgccccatcaccttccgccgcatccagctgcctgcccggggccatgactgcaagcacgtgcagtgctttgacctggagagctacctgcagctgaactgtgagcggggcacctggcgctgccctgtgtgcaacaagacagccctgctggagggcctggaggtggaccagtacatgtggggcatcctgaatgccatccagcacagcgagtttgaggaggtgaccatcgaccccacctgctcctggaggcctgtgcccatcaagagtgacctgcacatcaaggatgatcctgatggcatccccagcaagcgcttcaagaccatgagccccagccagatgatcatgcccaacgtgatggagatgattgctgccctgggccctggccccagcccctaccccctgcccccacctcctgggggcaccaacagcaatgactacagcagccagggcaacaactaccagggccacggcaactttgacttcccccacggcaaccctgggggcacctccatgaatgacttcatgcacggccccccccagctgagccaccccccagacatgcccaacaacatggccgccctggagaagcccctgagccaccccatgcaggagaccatgcctcatgctggcagcagtgaccagccccaccccagcatccagcagggcctgcacgtgccccaccccagcagccagagcggcccccccctgcaccacagcggggcccctcctcctccacccagccagcccccccggcagcccccccaggccgcccccagcagccacccccacagcgacctgaccttcaaccccagcagcgccctggagggccaggccggggcccagggcgccagtgacatgcctgagcccagcctggacctgctgcctgagctgaccaacccagatgagctgctgagctacctggaccccccagacctgcccagcaacagcaatgatgacctgctgagcctgtttgagaacaactag

SEQ ID NO: 19155 - DNA, 1038 bp, Artificial Sequence
  Description of Artificial Sequence: Synthetic coding sequence
atggatggagaggacatcccagacttcagcagcctgaaggaggagacagcctactggaaggagctgagcctgaagtacaagcagagcttccaggaggccagagatgagctggtggagttccaggagggcagccgggagctggaggccgagctggaggcccagctggtgcaggccgagcagaggaacagagacctgcaggccgacaaccagaggctgaagtatgaggtggaggccctgaaggagaagctggagcaccagtatgcccagagctacaagcaggtgtctgtgctggaggatgacctgagccagacccgggccatcaaggagcagctgcacaagtatgtgcgggagctggagcaggccaatgatgacctggagcgggccaagagggccaccatcgtgtccctggaggactttgagcagaggctgaaccaggccattgaaagaaatgccttcctggagagcgagctggatgagaaggagagcctgctggtgtctgtgcagaggctgaaggatgaggcccgggacctgcggcaggagctggccgtgcgggagcggcagcaggaggtgaccaggaagagcgcccccagcagccccaccctggactgtgagaagatggacagcgctgtgcaggccagcctgagcctgcctgccacccctgtgggcaaaggaacagagaacaccttccccagccccaaggccatccccaatggatttggcaccagccccctgaccccatctgcccgcatcagcgccctgaacatcgtgggggacctgctgaggaaggtgggcgccctggagagcaagctggccgcctgcaggaactttgccaaggaccaggccagcaggaagagctacatctctggaaatgtgaactgtggggtgctgaatggaaatggcaccaagttcagccgcagcggccacaccagcttctttgacaagggagctgtgaatggatttgatcctgcccctcctcctcctggcctgggcagcagccggcccagcagcgcccctggcatgctgcccctgtctgtgtag

SEQ ID NO: 19156 - DNA, 588 bp, Artificial Sequence
  Description of Artificial Sequence: Synthetic coding sequence
atgggcagccgggccagcaccctgctgagagatgaggagctggaggagatcaagaaggagaccggcttcagccacagccagatcacccggctgtacagccgcttcaccagcctggacaagggggagaatggcaccctgagccgggaggacttccagagaattcctgagctggccatcaaccccctgggggaccgcatcatcaatgccttcttcccagaaggagaggaccaggtgaacttccggggcttcatgaggaccctggcccacttccggcccatcgaggacaatgagaagagcaaggatgtgaatggacctgagcccctgaacagccgcagcaacaagctgcactttgccttccggctgtatgacctggacaaggatgagaagatcagcagagatgagctgctgcaggtgctgaggatgatggtgggcgtgaacatcagtgatgagcagctgggcagcattgctgacaggaccatccaggaggccgaccaggatggagacagcgccatctccttcacagaatttgtgaaggtgctggagaaggtggatgtggagcagaagatgagcatccgcttcctgcactag

SEQ ID NO: 19157 - DNA, 780 bp, Artificial Sequence
  Description of Artificial Sequence: Synthetic coding sequence
atggctgatgcctgctgcaccaggacctacgtgattgctgccagcaccatgtctgtgtgcagcagtgatgtgggccacgtgtcccgggtgagcagccccagcacctgcaccggcagctcctggcaggtggacaactgccaggagagctgctgtgagcccaggagctgtgccagcagctgctgcacccccagctgctgtgccccagccccctgcctggccctggtgtgtgcccctgtgtcctgtgagcccagcccctgccagagcggctgcacagacagctgcacccccagctgctgccagcagagcagctgccagcctgcctgctgcaccagcagcccctgccagcaggcctgctgcgtgcctgtgtgctgcaagagcaactgctgcaagcctgtgtgctgcgtgtccatctgcagcggggccagcagcccctgctgccagcagagcagctgccagagcgcctgctgcaccttcagcccctgccagcaggcctgctgcgtgcccatctgctgcaagcccatctgctgcgtgcctgtgtgcagcggggccagcagcctgtgctgccagaagagcagctgccagcctgcctgctgcaccaccagctgctgccggcccagcagctctgtgtccctgctgtgcaggcctgtgtgcaggcctgcctgctgcgtgcctgtgcccagctgctgcgtgcctgccagcagctgccagcccagctgctgccacccagccagctgcctgtccttcctgtgcaggcctgcctgcagccggctggcctgctag

SEQ ID NO: 19158 - DNA, 171 bp, Artificial Sequence
  Description of Artificial Sequence: Synthetic coding sequence
atgatctactacagcaactactacggcggctacggctatggaggcctgggctgcggctacggctgcggctaccggggctacggctgcggctatggaggctacggcggctatggaaatggctactactgccccagctgctacggccgctactggagctatggcttctactag

SEQ ID NO: 19159 - DNA, 897 bp, Artificial Sequence
  Description of Artificial Sequence: Synthetic coding sequence
atggccgccagcaccatgtctgtgtgcagcagcgcctacagcgacagctggcaggtggatgactgcccagagagctgctgtgagcccccctgcagcgcccccagctgctgtgccccagcccccagcctgagcctggtgtgcacccctgtgtcctgtgtgagcagcccctgctgccaggccgcctgtgagcccagcgcctgccagagcggctgcaccagcagctgcacccccagctgctgccagcagagcagctgccagcctgcctgctgcaccagcagcccctgccagcaggcctgctgcgtgcctgtgtgctgcaagacagtgtgctgcaagcctgtgtgctgcgtgcctgtgtgctgcggggccgccagcagctgctgccggcagagcagctgccagcctgcctgctgtgccagcagcagctgccagcctgcctgctgcgtgcctgtgtgctgcaagcctgtgtgctgcgtgtccacctgcagcgaggacagcagcagctgctgccagcagagcagctgccagcctgcctgctgcaccagcagcagctaccagcaggcctgctgcgtgcctgtgtgctgcaagacagtgtactgcaagcccatctgctgcgtgcctgtgtgcagccgggccagcagcagccgctgccagcagcccagctgccagcctgcctgctgcaccaccagctgctgccggcccagcagctctgtgtccctgctgtgccaccctgtgtgccgcagcacctgctgcgtgcctgtgagcagctgctgtgcccccaccagcagctgccagagcagctgctgcaggcctgccagctgtgtgtccctgctgtgcaggcctgccagcagccggctggcctgctacagcctgtgcagcggcaagaagagcagctgctag

SEQ ID NO: 19160 - DNA, 567 bp, Artificial Sequence
  Description of Artificial Sequence: Synthetic coding sequence
atgacagcccccagctgtgccttccctgtgcagttccggcagcccagcgtgtctggcctgagccagatcaccaagagcctgtacatcagcaatggagtggccgccaacaacaagctgatgctgagcagcaaccagatcaccatggtgatcaacgtgtctgtggaggtggtgaacaccctgtatgaggacatccagtacatgcaggtgcctgtggccgacagccccaacagccggctgtgtgacttctttgaccccatcgctgaccacatccacagcgtggagatgaagcagggccgcaccctgctgcactgtgccgccggcgtgagccgctctgctgccctgtgcctggcctacctgatgaagtaccacgccatgagcctgctggatgcccacacctggaccaagagctgccggcccatcatccggcccaacagcggcttctgggagcagctgatccactatgagttccagctgtttgggaagaacacagtgcacatggtgagcagccctgtgggcatgatcccagacatctatgagaaggaggtgcggctgatgatccccctgtag

SEQ ID NO: 19161 - DNA, 147 bp, Artificial Sequence
  Description of Artificial Sequence: Synthetic coding sequence
atgagctttgacaacaactaccacggcggccagggctacgccaagggcggcctgggctgcagctatggctgcggcctgagcggctacggctacgcctgctactgcccctggtgctatgaaagatcctggttcagcggctgcttctag

SEQ ID NO: 19162 - DNA, 192 bp, Artificial Sequence
  Description of Artificial Sequence: Synthetic coding sequence
atgagctacagcggcagctactacggcggcctgggctacggctgcggcggctttggaggcctgggctacggctacagctgtggctgcggcagcttccggcggctgggctacggctgcggctatggaggctaccgctacagctgctgccaccccagctgctacggcggctactggagcagcggcttctactag

SEQ ID NO: 19163 - DNA, 189 bp, Artificial Sequence
  Description of Artificial Sequence: Synthetic coding sequence
atgtgtggcagctactacggcaactactacggggaccacggctacggctgctgcggctatgagggcctgggctacggctacggcagcctgcgctgtggctacagcagctgctgcggctacggccacggctacggcagccgcttcttctgtggctgcggctacggctgcggcagcggctactactactag

SEQ ID NO: 19164 - DNA, 4227 bp, Artificial Sequence
  Description of Artificial Sequence: Synthetic coding sequence
atgtggagcctgacagccagcgagggggagagcaccacagcccacttcttcctgggcgctggagatgagggcctgggcacccggggcatcggcatgaggcctgaggagagtgacagcgagctgctggaggatgaggaggatgaggtgcccccagagccccagatcatcgtgggcatctgtgccatgaccaagaagagcaagagcaagcccatgacccagatcctggagcggctgtgccgctttgactacctgactgtggtgatcctgggagaagatgtgatcctgaatgaacctgtggagaactggcccagctgccactgcctgatctccttccacagcaagggcttccccctggacaaggctgtggcctacagcaagctgaggaaccccttcctgatcaatgacctggccatgcagtactacatccaggacagaagagaggtgtaccgcatcctgcaggaggagggcatcgacctgcccaggtatgctgtgctgaacagagatcctgcccggcctgaggagtgcaacctgattgaaggagaggaccaggtggaggtgaatggagctgtgttccccaagccctttgtggagaagcctgtgtctgctgaggaccacaacgtgtacatctactaccccagcagcgctgggggcggcagccagaggctcttcaggaagattggcagccgcagctctgtgtacagccctgagagctctgtgaggaagacaggcagctacatctatgaggagttcatgcccacagatggaacagatgtgaaggtgtacacagtgggccctgactatgcccacgccgaggccaggaagagccctgccctggatggcaaggtggagcgggacagcgagggcaaggagatccgctaccctgtgatgctgacagccatggagaagctggtggccaggaaggtgtgtgtggccttcaagcagacagtgtgtggctttgacctgctgcgggccaacggccacagctttgtgtgtgatgtgaatggcttctcctttgtgaagaacagcatgaagtactatgatgactgtgccaagatcctgggcaacaccatcatgagggagctggccccccagttccagatcccctggagcatccccacagaagctgaggacatccccatcgtgcccaccaccagcggcaccatgatggagctgcgctgtgtgattgccatcatccgccacggggacaggacccccaagcagaagatgaagatggaggtgaagcacccccgcttctttgccctgtttgagaagcatggaggctacaagacaggcaagctgaagctgaagaggcctgagcagctgcaggaggtgctggacatcacccggctgctgctggccgagctggagaaggagcctggaggagaaattgaggagaagacaggcaagctggagcagctgaagtctgtgctggagatgtatggccacttcagcggcatcaacaggaaggtgcagctgacctactacccccatggagtgaaggccagcaatgaaggccaggacccccagcgggagaccctggcccccagcctgctgctggtgctgaagtggggcggggagctgaccccagctggccgggtgcaggccgaggagctgggccgggccttccgctgcatgtacccaggcggccagggcgactatgccggcttccctggctgcggcctgctgcggctgcacagcaccttcagacatgacctgaagatctatgccagtgatgagggccgggtgcagatgacagctgctgcctttgccaagggcctgctggccctggagggggagctgacccccatcctggtgcagatggtgaagagcgccaacatgaatggcctgctggacagtgatggagacagcctgagcagctgccagcaccgggtgaaggcccggctgcaccacatcctgcagcaggatgccccctttggacctgaggactatgaccagctggcccccaccaggagcaccagcctgctgaacagcatgaccatcatccagaaccctgtgaaggtgtgtgaccaggtgtttgccctgattgagaacctgacccaccagatccgggagaggatgcaggaccccaggtctgtggacctgcagctgtaccacagcgagaccctggagctgatgctgcagcgctggagcaagctggagcgggacttccggcagaagagcggccgctatgacatcagcaagatcccagacatctatgactgtgtgaagtatgatgtgcagcacaacggcagcctgggcctgcagggcacagctgagctgctgcggctgagcaaggccctggctgatgtggtgatcccccaggagtatggcatcagccgggaggagaagctggagattgctgtgggcttctgcctgcccctgctgaggaagatcctgctggacctgcagaggacccatgaagatgagagcgtgaacaagctgcaccccctgtacagcagaggagtgctgagccctggccgccacgtgaggacccggctgtacttcaccagcgagagccacgtgcacagcctgctgagcgtcttccgctatggaggcctgctggatgagacccaggatgcccagtggcagagggccctggactacctgagcgccatcagcgagctgaactacatgacccagatcgtcatcatgctgtatgaggacaacacccaggaccccctgtctgaggagcgcttccacgtggagctgcacttcagccctggggtgaagggcgtggaggaggagggcagcgccccagctggctgcggcttccggcctgccagcagtgaaaatgaggagatgaagaccaaccagggctccatggagaacctgtgccctgggaaggccagtgatgagccagaccgggccctgcagaccagcccccagcccccagagggccctggcctgcccaggaggagccccctcatccggaacaggaaggccggctccatggaggtgctgtctgagaccagcagcagcaggcctgggggctaccgcctcttcagcagcagccggcccccaacagagatgaagcagagcggcctgggcagccagtgcaccggcctcttcagcaccaccgtgctgggcggcagcagcagcgcccccaacctgcaggactatgcccggagccacggcaagaagctgcccccagccagcctgaagcacagagatggctttgagggctgcagcatggtgcccaccatctaccccctggagaccctgcacaatgccctgagcctgcggcaggtgtctgagttcctgagccgggtgtgccagaggcacacagatgcccaggcccaggccagcgctgccctgtttgacagcatgcacagcagccaggccagtgacaaccccttcagcccccccaggaccctgcacagcccccccctgcagctgcagcagaggtctgagaagccaccctggtacagcagcggccccagcagcacagtgagcagcgctggccccagcagccccaccaccgtggatggcaacagccagtttggcttcagtgaccagcccagcctgaacagccacgtggccgaggagcaccagggcctgggcctgctgcaggagaccccaggcagcggggcccaggagctgagcattgaaggagagcaggagctgtttgagcccaaccagagcccccaggtgccccccatggagaccagccagccctatgaggaggtgtcccagccctgccaggaggtgcctgacatcagccagccctgccaggacatcagcgaggccctgagccagccctgccagaaggtgcctgacatcagccagcagtgccaggagaaccacgacaatggaaaccacacctgccaggaggtgccccacatcagccagccctgccagaagagcagccagctgtgccagaaggtgtctgaggaggtgtgccagctgtgcctggagaacagcgaggaggtgtcccagccctgccagggcgtgtctgtggaggtgggcaagctggtgcacaagttccacgtgggcgtgggcagcctggtgcaggagaccctggtggaggtgggcagccctgctgaggagatccctgaggaggtgatccagccctaccaggagttctctgtggaggtgggccgcctggcccaggagaccagcgccatcaacctgctgagccagggcatccctgagattgacaagcccagccaggagttccctgaggagattgacctgcaggcccaggaggtgcctgaggagatcaactag

SEQ ID NO: 19165 - DNA, 705 bp, Artificial Sequence
  Description of Artificial Sequence: Synthetic coding sequence
atggagggcgccagcaggaacctggccagcaccccccgggtgcacgccaaggtgatgatgtacaggaaggagcagtacctggatgtgctgcacgccctgaaggtggtgcgctttgtgtctgatgccaccccccaggccgaggtgtacctgaggatgtaccagctggagagcggcaagctgcccaggagccccagcttccccctggagccagatgatgaggtgttcctggccatcgccaaggccatggaggagatggtggaggacagcgtggactgctactggatcaccaggagatttgtgaaccagctgaacaccaagtacagagacagcctgccccagctgcccaaggcctttgagcagtacctgaacctggaggatggccgcctgctgacccacctgaggatgtgcagcgctgcccccaagctgccctatgacctgtggttcaagcgctgctttgctggctgcctgcctgagagcagcctgcagagggtgtgggacaaggtggtgtctggcagctgcaagatcctggtgtttgtggccgtggagatcctgctgaccttcaagatcaaggtgatggccctgaacagcgctgagaagatcaccaagttcctggagaacatcccccaggacagcagtgatgccatcgtgtccaaggccatcgacctgtggcacaagcactgcggcacccctgtgcacagcagctag

SEQ ID NO: 19166 - DNA, 537 bp, Artificial Sequence
  Description of Artificial Sequence: Synthetic coding sequence
atgaccaccctgcgggccttcacctgtgatgacctcttccgcttcaacaacatcaacctggaccccctgacagagacctacggcatccccttctacctgcagtacctggcccactggccagagtacttcatcgtggccgaggcccctggaggagagctgatgggctacatcatgggcaaggccgagggctctgtggcccgggaggagtggcacggccacgtgacagccctgtctgtggcccctgagttccggcggctgggcctggccgccaagctgatggagctgctggaggagatcagcgagaggaaaggaggcttctttgtggacctgtttgtgcgggtgagcaaccaggtggccgtgaacatgtacaagcagctgggctacagcgtgtacagaacagtgattgagtactacagcgccagcaatggagagccagatgaagatgcctatgacatgaggaaggccctgagccgggacacagagaagaagagcatcatccccctgccccaccctgtgcggccagaagatattgaatag

SEQ ID NO: 19167 - DNA, 2373 bp, Artificial Sequence; identical to SEQ ID NO: 18522
  Description of Artificial Sequence: Synthetic coding sequence

SEQ ID NO: 19168 - DNA, 3588 bp, Artificial Sequence
  Description of Artificial Sequence: Synthetic coding sequence
atgtggagcctgacagccagcgagggggagagcaccacagcccacttcttcctgggcgctggagatgagggcctgggcacccggggcatcggcatgaggcctgaggagagtgacagcgagctgctggaggatgaggaggatgaggtgcccccagagccccagatcatcgtgggcatctgtgccatgaccaagaagagcaagagcaagcccatgacccagatcctggagcggctgtgccgctttgactacctgactgtggtgatcctgggagaagatgtgatcctgaatgaacctgtggagaactggcccagctgccactgcctgatctccttccacagcaagggcttccccctggacaaggctgtggcctacagcaagctgaggaaccccttcctgatcaatgacctggccatgcagtactacatccagggcgaccggcgggaggtgtaccgcatcctgcaggaggagggcatcgacctgcccaggtatgctgtgctgaacagagatcctgcccggcctgaggagtgcaacctgattgaaggagaggaccaggtggaggtgaatggagctgtgttccccaagccctttgtggagaagcctgtgtctgctgaggaccacaacgtgtacatctactaccccagcagcgctgggggcggcagccagaggctcttcaggaagattggcagccgcagctctgtgtacagccctgagagctctgtgaggaagacaggcagctacatctatgaggagttcatgcccacagatggaacagatgtgaaggtgtacacagtgggccctgactatgcccatgctgaggccaggaagagccctgccctggatggcaaggtggagcgggacagcgagggcaaggagatccgctaccctgtgatgctgacagccatggagaagctggtggccaggaaggtgtgtgtggccttcaagcagacagtgtgtggctttgacctgctgcgggccaacggccacagctttgtgtgtgatgtgaatggcttctcctttgtgaagaacagcatgaagtactatgatgactgtgccaagatcctgggcaacaccatcatgagggagctggccccccagttccagatcccctggagcatccccacagaagctgaggacatccccatcgtgcccaccaccagcggcaccatgatggagctgcgctgcgtcatcgccatcatcagacatggagacaggacccccaagcagaagatgaagatggaggtgaagcacccccgcttctttgccctgtttgagaagcacggcggctacaagacaggcaagctgaagctgaagaggcctgagcagctgcaggaggtgctggacatcacccggctgctgctggccgagctggagaaggagcccggcggggagattgaggagaagacaggcaagctggagcagctgaagtctgtgctggagatgtatggccacttcagcggcatcaacaggaaggtgcagctgacctactacccccacggcgtgaaggccagcaatgaaggccaggacccccagcgggagaccctggcccccagcctgctgctggtgctgaagtggggcggggagctgaccccagctggccgggtgcaggccgaggagctgggccgggccttccgctgcatgtacccaggcggccagggcgactatgccggcttccctggctgcggcctgctgcggctgcacagcaccttcagacatgacctgaagatctatgccagtgatgagggccgggtgcagatgacagctgctgcctttgccaagggcctgctggccctggagggggagctgacccccatcctggtgcagatggtgaagagcgccaacatgaatggcctgctggacagtgatggagacagcctgagcagctgccagcaccgggtgaaggcccggctgcaccacatcctgcagcaggatgcccccttcggcccagaagattatgaccagctggcccccaccaggagcaccagcctgctgaacagcatgaccatcatccagaaccctgtgaaggtgtgtgaccaggtgtttgccctgattgagaacctgacccaccagatccgggagaggatgcaggaccccaggtctgtggacctgcagctgtaccacagcgagaccctggagctgatgctgcagcgctggagcaagctggagcgggacttccggcagaagagcggccgctatgacatcagcaagatcccagacatctatgactgtgtgaagtatgatgtgcagcacaacggcagcctgggcctgcagggcacagctgagctgctgcggctgagcaaggccctggctgatgtggtgatcccccaggagtatggcatcagccgggaggagaagctggagattgctgtgggcttctgcctgcccctgctgaggaagatcctgctggacctgcagaggacccatgaagatgagtacagccggggcgtgctgagccctggaagacatgtgaggacccggctgtacttcaccagcgagagccacgtgcacagcctgctgtctgtgttccgctatggaggcctgctggatgagacccaggatgctgaccgggccctgcagaccagcccccagcccccagagggccctggcctgcccaggaggagccccctcatccggaacaggaaggccggctccatggaggtgctgtctgagaccagcagcagcaggcctgggggctaccgcctcttcagcagcagccggcccccaacagagatgaagcagagcggcctgggcagccagtgcaccggcctcttcagcaccaccgtgctgggcggcagcagcagcgcccccaacctgcaggactatgcccggagccacggcaagaagctgcccccagccagcctgaagcacagagatgagctgctgtttgtgcctgctgtgaagcgcttctctgtgtcctttgccaagcaccccaccaacggctttgagggctgcagcatggtgcccaccatctaccccctggagaccctgcacaatgccctgagcctgcggcaggtgccccccatggagaccagccagccctatgaggaggtgtcccagccctgccaggaggtgcctgacatcagccagccctgccaggacatcagcgaggccctgagccagccctgccagaaggtgcctgacatcagccagcagtgccaggagaaccacgacaatggaaaccacacctgccaggaggtgccccacatcagccagccctgccagaagagcagccagctgtgccagaaggtgtctgaggaggtgtgccagctgtgcctggagaacagcgaggaggtgtcccagccctgccagggcgtgtctgtggaggtgggcaagctggtgcacaagttccacgtgggcgtgggcagcctggtgcaggagaccctggtggaggtgggcagccctgctgaggagatccctgaggaggtgatccagccctaccaggagttctctgtggaggtgggccgcctggcccaggagaccagcgccatcaacctgctgagccagggcatccctgagattgacaagcccagccaggagttccctgaggagattgacctgcaggcccaggaggtgcctgaggagatcaactag

SEQ ID NO: 19169 - DNA, 240 bp, Artificial Sequence
  Description of Artificial Sequence: Synthetic coding sequence
atgtgctgcaactactacggcaacagctgtggctacggcagcggctgcggctgcggctacggcagcggcagcggctgcggctgcggctacggcaccggctacggctgcggctacggctgcggcttcggcagccactacggctgcggctacggcaccggctacggctgcggctacggcagcggcagcggctactgcggctaccggcccttctgcttccgccgctgctacagcagctgctag

SEQ ID NO: 19170 - DNA, 1767 bp, Artificial Sequence
  Description of Artificial Sequence: Synthetic coding sequence
atgaagctggagttcacagagaagaactacaacagctttgtgctgcagaacctgaaccggcagaggaagaggaaggagtactgggacatggccctgtctgtggacaaccacgtgttctttgcccacagaaatgtgctggccgctgtgagccccctggtgcgcagcctcatcagcagcaatgacatgaagacagcagatgagctgttcatcaccatcgacaccagctacctgagccctgtgacagtggaccagctgctggactacttctacagcggcaaggtggtgatcagcgagcagaatgtggaggagctgctgcggggggcccagtacttcaacaccccccggctgcgggtgcactgcaatgacttcctgatcaagagcatctgccgggccaactgcctgcgctacctgttcctggccgagctgtttgagctgaaggaggtgtctgatgtggcctacagcggcatccgggacaacttccactactgggccagccctgagggctccatgcacttcatgcgctgcccccctgtgatcttcggccgcctgctgagagatgagaacctgcacgtgctgaatgaagaccaggccctgagcgccctgatcaactgggtgtacttcaggaaggaggaccgggagaagtacttcaagaagttcttcaactacatcaacctgaatgctgtgagcaacaagaccctggtgtttgccagcaacaagctggtgggcatggagaacaccagcagccacaccaccctgattgaatctgtgctgatggacaggaagcaggagcggccctgcagcctgctggtgtaccagaggaagggggccctgctggacagcgtggtgatcctgggcggccagaaggcccacggccagttcaatgatggagtgtttgcctacatcatccaggagaacctgtggatgaagctgagtgacatgccctacagagctgctgccctgagcgccaccagcgctggccgctacatctacatcagcggcggcaccacagagcagatcagcggcctgaagacagcctggaggtatgacatggatgacaacagctggaccaagctgcctgacctgcccatcggcctggtgttccacaccatggtgacctgtggcggcaccgtgtacagcgtgggcggcagcatcgcccccaggagatatgtgagcaacatctaccgctatgatgagaggaaggaggtgtggtgcctggccggcaagatgagcatccccatggatggaacagctgtgatcaccaagggggacagacacctgtacatcgtgacaggccgctgcctggtgaagggctacatcagccgggtgggcgtggtggactgctttgacaccagcactggagatgtggtgcagtgcatcaccttccccatcgagttcaaccaccggcccctgctgtccttccagcaggacaacatcctgtgtgtgcacagccaccggcagagcgtggagatcaacctgcagaaggtgaaggccagcaagaccaccacctctgtgcctgtgctgcccaacagctgccccctggatgtgtcccatgccatctgcagcatcggggacagcaaggtgtttgtgtgtggcggcgtgaccacagccagtgatgtgcagaccaaggactacaccatcaaccccaatgccttcctgctggaccagaagacaggcaagtggaagaccctggcccctcctcctgaggccctggactgcccagcctgctgcctggccaagctgccctgcaagatcctgcagaggatctag

SEQ ID NO: 19171 - DNA, 2208 bp, Artificial Sequence
  Description of Artificial Sequence: Synthetic coding sequence
atgatccccccccaggaggccagcgccaggagaagagaaattgaggacaagctgaagcaggaggaggagaccctgtccttcatccgggacagcctggagaagagtgaccagctgaccaagaacatggtgtccatcctgagcagctttgagagccggctgatgaagctggagaacagcatcatccctgtgcacaagcagacagagaacctgcagaggctgcaggagaatgtggagaagaccctgagctgcctggaccacgtgatctcctactaccacgtggccagtgacacagagaagatcatccgggagggccccaccggccgcctggaggagtacctgggctccatggccaagatccagaaggctgtggagtacttccaggacaacagcccagacagccctgagctgaacaaggtgaagctgctgtttgagcggggcaaggaggccctggagagcgagttccgcagcctgatgaccaggcacagcaaggtggtgtcccctgtgctgatcctggacctgatctctggagatgatgacctggaggcccaggaggatgtgaccctggagcacctgcctgagagcgtgctgcaggacgtcatccgcatcagccgctggctggtggagtatggaagaaaccaggacttcatgaatgtgtactaccagatccgcagcagccagctggacaggagcatcaagggcctgaaggagcacttccacaagagcagcagcagcagtggagtgccctacagccctgccatccccaacaagaggaaggacacccccaccaagaagcctgtgaagaggcctggcaccatcaggaaggcccagaacctgctgaagcagtacagccagcacggcctggatggcaagaagggcggcagcaacctgatccccctggagggcctgctgccctgcaccccccggggcggcctgcccggcccctggatcaatgctgcctgtgtgtgtgccgctgacatcagccctggccacgagcatgacttccgggtgaagcacctgtctgaggccctgaatgacaagcacggccccctggccggcagagatgacatgctggatgtggagacagatgcctacatccactgtgtgtctgcctttgtgaagctggcccagagcgagtaccagctgctggccgacatcatccctgagcaccaccagaagaagacctttgacagcctcatccaggatgccctggatggcctgatgctggagggagaaaatattgtgtctgctgccaggaaggccatcgtgagacatgacttcagcacagtgctgactgtgttccccatcctgcggcacctgaagcagaccaagccagagtttgaccaggtgctgcagggcacagctgccagcaccaagaacaagctgcccggcctcatcacctccatggagaccatcggggccaaggccctggaggactttgctgacaacatcaagaatgaccctgacaaggagtacaacatgcccaaggatggcaccgtgcatgagctgaccagcaatgccatcctcttcctgcagcagctgctggacttccaggagacagctggggccatgctggccagccaggagaccagcagcagcgccaccagctacagcagcgagttcagcaagaggctgctgagcacctacatctgcaaggtgctgggcaacctgcagctgaacctgctgagcaagagcaaggtgtatgaggaccctgccctgagcgccatcttcctgcacaacaactacaactacatcctgaagagcctggagaagtctgagctgatccagctggtggccgtgacccagaagacagctgagaggagctaccgggagcacatcgagcagcagatccagacctaccagaggtcctggctgaaggtgacagactacatcgccgagaagaacctgcccgtcttccagcccggggtgaagctgcgggacaaggagcggcagatcatcaaggagcgcttcaagggcttcaatgatggcctggaggagctgtgcaagatccagaaggcctgggccatcccagacacagagcagagggaccgcatccggcaggcccagaagaccatcgtgaaggagacctacggggccttcctgcagaagtttggatctgtgcccttcaccaagaaccctgagaagtacatcaagtatggagtggagcaggtgggggacatgattgaccggctgtttgacaccagcgcctag

SEQ ID NO: 19172 - DNA, 378 bp, Artificial Sequence
  Description of Artificial Sequence: Synthetic coding sequence
atggccggggccggccccaccatgctgctgcgggaggagaatggctgctgcagccggcggcagagcagcagcagcgctggggacagtgatggagagcgggaggacagcgctgctgagcgggcccggcagcagctggaggccctgctgaacaagaccatgaggatccgcatgacagatggccgcaccctggtgggctgcttcctgtgcacagaccgggactgcaacgtcatcctgggcagcgcccaggagttcctgaagcccagcgacagcttctctgctggggagccccgggtgctgggcctggccatggtgcccggccaccacatcgtgtccattgaggtgcagcgggagagcctgaccggccccccctacctgtag

SEQ ID NO: 19173 - DNA, 477 bp, Artificial Sequence
  Description of Artificial Sequence: Synthetic coding sequence
atgctgctgctggactgcaaccctgaggtggatggcctgaagcacctgctggagactggagcctctgtgaatgcccccccagacccctgcaagcagagccctgtgcacctggccgccggcagcggcctggcctgcttcctgctgtggcagctgcagacaggagctgacctgaaccagcaggatgtgctgggggaggcccccctgcacaaggccgccaaggtgggcagcctggagtgcctgagcctgctggtggccagtgatgcccagattgacctgtgcaacaagaatggccagacagctgaggacctggcctggagctgtggcttcccagactgtgccaagttcctgaccaccatcaagtgcatgcagaccatcaaggccagcgagcacccagacagaaatgactgtgtggccgtgctgcggcagaagaggagcctgggctctgtggagaacaccagcggcaagaggaaatgttag

SEQ ID NO: 19174 - DNA, 8712 bp, Artificial Sequence
  Description of Artificial Sequence: Synthetic coding sequence
atgaggggccggcggggccggccccccaagcagcctgctgccccagctgctgagcgctgtgccccagcccctcctcctcctcctcctccacccaccagcggccccatcggcggcctgcggagccgccaccggggcagcagccggggccgctgggccgccgcccaggccgaggtggcccccaagacccggctgagcagcccccggggcggcagcagcagcaggaggaagcccccacctcctcctccagccccacccagcaccagcgcccctggccggggcggccggggcggcggcggcggccgcactggaggcggcggcggcggcggccacctggcccggaccacagctgcccggcgggctgtgaacaaggtggtgtatgatgaccatgaaagtgaggaggaggaggaggaggaggacatggtgtctgaggaggaggaggaggaggatggagatgctgaggagacccaggacagtgaagatgatgaagaagatgagatggaggaggatgatgatgacagcgactacccagaggagatggaggatgatgatgatgatgccagctactgcacagagagcagcttccgcagccacagcacctacagcagcaccccaggccgcaggaagccccgggtgcaccggcccaggagccccatcctggaggagaaggacatcccccccctggagttccccaagagcagcgaggacctgatggtgcccaatgagcacatcatgaatgtgattgccatctatgaggtgctgaggaactttggcaccgtgctgcggctgagccccttccgctttgaggacttctgtgccgccctggtgtcccaggagcagtgcaccctgatggccgagatgcacgtggtgctgctgaaggctgtgctgcgggaggaggacaccagcaacaccacctttggacctgctgacctgaaggacagcgtgaacagcaccctgtacttcattgatggcatgacctggccagaggtgctgcgggtgtactgtgagagtgacaaggagtaccaccacgtgctgccctaccaggaggccgaggactacccctacggccctgtggagaacaagatcaaggtgctgcagttcctggtggaccagttcctgaccaccaacatcgcccgggaggagctgatgtctgaaggagtcatccagtatgatgaccactgccgggtgtgccacaagctgggggacctgctgtgctgtgagacctgcagcgctgtgtaccacctggagtgtgtgaagccacccctggaggaggtgcctgaagatgagtggcagtgtgaggtgtgtgtggcccacaaggtgcctggggtgacagactgtgtggccgagatccagaagaacaagccctacatcagacatgagcccatcggctatgacaggagcaggaggaagtactggttcctgaacagaagactcatcatcgaggaggacacagaaaatgaaaatgagaagaagatctggtactacagcaccaaggtgcagctggccgagctgattgactgcctggacaaggactactgggaggccgagctgtgcaagatcctggaggagatgagggaggagatccaccgccacatggacatcacagaggacctgaccaacaaggcccggggcagcaacaagagcttcctggccgccgccaatgaggagatcctggagagcatccgggccaagaagggggacatcgacaacgtgaagagccctgaggagacagagaaggacaagaatgaaacagaaaatgacagcaaggatgctgagaagaaccgggaggagtttgaggaccagagcctggagaaggacagtgatgacaagaccccagatgatgatcctgagcagggcaagtctgaggagcccacagaggtgggggacaagggcaacagcgtgtctgccaacctgggggacaacaccaccaatgccaccagcgaggagaccagccccagcgagggccgcagccctgtgggctgcctgtctgagaccccagacagcagcaacatggccgagaagaaggtggccagcgagctgccccaggatgtgcctgaggagcccaacaagacctgtgagagcagcaacaccagcgccaccaccaccagcatccagcccaacctggagaacagcaacagcagcagcgagctgaacagcagccagagcgagagcgccaaggctgctgatgatcctgaaaatggagagcgggagagccacacccctgtgtccatccaggaggagatcgtgggggacttcaagtctgagaagagcaatggagagctgtctgagagccctggggccggcaagggggccagcggcagcacccgcatcatcacccggctgagaaatccagacagcaagctgagccagctgaagagccagcaggtggccgccgccgcccacgaggccaacaagctgttcaaggagggcaaggaggtgctggtggtgaacagccagggcgagatcagccggctgagcaccaagaaggaggtgatcatgaagggcaacatcaacaactacttcaagctgggccaggagggcaagtacagagtgtaccacaaccagtacagcaccaacagctttgccctgaacaagcaccagcacagagaagatcatgacaagaggaggcacctggcccacaagttctgcctgaccccagctggggagttcaagtggaatggatctgtgcacggcagcaaggtgctgaccatcagcaccctgcggctgaccatcacccagctggagaacaacatccccagcagcttcctgcaccccaactgggccagccaccgggccaactggatcaaggctgtgcagatgtgcagcaagccccgggagtttgccctggccctggccatcctggagtgtgctgtgaagcctgtggtgatgctgcccatctggagggagagcctgggccacacccggctgcacaggatgaccagcattgagcgggaggagaaggagaaggtgaagaagaaggagaagaagcaggaggaggaggagaccatgcagcaggccacctgggtgaagtacaccttccctgtgaagcaccaggtgtggaagcagaagggggaggagtacagagtgacaggctatggaggctggagctggatcagcaagacccacgtgtacagatttgtgcccaagctgcccggcaacaccaacgtgaactacaggaagagcctggagggcaccaagaacaacatggatgagaacatggatgaaagtgacaagaggaagtgcagccgcagccccaagaagatcaagattgaaccagattctgagaaggatgaggtgaagggcagtgatgctgccaagggagctgaccagaatgagatggacatcagcaagatcacagagaagaaggaccaggatgtgaaggagctgctggacagcgacagcgacaagccctgcaaggaggagcccatggaggtggatgatgacatgaagacagagagccacgtgaactgccaggagagcagccaggtggatgtggtgaatgtgtctgagggcttccacctgcggaccagctacaagaagaagaccaagagcagcaagctggatggcctgctggagcggcgcatcaagcagttcaccctggaggagaagcagaggctggagaagatcaagctggagggcggcatcaagggcatcggcaagaccagcaccaacagcagcaagaacctgtctgagagccctgtgatcaccaaggccaaggagggctgccagagcgacagcatgaggcaggagcagagccccaatgccaacaatgaccagcctgaggacctgatccagggctgcagcgagagtgacagctctgtgctgaggatgtctgaccccagccacaccaccaacaagctgtaccccaaggacagagtgctggatgatgtgtccatccgcagccctgagaccaagtgccccaagcagaacagcattgaaaatgacatcgaggagaaggtgtctgacctggccagccggggccaggagcccagcaagagcaagaccaagggaaatgacttcttcattgatgacagcaagctggccagcgcagatgacatcggcaccctcatctgcaagaacaagaagcccctcatccaggaggagagtgacaccatcgtgagcagcagcaagagcgccctgcacagctctgtgcccaagagcaccaatgacagagatgccacccccctgagccgggccatggactttgagggcaagctgggctgtgacagcgagagcaacagcaccctggagaacagcagtgacacagtgtccatccaggacagcagcgaggaggacatgattgtgcagaacagcaatgaaagcatcagcgagcagttccgcacccgggagcaggatgtggaggtgctggagcccctgaagtgtgagctggtgtctggagagagcacaggcaactgtgaggaccggctgcctgtgaagggcacagaggccaacgggaagaagcccagccagcagaagaagctggaggagaggcctgtgaacaagtgcagcgaccagatcaagctgaagaacaccacagacaagaagaacaatgaaaatcgggagagcgagaagaagggccagaggaccagcaccttccagatcaacgggaaggacaacaagcccaagatctacctgaagggagaatgtctgaaggagatcagcgagagccgggtggtgtctggaaatgtggagcccaaggtgaacaacatcaacaagatcatcccagaaaatgacatcaagagcctgactgtgaaggagagcgccatccggcccttcatcaatggagatgtgatcatggaggacttcaatgaaagaaacagcagcgagaccaagagccacctgctgagcagcagtgatgctgagggcaactacagagacagcctggagaccctgcccagcaccaaggagagtgacagcacccagaccaccaccccatctgccagctgcccagagagcaacagcgtgaaccaggtggaggacatggagattgagaccagcgaggtgaagaaggtgaccagcagccccatcaccagcgaggaggagagcaacctgagcaatgacttcattgatgaaaatggcctgcccatcaacaagaatgaaaatgtgaatggagagagcaagaggaagacagtcatcacagaggtgaccaccatgaccagcacagtggccacagagagcaagacagtcatcaaggtggagaagggggacaagcagacagtggtgagcagcacagagaactgtgccaagagcacagtgaccaccaccaccaccaccgtgaccaagctgagcacccccagcactggaggctctgtggacatcatctctgtgaaggagcagagcaagacagtggtgaccaccaccgtgacagacagcctgaccaccaccggcggcaccctggtgacctccatgacagtgtccaaggagtacagcacccgggacaaggtgaagctgatgaagttcagccggcccaagaagaccaggtctggaacagccctgcccagctacaggaagtttgtgaccaagagcagcaagaagagcatctttgtgctgcccaatgatgacctgaagaagctggccaggaagggcggcatccgggaggtgccctacttcaactacaatgccaagccagccctggacatctggccctaccccagcccccggcccaccttcggcatcacctggagataccgcctgcagacagtgaagagcctggccggcgtgtccctgatgctgcggctgctgtgggccagcctgcgctgggatgacatggccgccaaggcccctcctgggggcggcaccaccaggacagagaccagcgagacagagatcaccaccacagagatcatcaagagaagagatgtgggcccctacggcatccgctctgagtactgcatcaggaagatcatctgccccatcggcgtgcctgagacccccaaggagacccccaccccccagaggaagggcctgcggagcagcgccctgcggcccaagaggcctgagacccccaagcagacaggccctgtgatcatcgagacctgggtggccgaggaggagctggagctgtgggagatccgggcctttgctgagcgggtggagaaggagaaggcccaggccgtggagcagcaggccaagaagaggctggagcagcagaagcccaccgtcatcgccaccagcaccaccagccccaccagcagcaccaccagcaccatcagccctgcccagaaggtgatggtggcccccatcagcggctctgtgaccaccggcaccaagatggtgctgaccaccaaggtgggcagccctgccaccgtgaccttccagcagaacaagaacttccaccagacctttgccacctgggtgaagcagggccagagcaacagcggcgtggtgcaggtgcagcagaaggtgctgggcatcatccccagcagcacaggcaccagccagcagaccttcaccagcttccagcccaggacagccaccgtgaccatccggcccaacaccagcggcagcggcggcaccaccagcaacagccaggtgatcaccggcccccagatccggcccggcatgaccgtcatccgcacccccctgcagcagagcaccctgggcaaggccatcatccgcacccctgtgatggtgcagcccggggccccccagcaggtgatgacccagatcatccggggccagcctgtgtccacagctgtgtctgcccccaacacagtgagcagcaccccaggccagaagagcctgaccagcgccaccagcaccagcaacatccagagcagcgccagccagcccccccggccccagcagggccaggtgaagctgaccatggcccagctgacccagctgacccagggccatggaggcaaccagggcctgactgtggtgatccagggccagggccagaccaccggccagctgcagctgatcccccagggcgtgacagtgctgcccggccctggccagcagctgatgcaggccgccatgcccaatggaacagtgcagcgcttcctgttcacccccctggccaccacagccaccacagccagcaccaccaccaccaccgtgtccaccacagctgctggcactggagagcagaggcagagcaagctgagcccccagatgcaggtgcaccaggacaagaccctgcccccagcccagagcagctctgtgggccctgctgaggcccagccccagacagcccagcccagcgcccagccccagccccagacccagccccagagccctgcccagcctgaggtgcagacccagcctgaggtgcagacccagaccaccgtgagcagccacgtgcccagcgaggcccagcccacccacgcccagagcagcaagccccaggtggccgcccagagccagccccagagcaatgtgcagggccagagccctgtgcgggtgcagagccccagccagacccgcatccggcccagcacccccagccagctgagccctggccagcagagccaggtgcagaccaccaccagccagcccatccccatccagccccacaccagcctgcagatccccagccagggccagccccagagccagccccaggtggtgatgaagcacaatgctgtgattgagcacctgaagcagaagaagtccatgaccccagctgagcgggaggagaaccagaggatgattgtgtgcaaccaggtgatgaagtacatcctggacaagattgacaaggaggagaagcaggccgccaagaagaggaagcgggaggagagcgtggagcagaagaggagcaagcagaatgccaccaagctgagcgccctgctcttcaagcacaaggagcagctgcgggcagagatcctgaagaagagggccctgctggacaaggacctgcagatcgaggtgcaggaggagctgaagagggacctgaagatcaagaaggagaaggacctgatgcagctggcccaggccacagctgtggccgccccctgcccccctgtgaccccagcccccccagcccccccagcccccccacccagccccccacctcctcctgctgtgcagcacacaggcctgctgagcacccccaccctgcctgctgccagccagaagaggaagcgggaggaggagaaggacagcagcagcaagagcaagaagaagaagatgatcagcaccaccagcaaggagaccaagaaggacaccaagctgtactgcatctgcaagaccccctatgatgagagcaagttctacatcggctgtgaccgctgccagaactggtaccacggccgctgtgtgggcatcctgcagagcgaggccgagctgattgatgaatatgtgtgcccccagtgccagagcacagaagatgccatgacagtgctgacccccctgacagagaaggactatgagggcctgaagagggtgctgcggagcctgcaggcccacaagatggcctggcccttcctggagcctgtggaccccaatgatgccccagactactacggcgtcatcaaggagcccatggacctggccaccatggaggagcgggtgcagaggcgctactatgagaagctgacagaatttgtggccgacatgaccaagatctttgacaactgccgctactacaaccccagcgacagccccttctaccagtgtgccgaggtgctggagagcttctttgtgcagaagctgaagggcttcaaggccagccgcagccacaacaacaagctgcagagcacagccagctag

SEQ ID NO: 19175 - DNA, 2628 bp, Artificial Sequence
  Description of Artificial Sequence: Synthetic coding sequence
atgaacttccaggccggcggcggccagagcccccagcagcagcagcagctggccggcggccccccccagcagtttgccctgagcaacagcgctgccatccgggcagagatccagagatttgagagcgtgcaccccaacatctatgccatctatgacctgattgaaagaattgaggacctggccctgcagaaccagatccgggagcacgtgatcagcattgaggacagctttgtgaacagccaggagtggaccctgagccgctctgtgcctgagctgaaggtgggcatcgtgggcaacctgagcagcggcaagagcgccctggtgcaccgctacctgaccggcacctacgtgcaggaggagagccctgagggcggccgcttcaagaaggagatcgtggtggatggccagagctacctgctgctgatcagagatgagggcggccccccagagctgcagtttgctgcctgggtggatgctgtggtgtttgtgttcagcctggaggatgagatctccttccagacagtgtacaactacttcctgcggctgtgcagcttcagaaatgccagcgaggtgcccatggtgctggtgggcacccaggatgccatctctgctgccaacccccgggtgattgatgacagccgggccaggaagctgagcacagacctgaagcgctgcacctactatgagacctgtgccacctacggcctgaatgtggagagggtcttccaggatgtggcccagaaggtggtggccctgaggaagaagcagcagctggccatcggcccctgcaagagcctgcccaacagccccagccacagcgctgtgtctgctgccagcatcccagctgtgcacatcaaccaggccaccaacggcggcggcagcgccttcagtgactacagcagctctgtgcccagcacccccagcatcagccagcgggagctgcgcatcgagaccatcgccgccagcagcacccccacccccatcaggaagcagagcaagaggaggagcaacatcttcaccagcaggaaaggagctgacctggaccgggagaagaaggctgctgagtgcaaggtggacagcatcggcagcggccgggccatccccatcaagcagggcatcctgctgaagaggtctgggaagagcctgaacaaggagtggaagaagaagtatgtgaccctgtgtgacaatggcctgctgacctaccaccccagcctgcatgactacatgcagaacatccacggcaaggagattgacctgctgcggaccaccgtgaaggtgcctgggaagaggctgccccgggccaccccagccacagcccctggcaccagcccccgggccaacggcctgtctgtggagaggagcaacacccagctgggcggcggcaccggggccccccacagcgccagcagcgccagcctgcacagcgagcggcccctgagcagcagcgcctgggccggccccaggcctgagggcctgcaccagaggagctgcagcgtgtcctctgctgaccagtggagcgaggccaccaccagcctgcccccaggcatgcagcacccagccagcggccctgctgaggtgctgagcagcagccccaagctggaccccccacccagcccccacagcaacaggaagaagcacaggaggaagaagagcacaggcacccccaggccagatggccccagcagcgccacagaggaggccgaggagagctttgaatttgtggtggtgtccctgaccggccagacctggcactttgaggccagcacagctgaggagcgggagctgtgggtgcagagcgtgcaggcccagatcctggccagcctgcagggctgccgcagcgccaaggacaagacccggctgggcaaccagaatgctgccctggccgtgcaggccgtgaggacagtgcggggcaacagcttctgcatcgactgtgatgcccccaacccagactgggccagcctgaacctgggcgccctgatgtgcattgaatgttctggcatccaccgccacctgggcgcccacctgagccgggtgcgcagcctggacctggatgactggcccccagagctgctggccgtgatgacagccatgggaaatgccctggccaacagcgtgtgggagggcgccctgggcggctacagcaagccaggcccagatgcctgccgggaggagaaggagcgctggatccgggccaagtatgagcagaagctgttcctggcccccctgcccagcagtgatgtgcccctgggccagcagctgctgcgggctgtggtggaggatgacctgcggctgctggtgatgctgctggcccacggcagcaaggaggaggtgaatgagacctatggagatggagatggccgcacagccctgcacctgagcagcgccatggccaacgtggtgttcacccagctgctgatctggtacggcgtggatgtgcgcagcagagatgcccggggcctgacccccctggcctatgccaggagagctggcagccaggagtgtgccgacatcctgatccagcacggctgccctggagagggctgcggcctggcccccacccccaaccgggagcccgccaacggcaccaaccccagcgctgagctgcacaggagccccagcctgctgtag

SEQ ID NO: 19176 - DNA, 1761 bp, Artificial Sequence
  Description of Artificial Sequence: Synthetic coding sequence
atgggcggggccctgggcctgcggcagctgcccatctgtgccccagcctgccggcccagcagcggccacagcccctgggccgccgccagccccaaccccaaccagtggagcagccgcagccgctggtgctgcctgcggcgctctgaggcccggcgcagctgcaggcctgtgggccgggccgcccctggccccacccgggccatggcccggcctgccaccagcacccggcgcagcgcctgcccccccctgacccccaccccagccctgagaattgcctggaggctgctgagcgccaccagcaggaccagcaggatggcctctgtgctgagccggggccgggtgcgctgcccctggcatggagcctgcttcaacatcagcactggagacctggaggacttccctggcctggacagcctgcacaagttccaggtgaagattgagaaggagaaggtgtatgtgcgggccagcaagcaggccctgcagctgcagaggaggaccaaggtgatggccaagtgcatcagccccagcgctggctacagcagcagcaccaacgtgctgattgtgggcgctggagctgctggcctggtgtgtgccgagaccctgcggcaggagggcttcagtgaccgcatcgtgctgtgcaccctggacagacacctgccctatgaccggcccaagctgagcaagagcctggacacccagcctgagcagctggccctgcggcccaaggagttcttccgggcctacggcatcgaggtgctgacagaggcccaggtggtgacagtggatgtgaggaccaagaaggtggtgttcaaggatggcttcaagctggagtacagcaagctgctgctggcccctggcagcagccccaagaccctgagctgcaagggcaaggaggtggagaatgtgttcaccatccgcaccccagaagatgccaacagagtggtgcggctggcccggggcagaaatgtggtggtggtgggcgccggcttcctgggcatggaggtggccgcctacctgacagagaaggcccacagcgtgtctgtggtggagctggaggagacccccttccgccgcttcctgggggagcgggtgggccgggccctgatgaagatgtttgagaacaacagagtgaagttctacatgcagacagaggtgtctgagctgcggggccaggagggcaagctgaaggaggtggtgctgaagagcagcaaggtggtgcgggcagatgtgtgtgtggtgggcattggagctgtgcctgccaccggcttcctgcggcagagcggcatcggcctggacagccggggcttcatccctgtgaacaagatgatgcagaccaacgtgcctggggtgtttgctgctggagatgctgtgaccttccccctggcctggaggaacaacaggaaggtgaacatcccccactggcagatggcccacgcccagggccgggtggccgcccagaacatgctggcccaggaggccgagatgagcacagtgccctacctgtggacagccatgtttgggaagagcctgcgctatgccggctatggagagggctttgatgatgtgatcatccagggcgacctggaggagctgaagtttgtggccttctacaccaagggagatgaggtgattgctgtggcctccatgaactatgaccccatcgtgtccaaggtggccgaggtgctggccagcggccgggccatcaggaagcgggaggtggagactggagacatgtcctggctgaccgggaagggcagctag

SEQ ID NO: 19177 - DNA, 1521 bp, Artificial Sequence
  Description of Artificial Sequence: Synthetic coding sequence
atgcctgtgcaggccgcccagtggacagagttcctgagctgccccatctgctacaatgaatttgatgaaaatgtgcacaagcccatcagcctgggctgcagccacacagtgtgcaagacctgcctgaacaagctgcacaggaaggcctgcccctttgaccagacagccatcaacacagacattgatgtgctgcctgtgaactttgccctgctgcagctggtgggcgcccaggtgcctgaccaccagagcatcaagctgagcaacctgggggagaacaagcactatgaggtggccaagaagtgtgtggaggacctggccctgtacctgaagcccctgagcggcggcaagggcgtggccagcctgaaccagagcgccctgagccggcccatgcagaggaagctggtgaccctggtgaactgccagctggtggaggaggagggccgggtgcgggccatgagagctgcccggagcctgggggagaggacagtgacagagctgatcctgcagcaccagaacccccagcagctgagcgccaacctgtgggccgctgtgcgggcccggggctgccagttcctgggccctgccatgcaggaggaggccctgaagctggtgctgctggccctggaggatggcagcgccctgagcaggaaggtgctggtgctgtttgtggtgcagaggctggagccccgcttcccccaggccagcaagaccagcattggacatgtggtgcagctgctgtaccgggccagctgcttcaaggtgaccaagagagatgaggacagcagcctgatgcagctgaaggaggagttccgctcctatgaggccctgcggcgggagcatgatgcccagatcgtgcacatcgccatggaggccggcctgcgcatcagccctgagcagtggagcagcctgctgtatggagacctggcccacaagagccacatgcagagcatcatcgacaagctgcagagccctgagagctttgccaagtctgtgcaggagctgaccatcgtgctgcagaggactggagaccctgccaacctgaaccggctgcggccccacctggagctgctggccaacatcgaccccaacccagatgctgtgagccccacctgggagcagctggagaatgccatggtggccgtgaagacagtggtgcacggcctggtggacttcatccagaactacagcaggaagggccacgagaccccccagccccagcccaacagcaagtacaagacctccatgtgccgggacctgcggcagcagggcggctgcccccggggcaccaactgcacctttgcccacagccaggaggagctggagaagtgcaacccccggggcctgtacctgcactgctgcctgctgagctctgtggccagcctgggcaccgtgcacaatgagctgtacaagcagcagcactgtgaccgggagaagatctctgtgtgtgctgtgaagagagctgagacctgcttcagcagccagttcttcagccccctggaggtgccccgggaggaggactag

SEQ ID NO: 19178 - DNA, 783 bp, Artificial Sequence
  Description of Artificial Sequence: Synthetic coding sequence
atgccccgggcccggagcggccgccgcagcagaggagctgggggccgggaggagaccttcctgcgggtgcgggccaaccggcagacccggctgaatgccagaattggcaagatgaagaggaggaagcaggatgagggccaggtgtgccccctgtgcaaccggcccctggccggcagcgagcaggagatgagccgccacgtggagcactgcctgagcaagcgggagggcagctgcatggctgaagatgatgctgtggacattgaacatgagaacaacaacagatttgaggagtatgagtggtgtggccagaagaggatccgggccaccaccctgctggagggcggcttccggggcagcggcttcatcatgtgcagcggcaaggagaacccagacagtgatgctgacctggatgtggatggagatgacaccctggagtatggcaagccccagtacacagaagcagatgtgatcccctgcaccggggaggagcccggggaggccaaggagcgggaggccctgcggggagctgtgctgaatggaggcccccccagcacccgcatcaccccagagttcagcaagtgggccagtgatgagatgcccagcaccagcaatggagagagcagcaagcaggaggccatgcagaagacctgcaagaacagcgacatcgagaagatcacagaagattctgctgtgaccacctttgaggccctgaaggcccgggtgcgggagctggagcggcagctgagcagaggagaccgctacaagtgcctgatctgcatgtag

SEQ ID NO: 19179 - DNA, 1461 bp, Artificial Sequence
  Description of Artificial Sequence: Synthetic coding sequence
atggctgctgtgaagaccctgaaccccaaggccgaggtggcccgggcccaggccgccctggccgtgaacatctctgctgcccggggcctgcaggatgtgctgcggaccaacctgggccccaagggcaccatgaagatgctggtgtctggagctggggacatcaagctgaccaaggatggaaatgtgctgctgcacgagatgggcctgcacccccgcatcatcacagagggctttgaggccgccaaggagaaggccctgcagttcctggaggaggtgaaggtgtcccgggagatggaccgggagaccctgattgatgtggcccggaccagcctgcggaccaaggtgcatgctgagctggctgatgtgctgacagaggccgtggtggacagcatcctggccatcaagaagcaggatgagcccatcgacctcttcatgattgagatcatggagatgaagcacaagtcagaaacagacaccagcctcatccggggcctggtgctggaccatggagcccggcacccagacatgaagaagagggtggaggatgcctacatcctgacctgcaatgtgtccctggagtatgagaagacagaggtgaacagcggcttcttctacaagtctgctgaggagcgggagaagctggtgaaggccgagaggaagttcattgaagatagagtgaagaagatcatcgagctgaagaggaaggtgtgtggggacagcgacaagggctttgtggtgatcaaccagaagggcatcgaccccttcagcctggatgccctgagcaaggagggcatcgtggccctgcggcgggccaagagaagaaacatggagcggctgaccctggcctgtggcggcgtggccctgaacagctttgatgacctgagcccagactgcctgggccacgccggcctggtgtatgagtacaccctgggggaggagaagttcaccttcatcgagaagtgcaacaaccccaggtctgtgaccctgctgatcaagggccccaacaagcacaccctgacccagatcaaggatgctgtgagagatggcctgcgggctgtgaagaatgccattgatgatggctgtgtggtgcctggggccggggctgtggaggtggccatggccgaggccctgatcaagcacaagcccagcgtgaagggccgggcccagctgggcgtgcaggcctttgctgatgccctgctgatcatccccaaggtgctggcccagaacagcggctttgacctgcaggagaccctggtgaagatccaggccgagcacagcgagagcggccagctggtgggcgtggacctgaacacaggagagcccatggtggccgctgaggtgggcgtgtgggacaactactgtgtgaagaagcagctgctgcacagctgcaccgtcatcgccaccaacatcctgctggtggatgagatcatgagagctggcatgagcagcctgaagggctag

SEQ ID NO: 19180 - DNA, 1407 bp, Artificial Sequence
  Description of Artificial Sequence: Synthetic coding sequence
atgtccttccggctgagcggcggcagccgccgcatctgcagcaggacaggcagcggccgcctgagcggcggcggcaccggctttgtggccggaaatgtgtgtgtgggcagcggggcccggagcagcttcagctgcaccctggagggcatcagcagcggcggcagcttctgcaacagcggcggcggcctgggcagcggggcctgtgccggcttcctgggcaatgagcacagcctgctgtctggaaatgagaaggtgaccatgcagaacctgaatgaccggctggccagctacctggaccacgtgcacgccctggaggaggccaatgctgacctggagcagaagatcaagggctggtatgaaaaatgtgagcccggcagcagccgggagcatgaccatgactacagccgctacttctctgtgattgaggacctgaagaggcagatcatcagcgccaccatctgcaatgccagcatcgtgctgcagaatgacaatgcccggctgacagcagatgacttccggctgaagtatgaaaatgagctggccctgcaccacagcgtggaggccgacaccagcggcctgcggcgggtgctggatgagctgaccctgtgcaccacagacctggagatccagtgtgagaccctgtctgaggagctgacctacctgaagaagagccatgaggaggagatggaggtgctgcagtacacagctggaggaaatgtgaatgtggagatgaatgccaccccaggagtggacctgactgtgctgctgaacaacatgagagcagaatatgaggacctggccgagcagaacaggaaggatgctgaggcctggttcaatgaaagaagtgccaccctgcagcagcagatcagtgaccacgagggcgccgccacagctgccagaaatgagctgacagagctgaagaggaacctgcagaccctggagattgagctgcagagcctgatggctgtgaagcacagctatgagtgcagcctggccgagacagagggcaactactgcaaccagctgcagcagatccaggaccagattggagtgatggaggagcagctgcagcagatcagaacagaaacagagggccagaagctggagtatgagcagctgctggatgtgaagatcttcctggagaaggagattgacatctactgcaacctgctggatggagaggagaggaagagcaagagcacctgctacaagagcaagggctacagacctgtgaacagcggcaaccaggccaaggacagcacagaggagaccatcgtgaagacagtggtggaggagctggaccagatcggcaacctgctgagcctgcgggtgcacagcgtggaggagaagagcagcaagatcagcaacatcaccgtggagcagagggtgcccagcaaggccccctag

SEQ ID NO: 19181 - DNA, 816 bp, Artificial Sequence; identical to SEQ ID NO: 19117
  Description of Artificial Sequence: Synthetic coding sequence

SEQ ID NO: 19182 - DNA, 753 bp, Artificial Sequence
  Description of Artificial Sequence: Synthetic coding sequence
atgtctgaaaatgctgccccagacttctactacgtggccatggactttggaggccacggcctgagcagccactacagccctggggtgccctactacctgcagacctttgtgtctgagatcagaagagtggtggccggcggcgtggtgggcggcatgttcttctgcaccttccctgagatggtggacaagctgatcctgctggacacccccctcttcctgctggagagtgatgagatggagaacctgctgacctacaagagaagagccatcgagcacgtgctgcaggtggaggccagccaggagcccagccacgtgttcagcctgaagcagctgctgcagaggctgctgaagagcaacagccacctgtctgaagaatgtggggagctgctgctgcagaggggcaccaccaaggtggccaccggcctggtgctgaacagagaccagaggctggcctgggccgagaacagcattgacttcatcagccgggagctgtgtgcccacagcatcaggaagctgcaggcccacgtgctgctgatcaaggctgtgcacggctactttgacagccggcagaactacagcgagaaggagagcctgtccttcatgattgacaccatgaagagcaccctgaaggagcagttccagtttgtggaggtgcccggcaaccactgtgtgcacatgtctgagccccagcacgtggccagcatcatcagcagcttcctgcagtgcacccacatgctgcctgcccagctgtag

SEQ ID NO: 19183 - DNA, 510 bp, Artificial Sequence
  Description of Artificial Sequence: Synthetic coding sequence
atggtgttccccctgcccaccccccaggagcccatcatggccaccccacccaagagaagagctgtggaggccactggagagaaggtgctgcgctatgagaccttcatcagtgatgtgctgcagagggacctgaggaaggtgctggaccaccgggacaaggtgtatgagcagctggccaagtacctgcagctgagaaatgtcatcgagcggctgcaggaggccaagcacagcgagctgtacatgcaggtggacctgggctgcaacttctttgtggacacagtggtgcctgacaccagccgcatctacgtggccctgggctacggcttcttcctggagctgaccctggccgaggccctgaagttcatcgacaggaagagcagcctgctgacagagctgagcaacagcctgaccaaggacagcatgaacatcaaggcccacatccacatgctgctggagggcctgcgggagctgcagggcctgcagaacttccctgagaagccccaccactag

SEQ ID NO: 19184 - DNA, 3177 bp, Artificial Sequence
  Description of Artificial Sequence: Synthetic coding sequence
atgaccaccgtggtggtgcacgtggacagcaaggccgagctgaccaccctgctggagcagtgggagaaggagcacggcagcggccaggacatggtgcccatcctgaccaggatgagccagctgattgagaaggagacagaggagtacagaaaaggagaccctgacccctttgatgacagacaccctggccgggctgaccctgagtgcatgctgggccacctgctgcgcatcctcttcaagaatgatgacttcatgaatgccctggtgaatgcctacgtgatgaccagccgggagccccccctgaacacagctgcctgccgcctgctgctggacatcatgcctggcctggagacagctgtggtgttccaggagaaggagggcatcgtggagaacctcttcaagtgggcccgggaggccgaccagcccctgcggacctacagcacaggcctgctgggcggggccatggagaaccaggacattgctgccaactacagagatgagaacagccagctggtggccatcgtgctgcggcggctgcgggagctgcagctgcaggaggtggccctgcggcaggagaacaagaggcccagccccaggaagctgagcagcgagcccctgctgcccctggatgaggaggccgtggacatggactatggagacatggctgtggatgatgctgagatccagaagagcgccctgcagatcatcatcaactgtgtgtgtggccctgacaaccgcatcagcagcatcggcaagttcatcagcggcacccccaggaggaagctgccccagaaccccaagagcagcgagcacaccctggccaagatgtggaatgtggtgcagagcaacaacggcatcaaggtgctgctgagcctgctgagcatcaagatgcccatcacagatgctgaccagatccgggccctggcctgcaaggccctggtgggcctgagccgcagcagcacagtgcggcagatcatcagcaagctgcccctcttcagcagctgccagatccagcagctgatgaaggagcctgtgctgcaggacaagagaagtgaccacgtgaagttctgcaagtatgctgctgagctgattgaaagagtgtctgggaagcccctgctgattggaacagatgtgtccctggcccggctgcagaaggcagatgtggtggcccagagccgcatctccttccctgagaaggagctgctgctgctgatccggaaccacctgatcagcaagggcctgggggagacagccaccgtgctgaccaaggaggccgacctgcccatgacagctgccagccacagcagcgccttcacccctgtgacagctgctgccagccctgtgtccctgcccaggaccccccgcatcgccaacggcatcgccacccggctgggcagccacgccgctgtgggcgccagcgcccccagcgcccccacagcccacccccagccccggcccccccagggccccctggccctgcccggccccagctatgccggcaacagccccctgattggccgcatctccttcatccgggagcggcccagcccctgcaatggaaggaagatccgggtgctgcggcagaagagtgaccacggggcctacagccagagccctgccatcaagaagcagctggacagacacctgcccagcccccccaccctggacagcatcatcacagagtacctgcgggagcagcacgcccgctgcaagaaccctgtggccacctgcccccccttcagcctcttcaccccccaccagtgcccagagcccaagcagaggcggcaggcccccatcaacttcaccagccggctgaacagaagagccagcttccccaagtatggaggagtggatggcggctgctttgacagacacctgatcttcagccgcttccggcccatctctgtgttccgggaggccaatgaagatgaaagtggcttcacctgctgtgccttcagcgcccgggagcgcttcctgatgctgggcacctgcaccggccagctgaagctgtacaacgtgttttctggccaggaggaggccagctacaactgccacaacagcgccatcacccacctggagcccagcagagatggcagcctgctgctgaccagcgccacctggagccagcccctgagcgccctgtggggcatgaagtctgtgtttgacatgaagcacagcttcacagaggaccactacgtggagttcagcaagcacagccaggacagagtcatcggcaccaagggggacatcgcccacatctatgacatccagacaggcaacaagctgctgaccctcttcaacccagacctggccaacaactacaagaggaactgtgccaccttcaaccccacagatgacctggtgctgaatgatggagtgctgtgggatgtgcgcagcgcccaggccatccacaagtttgacaagttcaacatgaacatcagcggggtcttccaccccaacggcctggaggtgatcatcaacacagagatctgggacctgcggaccttccacctgctgcacacagtgcctgccctggaccagtgccgggtggtgttcaaccacactggaacagtgatgtacggggccatgctgcaggctgatgatgaagatgacctgatggaggagaggatgaagagccccttcggcagcagcttccgcaccttcaatgccacagactacaagcccatcgccaccattgatgtgaagaggaacatctttgacctgtgcacagacaccaaggactgctacctggccgtgattgagaaccagggctccatggatgccctgaacatggacacagtgtgccgcctgtatgaggtgggccggcagaggctggctgaagatgaagatgaggaggaggaccaggaggaggaggagcaggaggaggaggatgatgatgaagatgatgatgacacagatgacctggatgagctggacacagaccagctgctggaggccgagctggaggaggatgacaacaatgaaaatgctggagaagatggagacaatgacttcagccccagtgatgaggagctggccaacctgctggaggagggggaggatggagaagatgaagattctgatgctgatgaggaggtggagctgatcctgggggacacagacagcagtgacaacagcgacctggaggatgacatcatcctgagcctgaatgaatag

SEQ ID NO: 19185 - DNA, 2409 bp, Artificial Sequence
  Description of Artificial Sequence: Synthetic coding sequence
atggctgctgaggccctggccgctgaggccgtggccagccggctggagcggcaggaggaggacatccgctggctgtggagcgaggtggagcggctgagagatgagcagctgaatgccccctacagctgccaggccgagggcccctgcctgacccgggaggtggcccagctgcgggcagagaactgtgacctgcggcaccggctgtgcagcctgcggctgtgcctggccgaggagaggagccggcaggccaccctggagagcgctgagctggaggccgcccaggaggccggggcccagcccccacccagccagagccaggacaaggacatgaagaagaagaagatgaaggagagcgaggccgacagcgaggtgaagcaccagcccatcttcatcaaggagcggctgaagctgtttgagatcctgaagaaggaccaccagctgctgctggccatctacggcaagaagggggacaccagcaacatcatcaccgtgcgggtggctgatggccagacagtgcagggcgaggtgtggaagaccaccccctaccaggtggccgctgagatcagccaggagctggccgagagcaccgtcatcgccaaggtgaatggagagctgtgggacctggaccggcccctggagggggacagcagcctggagctgctgacctttgacaatgaggaggcccaggccgtgtactggcacagcagcgcccacatcctgggggaggccatggagctgtactacggcggccacctgtgctacggcccccccattgaaaatggcttctactatgacatgtttattgaagatagagctgtgagcagcacagagctgagcgccctggagaacatctgcaaggccatcatcaaggagaagcagccctttgagcggctggaggtgtccaaggagatcctgctggagatgttcaagtacaacaagttcaagtgccgcatcctgaatgagaaggtgaacacagccaccaccaccgtgtaccgctgtggccccctgattgacctgtgcaagggcccccacgtgcgccacacaggcaagatcaagaccatcaagatcttcaagaacagcagcacctactgggagggcaaccctgagatggagaccctgcagaggatctacggcatctccttcccagacaacaagatgatgagggactgggagaagttccaggaggaggccaagaacagagaccacaggaagattggcaaggagcaggagctgttcttcttccatgacctgagccctggcagctgcttcttcctgcccaggggggccttcatctacaacaccctgacagacttcatccgggaggagtaccacaagagggacttcacagaggtgctgagccccaacatgtacaacagcaagctgtgggaggccagcggccactggcagcactacagcgagaacatgttcacctttgaaattgagaaggacacctttgccctgaagcccatgaactgccccggccactgcctgatgtttgcccaccggcccaggtcctggagggagatgcccatccgctttgctgactttggagtgctgcacagaaatgagctgagcggcaccctgagcggcctgaccagggtgcggcgcttccagcaggatgatgcccacatcttctgcaccgtggagcagatcgaggaggagatcaagggctgcctgcagttcctgcagagcgtgtacagcaccttcggcttctccttccagctgaacctgagcaccaggcctgagaacttcctgggggagattgagatgtggaatgaggccgagaagcagctgcagaacagcctgatggactttggagagccctggaagatgaaccctggagatggagccttctacggccccaagattgacatcaagatcaaggatgccatcggccgctaccaccagtgtgccaccatccagctggacttccagctgcccatccgcttcaacctgacctacgtgtccaaggatggagatgacaagaagaggcctgtgatcatccaccgggccatcctgggctctgtggagaggatgattgccatcctgtctgaaaattatggaggcaagtggcccttctggctgagcccccggcaggtgatggtgattcctgtgggccccacctgtgagaagtatgccctgcaggtgagcagcgagttctttgaggagggcttcatggctgatgtggacctggaccacagctgcaccctgaacaagaagatcagaaatgcccagctggcccagtacaacttcatcctggtggtgggggagaaggagaagattgacaatgctgtgaatgtgaggacccgggacaacaagatccatggagagatcctggtgaccagcgccatcgacaagctgaagaacctgaggaagaccaggaccctgaatgctgaggaggccttctag

SEQ ID NO: 19186 - DNA, 1149 bp, Artificial Sequence
  Description of Artificial Sequence: Synthetic coding sequence
atgttcaagatccagctggagcccctgaagctgcgggcctggaccctgaatggatttgtgaagttcaggaacaaggagaccagcgctggccctgtggccgtgatgggcaaggactactacaagatcctgggcatccccagcggggccaatgaagatgagatcaagaaggcctacaggaagatggccctgaagtaccacccagacaagaacaaggagcccaatgctgaggagaagttcaaggagattgctgaggcctatgatgtgctgagtgaccccaagaagaggggcctgtatgaccagtatggagaggagggcctgaagacaggaggcggcaccagcggcggcagcagcggcagcttccactacaccttccatggagacccccacgccacctttgccagcttcttcggcggcagcaacccctttgacatcttctttgccagcagccgcagcacccggcccttcagcggctttgatcctgatgacatggatgtggatgaagatgaggacccctttggagccttcggccgcttcggcttcaacggcctgagccggggcccccggcgggcccctgagcccctgtaccccaggaggaaggtgcaggacccccctgtggtgcatgagctgcgggtgtccctggaggagatctaccacggcagcaccaagaggatgaagatcacccggcggcggctgaacccagatggccgcacagtgaggacagaggacaagatcctgcacatcgtcatcaagaggggctggaaggagggcaccaagatcaccttccccaaggagggagatgccaccccagacaacatcccagctgacatcgtgtttgtgctgaaggacaagccccacgcccacttcagaagagatggcaccaacgtgctgtacagcgccctgatcagcctgaaggaggccctgtgtggctgcaccgtgaacatccccaccattgatggccgggtcatccccctgccctgcaatgatgtgatcaagccaggcaccgtgaagaggctgcggggggagggcctgcccttccccaaggtgcccacccagagaggagacctgattgtggagttcaaggtgcgcttcccagaccggctgaccccccagacccggcagatcctgaagcagcacctgccctgcagctag

SEQ ID NO: 19187 - DNA, 1356 bp, Artificial Sequence
  Description of Artificial Sequence: Synthetic coding sequence
atgagggagtgcatcagcatccacgtgggccaggccggcgtgcagattggaaatgcctgctgggagctgtactgcctggagcacggcatccagccagatggccagatgcccagcgacaagaccatcggcggcggagatgacagcttcaacaccttcttcagcgagaccggggccggcaagcacgtgcccagggctgtgtttgtggacctggagcccaccgtgattgatgaggtgaggacaggcacctaccggcagctgttccaccctgagcagctgatcaccgggaaggaggatgctgccaacaactatgcccggggccactacaccatcggcaaggagatcatcgacctggtgctggaccgcatcaggaagctggccgaccagtgcaccggcctgcagggcttcctggtgttccacagctttggaggcggcactggaagtggcttcaccagcctgctgatggagcggctgtctgtggactatggcaagaagagcaagctggagttcagcatctacccagccccccaggtgtccacagctgtggtggagccctacaacagcatcctgaccacccacaccaccctggagcacagcgactgtgccttcatggtggacaatgaggccatctatgacatctgcagaagaaacctggacatcgagcggcccacctacaccaacctgaacagactcatcagccagatcgtgagcagcatcacagccagcctgcgctttgatggagccctgaatgtggacctgacagagttccagaccaacctggtgccctacccccgcatccacttccccctggccacctacgcccctgtgatctctgctgagaaggcctaccacgagcagctgtctgtggccgagatcaccaatgcctgctttgagcccgccaaccagatggtgaagtgtgaccccaggcatggcaagtacatggcctgctgcctgctgtacagaggagatgtggtgcccaaggatgtgaatgctgccatcgccaccatcaagaccaagaggagcatccagtttgtggactggtgccccaccggcttcaaggtgggcatcaactaccagcccccaacagtggtgcctggaggagacctggccaaggtgcagagagctgtgtgcatgctgagcaacaccacagccatcgccgaggcctgggcccggctggaccacaagtttgacctgatgtatgccaagagggcctttgtgcactggtacgtgggggagggcatggaggagggggagttcagcgaggcccgggaggacatggccgccctggagaaggactatgaggaggtgggcgtggacagcgtggagggggagggggaggaggagggggaggagtactag

SEQ ID NO: 19188 - DNA, 444 bp, Artificial Sequence
  Description of Artificial Sequence: Synthetic coding sequence
tgaacagcccggggccctgagcctgagcagatgggcctggccccctgctgcacccaggccctgtgtggcctggccctgcggcaccacagccacctgcagcagatccggctggagttccaccggctgtctgaggagaacaccctgctgaagaatgacctgggccgggtgcggcaggagctggaggccgctgagagcacccatgatgcccagaggaaggagattgaggtgctgaagaaggacaaggagaaggcctgcagcgagatggaggtgctgaaccggcagaaccagaactacaaggaccagctgagccagctgaatgtgcgggtgctgcagctgggccaggaggccagcacccaccaggcccagaatgaggagcaccgggtgaccatccagatgctgacccagagcctggaggaggtggtgcgcagcggccagcagcagtag

SEQ ID NO: 19189 - DNA, 771 bp, Artificial Sequence
  Description of Artificial Sequence: Synthetic coding sequence
atggccacccagaggaagcacctggtgaaggacttcaacccctacatcacctgctacatctgcaagggctacctgatcaagcccaccaccgtgacagaatgtctgcacaccttctgcaagacctgcatcgtgcagcactttgaggacagcaatgactgcccccgctgtggcaaccaggtgcatgagaccaaccccctggagatgctgcggctggacaacaccctggaggagatcatcttcaagctggtgcccggcctgcgggagcaggagctggagcgggagagcgagttctggaagaagaacaagccccaggagaatggccaggatgacaccagcaaggctgacaagcccaaggtggatgaggagggagatgaaaatgaagatgacaaggactaccacagaagtgacccccagatcgccatctgcctggactgcctgagaaataatggccagagcggggacaacgtggtgaagggcctgatgaagaagttcatccgctgcagcaccagggtgacagtgggcaccatcaagaagttcctgagcctgaagctgaagctgcccagcagctatgagctggatgtgctgtgcaatggagagatcatgggcaaggaccacaccatggagttcatctacatgacccgctggaggctgcggggggagaacttccgctgcctgaactgcagcgccagccaggtgtgcagccaggacggccccctgtaccagagctaccccatggtgctgcagtaccggcccagaattgactttggatag

SEQ ID NO: 19190 - DNA, 6672 bp, Artificial Sequence
  Description of Artificial Sequence: Synthetic coding sequence
atggcccccaagaaggagaagggcggcaccgtgaacaccagcagcaagatctgggagcccagcctgattgctgcccagttcaaccagaatgactggcaggccagcatcgcctttgtggtgggcaaccagattgaagatgacctgctgatccaggccctgactgtggccgtgcaggtgccccagaggaagctgttctccatggtgtcctggcaggacatcctgcagcagatcaatgagatcaacaccctggtgggcagcgccagcagcaagaaggccaagaagcctgtgggcggcaatgcccccctgtactatgaggtgctgacagctgccaaggccatcatggacagcggggagaagctgaccctgcccctgattggcaagctgctgaagttccagctgctgcagatcaagttcaaggaccagcagaggagagaaaatgagaagaaggtgattgaggacaagcccaagctggagaaggacaagggcaaggccaagagccccaaggagaagaaggcccccagcgccaagccagccaagggcaagggcaaggaccagcctgaggccaatgcccctgtgaagaagaccacccagctgaagagaagaggagaagatgaccacaccaaccgctacattgatgatgagccagatgatggagcccagcactacatcatcgtggtgggcttcaacaacccccagctgctggccatcatggccgagctgggcatccccatcaccagcgtcatcaagatcagcagtgaaaattatgagcccctgcagacccacctggccgctgtgaaccagcagcaggaggtgctgctgcagagcgaggacctggaggccgagaagctgaagaaggaaaatgccatcaaggagctgaagaccttctggaagtacctggagcctgtgctgaacaatgagaagccagagaccaacctgtttgatgtggcccggctggagtacatggtgaaggctgctgacttccccagcgactggagcgatggagagatgatgctgaagctgggcacagacatctttgagaacatcgcctgcctgatgtatgacatcctggactggaagaggcagcaccagcactacctggagagcatgcagctgatcaacgtgccccaggtggtgaatgagaagcctgtgctggaggccatgcccaccagcgaggccccccagcctgctgtgcctgcccctgggaagaagaaggcccagtatgaggagccccaggcccctcctcctgtgaccagcgtcatcaccacagaggtggacatgagatactacaactacctgctgaaccccatccgggaggagttcatctctgtgcccctcatcctgcactgcatgctggagcaggtggtggccacagaggaggacctggtgccccccagcctgcgggagcccagccccagggcagatggcctggaccacagaattgctgcccacatcgtgtccctgctgcccagcctgtgcctgtctgagcgggagaagaagaacctgcatgacatcttcctgtctgaggaggagaatgaaagcaaggctgtgcccaagggccccctgctgctgaactaccatgatgcccacgcccacaagaagtatgccctgcaggaccagaagaactttgatcctgtgcagatcgagcaggagatgcagagcaagctgcccctgtgggagttcctgcagttccccctgcccccaccctggaacaacaccaagaggctggccaccatccacgagctgatgcacttctgcaccagtgatgtgctgtcctggaatgaggtggagcgggccttcaaggtgttcacctttgagagcctgaagctgtctgaggtggatgagaagggcaagctgaagcccagcggcatgatgtgtggcagtgacagcgagatgttcaacatcccctgggacaacccagccaggtttgccaagcagatccggcagcagtatgtgatgaagatgaacacccaggaggccaagcagaaggctgacatcaagatcaaggacaggaccctgtttgtggaccagaacctgtccatgtctgtgcaggacaatgaaagcaaccgggagcccagcgaccccagccagtgtgatgccaacaacatgaagcacagcgacctgaacaacctgaagctgtctgtgcctgacaaccggcagctgctggagcaggagagcatcatgaaggcccagccccagcacgagagcctggagcagaccaccaacaatgagatcaaggatgatgctgtgaccaaggctgacagccatgagaagaagcccaagaagatgatggtggaggccgacctggaggacatcaagaagacccagcagaggagcctgatggactggagcttcacagagcacttcaagcccaaggtgctgctgcaggtgctgcaggaggcccacaagcagtaccgctgtgtggacagctactaccacacccaggacaacagcctgctgctggtgttccacaaccccatgaaccggcagaggctgcactgtgagtactggaacatcgccctgcacagcaatgtgggcttcaggaactacctggagctggtggccaagagcatccaggactggatcaccaaggaggaggccatctaccaggagagcaagatgaatgagaagatcatccgcaccagggctgagctggagctgaagagcagcgccaatgccaagctgaccagcgccagcaagatcttcagcatcaaggagagcaagagcaacaagggcatcagcaagacagagatcagtgaccaggagaaggagaaggagaaggagaagatccccttcatcctggagggcagcctgaaggcctggaaggaggagcagcaccggctggccgaggaggagcggctgcgggaggagaagaaggccgagaagaagggcaaggaggccggcaagaagaagggcaaggacaatgctgagaaggaggacagccgcagcctgaagaagaagagcccctacaaggagaagagcaaggaggagcaggtgaagatccaggaggtgacagaggagagcccccaccagcctgagcccaagatcacctaccccttccacggctacaacatgggcaacatccccacccagatcagcggcagcaactactacctgtaccccagtgatggcggccagatcgaggtggagaagaccatgtttgagaagggccccaccttcatcaaggtgcgggtggtgaaggacaaccacaacttcatgatccacctgaatgaccccaaggagatcgtgaagaaggaggagaagggggactactacctggaggaggaggaggagggagatgaggagcagagcctggagacagaggtgtctgatgccaagaacaaggccttcagcaagtttggcagcttcagcgccaccctggagaatggcatctgcctgagcatctcctactacggcagcaatggcatggcccctgaggacaaggaccctgacctggagaccatcctgaacatccccagcgccctgacccccaccgtggtgcctgtgattgtgacagtgccccagagcaaggccaagggcaagatcaagggcaaggagaagcccaaggagagcctgaaggaggaggagcaccccaaggaggaggagaagaaggaggaggaggtggagcctgagcctgtgctgcaggagaccctggatgtgcccaccttccagagcctgaatgtgtcctgccccagcggcctgctgctgaccttcatcggccaggagagcacaggccagtatgtgattgatgaggagcccacctgggacatcatggtgcggcagagctacccccagagggtgaagcactatgagttctacaagacagtgatgcctcctgctgagcaggaggccagcagggtcatcaccagccagggcaccgtggtgaagtacatgctggatggcagcacccagatcctgtttgctgatggagctgtgagccgcagccccaacagcggcctcatctgcccccccagcgagatgcctgccaccccccacagcggggacctgatggacagcatcagccagcagaagtctgagaccatccccagcgagatcaccaacaccaagaagggcaagagccacaagagccagagctccatggcccacaagggggagatccatgaccccccacctgaggccgtgcagacagtgacccctgtggaggtgcacatcggcacctggttcaccaccaccccagagggcaacagaattggcaccaagggcctggagagaattgctgacctgacccccctgctgtccttccaggccacagatcctgtgaatggaacagtgatgaccacccgggaggacaaggtggtgattgtggagaggaaggatggcaccagaattgtggaccatgctgatggcacccgcatcaccaccttctaccaggtgtatgaggaccagatcatcctgcctgatgaccaggagaccacagagggccccaggacagtgacccggcaggtgaagtgcatgagggtggagagcagccgctatgccaccgtcatcgccaactgtgaggacagcagctgctgtgccacctttggagatggcaccaccatcatcgccaagccccagggcacctaccaggtgctgccccccaacacaggcagcctgtacatcgacaaggactgcagcgctgtgtactgccacgagagcagcagcaacatctactaccccttccagaagcgggagcagctgcgggccggccgctacatcatgaggcacaccagcgaggtgatctgtgaggtgctggaccctgagggcaacaccttccaggtgatggctgatggcagcatcagcaccatcctgcctgagaagaagctggaggatgacctgaatgagaagacagagggctatgacagcctgagctccatgcacctggagaagaaccaccagcagatctatggagagcacgtgccccgcttctttgtgatgtatgcagatggcagcggcatggagctgctgcgggacagcgacatcgaggagtacctgagcctggcctacaaggagagcaacacagtggtgctgcaggagcctgtgcaggagcagcccggcaccctgaccatcaccgtgctgcggcccttccacgaggccagcccctggcaggtgaagaaggaggacaccatcgtgccccccaacctgcggagccgctcctgggagaccttccccagcgtggagaagaagaccccaggcccccccttcggcacccagatctggaagggcctgtgcatcgagagcaagcagctggtgtctgcccctggggccatcctgaagagccccagcgtgctgcagatgaggcagttcatccagcatgaagtcatcaagaatgaggtgaagctgcggctgcaggtgtccctgaaggactacatcaactacatcctgaagaaggaggatgagctgcaggagatgatggtgaaggacagcaggacagaggaggagagaggaaatgctgctgacctgctgaagctggtgatgtccttccccaagatggaggagaccaccaagagccacgtgacagaggtggccgcccacctgacagacctcttcaagcagagcctggccaccccacccaagtgccccccagacaccttcggcaaggacttctttgagaagacctggaggcacacagccagcagcaagcgctggaaggagaagattgacaagaccaggaaggagattgagaccacccagaactacctgatggacatcaagaaccgcatcatcccccccttcttcaagtctgagctgaaccagctgtaccagagccagtacaaccacctggacagcctgagcaagaagctgcccagcttcaccaagaagaatgaagatgccaatgaaacagctgtgcaggacaccagtgacctgaacctggacttcaagccccacaaggtgtctgagcagaagagcagctctgtgcccagcctgcccaagccagagatctctgctgacaagaaggacttcaccgcccagaaccagacagagaacctgaccaagagccctgaggaggccgagagctatgagcctgtgaagatccccacccagagcctgctgcaggatgtggccggccagaccaggaaggagaaggtgaagctgccccactacctgctgagcagcaagcccaagagccagcccctggccaaggtgcaggacagcgtgggcggcaaggtgaacaccagctctgtggccagcgctgccatcaacaatgccaagagcagcctgtttggcttccacctgctgcccagctctgtgaagtttggagtgctgaaggagggccacacctacgccaccgtggtgaagctgaagaatgtgggcgtggacttctgccgcttcaaggtgaagcagcccccacccagcacaggcctgaaggtgacctacaagccaggccctgtggccgccggcatgcagacagagctgaacatcgagctgtttgccacagctgtgggagaagatggagccaagggcagcgcccacatcagccacaacatcgagatcatgacagagcacgaggtgctcttcctgcctgtggaggccaccgtgctgaccagcagcaactatgacaagaggcccaaggacttcccccagggcaaggagaaccccatggtgcagaggaccagcaccatctacagcagcaccctgggcgtcttcatgagcaggaaggtgagcccccactag

SEQ ID NO: 19191 - DNA, 2337 bp, Artificial Sequence
  Description of Artificial Sequence: Synthetic coding sequence
atgcctgccttcctgggcctgaagtgcctgggcaagctgtgcagcagcgagaagagcaaggtgaccagcagcgagaggaccagcgcccggggcagcaacaggaagaggctcatcgtggaggaccggcgggtgtctggcaccagcttcaccgcccacagaagagccaccatcacccacctgctgtacctgtgccccaaggactactgcccccggggccgggtgtgcaacagcgtggacccctttgtggcccacccccaggacccccaccaccccagcgagaagcctgtgatccactgccacaagtgtggggagccctgcaagggggaggtgctgcgggtgcagaccaagcacttccacatcaagtgcttcacctgcaaggtgtgtggctgtgacctggcccagggcggcttcttcatcaagaatggagagtacctgtgcaccctggactaccagaggatgtatggcacccgctgccacggctgtggggagtttgtggagggggaggtggtgacagccctgggcaagacctaccaccccaactgctttgcctgcaccatctgcaagaggcccttccccccaggggacagagtgaccttcaacggccgggactgcctgtgccagctgtgtgcccagcccatgagcagcagccccaaggagaccaccttcagcagcaactgtgccggctgcggccgggacatcaagaatggccaggccctgctggccctggacaagcagtggcacctgggctgcttcaagtgcaagagctgtgggaaggtgctgactggagagtacatcagcaaggatggagccccctactgtgagaaggactaccagggcctgtttggagtgaagtgtgaggcctgccaccagttcatcaccgggaaggtgctggaggccggggacaagcactaccaccccagctgtgcccgctgcagccgctgcaaccagatgttcacagaaggagaggagatgtacctgcagggcagcacagtgtggcacccagactgcaagcagagcaccaagacagaggagaagctgcggcccaccaggaccagcagcgagagcatctacagccggcccggcagcagcatccctggcagccctggccacaccatctatgccaaggtggacaatgagatcctggactacaaggacctggccgccatccccaaggtgaaggccatctatgacatcgagaggccagacctgatcacctatgagcccttctacaccagcggctatgatgacaagcaggagcggcagagcctgggggagagccccaggaccctgagccccaccccatctgctgagggctaccaggatgtgcgggacaggatgatccacaggagcaccagccagggcagcatcaacagccctgtgtacagccgccacagctacacccccaccaccagccgcagcccccagcacttccacaggcctggaaatgagcccagcagcggcaggaacagccccctgccctacagaccagacagccggcccctgacccccacctacgcccaggcccccaagcacttccacgtgcctgaccagggcatcaacatctacaggaagccacccatctacaagcagcacgccgccctggccgcccagagcaagagcagcgaggacatcatcaagttcagcaagtttcctgctgcccaggccccagaccccagcgagacccccaagattgaaacagaccactggccaggcccccccagctttgctgtggtgggccctgacatgaagaggaggagcagcggccgggaggaggatgatgaggagctgctgcggcggcggcagctgcaggaggagcagctgatgaagctgaacagcggcctgggccagctgatcctgaaggaggagatggagaaggagagccgggagaggagcagcctgctggccagccgctatgacagccccatcaacagcgccagccacatccccagcagcaagacagccagcctgcccggctatggaagaaatggcctgcacaggcctgtgtccacagactttgcccagtacaacagctatggagatgtgtctgggggcgtgcgggactaccagaccctgcctgatggccacatgcctgccatgaggatggaccggggcgtgtccatgcccaacatgctggagcccaagatcttcccctatgagatgctgatggtgaccaacagaggaagaaacaagatcctgcgggaggtggacaggacccggctggagcggcacctggcccctgaggtgttccgggagatcttcggcatgagcatccaggagtttgaccggctgcccctgtggaggagaaatgacatgaagaagaaggccaagctgttctag

SEQ ID NO: 19192 - DNA, 1689 bp, Artificial Sequence
  Description of Artificial Sequence: Synthetic coding sequence
atgaaccccctgtttggccccaacctcttcctgctgcagcaggagcagcagggcctggccggccccctgggggacagcctgggcggggaccactttgctgggggcggggacctgcccccagcccccctgagccctgctggccctgctgcctacagccccccaggccctggccctgcccccccagctgccatggccctgagaaatgacctgggcagcaacatcaacgtgctgaagaccctgaacctgcgcttccgctgcttcctggccaaggtgcatgagctggagaggaggaaccggctgctggagaagcagctgcagcaggccctggaggagggcaagcagggccggcggggcctgggcagaagagaccaggccgtgcagacaggctttgtgagccccatccggcccctgggcctgcagctgggcgcccggcctgctgctgtgtgcagccccagcgcccgggtgctgggcagccctgcccggagccctgctggccccctggcccccagcgctgccagcctgagcagcagcagcaccagcaccagcaccacctacagcagcagcgcccgcttcatgcctggcaccatctggagcttcagccacgcccggcggctgggccctggcctggagcccaccctggtgcagggccctggcctgtcctgggtgcacccagatggagtgggcgtgcagattgacaccatcaccccagagatccgggccctgtacaacgtgctggccaaggtgaagcgggagagagatgagtacaagaggcgctgggaggaggagtacacagtgcgcatccagctgcaggacagagtgaatgagctgcaggaggaggcccaggaggctgatgcctgccaggaggagctggccctgaaggtggagcagctgaaggccgagctggtggtgttcaagggcctgatgagcaacaacctgtctgagctggacaccaagatccaggagaaggccatgaaggtggacatggacatctgcagaagaattgacatcacagccaagctgtgtgatgtggcccagcagaggaactgtgaggacatgatccagatgttccagaagaagctggtgcccagcatgggcggcaggaagcgggagaggaaggctgctgtggaggaggacaccagcctgtctgagagcgagggcccccggcagccagatggagatgaggaggagagcacagccctgagcatcaatgaggagatgcagaggatgctgaaccagctgcgggagtatgactttgaagatgactgtgacagcctgacctgggaggagacagaggagaccctgctgctgtgggaggacttcagcggctacgccatggctgctgctgaggcccagggcgagcaggaggacagcctggagaaggtgatcaaggacacagagagcctcttcaagacccgggagaaggagtaccaggagaccatcgaccagatcgagctggagctggccacagccaagaatgacatgaacagacacctgcacgagtacatggagatgtgcagcatgaagaggggcctggatgtgcagatggagacctgcagaagactcatcacccagagcggggacaggaagagccctgccttcaccgctgtgcccctgagtgaccccccacctccacccagcgaggctgaagattctgacagagatgtgtccagtgacagctccatgaggtag

SEQ ID NO: 19193 - DNA, 2415 bp, Artificial Sequence
  Description of Artificial Sequence: Synthetic coding sequence
atgaactaccagcagcagctggccaacagcgctgccatccgggcagagatccagagatttgagagcgtgcaccccaacatctacagcatctatgagctgctggagcgggtggaggagcctgtgctgcagaaccagatccgggagcacgtgattgccattgaagatgcctttgtgaacagccaggagtggaccctgagccgctctgtgcctgagctgaaggtgggcatcgtgggcaacctggccagcggcaagagcgccctggtgcaccgctacctgaccggcacctacgtgcaggaggagagccctgagggcggccgcttcaagaaggagatcgtggtggatggccagagctacctgctgctgatcagagatgagggcggccccccagaggcccagtttgccatgtgggtggatgctgtgatctttgtgttcagcctggaggatgagatctccttccagacagtgtaccactactacagcaggatggccaactacagaaacaccagcgagatccccctggtgctggtgggcacccaggatgccatcagcagcgccaacccccgggtgattgatgatgcccgggccaggaagctgagcaatgacctgaagcgctgcacctactatgagacctgtgccacctacggcctgaatgtggagagggtcttccaggatgtggcccagaagatcgtggccaccaggaagaagcagcagctgagcatcggcccctgcaagagcctgcccaacagccccagccacagctctgtgtgcagcgcccaggtgtctgctgtgcacatcagccagaccagcaatggaggcggcagcctgagtgactacagcagctctgtgcccagcacccccagcaccagccagaaggagctgagaattgatgtgcccccaacagccaacacccccacccctgtgaggaagcagagcaagagaagaagcaacctcttcaccagcaggaagggcagtgaccctgacaaggagaagaagggcctggagagcagagctgacagcatcggcagcggccgggccatccccatcaagcagggcatgctgctgaagaggtctgggaagagcctgaacaaggagtggaagaagaagtatgtgaccctgtgtgacaatggagtgctgacctaccaccccagcctgcatgactacatgcagaatgtgcacggcaaggagattgacctgctgcggaccaccgtgaaggtgcctgggaagaggcctccccgggccaccagcgcctgtgcccccatcagcagccccaagaccaacggcctgagcaaggacatgagcagcctgcacatcagccccaacagcgacaccggcctgggggacagcgtgtgcagcagccccagcatcagcagcaccaccagccccaagctggaccccccacccagcccccacgccaacaggaagaagcacaggaggaagaagagcaccagcaacttcaaggcagatggcctgtctggaacagctgaggagcaggaggagaactttgagttcatcatcgtgtccctgaccggccagacctggcactttgaggccaccacctatgaggagagagatgcctgggtgcaggccatcgagagccagatcctggccagcctgcagagctgtgagagcagcaagaacaagagccggctgaccagccagagcgaggccatggccctgcagagcatccggaacatgaggggcaacagccactgtgtggactgtgagacccagaaccccaactgggccagcctgaacctgggcgccctgatgtgcattgaatgttctggcatccacaggaacctgggcacccacctgagccgggtgcgcagcctggacctggatgactggcctgtggagctgatcaaggtgatgagcagcattggaaatgagctggccaacagcgtgtgggaggagagcagccagggccgcaccaagcccagcgtggacagcacccgggaggagaaggagcgctggatccgggccaagtatgagcagaagctgttcctggcccccctgccctgcacagagctgagcctgggccagcacctgctgcgggccacagcagatgaggacctgaggacagccatcctgctgctggcccacggcagcagagatgaggtgaatgagacctgtggggagggagatggccgcacagccctgcacctggcctgcaggaaaggaaatgtggtgctggcccagctgctgatctggtacggcgtggatgtgacagccagagatgcccacggcaacacagccctggcctatgcccggcaggccagcagccaggagtgcattgatgtgctgctgcagtatggctgcccagatgaaagatttgtgctgatggccacccccaacctgagcagaagaaacaacaacagaaacaacagcagcggccgggtgcccaccatcatctag

SEQ ID NO: 19194 - DNA, 2712 bp, Artificial Sequence
  Description of Artificial Sequence: Synthetic coding sequence
atgcctgagcagttctctgtggccgagttcctggccgtgacagctgaggacctgagcagccctgctggagctgctgcctttgctgccaagatgccccgctacagaggagctgccctggcccgggaggagatcctggagggggaccaggccatcctgcagaggatcaagaaggctgtgcgggccatccacagcagcggcctgggccacgtggagaatgaggagcagtaccgggaggccgtggagagcctgggcaacagccacctgagccagaacagccatgagctgagcacaggcttcctgaacctggccgtgttcacccgggaggtggccgccctcttcaagaacctgatccagaacctgaacaacatcgtgtccttccccctggacagcctgatgaagggccagctgagagatggccggcaggacagcaagaagcagctggagaaggcctggaaggactatgaggccaagatggccaagctggagaaggagcgggaccgggcccgggtgactggaggcatccctggagaggtggcccaggacatgcagcgggagcggcgcatcttccagctgcacatgtgtgagtacctgctgaaggccggggagagccagatgaagcagggccctgacttcctgcagagcctcatcaagttcttccacgcccagcacaacttcttccaggacggctggaaggccgcccagagcctcttccccttcatcgagaagctggccgcctctgtgcacgccctgcaccaggcccaggaggatgagctgcagaagctgacccagctgcgggacagcctgcggggcaccctgcagctggagagccgggaggagcacctgagcaggaagaacagcggctgcggctacagcatccaccagcaccagggcaacaagcagtttggaacagagaaggtgggcttcctgtacaagaagagtgatggcatcagaagagtgtggcagaagaggaaatgtggggtgaagtatggctgcctgaccatcagccacagcaccatcaaccggccccctgtgaagctgaccctgctgacctgccaggtgcggcccaaccctgaggagaagaagtgctttgacctggtgacccacaacagaacctaccacttccaggctgaagatgaacatgaatgtgaggcctgggtgtctgtgctgcagaacagcaaggatgaggccctgagcagcgccttcctgggggagcccagcgctggccctggctcctggggcagcgctggccatgatggagagccccatgacctgaccaagctgctgattgctgaggtgaagagccggcccggcaacagccagtgctgtgactgtggggctgctgaccccacctggctgagcaccaacctgggcgtgctgacctgcatccagtgcagcggcgtgcaccgggagctgggcgtgcgcttcagcaggatgcagagcctgaccctggacctgctgggccccagcgagctgctgctggccctgaacatgggcaacaccagcttcaatgaggtgatggaggcccagctgcccagccatggaggccccaagcccagcgctgagagtgacatgggcacccggcgggactacatcatggccaagtatgtggagcacagatttgcccggcgctgcaccccagagccccagaggctgtggacagccatctgcaacagagacctgctgtctgtgctggaggcctttgccaacggccaggactttggccagcccctgcccggcccagatgcccaggcccctgaggagctggtgctgcacctggccgtgaaggtggccaaccaggccagcctgcccctggtggacttcatcatccagaatggaggccacctggatgccaaggccgcagatggcaacacagccctgcactatgctgccctgtacaaccagcctgactgcctgaagctgctgctgaagggccgggccctggtgggcaccgtgaatgaggccggggagacagccctggacatcgccaggaagaagcaccacaaggaatgtgaggagctgctggagcaggcccaggccggcacctttgccttccccctgcacgtggactacagctgggtgatcagcacagagcccggcagtgacagcgaggaggatgaggaggagaagcgctgcctgctgaagctgcctgcccaggcccactgggccagcggccgcctggacatcagcaacaagacctatgaaacagtggccagcctgggcgccgccaccccccagggcgagagcgaggactgccccccacccctgcctgtgaagaacagcagcaggaccctggtgcagggctgtgcccggcatgccagcggggacagaagtgaggtgagcagcctgagcagcgaggcccctgagaccccagagagcctgggcagccctgccagcagcagcagcctgatgagccccctggagcccggggaccccagccaggccccacccaacagcgaggagggcctgcgggagcccccaggcaccagccggcccagcctgaccagcggcaccacccccagcgagatgtacctgcctgtgcgcttcagcagcgagagcaccaggagctacagaagaggagcccggagcccagaagatggccccagcgcccggcagcccctgcccaggagaaatgtgcctgtgggcatcacagaaggagatggcagcaggacaggcagcctgcctgccagctctgtgcagctgctgcaggactag

SEQ ID NO: 19195 - DNA, 1359 bp, Artificial Sequence
  Description of Artificial Sequence: Synthetic coding sequence
atgatgaagaggcagctgcacaggatgaggcagctggcccagacaggcagcctgggccgcaccccagagacagctgagttcctgggggaggacctgctgcaggtggagcagaggctggagcccgccaagagagctgcccacaacatccacaagaggctgcaggcctgcctgcagggccagagcggggctgacatggacaagagggtgaagaagctgcccctgatggccctgagcaccaccatggccgagagcttcaaggagctggaccctgacagctccatgggcaaggccctggagatgagctgtgccatccagaaccagctggcccgcatcctggccgagtttgagatgaccctggagagagatgtgctgcagcccctgagccggctgtctgaggaggagctgcctgccatcctgaagcacaagaagagcctgcagaagctggtgtctgactggaacaccctgaagagccggctgagccaggccaccaagaacagcggcagcagccagggcctgggcggcagccctggcagccacagccacaccaccatggccaacaaggtggagaccctgaaggaggaggaggaggagctgaagaggaaggtggagcagtgcagagatgagtacctggccgacctgtaccactttgtgaccaaggaggacagctatgccaactacttcatccggctgctggagatccaggccgactaccacagaagaagcctgagcagcctggacacagccctggccgagctgcgggagaaccacggccaggccgaccacagccccagcatgacagccacccacttcccccgggtgtatggagtgtccctggccacccacctgcaggagctgggccgggagatcgccctgcccatcgaggcctgtgtgatgatgctgctgtctgagggcatgaaggaggagggcctcttccggctggccgccggggcctctgtgctgaagaggctgaagcagaccatggccagtgacccccacagcctggaggagttctgcagcgacccccatgctgtggccggggccctgaagagctacctgcgggagctgcctgagcccctgatgacctttgacctgtatgatgactggatgagagctgccagcctgaaggagcccggggcccggctgcaggccctgcaggaggtgtgcagccggctgcccccagagaacctgagcaacctgcgctacctgatgaagttcctggcccggctggccgaggagcaggaggtgaacaagatgacccccagcaacatcgccatcgtgctgggccccaacctgctgtggcccccagagaaggagggcacagagcccgcccgggagctgggcagccagaccctgtgctag

SEQ ID NO: 19196 - DNA, 1137 bp, Artificial Sequence
  Description of Artificial Sequence: Synthetic coding sequence
atgaacaacagcggggctgatgaaattggcaagctgtttgtgggcggcctggactggagcaccacccaggagaccctgcggagctacttcagccagtatggagaggtggtggactgtgtgatcatgaaggacaagaccaccaaccagagccggggctttggatttgtgaagttcaaggaccccaactgtgtgggcaccgtgctggccagccggccccacaccctggatggcaggaacatcgaccccaagccctgcaccccccggggcatgcagcctgagaggacccggcccaaggagggctggcagaagggccccaggagtgacaacagcaagagcaacaagatctttgtgggcggcatcccccacaactgtggggagacagagctgcgggagtacttcaagaagtttggagtggtgacagaggtggtgatgatctatgatgctgagaagcagaggccccggggcttcggcttcatcacctttgaagatgagcagagcgtggaccaggccgtgaacatgcacttccatgacatcatgggcaagaaggtggaggtgaagagagctgagccccgggacagcaagagccaggcccctggccagcccggggccagccagtggggcagccgggtggtgcccaatgctgccaacggctgggccggccagcccccacccacctggcagcagggctacggcccccagggcatgtgggtgcctgctggccaggccatcggcggctacggccccccacctgctggccgcggggcccctcctcctcctccacccttcaccagctacatcgtgtccaccccacctgggggcttccccccaccccagggcttcccccagggctacggggccccaccccagttctcctttggctacggccccccacctcctcctccagaccagtttgcccctcctggggtgcccccacctccagccacccctggggccgcccccctggccttccccccaccacccagccaggccgccccagacatgagcaagcccccaacagcccagcctgacttcccctacggccagtatggcctgggcagctacagccctgcccctcctggctgcggcccccactttgtgtacagcctgatggtgcggctgagcagtgatgtggcctag

SEQ ID NO: 19197 - DNA, 2430 bp, Artificial Sequence
  Description of Artificial Sequence: Synthetic coding sequence
atggaggtgctgcgggagaaggtggaggaggaggaggaggccgagcgggaggaggccgctgagtgggccgagtgggccaggatggagaagatgatgaggcctgtggaggtgaggaaggaggagatcaccctgaagcaggagaccctgcgggacctggagaagaagctgtctgagatccagatcaccgtgtctgctgagctgcctgccttcaccaaggacaccatcgacatcagcaagctgcccatctcctacaagaccaacacccccaaggaggagcacctgctgcaggtggccgacaacttcagccggcagtacagccacctgtgcccagacagagtgcccctcttcctgcaccccctgaatgaatgtgaggtgcccaagtttgtgtccaccaccctgcggcccaccctgatgccctacccagagctgtacaactgggacagctgtgcccagtttgtgtctgacttcctgaccatggtgcccctgcctgaccccctgaagcccaccatcaagaaggaggagaaggtgctgcccaagaagtacaccatcaagccaccccgggacctgtgcagcagatttgagcaggagcaggaggtgaagaagcagcaggagatccgggcccaggagaagaagaggctgcgggaggaggaggagcggctgatggaggccgagaaggccaagccagatgccctgcacggcctgcgggtgcacagctgggtgctggtgctgagcggcaagcgggaggtgcctgagaacttcttcatcgaccccttcaccggccacagctacagcacccaggatgagcacttcctgggcatcgagagcctgtggaaccacaagaactactggatcaacatgcaggactgctggaactgctgcaaggacctgatctttgacctgggggaccctgtgcgctgggagtacatgctgctgggcacagacaagagccagctgagcctgacagaagaagatgacagcggcatcaatgatgaagatgatgtggagaacctgggcaaggaggatgaggacaagagctttgacatgccccacagctgggtggagcagatcgagatcagccctgaggcctttgagacccgctgccccaacgggaagaaggtgatccagtacaagagggccaagctggagaagtgggccccctacctgaacagcaatggcctggtgtcccggctgaccacctatgaggacctgcagtgcaccaacatcctggagatcaaggagtggtaccagaaccgggaggacatgctggagctgaagcacatcaacaagaccacagacctgaagacagactacttcaagccaggccacccccaggccctgcgggtgcacagctacaagtccatgcagcctgagatggacagagtcatcgagttctatgaaacagcccgggtggatggcctgatgaagcgggaggagacccccaggaccatgacagagtactaccagggccgcccagacttcctgagctacagacatgccagctttggcccccgggtgaagaagctgaccctgagcagcgctgagagcaacccccggcccatcgtgaagatcacagagcgcttcttcagaaatcctgccaagccagcagaagaagatgtggccgagagggtcttcctggtggccgaggagcgcatccagctgcgctaccactgccgggaggaccacatcacagccagcaagcgggagttcctgcggaggacagaggtggacagcaagggcaacaagatcatcatgaccccagacatgtgcatcagctttgaggtggagcccatggagcacaccaagaagctgctgtaccagtatgaggccatgatgcacctgaagcgggaggagaagctgagccgccaccaggtgtgggagagcgagctggaggtgctggagatcctgaagctgcgggaggaggaggaggccgcccacaccctgaccatcagcatctatgacaccaagagaaatgagaagagcaaggagtaccgggaggccatggagaggatgatgcatgaggagcacctgcggcaggtggagacccagctggactacctggcccccttcctggcccagctgcccccaggagagaagctgacctgctggcaggccgtgcggctgaaggatgagtgcctgagtgacttcaagcagaggctcatcaacaaggccaacctgatccaggccaggtttgagaaggagacccaggagctgcagaagaagcagcagtggtaccaggagaaccaggtgaccctgaccccagaagatgaggacctgtacctgagctactgcagccaggccatgttccgcatccgcatcctggagcagaggctgaacagacacaaggagctggcccccctgaagtacctggccctggaggagaagctgtacaaggacccccggctgggggagctgcagaagatctttgcctag

SEQ ID NO: 19198 - DNA, 828 bp, Artificial Sequence
  Description of Artificial Sequence: Synthetic coding sequence
atgtggcccctgacagccctgctgctgctggtgcccagcagcggccaggccgccaccctggagaagcccatcctgagcctgcaccccccctggaccaccatcttcaagggggagcgggtgaccctgaagtgtgatggctaccaccccctgctgctggagctgcagcccatcagcaccctgtggtacctgggccacctgctgctgcccagccacaagaagagcattgaggtgcagaccccaggagtgtaccgctgccagaccaggggggcccctgtgtctgaccccatccacctgtctgtgtccaatgactggctgatcctgcaggtgccctatgcccctgtgtttgaaggagagcccctggtgctgcgctgccggggctggtatgacaaggtggtgtacaagctgcactactaccatgatggccaggccgtgcgctacttccacagcagcgccaactacacagtgctgcaggcccgggccagtgacagcggccgctaccagtgcagcggcaccatgagaattcctgtggagagcgcccccatgttttctgccaaggtggccgtgacagtgcaggaggcccggcatgctgctgctgtgcgggtgctgcaggtgcagcccaggggggcccccctgcggctgggcagaagagtgcacagccctggggcccggggccgcggggccagaattgtgctggtgcggggcggctaccgccacccccagtgcccagagacccagagcgtggccgccgcccctggagctggcttcagccctggccctggcctgcaccaccggcccagctccatgggccgcagcctgggctcctggtag

SEQ ID NO: 19199 - DNA, 657 bp, Artificial Sequence
  Description of Artificial Sequence: Synthetic coding sequence
atgaactgccgctctgaggtgctggaggtgtctgtggagggccggcaggtggaggaggccatgctggccgtgctgcacacagtgctgctgcacaggagcacaggcaagttccactacaagaaggagggcacctacagcattggaacagtgggcacccaggatgtggactgtgacttcatcgacttcacctacgtgcgggtgtcctctgaggagctggaccgggccctgaggaaggtggtgggggagttcaaggatgccctgaggaacagcggaggagatggcctgggccagatgagcctggagttctaccagaagaagaagagccgctggcccttcagtgatgagtgcatcccctgggaggtgtggacagtgaaggtgcacgtggtggccctggccacagagcaggagcggcagatctgccgggagaaggtgggggagaagctgtgtgagaagatcatcaacatcgtggaggtgatgaacagacatgagtacctgcccaagatgcccacccagagcgaggtggacaacgtgtttgacaccggcctgagagatgtgcagccctacctgtacaagatctccttccagatcacagatgccctgggcacctctgtgaccaccaccatgagaagactcatcaaggacaccctggccctgtag

SEQ ID NO: 19200 - DNA, 552 bp, Artificial Sequence
  Description of Artificial Sequence: Synthetic coding sequence
atgatgcagatctgtgacacctacaaccagaagcacagcctcttcaatgccatgaaccgcttcatcggggctgtgaacaacatggaccagacagtgatggtgcccagcctgctgagagatgtgcccctggccgaccccggcctggacaatgatgtgggcgtggaggtgggcggcagcggcggctgcctggaggagaggaccccacctgtgcctgattctggcagcgccaacggcagcttctttgcccccagccgggacatgtacagccactacgtgctgctgaagagcatcagaaatgacatcgagtggggcgtgctgcaccagcccccacctcctgctggcagcgaggagggcagcgcctggaagagcaaggacatcctggtggacctgggccacctggagggcgcagatgctggggaggaggacctggagcagcagttccactaccacctgcggggcctgcacacagtgctgagcaagctgaccaggaaggccaacatcctgaccaaccgctacaagcaggagatcggcttcggcaactggggccactag

SEQ ID NO: 19201 - DNA, 369 bp, Artificial Sequence
  Description of Artificial Sequence: Synthetic coding sequence
atgctgtttgccccctgctgccaccagtgtggggagttcatcatcggccgggtcatcaaggccatgaacaacagctggcaccctgagtgcttccgctgtgacctgtgccaggaggtgctggccgacattggatttgtgaagaatgccggccgccacctgtgccggccctgccacaaccgggagaaggcccggggcctgggcaagtacatctgccagaagtgccacgccatcattgatgagcagcccctcatcttcaagaatgacccctaccacccagaccacttcaactgtgccaactgtggccaggagggcagtgactgccgctgcaccggggctgagcggggggccatcctgcctgccatgccctag

SEQ ID NO: 19202 - DNA, 1083 bp, Artificial Sequence
  Description of Artificial Sequence: Synthetic coding sequence
atggattctgagctgatgcacagcatcgtgggcagctaccacaagcccccagagcgggtgtttgtgcccagcttcacccagaatgagcccagccagaactgccacccagccaacctggaggtgaccagccccaagatcctgcacagccccaacagccaggagaagcagctggagtacaccaagaggatggtgctgaatgtggagcgggagaagaacatgatcctggagcagcaggcccagctgcagcgggagaaggagcaggaccagatgaagctgtatgccaagctggagaagctggatgtgctggagaaggagtgcttccggctgaccaccacccagaagacagctgaggacaagatcaagcacctggaggagaagctgaaggaggaggagcaccagaggaagctgttccaggacaaggccagcgagctgcagacaggcctggagatcagcaagatcatcatgagctctgtgagcaacctgaagcacagcaaggagaagaagaagagcagcaagaagaccaagtgcatcaagagaagaccaccctggcagatctgcagcaagtttggagccctgccctttgtggccgagaagcccagcaggaccacctcctggtgcaaggccatccccccagattctgagaagagcatcagcatctgtgacaacctgtctgagctgctgatggccatgcaggatgagctggaccagatgtccatggagcaccaggagctgctgaagcagatgaaggagacagagagccacagcgtgtgtgatgacattgaatgtgagctggagtgcctgctgaagaagatggagatcaagggggagcagatcagcaagctgaagaagcaccaggacagcgtgtgcaagctgcagcagaaggtgcagaacagcaagatgtctgaggccagcggcatccagcaggaggacagctaccccaagggcagcaagaacatcaagaacagccccaggaagtgcctgacagacaccaacctcttccagaagaacagcagcttccaccccatccgggtgcacaacctgcagatgaagctgcggagagatgacatcatgtgggagcagtag

SEQ ID NO: 19203 - DNA, 1758 bp, Artificial Sequence
  Description of Artificial Sequence: Synthetic coding sequence
atgagcggcagcacccccttccagatgaggctggtgcacctggacctgaagggggccccacccaaggtgtcctacctgtctgagatcttccccctcttccgggccctgggcgccaacggcctgctgattgaatatgaggacatgttcccctatgagggccccctgcggctgctgcgggccaagtatgcctacagccccagcgagatcaaggagatcctgcacctggccggcctgaatgagctggaggtgatccccctggtgcagaccttcggccacatggagtttgtgctgaagcacacagcctttgcccacctgcgggaggtgggcagcttcccctgcaccctgaacccccatgaggccgagagcctggccctggtgggcgccatgattgaccaggtgctggagctgcaccctggggcccagaggctgcacatcggctgtgatgaggtgtactacctgggggagggggaggccagccgccgctggctgcagcaggagcagaacagcacaggcaagctgtgcctgagccacatgagagctgtggccagcggcgtgaaggcccggcggcccagcgtgacccccctggtgtgggatgacatgctgcgggacctgcctgaggaccagctggccgccagcggcgtgccccagctggtggagcctgtgctgtgggactacacagctgacctggatgtgcacggcaaggtgctgctgatgcagaagtaccgccgctgtggcttcccccagctgtgggccgccagcgccttcaagggggccaccggccccagccaggccgtgccccctgtggagcaccacctgagaaatcatgtgcagtggctgcaggtggccggcagcggccccacagacagcctgcagggcatcatcctgaccggctggcagagatatgaccactacagcgtgctgtgtgagctgctgcctgctggggtgcccagcctggccgcctgcctgcagctgctgctgcggggcggctttgatgaagatgtgaaggccaaggtggagaacctgctgggcatcagcagcctggagaagacagatcctgtgcggcaggccccctgcagccccccctgccccctgctgcccctgcccttcccccggccctggaggcagctgttctctgctggcctgtctgctggccggggccctgcccccagcctggccgccaccagcctgcccctgagccacaagagcgccagcatctgtgccgccctgtggatgcgctgctggagggccaccggcatgagcctggccggcagcgcccccaccacagccagcggcagcagcagcaccaggtcctggttcagcaccagcagcccccagaggtctgcctcctggcacagcggggcccccagctgccgctcctggaggctgccctgctcctggctgagcaccaggatgccctggaggagcggctggaggaagacctgcaccccagcctgcagcggctgcaagctgtgctgcaggaccagcgcccgctgcctgcccccacgctgccaccccccagccctggccggcaccctgctgcggaccccagagggccgggcccacgcccggggcctgctgctggaggccggcggggccctgcactgccagatggcctgggccatccgggcccacgtgggcgtggtgcccagcggccctgctgtgtcctgcccccacagcgtgcctgagggccctggccagcccctgggggagcggctggagaacacagagggcagcagcacaggccgcccagccctgtag

SEQ ID NO: 19204 - DNA, 2112 bp, Artificial Sequence
  Description of Artificial Sequence: Synthetic coding sequence
atggaggccctgctggagggcatccagaacagaggacatggaggcggcttcctgaccagctgtgaggccgagctgcaggagctgatgaagcagattgacatcatggtggcccacaagaagtctgagtgggagggccgcacccacgccctggagacctgcctgaagatccgggagcaggagctgaagagcctgcggagccagctggatgtgacccacaaggaggtgggcatgctgcaccagcaggtggaggagcacgagaagatcaagcaggagatgaccatggagtacaagcaggagctgaagaagctgcacgaggagctgtgcatcctgaagaggagctatgagaagctgcagaagaagcagatgagggagttccggggcaacaccaagaaccaccgggaggacagaagtgaaattgagcggctgacagccaagattgaggagttccggcagaagagcctggactgggagaagcagaggctcatctaccagcagcaggtgagcagcctggaggcccagaggaaggccctggccgagcagagcgagatcatccaggcccagctggtgaacaggaagcagaagctggagagcgtggagctgagcagccagagcgagatccagcacctgagcagcaagctggagcgggccaatgacaccatctgtgccaatgagctggagattgagcggctgaccatgagggtgaatgacctggtgggcacctccatgacagtgctgcaggagcagcagcagaaggaggagaagctgcgggagagcgagaagctgctggaggccctgcaggaggagaagcgggagctgaaggccgccctgcagagccaggagaacctgatccacgaggcccgcatccagaaggagaagctgcaggagaaggtgaaggccaccaacacccagcacgctgtggaggccatccggccccgggaggagagcctggccgagaagaagtacaccagccagggccagggcgacctggacagcgtgctgagccagctgaacttcacccacaccagcgaggacctgctgcaggccgaggtgacctgcctggagggcagcctggagagcgtgtctgccacctgcaagcagctgagccaggagctgatggagaagtatgaggagctgaagaggatggaggcccacaacaatgagtacaaggccgagatcaagaagctgaaggagcagatcctgcagggcgagcagagctacagcagcgccctggagggcatgaagatggagatcagccacctgacccaggagctgcaccagagggacatcaccatcgccagcaccaagggcagcagcagtgacatggagaagaggctgcgggcagagatgcagaaggccgaggacaaggctgtggagcacaaggagatcctggaccagctggagagcctgaagctggagaacagacacctgtctgagatggtgatgaagctggagctgggcctgcacgaggccaaggagatcagcctggccgacctgcaggagaactacatcgaggccctgaacaagctggtgtctgagaaccagcagctgcagaaggacctgatgaacaccaagagccagctggagatcagcacccagatgtgcaagaagcagaatgaccgcatcttcaagcccacccacagcaggaccacagagttcaagaacacagagttcaagcccacccacggccagcacagacatgatggcatcaagacagagcactacaagacagacctgcacagcccccggggccaggccagtgacagcatcaaccccatgagccgggtgctgagccccctgagcccccagatcagcccctgcagcagcaccaggagcctgaccagctacagcctgtgcaagacccacagcctgcccagcgccctggacaccaatgaggccaacttcagtgacaccatgtctgagagcatgaatgaccaggaggagttcatcagcagctgcagcctgcctgtgagccccctgggcagcatcgccacccgcttcctggaggaggaggagctgcggagccaccacatcctggagcggctggatgcccacatcgaggagctgaagcgggagagcgagaagacagtgcggcagttcaccgccctgaagtag

SEQ ID NO: 19205 - DNA, 1626 bp, Artificial Sequence
  Description of Artificial Sequence: Synthetic coding sequence
atgagcagctgtgtgagcagccagcccagcagcaacagagctgccccccaggatgagctgggcggccggggcagcagcagcagcgagagccagaagccctgtgaggccctgcggggcctgagcagcctgagcatccacctgggcatggagagcttcatcgtggtgacagaatgtgagcccggctgtgctgtggacctgggcctggcccgggaccggcccctggaggctgatggccaggaggtgcccctggacaccagcggcagccaggcccggccccacctgagcggcaggaagctgagcctgcaggagaggagccagggcggcctggccgccggcggcagcctggacatgaatggccgctgcatctgccccagcctgccctacagccctgtgagcagcccccagagcagcccccggctgccccggcggcccaccgtggagagccaccacgtgtccatcaccggcatgcaggactgtgtgcagctgaaccagtacaccctgaaggatgaaattggcaagggcagctatggagtggtgaagctggcctacaatgaaaatgacaacacctactatgccatgaaggtgctgagcaagaagaagctgatccggcaggccggcttcccccggcggcccccaccccggggcaccaggcctgcccctgggggctgcatccagccccggggccccatcgagcaggtgtaccaggagatcgccatcctgaagaagctggaccaccccaacgtggtgaagctggtggaggtgctggatgaccccaatgaagaccacctgtacatggtgtttgagctggtgaaccagggccctgtgatggaggtgcccaccctgaagcccctgtctgaggaccaggcccgcttctacttccaggacctgatcaagggcatcgagtacctgcactaccagaagatcatccaccgggacatcaagcccagcaacctgctggtgggggaggatggccacatcaagattgctgactttggagtgtccaatgagttcaagggcagtgatgccctgctgagcaacacagtgggcaccccagccttcatggcccctgagagcctgtctgagaccaggaagatcttcagcggcaaggccctggatgtgtgggccatgggcgtgaccctgtactgctttgtgtttggccagtgccccttcatggatgagcgcatcatgtgcctgcacagcaagatcaagagccaggccctggagttcccagaccagcctgacattgctgaggacctgaaggacctgatcaccaggatgctggacaagaaccctgagagcagaattgtggtgcctgagatcaagctgcacccctgggtgaccaggcatggagctgagcccctgcccagtgaagatgagaactgcaccctggtggaggtgacagaggaggaggtggagaacagcgtgaagcacatccccagcctggccaccgtcatcctggtgaagaccatgatcaggaagaggagctttggaaacccctttgagggcagccggcgggaggagaggagcctgagcgcccctggcaacctgctgaccaagcagggcagcgaggacaacctgcagggcacagatcctcctcctgtgggggaggaggaggtgctgctgtag

SEQ ID NO: 19206 - DNA, 2463 bp, Artificial Sequence
  Description of Artificial Sequence: Synthetic coding sequence
atgacagacacccggcggcgggtgaaggtgtacaccctgaatgaagatcggcagtgggatgaccggggcaccggccacgtgagcagcggctacgtggagcggctgaagggcatgagcctgctggtgcgggcagagagtgatggcagcctgctgctggagagcaagatcaaccccaacacagcctaccagaagcagcaggacaccctcatcgtgtggagcgaggccgagaactatgacctggccctgtccttccaggagaaggccggctgtgatgagatctgggagaagatctgccaggtgcagggcaaggaccccagcgtggacatcacccaggacctggtggatgaaagtgaggaggagagatttgatgacatgagcagccctggcctggagctgcccagctgtgagctgagccggctggaggagattgctgagctggtggccagcagcctgcccagccccctgcggcgggagaagctggccctggccctggagaatgaaggctacatcaagaagctgctggagctgttccacgtgtgtgaggacctggagaacatcgagggcctgcaccacctgtatgagatcatcaagggcatcttcctgctgaacagaacagccctgtttgaggtgatgttttctgaggagtgcatcatggatgtgattggctgcctggagtatgaccctgccctgagccagcccaggaagcaccgggagttcctgaccaagacagccaagttcaaggaggtgatccccatcagtgaccctgagctgaagcagaagatccaccagacctacagagtgcagtacatccaggacatggtgctgcccaccccatctgtgtttgaggagaacatgctgagcaccctgcacagcttcatcttcttcaacaaggtggagatcgtgggcatgctgcaggaggatgagaagttcctgacagacctgtttgcccagctgacagatgaggccacagatgaggagaagaggcaggagctggtgaacttcctgaaggagttctgtgccttcagccagaccctgcagccccagaacagagatgccttcttcaagaccctgagcaacatgggcatcctgcctgccctggaggtgatcctgggcatggatgacacccaggtgcgctctgctgccacagacatcttctcctacctggtggagtacaaccccagcatggtgcgggagtttgtgatgcaggaggcccagcagaatgatgatgacatcctgctgatcaacctgatcatcgagcacatgatctgtgacacagatcctgagctgggcggcgctgtgcagctgatgggcctgctgcggaccctggtggaccctgagaacatgctggccacagccaacaagacagagaagacagagttcctgggcttcttctacaagcactgcatgcacgtgctgacagcccccctgctggccaacaccacagaggacaagcccagcaaggatgacttccagacagcccagctgctggccctggtgctggagctgctgaccttctgtgtggagcaccacacctaccacatcaagaactacatcatcaacaaggacatcctgcggcgggtgctggtgctgatggccagcaagcacgccttcctggccctgtgtgccctgcgcttcaagaggaagatcatcggcctgaaggatgagttctacaaccgctacatcatgaagagcttcctgtttgagcctgtggtgaaggccttcctgaacaacggcagccgctacaacctgatgaacagcgccatcatcgagatgtttgagttcatccgggtggaggacatcaagagcctgacagcccacgtgattgagaactactggaaggccctggaggatgtggactatgtgcagaccttcaagggcctgaagctgcgctttgagcagcagcgggagcggcaggacaaccccaagctggacagcatgaggagcatcctgaggaaccaccgctacagaagagatgcccggaccctggaggatgaggaggagatgtggttcaacacagatgaagatgacatggaggatggagaggccgtggtgagccccagcgacaagaccaagaatgatgatgacatcatggaccccatcagcaagttcatggagaggaagaagctgaaggagagcgaggagaaggaggtgctgctgaagaccaacctgagcggccggcagagccccagcttcaagctgagcctgagcagcggcaccaagaccaacctgaccagccagagcagcaccaccaacctgcccggcagccctggcagccctggcagccctggcagccctggcagccctggctctgtgcccaagaacaccagccagacagctgccatcaccaccaagggcggcctggtgggcctggtggactacccagatgatgatgaagatgatgatgaagatgaggacaaggaggacaccctgcccctgagcaagaaggccaagtttgacagctag

SEQ ID NO: 19207 - DNA, 2382 bp, Artificial Sequence
  Description of Artificial Sequence: Synthetic coding sequence
atgtctgagcagggcgacctgaaccaggccatcgccgaggagggcggcacagagcaggagacagccaccccagaaaatggcatcgtgaagtctgagagcctggatgaggaggagaagctggagctgcagaggcggctggaggcccagaaccaggagaggaggaagagcaagagcggggccggcaagggcaagctgaccaggagcctggccgtgtgtgaggagagcagcgcccggcctggaggagagagcctgcaggaccaggagagcatccacctgcagctgagcagcttcagcagcctgcaggaggaggacaagagcaggaaggatgattctgagcgggagaaggagaaggacaagaacaaggacaagaccagcgagaagcccaagatccgcatgctgagcaaggactgcagccaggagtacacagacagcactggaattgacctgcacgagttcctgatcaacaccctgaagaacaacagccgggacaggatgatcctgctgaagatggagcaggagatcatcgacttcatcgctgacaacaacaaccactacaagaagttcccccagatgagcagctaccagaggatgctggtgcaccgggtggccgcctacttcggcctggaccacaacgtggaccagacaggcaagagcgtcatcatcaacaagaccagcagcacccgcatccctgagcagcgcttctgtgagcacctgaaggatgagaagggggaggagagccagaagcgcttcatcctgaagagggacaacagcagcattgacaaggaggacaaccagagcgtgtgcagccaggagagcctgtttgtggagaacagaggcaacagagatggcagcggccgcaccagcggcagccggcagagcagcagtgaaaatgagctgaagtggagcgaccaccagagggcctggagcagcacagacagcgacagcagcaacagaaacctgaagccagccatgaccaagacagccagctttggaggcatcaccgtgctgaccaggggggacagcaccagcagcaccaggagcacaggcaagctgagcaaggccggcagcgagagcagcagcagcgctggcagcagcggcagcctgagcaggacccacccccccctgcagagcacccccctggtgtctggagtggccgccggcagccctggctgtgtgccctacccagaaaatggaattggaggccaggtggcccccagcagcaccagctacatcctgctgcccctggaggccgccaccggcatccccccaggcagcatcctgctgaacccccacacaggccagccctttgtgaacccagatggcaccccagccatctacaacccccccaccagccagcagcccctgcggagcgccatggtgggccagagccagcagcagcccccccagcagcagcccagcccccagccccagcagcaggtgcagcccccccagccccagatggccggccccctggtgacccagagcgtgcagggcctgcaggccagcagccagagcgtgcagtacccagctgtgtccttccccccccagcacctgctgcctgtgagccccacccagcacttccccatgagagatgatgtggccacccagtttggccagatgaccctgagccggcagagcagtggagagaccccagagcccccatctggccctgtgtaccccagcagcctgatgccccagcctgcccagcagcccagctatgtgattgccagcacaggccagcagctgcccaccggcggcttcagcggcagcggcccccccatcagccagcaggtgctgcagcccccacccagcccccagggctttgtgcagcagcccccaccagcccagatgcctgtgtactactaccccagcggccagtaccccaccagcaccacccagcagtaccggcccatggcccctgtgcagtacaatgcccagaggagccagcagatgccccaggccgcccagcaggccggctaccagcctgtgctgagcggccagcagggcttccagggcctcatcggcgtgcagcagcccccccagagccagaatgtcatcaacaaccagcagggcacccctgtgcagagcgtgatggtgtcctaccccaccatgagcagctaccaggtgcccatgacccagggcagccagggcctgccccagcagagctaccagcagcccatcatgctgcccaaccaggccggccagggcagcctgcctgccaccggcatgcctgtgtactgcaatgtgaccccacccaccccccagaacaacctgcggctgattggcccccactgccccagcagcacagtgcctgtgatgtctgccagctgcaggaccaactgtgcctccatgagcaatgccggctggcaggtgaagttctag

SEQ ID NO: 19208 - DNA, 1467 bp, Artificial Sequence
  Description of Artificial Sequence: Synthetic coding sequence
atgaggttccactggctgcccaccctgtctgagccctttgacaggaaccaggagctggagacctgcatccggcccctgtggacccccagcggcagcgcctgtgaaacagagcacaacaagtccatggacatgggcaaccagcaccccagcatcagccggctgcaggagatccagaaggaggtgaagtctgtggagcagcaggtgattggcttcagcggcctgagtgatgacaagaactacaagaagctggagcgcatcctgaccaagcagctgtttgaaattgacagcgtggacacagagggcaagggggacatccagcaggccaggaagagagctgcccaggagacagagcggctgctgaaggagctggagcagaatgccaaccacccccacagaattgagatccagaacatctttgaggaggcccagagcctggtgcgggagaagatcgtgcccttctacaatggaggcaactgtgtgacagatgaatttgaggagggcatccaggacatcatcctgcggctgacccacgtgaagacaggaggcaagatcagcctgaggaaggcccgctaccacaccctgaccaagatctgtgctgtgcaggagatcatcgaggactgcatgaagaagcagcccagcctgcccctgtctgaagatgcccaccccagcgtggccaagatcaactttgtgatgtgtgaggtgaacaaggcccggggcgtgctgattgccctgctgatgggcgtgaacaacaatgagacctgccgccacctgagctgtgtgctgagcggcctgattgctgacctggatgccctggatgtgtgtggccgcacagagatccggaactacagaagagaggtggtggaggacatcaacaagctgctgaagtacctggacctggaggaggaggccgacaccaccaaggcctttgacctgcggcagaaccacagcatcctgaagattgagaaggtgctgaagaggatgagggagatcaagaatgagctgctgcaggcccagaaccccagcgagctgtacctgagcagcaagacagagctgcagggcctgattggccagctggatgaggtgtccctggagaagaacccctgcatccgggaggcccggcggcgggccgtcatcgaggtgcagaccctcatcacctacatcgacctgaaggaggccctggagaagaggaagctgtttgcctgtgaggagcaccccagccacaaggctgtgtggaatgtgctgggcaacctgtctgagatccagggcgaggtgctgagctttgatggcaacagaacagacaagaactacatccggctggaggagctgctgaccaagcagctgctggccctggatgctgtggacccccagggcgaggagaagtgcaaggccgccaggaagcaggccgtgcggctggcccagaacatcctgagctacctggacctgaagagtgatgagtgggagtactag

SEQ ID NO: 19209 - DNA, 978 bp, Artificial Sequence
  Description of Artificial Sequence: Synthetic coding sequence
atgggcaagatggtgtctgtcatcaacacagtggacaccagccatgaggacatgattcatgatgcccagatggactactacggcacccggctggccacctgcagcagtgacagatctgtgaagatctttgatgtgagaaatggaggccagatcctgattgctgacctgcggggccacgagggccctgtgtggcaggtggcctgggcccaccccatgtatggcaacatcctggccagctgcagctatgacaggaaggtgatcatctggagggaggagaatggcacctgggagaagagccatgagcacgccggccatgacagctctgtgaacagcgtgtgctgggcccctcatgactatggcctcatcctggcctgtggcagcagtgatggagccatcagcctgctgacctacaccggggagggccagtgggaggtgaagaagatcaacaatgcccacaccatcggctgcaatgctgtgtcctgggccccagctgtggtgcccggcagcctgattgaccaccccagcggccagaagcccaactacatcaagagatttgccagcggcggctgtgacaacctgatcaagctgtggaaggaggaggaggatggccagtggaaggaggagcagaagctggaggcccacagcgactgggtgagagatgtggcctgggcccccagcatcggcctgcccaccagcaccatcgccagctgcagccaggacggccgggtcttcatctggacctgtgatgatgccagcagcaacacctggagccccaagctgctgcacaagttcaatgatgtggtgtggcacgtgtcctggagcatcacagccaacatcctggccgtgtctggaggagacaacaaggtgaccctgtggaaggagagcgtggatggccagtgggtgtgcatcagtgatgtgaacaagggccagggctctgtgtctgcctctgtgacagagggccagcagaatgagcagtag

SEQ ID NO: 19210 - DNA, 846 bp, Artificial Sequence
  Description of Artificial Sequence: Synthetic coding sequence
atgctgttcatcttccccctgagcctgccctggaggcccagctgctggaaggagagctgcagcacaggccagaggcaggccggccgcagccgggaggacagcgtgaccccaccacccagcagcccctggcccaccccacctgctggggccatgagcaccaagcaggaggccaggagagatgaaggagaggcccggacccggggccaggaggcccagctgcgggaccgggcccacctgagccagcagaggcggctgaagcaggccacccagttcctgcacaaggacagcgctgacctgctgcccctggacagcctgaagaggctgggcaccagcaaggacctgcagcccaggagcgtcatccagaggcggctggtggagggcaaccccaactggctgcagggcgagccccccaggatgcaggacctgatccacggccaggagagcaggaggaagaccagcaggacagagatcccagccctgctggtgaactgcaagtgccaggaccagctgctgcgggtggccgtggacaccggcacccagtacaaccgcatctctgctggctgcctgagccggctgggcctggagaagagggtgctgaaggccagcgctggggacctggcccctggcccccccacccaggtggagcagctggagctgcagctgggccaggagaccgtggtgtgcagcgcccaggtggtggatgctgagagccctgagttctgcctgggcctgcagaccctgctgagcctgaagtgctgcatcgacctggagcacggcgtgctgcggctgaaggcccccttcagcgagctgcccttcctgcccctgtaccaggagcccggccagtag

SEQ ID NO: 19211 - DNA, 1533 bp, Artificial Sequence
  Description of Artificial Sequence: Synthetic coding sequence
actggaggcggcgtggccccagctggccaggtgaggacagccacctgggcccggcgggcccggccctacaggaagatggccgccaggactggaacagagctggccagcgctgccagcaccacagcccctggcagcagcaagaggaggaagaggcacccctggcacacagtgtccagaagacctggccgcacccccaagtggaggctgccccgcatcagcgcccgggccccctaccgcctgcggcggctgcggcggcacacctactggccaccccggcggcctgtggccgccagccgctgctggcctgtgggcgccacccccctgggctctgtgggcggccgcacaggcaagatggatgctgccaccctgacctatgacaccctgcgctttgctgagtttgaggacttccctgagaccagcgagcctgtgtggatcctgggcaggaagtacagcatcttcacagagaaggatgagatcctgagtgatgtggccagccggctgtggttcacctacaggaagaacttccctgccatcggcggcaccggccccaccagtgacaccggctggggctgcatgctgcgctgtggccagatgatctttgcccaggccctggtgtgccgccacctgggccgggactggcgctggacccagaggaagaggcagcctgacagctacttctctgtgctgaatgccttcatcgacaggaaggacagctactacagcatccaccagatcgcccagatgggcgtgggggagggcaagagcatcggccagtggtacggccccaacacagtggcccaggtgctgaagaagctggccgtgtttgacacctggagcagcctggccgtgcacatcgccatggacaacacagtggtgatggaggagatccggcggctgtgcaggacctctgtgccctgtgccggggccacagccttccctgctgacagcgacagacactgcaatggcttccctgctggagctgaggtgaccaaccggcccagcccctggaggcccctggtgctgctgatccccctgcggctgggcctgacagacatcaatgaggcctacgtggagaccctgaagcactgcttcatgatgccccagagcctgggcgtgattggaggcaagcccaacagcgcccactacttcatcggctacgtgggggaggagctgatctacctggacccccacaccacccagcctgctgtggagcccacagatggctgcttcatcccagatgagagcttccactgccagcaccccccctgcaggatgagcattgctgagctggaccccagcattgctgtgggcttcttctgcaagacagaagatgacttcaatgactggtgccagcaggtgaagaagctgagcctgctgggcggggccctgcccatgtttgagctggtggagctgcagcccagccacctggcctgcccagatgtgctgaacctgagcctggacagcagtgatgtggagcggctggagcgcttctttgacagtgaagatgaagattttgagatcctgagcctgtag

SEQ ID NO: 19212 - DNA, 552 bp, Artificial Sequence
  Description of Artificial Sequence: Synthetic coding sequence
atggccagcaacaagaccaccctgcagaagatgggcaagaagcagaatggcaagagcaagaaggtggaggaggccgagcctgaggagtttgtggtggagaaggtgctggaccggcgggtggtgaatggcaaggtggagtacttcctgaagtggaagggcttcacagatgctgacaacacctgggagcctgaggagaacctggactgcccagagctgattgaggccttcctgaacagccagaaggccggcaaggagaaggatggcaccaagaggaagagcctgagtgacagcgagagtgatgacagcaagagcaagaagaagagagatgctgctgacaagccccggggctttgcccggggcctggaccctgagcgcatcattggagccacagacagcagtggagagctgatgttcctgatgaagtggaaggacagtgatgaggccgacctggtgctggccaaggaggccaacatgaagtgcccccagatcgtgattgccttctatgaggagcggctgacctggcacagctgcccagaagatgaggcccagtag

SEQ ID NO: 19213 - DNA, 1464 bp, Artificial Sequence
  Description of Artificial Sequence: Synthetic coding sequence
atggagaggagcggccagagggtgaccacctgggactgtgaccagggcaagcacagcgacagcgactacagagaagatggcatggacctgggcagtgatgctggcagcagcagcagcagcagccgggccagcagccagagcaacagcaccaaggtgaccccctgcagcgagtgcaagagcagcagcagccctgggggcagcctggacctggtgtctgccctggaggactatgaggagcccttccctgtgtaccagaagaaggtgattgatgagtgggcccctgaggaggatggagaggaggaggaggaggaggatgagcgggaccagaggggctacagagatgacaggagccctgcccgggagcctggagatgtgtctgcccggaccaggtctgggggcggcggcggccgcagcgccaccacagccatgcctcctcctgtgcccaatggaaacctgcaccagcacgacccccaggacctgcggcacaatggaaatgtggtggtggccggccggcccagctgcagccggggcccccggcgggccatccagaagccccagcctgctgggggcagaagaagtggccggggccctgctgctgggggcctgtgcctgcagcccccagatggcggcacctgtgtgcctgaggagccccctgtgccccccatggactgggaggccctggagaagcacctggccggcctgcagttccgggagcaggaggtgaggaaccagggccaggcccggaccaacagcaccagcgcccagaagaatgaaagagagagcatccggcagaagctggccctgggcagcttctttgatgatggccctggcatctacaccagctgcagcaagagcggcaagcccagcctgagcagccggctgcagagcggcatgaacctgcagatctgctttgtgaatgacagcggcagtgacaaggacagtgatgctgatgacagcaagacagagaccagcctggacacccccctgagccccatgagcaagcagagcagcagctacagcgaccgggacaccacagaggaggagagcgagagcctggatgacatggacttcctgacccggcagaagaagctgcaggccgaggccaagatggccctggccatggccaagcccatggccaagatgcaggtggaggtggagaagcagaacaggaagaagagccctgtggccgacctgctgccccacatgccccacatcagtgaatgtctgatgaagaggagcctgaagcccacagacctgcgggacatgaccatcggccagctgcaggtgattgtgaatgacctgcacagccagatcgagagcctgaatgaggagctggtgcagctgctgctgatcagagatgagctgcacacagagcaggatgccatgctggtggacatcgaggacctgaccaggcatgctgagagccagcagaagcacatggccgagaagatgcctgccaagtag

SEQ ID NO: 19214 - DNA, 927 bp, Artificial Sequence
  Description of Artificial Sequence: Synthetic coding sequence
atgaagagggcccaccctgagtacagcagcagtgacagcgagctggatgagaccatcgaggtggagaaggagagcgcagatgaaaatggaaacctgagcagcgccctgggctccatgagccccaccaccagcagccagatcctggccaggaagagaagaagaggcatcatcgagaagagaagaagagaccgcatcaacaacagcctgtctgagctgcggcggctggtgcccagcgcctttgagaagcaggtgatggagcagggcagcgccaagctggagaaggccgagatcctgcagatgacagtggaccacctgaagatgctgcacacagctgggggcaagggctactttgatgcccacgccctggccatggactaccgcagcctgggcttcagagaatgtctggccgaggtggcccgctacctgagcatcatcgagggcctggatgccagtgaccccctgcgggtgcggctggtgagccacctgaacaactatgccagccagcgggaggccgccagcggggcccatgctggcctgggccacatcccctggggcaccgtgtttggccaccacccccacatcgcccaccccctgctgctgccccagaatggacatggaaatgccggcaccacagccagccccacagagccccaccaccagggccgcctgggcagcgcccaccctgaggccccagccctgcgggccccacccagcggcagcctgggccctgtgctgcctgtggtgaccagcgccagcaagctgagcccccccctgctgagctctgtggccagcctgagcgccttccccttctcctttggcagcttccacctgctgagccccaatgccctgagccccagcgcccccacccaggccgccaacctgggcaagccctaccggccctggggcacagaaattggagccttctag

SEQ ID NO: 19215 - DNA, 1338 bp, Artificial Sequence
  Description of Artificial Sequence: Synthetic coding sequence
atgtctgtgacctatgatgacagcgtgggcgtggaggtgtccagtgacagcttctgggaggtgggcaactacaagaggacagtgaagagaattgatgatggccaccggctgtgcagcgacctgatgaactgcctgcacgagcgggccagaattgagaaggcctatgcccagcagctgacagagtgggcccggcgctggaggcagctggtggagaagggcccccagtatggcaccgtggagaaggcctggatggccttcatgtctgaggccgagcgggtgtctgagctgcacctggaggtgaaggccagcctgatgaatgatgactttgagaagatcaagaactggcagaaggaggccttccacaagcagatgatgggcggcttcaaggagaccaaggaggctgaagatggcttcaggaaggcccagaagccctgggccaagaagctgaaggaggtggaggccgccaagaaggcccaccacgccgcctgcaaggaggagaagctggccatcagccgggaggccaacagcaaggctgaccccagcctgaaccctgagcagctgaagaagctgcaggacaagattgagaagtgcaagcaggatgtgctgaagaccaaggagaagtatgagaagagcctgaaggagctggaccagggcaccccccagtacatggagaacatggagcaggtgtttgagcagtgccagcagtttgaggagaagaggctgcgcttcttccgggaggtgctgctggaggtgcagaagcacctggacctgagcaatgtggccggctacaaggccatctaccatgacctggagcagagcatccgggctgctgatgctgtggaggacctgcgctggttccgggccaaccacggccctggcatggccatgaactggccccagtttgaggagtggagcgctgacctgaacagaaccctgagccggcgggagaagaagaaggccacagatggagtgaccctgaccggcatcaaccagacaggagaccagagcctgcccagcaagcccagctctgtgagcagctatgagaagacccagagctaccccacagactggagcgatgatgagagcaacaaccccttcagcagcacagatgccaacggggacagcaacccctttgatgatgatgccaccagcggcacagaggtgcgggtgcgggccctgtatgactatgagggccaggagcatgatgagctgtccttcaaggctggagatgagctgaccaagatggaggatgaagatgagcagggctggtgcaagggccgcctggacaatggccaggtgggcctgtacccagccaactacgtggaggccatccagtag

SEQ ID NO: 19216 - DNA, 1248 bp, Artificial Sequence
  Description of Artificial Sequence: Synthetic coding sequence
atgatgctgggccctgagggcggggagggctttgtggtgaagctgcggggcctgccctggagctgcagcgtggaggatgtgcagaacttcctgagtgactgcaccatccatgatggagctgctggggtgcacttcatctacacccgggagggccggcagagcggggaggcctttgtggagctgggctctgaagatgatgtgaagatggccctgaagaaggaccgggagagcatgggccaccgctacatcgaggtgttcaagagccacaggacagagatggactgggtgctgaagcacagcggccccaacagcgctgacagcgccaatgatggctttgtgcggctgcggggcctgcccttcggctgcaccaaggaggagatcgtgcagttcttcagcggcctggagatcgtgcccaacggcatcaccctgcctgtggaccctgagggcaagatcaccggggaggcctttgtgcagtttgccagccaggagctggccgagaaggccctgggcaagcacaaggagcgcatcggccaccgctacatcgaggtgttcaagagcagccaggaggaggtgcgcagctacagcgacccccccctgaagttcatgtctgtgcagaggcctggcccctatgacaggcctggaacagcccggcgctacatcggcatcgtgaagcaggccggcctggagaggatgaggcctggggcctacagcacaggctacggcggctatgaggagtacagcggcctgagtgatggctacggcttcaccacagacctgtttggccgggacctgagctactgcctgagcggcatgtatgaccaccgctacggggacagcgagttcaccgtgcagagcaccaccggccactgtgtgcacatgaggggcctgccctacaaggccacagaaaatgacatctacaacttcttcagccccctgaaccctgtgcgggtgcacattgaaattggaccagatggccgggtgactggagaggctgatgtggagtttgccacccatgaggaggccgtggccgccatgagcaaggaccgggccaacatgcagcaccgctacatcgagctgttcctgaacagcaccactggagccagcaatggagcctacagcagccaggtgatgcagggcatgggcgtgtctgctgcccaggccacctacagcggcctggagagccagagcgtgtctggctgctatggagctggctacagcggccagaacagcatgggcggctatgactag

SEQ ID NO: 19217 - DNA, 1770 bp, Artificial Sequence
  Description of Artificial Sequence: Synthetic coding sequence
atgtctgtgtctgtgcatgagaccaggaagagccgcagcagcacaggctccatgaatgtgaccctcttccacaaggccagccacccagactgtgtgctggcccacctgaacaccctgaggaagcactgcatgttcacagatgtgaccctgtgggccggggaccgggccttcccctgccacagagctgtgctggccgccagcagccgctactttgaggccatgttcagccacggcctgcgggagagcagagatgacacagtgaacttccaggacaacctgcaccctgaggtgctggagctgctgctggactttgcctacagcagccgcatcgccatcaatgaagaaaatgctgagagcctgctggaggccggggacatgctgcagttccatgatgtgagagatgctgctgctgagttcctggagaagaacctcttccccagcaactgcctgggcatgatgctgctgagtgatgcccaccagtgccggcggctgtatgagttctcctggaggatgtgcctggtgcactttgagaccgtgcggcagagcgaggacttcaacagcctgagcaaggacaccctgctggacctgatcagcagtgatgagctggagacagaagatgagcgggtggtgtttgaggccatcctgcagtgggtgaagcatgacctggagcccaggaaggtgcacctgcctgagctgctgcggtctgtgcggctggccctgctgcccagcgactgcctgcaggaggccgtgagcagcgaggccctgctgatggctgatgagaggaccaagctgatcatggatgaggccctgcgctgcaagacccgcatcctgcagaatgatggagtggtgaccagcccctgtgcccggcccaggaaggccggccacaccctgctgatcctgggcggccagaccttcatgtgtgacaagatctaccaggtggaccacaaggccaaggagatcatccccaaggctgacctgcccagccccaggaaggagttcagcgccagcgccatcggctgcaaggtgtatgtgactggaggccggggctctgaaaatggagtgtccaaggatgtgtgggtgtatgacacagtgcatgaggagtggagcaaggccgcccccatgctgattgccaggtttggacatggcagcgctgagctggagaactgcctgtatgtggtgggcggccacaccagcctggccggggtcttccctgccagccccagcgtgtccctgaagcaggtggagaagtatgaccccggggccaacaagtggatgatggtggcccccctgagagatggagtgtccaatgctgctgtggtgtctgccaagctgaagctgtttgtgtttggaggcaccagcatccaccgggacatggtgtccaaggtgcagtgctatgaccccagtgaaaatcgctggaccatcaaggcagaatgtccccagccctggagatacacagctgctgctgtgctgggcagccagatcttcatcatgggcggggacacagagttcaccgctgccagcgcctacagatttgactgtgagaccaaccagtggaccagaattggagacatgacagccaagaggatgagctgccacgccctggccagcggcaacaagctgtatgtggtgggcggctacttcggcacccagcgctgcaagaccctggactgctatgaccccaccagtgacacctggaactgcatcaccaccgtgccctacagcctcatccccacagcctttgtgtccacctggaagcacctgcctgcctag

SEQ ID NO: 19218 - DNA, 1311 bp, Artificial Sequence
  Description of Artificial Sequence: Synthetic coding sequence
atgatgggagaggccgctgtggccgccggcccctgccccctgcgggaggacagcttcacccgcttcagcagccagagcaatgtgtatggcctggccggcggggccggcggccgcggggagctgctggccgccaccctgaagggcaaggtgctgggcttccgctaccaggacctgcggcagaagatccggcctgtggccaaggagctgcagttcaactacatccctgtggatgctgagatcgtgtccattgacaccttcaacaagagcccccccaagaggggcctggtggtgggcatcaccttcatcaaggacagcggggacaagggcagccccttcctgaacatctactgtgactatgagcccggcagcgagtacaacctggacagcatcgcccagagctgcctgaacctggagctgcagttcacccccttccagctgtgccacgccgaggtgcaggtgggggaccagctggagaccgtcttcctgctgtctggaaatgaccctgccatccacctgtacaaggaaaatgaaggcctgcaccagtttgaggagcagcctgtggagaacctcttccctgagctgaccaacctgaccagctctgtgctgtggctggatgtgcacaacttccctggcaccagccggcggctgagcgccctgggctgccagagcggctacgtgcgggtggcccacgtggaccagaggagccgggaggtgctgcagatgtggagcgtgctgcaggacggccccatcagcagggtcatcgtgttcagcctgtctgctgccaaggagaccaaggaccggcccctgcaggatgagtacagcgtgctggtggcctccatgctggagcctgctgtggtgtacagagacctgctgaacagaggcctggaggaccagctgctgctgcccggcagtgaccagtttgattctgtgctgtgcagcctggtgacagatgtggacctggatggccggcctgaggtgctggtggccacctacggccaggagctgctgtgctacaagtaccggggccctgagagcggcctgcctgaggcccagcacggcttccacctgctgtggcagaggagcttcagcagccccctgctggccatggcccacgtggacctgactggagatggcctgcaggagctggccgtggtgtccctgaagggcgtgcacatcctgcagcacagcctcatccaggccagcgagctggtgctgacccggctgcggcaccaggtggagcagaggagaagaaggctgcagggcctggaggatggagctggggccggccctgcagaaaatgctgccagctag

SEQ ID NO: 19219 - DNA, 642 bp, Artificial Sequence
  Description of Artificial Sequence: Synthetic coding sequence
atgctgctgcccttcatccgcaccctgcccctgctgtgctacaaccacctgctggtgtccccagattctgccaccctgagccccccctacagcctggagaagatgacagacctggtggccgtgtgggatgtggccctgagtgatggagtgcacaagattgaatttgaacatggcaccaccagcggcaagagggtggtgtatgtggatggcaaggaggagatcaggaaggagtggatgttcaagctggtgggcaaggagaccttctacgtgggcgccgccaagaccaaggccaccatcaacattgatgccatcagcggctttgcctatgagtacaccctggagatcaacgggaagagcctgaagaagtacatggaggacaggagcaagaccaccaacacctgggtgctgcacatggatggagagaacttcagaattgtgctggagaaggatgccatggatgtgtggtgcaatggcaagaagctggagacagctggggagtttgtggatgatggaacagagacccacttcagcatcggcaaccacgactgctacatcaaggctgtgagcagcggcaagaggaaggagggcatcatccacaccctcatcgtggacaaccgggagatccctgagatcgccagctag

SEQ ID NO: 19220 - DNA, 663 bp, Artificial Sequence
  Description of Artificial Sequence: Synthetic coding sequence
atgaccagcggggaggtgaagaccagcctgaagaatgcctacagcagcgccaagaggctgagccccaagatggaggaggagggggaggaggaggactactgcacccctggggcctttgagctggagcggctcttctggaagggcagcccccagtacacccacgtgaatgaggtgtggcccaagctgtacatcggagatgaggccacagccctggaccgctaccgcctgcagaaggccggcttcacccacgtgctgaatgctgcccacggccgctggaatgtggacaccggccctgactactacagagacatggacatccagtaccatggagtggaggctgatgacctgcccacctttgacctgagcgtcttcttctacccagctgctgccttcatcgaccgggccctgagtgatgaccacagcaagatcctggtgcactgtgtgatgggccgcagccgcagcgccaccctggtgctggcctacctgatgatccacaaggacatgaccctggtggatgccatccagcaggtggccaagaacagatgtgtgctgcccaacagaggcttcctgaagcagctgcgggagctggacaagcagctggtgcagcagaggagaagaagccagaggcaggatggagaggaggaggatggccgggagctgtag

SEQ ID NO: 19221 - DNA, 1845 bp, Artificial Sequence
  Description of Artificial Sequence: Synthetic coding sequence
atgagccctgctgaccgctgccgcagcgccaacaccattgaaccagccaccaccagcagcctggccctcttcctgctgctgcagagggaccagagcagcaggacccggggcctgcctgaggagaaggaggaggtgaccatggacaccagtgaaaatagaccagaaaatgatgtgcctgagccccccatgcccatcgctgaccaggtgtccaatgatgacaggcctgagggctctgtggaggatgaggagaagaaggagagcagcctgcccaagagcttcaagaggaagatctctgtggtgtctgccaccaagggcgtgcctgctggcaacagcgacacagaaggaggccagcccggcaggaagaggcgctggggcgccagcacagccaccacccagaagaagcccagcatcagcatcaccacagagagcctgaagagcctcatcccagacatcaagcccctggccggccaggaggccgtggtggacctgcatgctgatgacagccgcatcagtgaagatgaaacagaaagaaatggagatgatggcacccatgacaagggcctgaagatctgcaggacagtgacccaggtggtgcctgctgagggccaggagaatggccagcgggaggaggaggaggaggagaaggagcctgaggccgagccccctgtgcccccccaggtgtctgtggaggtggccctgcccccacctgctgagcacgaggtgaagaaggtgaccctgggggacaccctgacccggcgcagcatcagccagcagaagagcggcgtgtccatcaccattgatgatcctgtgaggacagcccaggtgcccagccccccccggggcaagatcagcaacatcgtgcacatcagcaacctggtgcggcccttcaccctgggccagctgaaggagctgctgggccgcacaggcaccctggtggaggaggccttctggattgacaagatcaagagccactgctttgtgacctacagcacagtggaggaggccgtggccaccaggacagccctgcatggagtgaagtggccccagagcaaccccaagttcctgtgtgccgactatgcagagcaggatgagctggactaccaccggggcctgctggtggaccggcccagcgagaccaagacagaggagcagggcatcccccggcccctgcaccccccacctcctcctcctgtgcagcccccccagcaccccagggctgagcagcgggagcaggagagagctgtgcgggagcagtgggccgagcgggagcgggagatggagcggcgggagaggaccaggtctgagcgggagtgggaccgggacaaggtgcgggagggccccaggagccgcagccgcagccgggacagaagaaggaaggagcgggccaagagcaaggagaagaagtctgagaagaaggagaaggcccaggaggagcccccagccaagctgctggatgacctcttcaggaagaccaaggccgccccctgcatctactggctgcccctgacagacagccagatcgtgcagaaggaggccgagagagctgagcgggccaaggagcgggagaagaggaggaaggagcaggaggaggaggagcagaaggagcgggagaaggaggccgagcgggagaggaaccggcagctggagcgggagaagagaagagagcacagccgggagcgggaccgggagcgggagcgggagcgggagcgggacagaggagaccgggaccgggaccgggagcgggaccgggagcggggccgggagcgggacagaagagacaccaagaggcacagccgcagccgcagccgcagcacccctgtgcgggacagaggaggaagaagatag

SEQ ID NO: 19222 - DNA, 1203 bp, Artificial Sequence
  Description of Artificial Sequence: Synthetic coding sequence
atgaagaatgagcccctgaccccaggctaccacggcttccctgcccgggacagccagggcaaccaggagcccaccaccaccccagatgccatggtgcagcccttcaccaccatccccttccccccaccaccccagaatggcatccccacagaatatggagtgccccacacccaggactatgccggccagacaggagagcacaacctgaccctgtatggcagcacccaggcccacggggagcagagcagcaacagccccagcacccagaatggcagcctgaccacagaaggaggagcccagacagatggccagcagagccagacccagagcagcgagaacagcgagagcaagagcacccccaagaggctgcacgtgagcaacatccccttccgcttccgggaccctgacctgcggcagatgtttggccagtttgggaagatcctggatgtggagatcatcttcaatgaaagaggcagcaagggcttcggctttgtgacctttgagaacagcgcagatgctgaccgggcccgggagaagctgcatggaacagtggtggagggcaggaagattgaggtgaacaatgccacagcccgggtgatgaccaacaagaagatggtgaccccctatgccaacggctggaagctgagccctgtggtgggcgctgtgtatggccctgagctgtatgctgccagcagcttccaggctgatgtgtccctgggcaatgatgctgctgtgcccctgagcggccggggcggcatcaacacctacatccccctcatcatccctggcttcccctaccccacagctgccaccacagctgctgccttccggggggcccacctgcggggccggggccgcacagtgtatggagctgtgcgggctgtgcccccaacagccatcccagcctacccaggagtggtgtaccaggacggcttctatggagctgacctgtacattgaaagtgccaactgcttccgcagcaacagagtggacatgcagcccacagacatgcacagcctgctgctgcagccccagccccccctgctgcagcccctgcagcccctgactgtgacagtgatggccggctgcacccagcccacccccaccatgcccctgcccctgcccctggccatggagctggccctgtggagggtgtacacagaggtggccacagctgacctgcccccaacagaggtgacctag

SEQ ID NO: 19223 - DNA, 1545 bp, Artificial Sequence
  Description of Artificial Sequence: Synthetic coding sequence
atggatgagggcatggagatcagcagcgagggcaacagcctcatcaaggctgtgcaccagagccggctgcggctgacccggctgctgctggagggcggggcctacatcaatgaaagcaatgacagaggagagacccccctgatgattgcctgcaagaccaagcacgtggaccaccagagcgtgtccaaggccaagatggtgaagtacctgctggagaacaatgctgaccccaacatccaggacaagagcggcaagacagccctgatgcacgcctgcctggagaaggccggccctgaggtggtgtccctgctgctgaagtctggagctgacctgagcctgcaggaccacagcagctacagcgccctggtgtatgccatcaacagcgaggacacagagaccctgaaggtgctgctgagcgcctgcaaggccaagggcaaggaggtgatcatcatcaccacagccaagctgccctgtgggaagcacaccaccaagcagtacctgaacatgcctcctgtggacattgatggctgccacagccctgccacctgcaccaccccatctgaaattgacatcaagacagccagcagccccctgagccacagcagcgagacagagctgaccctgtttggcttcaaggacctggagctggccggcagcaatgatgacacctgggaccccggcagccctgtgaggaagccagccctggcccccaagggccccaagctgccccacgccccaccctgggtgaagagcccccccctgctgatgcaccagaacagagtggccagcctgcaggaggagctgcaggacatcaccccagaggaggagctgagctacaagaccaacggcctggccctgagcaagcgcttcatcaccaggcaccagagcattgatgtgaaggacacagcccacctgctgcgggcctttgaccaggccagcagcaggaagatgtcctatgatgagatcaactgccagagctacctgtctgagggcaaccagcagtgcatcgaggtgcctgtggaccaggaccctgacagcaaccagaccatctttgccagcaccctgcggagcatcgtgcagaagaggaacctgggcgccaaccactacagcagtgacagccagctgtctgctggcctgaccccacccaccagtgaagatggcaaggccctgattggcaagaagaagatcctgagccccagccccagccagctgtctgagagcaaggagctgctggagaacatccccccaggccccctgagcagaagaaaccacgctgtgctggagcggcggggcagcggggccttccccctggaccacagcgtgacccagacccggcagggcttcctgccccccctgaatgtgaacagccacccccccatcagtgacatcaacgtgaacaacaagatctgcagcctgctgagctgtggccagaaggtgctgatgcccaccgtgcccatcttccccaaggagttcaagagcaagaagatgctgctgcggcggcagagcctgcagacagagcagatcaagcagctggtgaacttctag

SEQ ID NO: 19224 - DNA, 1674 bp, Artificial Sequence
  Description of Artificial Sequence: Synthetic coding sequence
atggaccagagccgggtgctgctgtgggtgaaggccgagcccttcatcgtgggcgccctgcaggtgcccccacccagcaagttcagcctgcactacctgaggaagatcagcacctacgtgcagatccgggccacagaaggagcctacccccggctgtactggagcacctggaggcacatcgcctgtgggaagctgcagctggccaaggacctggcctggctgtactttgagatctttgacagcctgtccatgaagaccccagaggagcggctggagtggagcgaggtgctgagcaactgcatgtctgaggaggaggtggagaagcagaggaaccagctgtctgtggacaccctgcagttcctgctcttcctgtacatccagcagctgaacaaggtgtccctgcggaccagcctgattggagaggagtggcccagccccaggaacaagagccagagcccagacctgacagagaagagcaactgccacaacaagaactggaatgactacagccaccaggcctttgtgtatgaccacctgagtgacctgctggagctgctgctggaccccaagcagctgacagccagcttccacagcacccacagcagcctggtgtcccgggaggccgtggtggccctgtccttcctgattgagggcaccatcagccgggccaggaagatctaccccctgcacgagctggccctgtggcagcccctgcacgccgacagcggcttcagcaagatcagcaagaccttctccttctacaagctggagacctggctgcggagctgcctgactggaaaccccttcggcaccagcgcctgcctgaagagcggcaagaagctggcctgggcccaccaggtggagggcaccaccaagagggccaagatcgcctgcaacacccacgtggcccccaggatgcaccggctggtggtgatgagccaggtgtacaagcagaccctggccaagagcagtgacaccctggccggggcccacgtgaagatccaccgctgcaatgaaagcttcatctacctgctgagccccctgcggtctgtgaccattgaaaaatgtagaaattccatctttgtgctgggccctgtgggcaccaccctgcacctgcacagctgtgacaacgtgaaggtgattgctgtgtgccaccggctgagcatcagcagcaccaccggctgcatcttccacgtgctgacccccacccggcccctcatcctgagcggcaaccagacagtgacctttgcccccttccacacccactaccccatgctggaggaccacatggccaggacaggcctggccaccgtgcccaactactgggacaaccccatggtggtgtgcagagaaaattctgacaccagggtcttccagctgctgcccccctgtgagttctacgtgttcatcatcccctttgagatggagggggacaccacagagatccctgggggcctgcccagcgtgtaccagaaggccctgggccagcgggagcagaagatccagatctggcagaagacagtgaaggaggcccacctgaccaaggaccagaggaagcagttccaggtgctggtggagaacaagttctatgagtggctgatcaacacaggccaccggcagcagctggacagcctggtgcccccagctgctggcagcaagcaggccgccggctag

SEQ ID NO: 19225 - DNA, 648 bp, Artificial Sequence
  Description of Artificial Sequence: Synthetic coding sequence
atggtgttccgccgctttgtggaggtgggccgggtggcctacgtgtcctttggcccccatgctgggaagctggtggccatcgtggatgtgattgaccagaacagagccctggtggatggcccctgcacccaggtgcggcggcaggccatgcccttcaagtgcatgcagctgacagacttcatcctgaagttcccccacagcgcccaccagaagtatgtgcggcaggcctggcagaaggctgacatcaacaccaagtgggccgccacccgctgggccaagaagattgaggcccgggagaggaaggccaagatgacagactttgaccgcttcaaggtgatgaaggccaagaagatgaggaaccgcatcatcaagaatgaggtgaagaagctgcagaaggccgccctgctgaaggccagccccaagaaggcccctggcaccaagggcacagctgctgctgctgctgctgctgctgctgccaaggtgcctgccaagaagatcacagctgccagcaagaaggccccagcccagaaggtgcctgcccagaaggccaccggccagaaggccgccccagcccccaaggcccagaagggccagaaggccccagcccagaaggccccagcccccaaggccagcggcaagaaggcctag

SEQ ID NO: 19226 - DNA, 888 bp, Artificial Sequence
  Description of Artificial Sequence: Synthetic coding sequence
atggagctgatccaggacaccagccggccccccctggagtatgtgaagggcgtgcccctcatcaagtactttgctgaggccctgggccccctgcagagcttccaggcccggccagatgacctgctgatcaacacctaccccaagagcggcaccacctgggtgtcccagatcctggacatgatctaccagggcggggacctggagaagtgcaacagagcccccatctacgtgcgggtgcccttcctggaggtgaatgaccctggagagcccagcggcctggagaccctgaaggacaccccaccacccaggctcatcaagagccacctgcccctggccctgctgccccagaccctgctggaccagaaggtgaaggtggtgtatgtggccaggaaccccaaggatgtggccgtgtcctactaccacttccacaggatggagaaggcccaccctgagcccggcacctgggacagcttcctggagaagttcatggccggggaggtgtcctatggctcctggtaccagcacgtgcaggagtggtgggagctgagcaggacccaccctgtgctgtacctgttctatgaggacatgaaggagaaccccaagcgggagatccagaagatcctggagtttgtgggccgcagcctgcctgaggagaccatggacttcatggtgcagcacaccagcttcaaggagatgaagaagaaccccatgaccaactacaccaccgtgccccaggagctgatggaccacagcatcagccccttcatgaggaagggcatggccggggactggaagaccaccttcaccgtggcccagaatgaaagatttgatgctgactatgcagagaagatggccggctgcagcctgtccttccgctctgagctgtag

SEQ ID NO: 19227 - DNA, 1368 bp, Artificial Sequence
  Description of Artificial Sequence: Synthetic coding sequence
atgagcagcctgggcgccagctttgtgcagatcaagtttgatgacctgcagttctttgagaactgtggcggcggcagctttggatctgtgtaccgggccaagtggatcagccaggacaaggaggtggccgtgaagaagctgctgaagattgagaaggaggccgagatcctgtctgtgctgagccacaggaacatcatccagttctatggagtcatcctggagccccccaactacggcatcgtgacagaatatgccagcctgggcagcctgtatgactacatcaacagcaacagaagtgaggagatggacatggaccacatcatgacctgggccacagatgtggccaagggcatgcactacctgcacatggaggcccctgtgaaggtgatccaccgggacctgaagagcagaaatgtggtgattgctgctgatggagtgctgaagatctgtgactttggagccagccgcttccacaaccacaccacccacatgagcctggtgggcaccttcccctggatggcccctgaggtgatccagagcctgcctgtgtctgagacctgtgacacctacagctatggagtggtgctgtgggagatgctgacccgggaggtgcccttcaagggcctggagggcctgcaggtggcctggctggtggtggagaagaatgaaaggctgaccatccccagcagctgccccaggagctttgctgagctgctgcaccagtgctgggaggctgatgccaagaagaggcccagcttcaagcagatcatcagcatcctggagagcatgagcaatgacaccagcctgcctgacaagtgcaacagcttcctgcacaacaaggccgagtggaggtgtgaaattgaggccaccctggagcggctgaagaagctggagcgggacctgtccttcaaggagcaggagctgaaggagcgggagcggcggctgaagatgtgggagcagaagctgacagagcagagcaacacccccctgctgctgcccctggccgccaggatgtctgaggagagctactttgagagcaagacagaggagagcaacagcgctgagatgagctgccagatcacagccaccagcaatggagagggccacggcatgaaccccagcctgcaggccatgatgctgatgggctttggagacatcttctccatgaacaaggccggggctgtgatgcacagcggcatgcagatcaacatgcaggccaagcagaacagcagcaagaccaccagcaagagaagaggcaagaaggtgaacatggccctgggcttcagtgactttgacctgtctgaaggagatgatgatgatgatgatgatggagaggaggaggacaatgacatggacaacagcgagtag

SEQ ID NO: 19228 - DNA, 423 bp, Artificial Sequence
  Description of Artificial Sequence: Synthetic coding sequence
atgaggttccgcttctgtggggacctggactgcccagactgggtgctggccgagatcagcaccctggccaagatgagctctgtgaagctgcggctgctgtgcagccaggtgctgaaggagctgctgggccagggcatcgactatgagaagatcctgaagctgacagcagatgccaagtttgagagcggagatgtgaaggccaccgtggccgtgctgtccttcatcctgagcagcgctgccaagcacagcgtggatggagagagcctgagcagcgagctgcagcagctgggcctgcccaaggagcacgccgccagcctgtgccgctgctatgaggagaagcagagccccctgcagaagcacctgcgggtgtgcagcctgaggaagctgaagcaggcccagaccctgatgagcagcctgggctag

SEQ ID NO: 19229 - DNA, 573 bp, Artificial Sequence
  Description of Artificial Sequence: Synthetic coding sequence
atgacagccagcgccagcagcttcagcagcagccagggcgtgcagcagcccagcatctacagcttcagccagatcaccaggagcctcttcctgagcaatggagtggccgccaatgacaagctgctgctgagcagcaaccgcatcacagccatcgtgaatgcctctgtggaggtggtgaatgtgttctttgagggcatccagtacatcaaggtgcctgtgacagatgcccgggacagccggctgtatgacttctttgaccccatcgctgacctgatccacaccatcgacatgaggcagggccgcaccctgctgcactgcatggccggcgtgagccgcagcgccagcctgtgcctggcctacctgatgaagtaccacagcatgagcctgctggatgcccacacctggaccaagagcagaagacccatcatccggcccaacaacggcttctgggagcagctgatcaactatgagttcaagctgttcaacaacaacacagtgaggatgatcaacagccctgtgggcaacatcccagacatctatgagaaggacctgaggatgatgatctccatgtag

SEQ ID NO: 19230 - DNA, 3576 bp, Artificial Sequence
  Description of Artificial Sequence: Synthetic coding sequence
atgctgaggaagctgaccatcgagcagatcaatgactggttcaccatcggcaagacagtgaccaacgtggagctgctgggcgcccccccagccttccctgctggggccgcccgggaggaggtgcagaggcaggatgtggcccctggggccggccctgctgcccaggccccagccctggcccaggccccagcccggcctgctgctgcctttgagaggagcctgagccagaggagcagcgaggtggagtacatcaacaagtaccggcagctggaggcccaggagctggatgtgtgccgctctgtgcagcccaccagcggccctggcccccggcccagcctggccaagctgagctctgtgacctgcatccctggcaccacctacaagtacccagacctgcccatcagccgctacaaggaggaggtggtgtccctgattgagagcaacagcgtggtgatcatccacggggccactggaagtggcaagagcacccagctgccccagtacatcctggaccactacgtgcagaggtctgcctactgcagcatcgtggtgacccagcccaggaagatcggggccagcagcatcgcccgctggatcagcaaggagcgggcctggaccctgggcggcgtggtgggctaccaggtgggcctggagaagatcgccacagaggacaccaggctcatctacatgaccaccggggtgctgctgcagaagatcgtgtctgccaagagcctgatggagttcacccacatcatcattgatgaggtgcatgagaggacagaggagatggacttcctgctgctggtggtgaggaagctgctgcggaccaacagcagatttgtgaaggtggtgctgatgtctgccaccatcagctgcaaggagtttgctgactactttgctgtgcctgtgcagaacaagatgaacccagcctacatctttgaggtggagggcaagccccacagcgtggaggagtactacctgaatgacctggagcacatccaccacagcaagctgagcccccacctgctggaggagcccgtcatcaccaaggacatctatgaggtggccgtgtccctcatccagatgtttgatgacctggacatgaaggagagcggcaacaaggcctggagcggggcccagtttgtgctggagaggagctctgtgctggtgttcctgcccggcctgggggagatcaactacatgcatgagctgctgaccagcctggtgcacaagaggctgcaggtgtaccccctgcacagctctgtggccctggaggagcagaacaacgtgttcctgagccctgtgcccggctacaggaagatcatcctgagcaccaacattgctgagagctctgtgacagtgcctgatgtgaagtatgtgattgacttctgcctgaccaggaccctggtgtgtgatgaggacaccaactaccagagcctgcggctgtcctgggccagcaagaccagctgcaaccagaggaagggccgggccggccgggtgtcccggggctactgctaccgcctggtgcacaaggacttctgggacaacagcatcccagaccacgtggtgcctgagatgctgcgctgccccctgggcagcaccatcctgaaggtgaagctgctggacatgggagagccccgggccctgctggccacagccctgagccccccaggcctgagtgacatcgagaggaccatcctgctgctgaaggaggtgggcgccctggccgtgtctggccagcgggaggatgagaacccccatgatggagagctgaccttcctgggccgggtgctggcccagctgcctgtgaaccagcagctgggcaagctgattgtgctgggccacgtgtttggctgcctggatgagtgcctgatcatcgccgccgccctgagcctgaagaacttctttgccatgcccttccggcagcacctggatggctacagaaacaaggtgaacttcagcggcagcagcaagagtgactgcatcgccctggtggaggccttcaagacctggaaggcctgccggcagacaggagagctgcgctaccccaaggatgagctgaactggggccgcctgaactacatccagatcaagaggatccgggaggtggccgagctgtatgaggagctgaagacccgcatcagccagttcaacatgcacgtggacagccggcggcctgtgatggaccaggagtacatctacaagcagcgcttcatcctgcaggtggtgctggccggggccttctaccccaactacttcaccttcggccagccagatgaggagatggctgtgcgggagctggccggcaaggaccccaagaccaccgtggtgctgaagcacatccccccctacggcttcctgtactacaagcagctgcagagcctcttccggcagtgtggccaggtgaagagcatcgtgtttgatggagccaaggcctttgtggagttcagcaggaaccccacagagcgcttcaagaccctgcctgctgtgtacatggccatcaagatgagccagctgaaggtgtccctggagctgtctgtgcacagcgctgaggagattgagggcaaggtgcagggcatgaatgtgtccaagctgaggaacaccagggtgaatgtggacttccagaagcagacagtggaccccatgcaggtgtccttcaacaccagtgacaggagccagacagtgacagacctgctgctgaccattgatgtgacagaggtggtggaggtgggccacttctggggctacagaattgatgagaacaacagcgagatcctgaagaagctgacagctgagatcaaccagctgaccctggtgcccctgcccacccacccccacccagacctggtgtgcctggccccctttgctgactttgacaagcagcgctacttccgggcccaggtgctgtatgtgtctggcaacagcgctgaggtgttctttgtggactatggcaacaagagccacgtggacctgcacctgctgatggagatcccctgccagttcctggagctgcccttccaggccctggagttcaagatctgcaagatgaggccttctgccaagagcctggtgtgtgggaagcactggagcgatggagccagccagtggtttgccagcctggtgtctggctgcaccctgctggtgaaggtgttttctgtggtgcacagcgtgctgcacgtggatgtgtaccagtacagcggcgtgcaggatgccatcaacatcagagatgtgctgatccagcagggctacgccgagctgacagaggagagctatgagagcaaggtgaacatcctgcgggccgccatcaacaagctggtgtgtgatggccccaacggctgcaagtgcctgggccctgagcgggtggcccagctgcaggacatcgcccggcagaagctgctgggcctcttctgccagagcaagccccgggagaagatcgtgcccaagtggcatgagaagccctatgagtggaaccaggtggaccccaagctggtgatggagcaggccgaccgggagagcagccggggcaagaacaccttcctgtaccagctgcacaagctggtggtgctgggcacctag

SEQ ID NO: 19231 - DNA, 906 bp, Artificial Sequence
  Description of Artificial Sequence: Synthetic coding sequence
atgaccaggcatggcaagaactgcacagctggagctgtgtacacctaccacgagaagaagaaggacacagctgccagcggctacggcacccagaacatccggctgagcagagatgctgtgaaggactttgactgctgctgcctgagcctgcagccctgccacgaccctgtggtgaccccagatggctacctgtatgagcgggaggccatcctggagtacatcctgcaccagaagaaggagatcgcccggcagatgaaggcctatgagaagcagaggggcacccggcgggaggagcagaaggagctgcagagagctgccagccaggaccacgtgcggggcttcctggagaaggagagcgccatcgtgtcccggcccctgaaccccttcaccgccaaggccctgagcggcaccagcccagatgatgtgcagcccggccccagcgtgggcccccccagcaaggacaaggacaaggtgctgcccagcttctggatccccagcctgaccccagaggccaaggccaccaagctggagaagcccagcaggacagtgacctgccccatgtctgggaagcccctgaggatgtctgacctgacccctgtgcacttcacccccctggacagctctgtggacagagtgggcctcatcaccaggagtgaaagatatgtgtgtgctgtgacccgggacagcctgagcaatgccaccccctgtgctgtgctgcggcccagcggggctgtggtgaccctggagtgtgtggagaagctgatcaggaaggacatggtggaccctgtgactggagacaagctgacagaccgggacatcatcgtgctgcagagaggaggcactggatttgctggcagcggcgtgaagctgcaggccgagaagagcaggcctgtgatgcaggcctag

SEQ ID NO: 19232 - DNA, 1509 bp, Artificial Sequence
  Description of Artificial Sequence: Synthetic coding sequence
atgcagagctgtgagagcagcggggacagcgcagatgaccccctgagccggggcctgcggcggcggggccagccccgggtggtggtgattggagctggcctggccggcctggccgccgccaaggccctgctggagcagggcttcacagatgtgacagtgctggaggccagcagccacatcggcggccgggtgcagagcgtgaagctgggccacgccacctttgagctgggcgccacctggatccacggcagccacggcaaccccatctaccacctggccgaggccaacggcctgctggaggagaccacagatggagagaggtctgtgggccgcatcagcctgtacagcaagaatggagtggcctgctacctgaccaaccacggccgccgcatccccaaggatgtggtggaggagttcagtgacctgtacaatgaggtgtacaacctgacccaggagttcttcagacatgacaagcctgtgaatgctgagagccagaacagcgtgggcgtcttcacccgggaggaggtgaggaaccgcatcagaaatgaccctgatgatcctgaggccaccaagaggctgaagctggccatgatccagcagtacctgaaggtggagagctgtgagagcagcagccacagcatggatgaggtgtccctgagcgccttcggggagtggacagagatccctggggcccaccacatcatccccagcggcttcatgagggtggtggagctgctggccgagggcatcccagcccacgtgatccagctgggcaagcctgtgcgctgcatccactgggaccaggccagcgcccggccccggggccctgagattgagccccggggcgtgctgaagaggcagtacaccagcttcttccggcccggcctgcccacagagaaggtggccgccatccaccggctgggcatcggcaccacagacaagatcttcctggagtttgaggagcccttctggggccctgagtgcaacagcctgcagtttgtgtgggaggatgaagctgagagccacaccctgacctacccacctgagctgtggtacaggaagatctgtggctttgatgtgctgtacccacctgagagatatggccacgtgctgagcggctggatctgtggggaggaggccctggtgatggagaagtgtgatgatgaggccgtggccgagatctgcacagagatgctgcggcagttcaccggcaaccccaacatccccaagccccggcgcatcctgcggagcgcctggggcagcaacccctacttccggggcagctacagctacacccaggtgggcagcagtggagcagatgtggagaagctggccaagcccctgccctacacagagagcagcaagacagcccccatgcaggtgctcttcagcggggaggccacccacaggaagtactacagcaccacccatggagccctgctgagcggccagcgggaggccgcccggctgattgagatgtacagagacctcttccagcagggcacctag

SEQ ID NO: 19233 - DNA, 579 bp, Artificial Sequence
  Description of Artificial Sequence: Synthetic coding sequence
atgggcacctttgacctgtggacagactacctgggcctggcccacctggtgcgggccctgagcggcaaggagggccctgagacccggctgagcccccagcctgagcctgagcccatgctggagcctgtgtctgccctggagcccatgcctgcccctgagagcgtgcctgtgcccggccccaaggaccagaagaggagcctggagagcagccctgcccctgagcggctgtgcagcttctgcaagcacaatggagagagccgggccatctaccagagccacgtgctgaaggatgaagctggccgggtgctgtgccccatcctgcgggactatgtgtgcccccagtgtggggccacccgggagcgggcccacacccggcgcttctgccccctgaccggccagggctacacctctgtgtacagccacaccaccaggaacagcgctgggaagaagctggtgcggccagacaaggccaagacccaggacaccggccacagaagaggaggcggcggcggggccggcttcagaggagctgggaagtctgagcccagccccagctgcagccccagcatgagcacctag

SEQ ID NO: 19234 - DNA, 2568 bp, Artificial Sequence
  Description of Artificial Sequence: Synthetic coding sequence
atggctgtggaggacagcaccctgcaggtggtggtgcgggtgcggccccccaccccccgggagctggacagccagaggaggcctgtggtgcaggtggtggatgagcgggtgctggtgttcaaccctgaggagccagatggcggcttccctggcctgaagtggggcggcacccatgatggccccaagaagaagggcaaggacctgacctttgtgtttgacagagtgtttggagaggccgccacccagcaggatgtgttccagcacaccacccacagcgtgctggacagcttcctgcagggctacaactgcagcgtgtttgcctacggggccactggagctgggaagacccacaccatgctgggccgggagggggaccccggcatcatgtacctgaccaccgtggagctgtaccgccgcctggaggcccggcagcaggagaagcactttgaggtgctgatctcctaccaggaggtgtacaatgagcagatccatgacctgctggagcccaagggccccctggccatcagagaagatcctgacaagggcgtggtggtgcagggcctgtccttccaccagcctgccagcgctgagcagctgctggagatcctgacccggggcaacagaaacagaacccagcaccccacagatgccaatgccaccagcagccgcagccacgccatcttccagatctttgtgaagcagcaggacagagtgcccggcctgacccaggccgtgcaggtggccaagatgagcctgattgacctggccggcagcgagcgggccagcagcacccacgccaagggggagcggctgcgggagggcgccaacatcaacagaagcctgctggccctgatcaacgtgctgaatgccctggctgatgccaagggcaggaagacccacgtgccctacagagacagcaagctgacccggctgctgaaggacagcctgggcggcaactgcaggacagtgatgattgctgccatcagccccagcagcctgacctatgaggacacctacaacaccctgaagtatgctgaccgggccaaggagatccggctgagcctgaagagcaatgtgaccagcctggactgccacatcagccagtatgccaccatctgccagcagctgcaggccgaggtggccgccctgaggaagaagctgcaggtgtatgagggcggcggccagcccccaccccaggacctgcccggcagccccaagagcggccccccacctgagcacctgcccagcagccccctgcccccccacccccccagccagccctgcaccccagagctgcctgctggcccccgggccctgcaggaggagagcctgggcatggaggcccaggtggagcgggccatggagggcaacagcagtgaccaggagcagagcccagaagatgaagatgagggccctgctgaggaggtgcccacccagatgcctgagcagaaccccacccacgccctgcctgagagcccccggctgaccctgcagcccaagcctgtggtgggccacttcagcgcccgggagctggatggagacaggagcaagcagctggccctgaaggtgctgtgtgtggcccagaggcagtacagcctgctgcaggccgccaacctgctgaccccagacatgatcacagaatttgagaccctgcagcagctggtgcaggaggagaagattgagcccggggctgaggccctgcggaccagcggcctggcccggggggcccccctggcccaggagctgtgcagcgagagcaagcccccaggctacacaggccctgtgaccaggaccatggcccggcggctgagcggccccctgcacaccctgggcatccccccaggccccaactgcaccccagcccagggcagccgctggcccatggagaagaagagaagaagacccagcgccctggaggccgacagccccatggcccccaagaggggcaccaagaggcagaggcagagcttcctgccctgcctgcggcggggcagcctgcctgacacccagcccagccagggccccagcacccccaagggggagcgggccagcagcccctgccacagcccccgggtgtgcccagccaccgtcatcaagagccgggtgcccctgggccccagcgccatgcagaactgcagcacccccctggccctgcccacccgggacctgaatgccacctttgacctgtctgaggagccccccagcaagcccagcttccatgaatgtattggctgggacaagatcccccaggagctgagccggctggaccagcccttcatcccccgggcccctgtgcccctcttcaccatgaagggccccaagcccaccagcagcctgcccggcaccagcgcctgcaagaagaagagggtggccagcagctctgtgagccacggccgcagccgcatcgcccggctgcccagcagcaccctgaagaggcctgctggccccctggtgctgcctgagctgcccctgagccccctgtgccccagcaacagaagaaatggcaaggacctgatccgggtgggccgggccctgtctgctggaaatggagtgaccaaggtgtcctag

SEQ ID NO: 19235 - DNA, 444 bp, Artificial Sequence
  Description of Artificial Sequence: Synthetic coding sequence
atgtggaagtttcctgggggcctgtctgagccagaagaagatattggagacacagctgtgcgggaggtgtttgaggagaccggcatcaagtctgagttccgctctgtgctgagcatccggcagcagcacaccaaccctggggccttcggcaagagtgacatgtacatcatctgccgcctgaagccctacagcttcaccatcaacttctgccaggaggagtgcctgcgctgtgagtggatggacctgaatgacctggccaagacagagaacaccacccccatcaccagccgggtggcccggctgctgctgtatggctaccgggagggctttgacaagattgacctgactgtggaggagctgcctgctgtgtacacaggcctcttctacaagctgtaccacaaggagctgcctgagaactacaagaccatgaagggcatcgactag

SEQ ID NO: 19236 - DNA, 3327 bp, Artificial Sequence
  Description of Artificial Sequence: Synthetic coding sequence
atggccctgcggcctggagctggcagcggcggcggcggcgctgctggagctggagctggcagcgctgggggcggcggcttcatgtttcctgtggccggcggcatccggcccccccaggccggcctgatgcccatgcagcagcagggcttccccatggtgtctgtgatgcagcccaacatgcagggcatcatgggcatgaactacagcagccagatgagccagggccccatcgccatgcaggccggcatccccatgggccccatgcctgctgctggcatgccctacctgggccaggcccccttcctgggcatgaggcctcctggcccccagtacaccccagacatgcagaagcagtttgctgaggagcagcagaagagatttgagcagcagcagaagctgctggaggaggagaggaagaggcggcagtttgaggagcagaagcagaagctgcggctgctgagctctgtgaagcccaagacaggagagaagagcagagatgatgccctggaggccatcaagggcaacctggatggcttcagcagagatgccaagatgcaccccaccccagccagccaccccaagaagccaggagtgggcgtcttccccagccaggaccctgcccagcccaggatgccaccctggatctacaatgaaagcctggtgcctgatgcctacaagaagatcctggagaccaccatgacccccaccggcatcgacacagccaagctgtaccccatcctgatgagcagcggcctgccccgggagaccctgggccagatctgggccctggccaacagaaccaccccaggcaagctgaccaaggaggagctgtacacagtgctggccatgattgctgtgacccaggtggtgaagccagaggaggatgacttccaggacttccaggatgccagcaagagcggcagcctggatgacagcttcagtgacttccaggagctgcctgccagcagcaagaccagcaacagccagcacggcaacagcgcccccagcctgctgatgcccctgcccggcaccaaggccctgcccagcatggacaagtatgctgtgttcaagggcattgctgctgacaagagcagcgagaacacagtgcccccaggggaccccggggacaagtacagcgccttccgggagctggagcagacagctgagaacaagcccctgggggagagctttgctgagttccgctctgctggaacagatgatggcttcacagacttcaagacagctgacagcgtgagccccctggagccccccaccaaggacaagaccttccccccatccttccccagcggcaccatccagcagaagcagcagacccaggtgaagaaccccctgaacctggccgacctggacatgttcagctctgtgaactgcagcagcgagaagcccctgtccttctctgctgtgttcagcaccagcaagtctgtgtccaccccccagagcacaggcagcgctgccaccatgacagccctggccgccaccaagaccagcagcctggctgatgactttggagagttcagcctgtttggagagtacagcggcctggcccctgtgggggagcaggatgactttgctgacttcatggccttcagcaacagcagcatcagcagcgagcagaagccagatgacaagtatgatgccctgaaggaggaggccagccctgtgcccctgaccagcaatgtgggcagcacagtgaagggcggccagaacagcacagctgccagcaccaagtatgatgtgttccggcagctgagcctggagggcagcggcctgggcgtggaggacctgaaggacaacacccccagcggcaagagtgatgatgactttgctgacttccacagcagcaagttcagcagcatcaacagcgacaagagcctgggggagaaggctgtggccttccgccacaccaaggaggacagcgcctctgtgaagagcctggacctgcccagcattggaggcagctctgtgggcaaggaggacagtgaagatgccctgtctgtgcagtttgacatgaagctggctgatgtgggcggggacctgaagcacgtgatgtctgacagcagcctggacctgcccaccgtgtctggccagcaccccccagctgctgctggcagcggcagccccagcgccaccagcatcctgcagaagaaggagaccagctttggcagcagcgagaacatcaccatgaccagcctgagcaaggtgaccacctttgtgtctgaagatgccctgcctgagaccaccttccctgccctggccagcttcaaggacaccatcccccagaccagcgagcagaaggagtatgaaaatagagactacaaggacttcaccaagcaggacctgcccacagctgagaggagccaggaggccacctgccccagccctgccagcagcggggccagccaggagaccccaaatgaatgttctgatgactttggagagttccagagcgagaagcccaagatcagcaagtttgacttcctggtggccaccagccagagcaagatgaagagcagcgaggagatgatcaagtctgagctggccacctttgacctgtctgtgcagggcagccacaagaggagcctgagcctgggggacaaggagatcagccgcagcagccccagccctgccctggagcagcccttccgggacaggagcaacaccctgaatgagaagccagccctgcccgtcatccgggacaagtacaaggacctgaccggggaggtggaggagaatgaaagatatgcctatgagtggcagcgctgcctgggcagcgccctgaatgtcatcaagaaggccaatgacaccctgaatggcatcagcagcagctctgtgtgcacagaggtgatccagagcgcccagggcatggagtacctgctgggcgtggtggaggtgtacagagtgaccaagagggtggagctgggcatcaaggccacagctgtgtgcagcgagaagctgcagcagctgctgaaggacatcgacaaggtgtggaacaacctgattggcttcatgagcctggccaccctgaccccagatgagaacagcctggacttcagcagctgcatgctgcggcccggcatcaagaatgcccaggagctggcctgtggggtgtgcctgctgaatgtggacagccgcagcaggaaggaggagaagccagctgaggagcaccccaagaaggccttcaacagcgagacagacagcttcaagctggcctacggcggccaccagtaccacgccagctgtgccaacttctggatcaactgtgtggagcccaagcccccaggcctggtgctgcctgacctgctgtag

SEQ ID NO: 19237 - DNA, 1257 bp, Artificial Sequence
  Description of Artificial Sequence: Synthetic coding sequence
atggagacccacatcagctgcctcttccctgagctgctggccatgatcttcggctacctggatgtgcgggacaagggccgggccgcccaggtgtgcacagcctggagagatgctgcctaccacaagtctgtgtggaggggcgtggaggccaagctgcacctgcggcgggccaaccccagcctcttccccagcctgcaggcccggggcatcagaagagtgcagatcctgagcctgcggcgcagcctgtcctatgtgatccagggcatggccaacatcgagagcctgaacctgagcggctgctacaacctgacagacaatggcctgggccacgcctttgtgcaggagatcggcagcctgcgggccctgaacctgagcctgtgcaagcagatcacagacagcagcctgggccgcatcgcccagtacctgaagggcctggaggtgctggagctgggcggctgcagcaacatcaccaacacaggcctgctgctgattgcctggggcctgcagaggctgaagagcctgaacctgcggagctgccgccacctgagtgatgtgggcatcggccacctggccggcatgaccaggtctgctgctgagggctgcctgggcctggagcagctgaccctgcaggactgccagaagctgacagacctgagcctgaagcacatcagccggggcctgaccggcctgcggctgctgaacctgtccttctgtggcggcatcagtgatgctggcctgctgcacctgagccacatgggcagcctgcggagcctgaacctgcggagctgtgacaacatcagtgacaccggcatcatgcacctggccatgggcagcctgcggctgagcggcctggatgtgtccttctgtgacaaggtgggggaccagagcctggcctacatcgcccagggcctggatggcctgaagagcctgagcctgtgcagctgccacatcagtgatgatggcatcaacaggatggtgcggcagatgcacggcctgcggaccctgaacatcggccagtgtgtgcgcatcacagacaagggcctggagctgattgctgagcacctgagccagctgactggaattgacctgtatggctgcacccgcatcaccaagaggggcctggagcgcatcacccagctgccctgcctgaaggtgctgaacctgggcctgtggcagatgacagacagcgagaaggaggcccggggggacttcagccccctcttcaccgtgaggacccggggcagcagcagaagatag

SEQ ID NO: 19238 - DNA, 1371 bp, Artificial Sequence
  Description of Artificial Sequence: Synthetic coding sequence
atggctgctgccctgaagtgcctgctgaccctgggccgctggtgccccggcctgggcgtggccccccaggcccgggccctggccgccctggtgcctggggtgacccaggtggacaacaagagcggcttcctgcagaagaggccccaccggcagcaccctggcatcctgaagctgccccacgtgcggctgccccaggccctggccaatggagcccagctgctgctgctgggcagcgctggccccaccatggagaaccaggtgcagaccctgaccagctacctgtggagccgccacctgcctgtggagcctgaggagctgcagaggcgggcccggcacctggagaagaagttcctggagaacccagacctgagccagacagaggagaagctgcggggagctgtgctgcacgccctgaggaagaccacctaccactggcaggagctgagctacacagagggcctgagcctggtgtacatggccgcccggctggatggcggctttgctgctgtgtcccgggccttccacgagatccgggccaggaacccagccttccagccccagaccctgatggactttggcagcggcaccggctctgtgacctgggccgcccacagcatctggggccagagcctgcgggagtacatgtgtgtggacagatctgctgccatgctggtgctggccgagaagctgctgaagggcggcagcgagagcggggagccctacatccctggggtcttcttccggcagttcctgcctgtgagccccaaggtgcagtttgatgtggtggtgtctgccttcagcctgtctgagctgcccagcaaggctgacagaacagaggtggtgcagaccctgtggaggaagacaggccacttcctggtgctggtggagaatggcaccaaggccggccacagcctgctgatggatgcccgggacctggtgctgaagggcaaggagaagagccccctggacccccggcccggctttgtgtttgccccctgcccccatgagctgccctgcccccagctgaccaacctggcctgcagcttcagccaggcctaccaccccatccccttctcctggaacaagaagcccaaggaggagaagttctccatggtgatcctggcccggggcagccctgaggaggcccaccgctggccccgcatcacccagcctgtgctgaagaggcccaggcatgtgcactgccacctgtgctgcccagatggccacatgcagcacgctgtgctgacagcccggcggcacggccgggacctgtaccgctgtgcccgggtgtcctcctggggagacctgctgcctgtgctgaccccatctgccttcccccccagcacagcccaggaccccagcgagagctag

SEQ ID NO: 19239 - DNA, 756 bp, Artificial Sequence
  Description of Artificial Sequence: Synthetic coding sequence
atggacatgaagaggcgcatccacctggagctgaggaacagaacaccagctgctgtgcgggagctggtgctggacaactgcaagagcaatgatggcaagattgagggcctgacagctgagtttgtgaacctggagttcctgagcctcatcaacgtgggcctcatctctgtgagcaacctgcccaagctgcccaagctgaagaagctggagctgtctgaaaatcgcatctttggaggcctggacatgctggccgagaagctgcccaacctgacccacctgaacctgagcggcaacaagctgaaggacatcagcaccctggagcccctgaagaagctggagtgcctgaagagcctggacctcttcaactgtgaggtgaccaacctgaatgactaccgggagagcgtcttcaagctgctgccccagctgacctacctggatggctatgaccgggaggaccaggaggccccagacagtgatgctgaggtggatggagtggatgaggaggaggaggatgaggagggagaagatgaggaggatgaagatgatgaagatggagaggaggaggagtttgatgaagaagatgatgaagatgaagatgtggagggagatgaagatgatgatgaggtgtctgaggaggaggaggagtttggcctggatgaagaagatgaagatgaagatgaagatgaggaggaggaggagggcggcaagggggagaagaggaagcgggagacagatgatgaaggagaagatgactag

SEQ ID NO: 19240 - DNA, 510 bp, Artificial Sequence
  Description of Artificial Sequence: Synthetic coding sequence
atgtctgcccccccagccctgcagatccgggaggccaatgcccacctggccgctgtgcacagaagagctgctgagctggaggcccggctggatgctgctgagaggacagtgcacgcccaggccgagcggctggccctgcatgaccagcagctgcgggccgccctggatgagctgggccgggccaaggaccgggagatcgccaccctgcaggagcagctgatgaccagcgaggccaccgtgcacagcctgcaggccaccgtgcaccagagagatgagctgatccggcagctgcagcccagggctgagctgctgcaggacatctgcagaagaagaccacccctggccggcctgctggatgccctggccgaggccgagcggctgggccccctgcctgccagtgaccccggccaccccccacctgggggccctggcccccccctggacaacagcactggagaggaggccgaccgggaccacctgcagcctgctgtgtttggcaccaccgtgtag

SEQ ID NO: 19241 - DNA, 2079 bp, Artificial Sequence
  Description of Artificial Sequence: Synthetic coding sequence
atgaagatcttctgcagccgggccaaccccaccaccggctctgtggagtggctggaggaggatgagcactatgactaccaccaggagatcgcccggagcagctatgctgacatgctgcatgacaaggacagaaatgtgaagtactaccagggcatccgggctgctgtgtcccgggtgaaggaccggggccagaaggccctggtgctggacattggaactggaacaggcctgctgtccatgatggctgtgacagctggagctgacttctgctacgccatcgaggtgttcaagcccatggctgatgctgctgtgaagatcgtggagaagaatggcttcagtgacaagatcaaggtgatcaacaagcacagcacagaggtgacagtgggccctgagggggacatgccctgccgggccaacatcctggtgacagagctgtttgacacagagctgattggagagggcgccctgcccagctatgaacatgcccaccgccacctggtggaggagaactgtgaggccgtgccccaccgggccaccgtgtatgcccagctggtggagagcggccgcatgtggagctggaacaagctgttccccatccacgtgcagaccagcctgggggagcaggtgattgtgccccctgtggatgtggagagctgccctggggcccccagcgtgtgtgacatccagctgaaccaggtgtccccagctgacttcaccgtgctgagtgatgtgctgcccatgttcagcattgacttcagcaagcaggtgagcagcagcgctgcctgccacagcagaagatttgagcccctgaccagcggccgggcccaggtggtgctgtcctggtgggacatcgagatggaccctgagggcaagatcaagtgcaccatggcccccttctgggcccacagcgaccctgaggagatgcagtggagggaccactggatgcagtgtgtgtacttcctgccccaggaggagcctgtggtgcagggcagcgccctgtacctggtggcccaccatgatgactactgtgtgtggtacagcctgcagaggaccagccctgagaagaatgaaagagtgcggcagatgaggcctgtgtgtgactgccaggcccacctgctgtggaaccggcccaggtttggagagatcaatgaccaggacagaacagacagatatgtgcaggccctgaggacagtgctgaagccagattctgtgtgcctgtgtgtgtctgatggcagcctgctgtctgtgctggcccaccacctgggcgtggagcaggtgttcaccgtggagagcagcgctgccagccacaagctgctgaggaagatcttcaaggccaaccacctggaggacaagatcaacatcatcgagaagaggcctgagctgctgaccaatgaagacctgcagggcaggaaggtgtccctgctgctgggggagcccttcttcaccaccagcctgctgccctggcacaacctgtacttctggtacgtgaggacagctgtggaccagcacctgggccctggggccatggtgatgccccaggccgccagcctgcatgctgtggtggtggagttccgggacctgtggaggatccgcagcccctgtggggactgtgagggctttgatgtgcacatcatggatgacatgatcaagagggccctggacttccgggagagccgggaggccgagccccaccccctgtgggagtacccctgccgcagcctgtctgagccctggcagatcctgacctttgacttccagcagcctgtgcccctgcagcccctgtgtgccgagggcaccgtggagctgcggcggcccggccagagccacgccgctgtgctgtggatggagtaccacctgaccccagagtgcaccctgagcacaggcctgctggagcctgctgaccctgagggcggctgctgctggaacccccactgcaagcaggccgtgtacttcttcagccctgccccagacccccgggccctgctgggcggccccaggacagtgtcctatgctgtggagttccacccagacaccggggacatcatcatggagttcagacatgctgacaccccagactag

SEQ ID NO: 19242 - DNA, 468 bp, Artificial Sequence
  Description of Artificial Sequence: Synthetic coding sequence
atgacagtggagggccccccacccaaggacacaggaattgcccgggtgcccctggccggggccgccggcggccctggcatcggccgggctgctggccggggcatcccagctggggtgcccatgccccaggccccagctggcctggccggccctgtgcggggcgtgggcggccccagccagcaggtgatgaccccccagggccggggcaccgtggccgctgctgctgctgctgccacagccagcattgctggggcccccacccagtacccacctggccggggcggccccccaccacccatgggccgcggggcccctcctcctggcatgatgggccccccacctggcatgaggcctcccatgggcccccccatgggcatccccccaggccggggcacccccatgggcatgcctcctcctggcatgaggcctcctcctcctggcatgaggggcaagtgcctgcagtggtag

SEQ ID NO: 19243 - DNA, 402 bp, Artificial Sequence
  Description of Artificial Sequence: Synthetic coding sequence
atgacccggggcaaccagcgggagctggcccggcagaagaacatgaagaagcagagcgacagcgtgaagggcaagagaagagatgatggcctgtctgctgctgccaggaagcagagcgcccccagcagcctgcccccaggcaccaggaggagctgcagccgcagcaggaagaggcagaccaggagaagaagaaaccccagcagctttgtggccagctgccccaccctgctgccctttgcctgtgtgcctggggccagccccaccaccctggccttcccccctgtggtgctgaccggccccagcacagatggcatcccctttgccctgagcctgcagagggtgccctttgtgctgcccagcccccaggtggccagcctgcccctgggccacagccggggctag

SEQ ID NO: 19244 - DNA, 1809 bp, Artificial Sequence
  Description of Artificial Sequence: Synthetic coding sequence
atggccgagttccgggtgcgggtgtccactggagaggccttcggggccggcacctgggacaaggtgtctgtgtccatcgtgggcaccagaggagagagcccccccctgcccctggacaacctgggcaaggagttcaccgctggagctgaggaggacttccaggtgaccctgcctgaagatgtgggccgggtgctgctgctgcgggtgcacaaggcccctcctgtgctgcccctgctgggccccctggccccagatgcctggttctgccgctggttccagctgaccccaccccggggcggccacctgctcttcccctgctaccagtggctggagggcgccggcaccctggtgctgcaggagggcacagccaaggtgtcctgggccgaccaccaccctgtgctgcagcagcagaggcaggaggagctgcaggcccggcaggagatgtaccagtggaaggcctacaaccctggctggccccactgcctggatgagaagacagtggaggacctggagctgaacatcaagtacagcacagccaagaatgccaacttctacctgcaggccggcagcgcctttgctgagatgaagatcaagggcctgctggacaggaagggcctgtggaggagcctgaatgagatgaagaggatcttcaacttccggaggaccccagctgctgagcacgcctttgagcactggcaggaggatgccttctttgccagccagttcctgaatggcctgaaccctgtgctgatccgccgctgccactacctgcccaagaacttccctgtgacagatgccatggtggcctctgtgctgggccctggcaccagcctgcaggccgagctggagaagggcagcctcttcctggtggaccacggcatcctgagcggcatccagaccaacgtcatcaacgggaagccccagttctctgctgcccccatgaccctgctgtaccagagccctggctgcggccccctgctgcccctggccatccagctgagccagaccccaggccccaacagccccatcttcctgcccacagatgacaagtgggactggctgctggccaagacctgggtgagaaatgctgagttctccttccacgaggccctgacccacctgctgcacagccacctgctgcctgaggtgttcaccctggccaccctgcggcagctgccccactgccaccccctcttcaagagcacaggcatcggcatcgagggcttcagcgagctgatccagaggaacatgaagcagctgaactacagcctgctgtgcctgcctgaggacatccgcacccggggcgtggaggacatccctggctactactacagagatgatggcatgcagatctggggcatccccagcagcctggagacccgggaggccctggtgcagtatgtgaccatggtgatcttcacctgcagcgccaagcacgccgctgtgtctgctggccagtttgacagctgtgcctggatgcccaacctgcccccatccatgcagctgcccccacccaccagcaagggcctggccacctgtgagggcttcatcgccaccctgccccctgtgaatgccacctgtgatgtgatcctggccctgtggctgctgagcaaggagcccggggaccagaggcccctgggcacctacccagatgagcacttcacagaggaggccccccggcgcagcatcgccaccttccagagccggctggcccagatcagccggggcatccaggagaggaaccagggcctggtgctgccctacacctacctggacccccccctgattgaaaattctgtgtccatctag

SEQ ID NO: 19245 - DNA, 3123 bp, Artificial Sequence
  Description of Artificial Sequence: Synthetic coding sequence
atggtgagcagcgcccagatgggcttcaacctgcaggccctgctggagcagctgagccaggatgagctgagcaagttcaagtacctgatcaccaccttcagcctggcccacgagctgcagaagatcccccacaaggaggtggacaaggcagatggcaagcagctggtggagatcctgaccacccactgtgacagctactgggtggagatggccagcctgcaggtgtttgagaagatgcacaggatggacctgtctgagcgggccaaggatgaggtgcgggaggccgccctgaagagcttcaacaagaggaagcccctgagcctgggcatcaccaggaaggagcggccccccctggatgtggatgagatgctggagcgcttcaagacagaggcccaggacaaggacaaccgctgccgctacatcctgaagaccaagttccgggagatgtggaagtcctggccaggggacagcaaggaggtgcaggtgatggccgagcgctacaagatgctgatccccttcagcaacccccgggtgctgcccggccccttctcctacacagtggtgctgtatggccctgctggcctgggcaagaccaccctggcccagaagctgatgctggactgggccgaggacaacctgatccacaagttcaagtatgccttctacctgagctgccgggagctgagccggctgggcccctgcagctttgctgagctggtgttccgggactggccagagctgcaggatgacatcccccacatcctggcccaggccaggaagatcctgtttgtgattgatggctttgatgagctgggcgccgcccctggggccctgattgaggacatctgtggggactgggagaagaagaagcctgtgcctgtgctgctgggcagcctgctgaacagagtgatgctgcccaaggccgccctgctggtgaccacccggccccgggccctgcgggacctgcgcatcctggccgaggagcccatctacatccgggtggagggcttcctggaggaggaccggcgggcctacttcctgcggcactttggagatgaggaccaggccatgagggcctttgagctgatgaggagcaatgctgccctcttccagctgggcagcgccccagctgtgtgctggatcgtgtgcaccaccctgaagctgcagatggagaagggggaggaccctgtgcccacctgcctgaccaggacaggcctcttcctgcgcttcctgtgcagccgcttcccccagggcgcccagctgcggggggccctgcggaccctgagcctgctggccgcccagggcctgtgggcccagacctctgtgctgcaccgggaggacctggagcggctgggcgtgcaggagagtgacctgcggctcttcctggatggagacatcctgcggcaggacagagtgtccaagggctgctacagcttcatccacctgtccttccagcagttcctgacagccctcttctacaccctggagaaggaggaggaggaggacagagatggccacacctgggacattggagatgtgcagaagctgctgagcggcgtggagcggctgaggaacccagacctgatccaggccggctactacagctttggcctggccaatgagaagagggccaaggagctggaggccaccttcggctgcaggatgagcccagacatcaagcaggagctgctgcgctgtgacatcagctgcaagggcggccacagcacagtgacagacctgcaggagctgctgggctgcctgtatgagagccaggaggaggagctggtgaaggaggtgatggcccagttcaaggagatcagcctgcacctgaatgctgtggatgtggtgcccagcagcttctgtgtgaagcactgcaggaacctgcagaagatgagcctgcaggtgatcaaggagaacctgcctgaaaatgtgacagccagcgagagtgatgctgaggtggagaggagccaggatgaccagcacatgctgcccttctggacagacctgtgcagcatcttcggcagcaacaaggacctgatgggcctggccatcaatgacagcttcctgagcgccagcctggtgcgcatcctgtgtgagcagatcgccagtgacacctgccacctgcagagggtggtgttcaagaacatcagccctgcagatgcccacaggaacctgtgcctggccctgcggggccacaagacagtgacctacctgaccctgcagggcaatgaccaggatgacatgtttcctgccctgtgtgaggtgctgcggcaccctgagtgcaacctgcgctacctgggcctggtgtcctgcagcgccaccacccagcagtgggccgacctgagcctggccctggaggtgaaccagagcctgacctgtgtgaacctgagtgacaatgagctgctggatgaaggagccaagctgctgtacaccaccctgcggcaccccaagtgcttcctgcagaggctgagcctggagaactgccacctgacagaggccaactgcaaggacctggccgctgtgctggtggtgtcccgggagctgacccacctgtgcctggccaagaaccccatcggcaacacaggagtgaagttcctgtgtgagggcctgcgctacccagagtgcaagctgcagaccctggtgctgtggaactgtgacatcaccagtgatggctgctgtgacctgaccaagctgctgcaggagaagagcagcctgctgtgcctggacctgggcctgaaccacatcggcgtgaagggcatgaagttcctgtgtgaggccctgaggaagcccctgtgcaacctgcgctgcctgtggctgtggggctgcagcatcccccccttcagctgtgaggacctgtgcagcgccctgagctgcaaccagagcctggtgaccctggacctgggccagaaccccctgggcagcagtggagtgaagatgctgtttgagaccctgacctgcagcagcggcaccctgcggaccctgcggctgaagattgatgacttcaatgatgagctgaacaagctgctggaggagattgaggagaagaacccccagctgatcatcgacacagagaagcaccacccctgggccgagcggcccagcagccatgacttcatgatctag

SEQ ID NO: 19246 - DNA, 3864 bp, Artificial Sequence
  Description of Artificial Sequence: Synthetic coding sequence
atggtgcctggagaggagaaccagctggtgcccaaggaggcccccctggaccacaccagtgacaagagcctgctggatgccaactttgagcccgggaagaagaacttcctgcacctgacagacaaggatggagagcagccccagatcctgctggaggacagcagcgctggggaggacagcgtgcatgaccgcttcatcggccccctgccccgggagggcagcggcggcagcaccagtgactatgtgtcccagagctacagctacagcagcatcctgaacaagtcagaaacaggctacgtgggcctggtgaaccaggccatgacctgctacctgaacagcctgctgcagaccctcttcatgaccccagagttcagaaatgccctgtacaagtgggagtttgaggagagcgaggaggaccctgtgaccagcatcccctaccagctgcagaggctgtttgtgctgctgcagaccagcaagaagagggccatcgagaccacagatgtgaccaggagctttggctgggacagcagcgaggcctggcagcagcatgatgtgcaggagctgtgccgggtgatgtttgatgccctggagcagaagtggaagcagacagagcaggccgacctgatcaatgagctgtaccagggcaagctgaaggactatgtgcgctgcctggagtgtggctatgagggctggagaattgacacctacctggacatccccctggtgatccggccctacggcagcagccaggcctttgcctctgtggaggaggccctgcacgccttcatccagcctgagatcctggatggccccaaccagtacttctgtgagcgctgcaagaagaagtgtgatgccaggaagggcctgcgcttcctgcacttcccctacctgctgaccctgcagctgaagagatttgattttgactacaccaccatgcaccgcatcaagctgaatgacaggatgaccttccctgaggagctggacatgagcaccttcattgatgtggaggatgagaagagcccccagacagagagctgcacagattctggagcagaaaatgaaggcagctgccacagcgaccagatgagcaatgacttcagcaatgatgatggagtggatgagggcatctgcctggagaccaacagcggcacagagaagatcagcaagagcggcctggagaagaacagcctcatctatgagctgttctctgtgatggtgcacagcggcagcgctgctgggggccactactatgcctgcatcaagagcttcagtgatgagcagtggtacagcttcaatgaccagcacgtgagccgcatcacccaggaggacatcaagaagacccacggcggcagcagcggcagccggggctactacagcagcgcctttgccagcagcaccaatgcctacatgctgatctaccgcctgaaggaccctgccagaaatgccaagttcctggaggtggatgagtacccagagcacatcaagaacctggtgcagaaggagcgggagctggaggagcaggagaagaggcagcgggagattgaaagaaacacctgcaagatcaagctgttctgcctgcaccccaccaagcaggtgatgatggagaacaagctggaggtgcacaaggacaagaccctgaaggaggccgtggagatggcctacaagatgatggacctggaggaggtgatccccctggactgctgccgcctggtgaagtatgatgagttccatgactacctggagaggagctatgaaggagaggaggacacccccatgggcctgctgctgggcggcgtgaagagcacctacatgtttgacctgctgctggagaccaggaagccagaccaggtgttccagagctacaagccaggagaggtgatggtgaaggtgcacgtggtggacctgaaggccgagagcgtggccgcccccatcaccgtgcgggcctacctgaaccagacagtgacagagttcaagcagctgatcagcaaggccatccacctgcctgctgagaccatgagaattgtgctggagcgctgctacaatgacctgcggctgctgtctgtgagcagcaagaccctgaaggccgagggcttcttccgcagcaacaaggtgtttgtggagagcagcgagaccctggactaccagatggcctttgctgacagccacctgtggaagctgctggacagacatgccaacaccatccggctgtttgtgctgctgcctgagcagagccctgtgtcctacagcaagaggacagcctaccagaaggccggcggggacagcggaaatgtggatgatgactgtgagcgggtgaagggccctgtgggcagcctgaagtctgtggaggccatcctggaggagagcacagagaagctgaagagcctgagcctgcagcagcagcaggatggagacaatggagacagcagcaagagcacagagaccagtgactttgagaacatcgagagccccctgaatgaaagagacagcagcgcctctgtggacaaccgggagctggagcagcacatccagaccagtgaccctgagaacttccagagcgaggagaggagtgacagtgatgtgaacaatgacaggagcaccagctctgtggacagcgacatcctgagcagcagccacagcagtgacaccctgtgcaatgctgacaatgcccagatccccctggccaacggcctggacagccacagcatcaccagcagcaggaggaccaaggccaatgaaggcaagaaggagacctgggacacagcagaagaagattctggaacagattctgaatatgatgagagcggcaagagcagaggagagatgcagtacatgtacttcaaggccgagccctatgctgctgatgagggcagcggggagggccacaagtggctgatggtgcacgtggacaagaggatcaccctggccgccttcaagcagcacctggagccctttgtgggcgtgctgagcagccacttcaaggtgttccgggtgtatgccagcaaccaggagtttgagagcgtgcggctgaatgagaccctgagcagcttcagtgatgacaacaagatcaccatccggctgggccgggccctgaagaagggggagtacagagtgaaggtgtaccagctgctggtgaatgagcaggagccctgcaagttcctgctggatgctgtgtttgccaagggcatgacagtgcggcagagcaaggaggagctgatcccccagctgcgggagcagtgtggcctggagctgagcattgaccgcttccggctgaggaagaagacctggaagaaccctggcaccgtcttcctggactaccacatctatgaggaggacatcaacatcagcagcaactgggaggtgttcctggaggtgctggatggagtggagaagatgaagtccatgagccagctggccgtgctgagccgccgctggaagcccagcgagatgaagctggaccccttccaggaggtggtgctggagagcagctctgtggatgagctgcgggagaagctgtctgagatcagcggcatccccctggatgacatcgagtttgccaagggccggggcaccttcccctgtgacatctctgtgctggacatccaccaggacctggactggaaccccaaggtgtccaccctgaatgtgtggcccctgtacatctgtgatgatggagctgtgatcttctacagagacaagacagaggagctgatggagctgacagatgagcagagaaatgagctgatgaagaaggagagcagccggctgcagaagacaggccaccgggtgacctacagccccaggaaggagaaggccctgaagatctacctggatggagcccccaacaaggacctgacccaggactag

SEQ ID NO: 19247 - DNA, 420 bp, Artificial Sequence
  Description of Artificial Sequence: Synthetic coding sequence
atgccctggagggctggaaatggagtgggcctggaggcccaggccggcacccaggaggccggccctgaggagtactgccaggaggagctgggcgctgaggaggagatggccgcccgggccgcctggcctgtgctgcggtctgtgaacagccgggagctgagccgcatcatcatctgcaaccacagccccagaattgtgctgcctgtgtggctgaactactacggcaagctgctgccctacctgaccctgctgcccggccgggacttccgcatccacaacttccgcagccacccctggctgttcagagatgcccggacccatgacaagctgctggtgaaccagacagagctgtttgtgcccagcagcaatgtgaatggccagcctgtgtttgccaacatcaccctgcagtgcatcccctag

SEQ ID NO: 19248 - DNA, 582 bp, Artificial Sequence
  Description of Artificial Sequence: Synthetic coding sequence
atggagggctgtgtgagcaacctgatggtgtgcaacctggcctacagcggcaagctggaggagctgaaggagagcatcctggccgacaagagcctggccaccaggacagaccaggccggctggagccccctgcacatcgccgccagcgctggaagagatgaaattgtgaaggccctgctgggcaagggggcccaggtgaatgctgtgaaccagaatggctgcacccccctgcactacgccgccagcaagaacagacatgaaattgctgtgatgctgctggagggcggggccaacccagatgccaaggaccactatgaggccacagccatgcacagagctgctgccaagggcaacctgaagatgatccacatcctgctgtactacaaggccagcaccaacatccaggacacagagggcaacacccccctgcacctggcctgtgatgaggagcgggtggaggaggccaagctgctggtgtcccagggcgccagcatctacatcgagaacaaggaggagaagacccccctgcaggtggccaagggcggcctgggcctcatcctgaagaggatggtggagggctag

SEQ ID NO: 19249 - DNA, 612 bp, Artificial Sequence
  Description of Artificial Sequence: Synthetic coding sequence
atgtctgaaaatgctgcccctggcctcatcagcgagctgaagctggccgtgccctggggccacatcgccgccaaggcctggggcagcctgcagggcccccctgtgctgtgcctgcacggctggctggacaatgccagcagctttgacaggctcatccccctgctgccccaggacttctactacgtggccatggactttggaggccacggcctgagcagccactacagccctggggtgccctactacctgcagacctttgtgtctgagatcagaagagtggtggccgccctgaagtggaaccgcttcagcatcctgggccacagctttggaggagtggtgggcggcatgttcttctgcaccttccctgagatggtggacaagctgatcctgctggacacccccctcttcctgctggagagtgatgagatggagaacctgctgacctacaagagaagagccatcgagcacgtgctgcaggtggaggccagccaggagcccagccacgtgttcagcctgaagcagctgctgcagaggcagaggacagccctgaccagcagcgctggcagctgtgtgcgcatccccagcggcagctgccggcccatgagctgctag

SEQ ID NO: 19250 - DNA, 765 bp, Artificial Sequence
  Description of Artificial Sequence: Synthetic coding sequence
atgcctgctggctccatgagcaccaccggctacccaggagtgtgcagcaccaccagctaccgcacccactgctacatccctgtgaccagctctgtgaccctgagcagcagtgacctgagccccaccttcggccactgcctgcccagcagctaccagggcaacctgtggctgctggactactgccaggagagctatggagaggcccccacctgcaagagccccagctgtgagcccaagacctgcagcaccaccggctgtgaccccagcaacagctctgtgccctgcaacagccccagcgctggccaggtgttttctgtgtgtgagaccaccaacgtgagccccagccccagctgcagccccagcacccagaccaacggctacgtgtgcaactgccacatccccaccagaaatgccagcaaggcctgccagaccctgagaaatggcagcaactgcttcggccagctgaactgcctgagcaagagcttccagaccctgaaccactgccgcctgagcaccctgggctacaagagctaccagaacccctgcttcatccccagctatgtgagccccctgtgctacatcagcaacagctgccagccccagagctacctggtgaggaactaccactacagcagctaccggcccaccagctgccggcccctgagctacctgagccgctccttccgcagcctgagctacatccccagcaccttcccccccctgcgctacctgtgcagcggcagccggcccctgaagtgctactag

SEQ ID NO: 19251 - DNA, 1338 bp, Artificial Sequence
  Description of Artificial Sequence: Synthetic coding sequence
atgagggagatcgtgcacctgcaggccggccagtgtggcaaccagatcggggccaagttctgggaggtgatcagtgatgagcacggcatcgaccccaccggcacctaccatggagacagcgacctgcagctggagcgcatcaacgtgtactacaatgaggccactggaggcaagtatgtgcccagggctgtgctggtggacctggagcccggcaccatggattctgtgcgcagcggccccttcggccagatcttccggccagacaactttgtgtttggccagagcggggccggcaacaactgggccaagggccactacacagaaggagctgagctggtggacagcgtgctggatgtggtgaggaaggaggccgagagctgtgactgcctgcagggcttccagctgacccacagcctgggcggcggcactggaagtggcatgggcaccctgctgatcagcaagatccgggaggagtacccagaccgcatcatgaacaccttctctgtggtgcccagccccaaggtgtctgacacagtggtggagccctacaatgccaccctgtctgtgcaccagctggtggagaacacagatgagacctactgcatcgacaatgaggccctgtatgacatctgcttccgcaccctgaagctgaccacccccacctacggggacctgaaccacctggtgtctgccaccatgtctggagtgaccacctgcctgcgcttccctggccagctgaatgctgacctgaggaagctggccgtgaacatggtgcccttcccccggctgcacttcttcatgcctggctttgcccccctgaccagccggggcagccagcagtaccgggccctgactgtgcctgagctgacccagcagatgtttgatgccaagaacatgatggccgcctgtgaccccaggcatggccgctacctgactgtggccgctgtgttccggggccgcatgtccatgaaggaggtggatgagcagatgctgaatgtgcagaacaagaacagcagctactttgtggagtggatccccaacaacgtgaagacagctgtgtgtgacatccccccccggggcctgaagatgtctgccaccttcatcggcaacagcacagccatccaggagctgttcaagaggatcagcgagcagttcaccgccatgttccggaggaaggccttcctgcactggtacacaggagagggcatggatgagatggagttcacagaagctgagagcaacatgaatgacctggtgtctgagtaccagcagtaccaggatgccacagctgaggaggagggggagtttgaggaggaggccgaggaggaggtggcctag

SEQ ID NO: 19252 - DNA, 750 bp, Artificial Sequence
  Description of Artificial Sequence: Synthetic coding sequence
atggccgagcggggggagctggacctgaccggggccaagcagaacacaggagtgtggctggtgaaggtgcccaagtacctgagccagcagtgggccaaggccagcggccgcggggaggtgggcaagctgagaattgccaagacccagggccgcacagaggtgtccttcaccctgaatgaagacctggccaacatccatgacatcggcggcaagccagcctctgtgtctgccccccgggagcacccctttgtgctgcagagcgtgggcggccagaccctgaccgtcttcacagagagcagcagtgacaagctgagcctggagggcatcgtggtgcagagagcagaatgtagacctgctgccagcgagaactacatgaggctgaagaggctgcagatcgaggagagcagcaagcctgtgcggctgagccagcagctggacaaggtggtgaccaccaactacaagcctgtggccaaccaccagtacaacattgaatatgaaaggaagaagaaggaggatggcaagagggcccgggctgacaagcagcacgtgctggacatgctgttcagcgcctttgagaagcaccagtactacaacctgaaggacctggtggacatcaccaagcagcctgtggtgtacctgaaggagatcctgaaggagattggagtgcagaatgtgaagggcatccacaagaacacctgggagctgaagccagagtaccgccactaccagggcgaggagaagagtgactag

SEQ ID NO: 19253 - DNA, 2511 bp, Artificial Sequence
  Description of Artificial Sequence: Synthetic coding sequence
atgtggagcctgggctgtgtgattgctgagctgttcctgggctggcccctgtacccaggggcctctgaatatgaccagatccgctacatcagccagacccagggcctgcctgctgagtacctgctgtctgctggcaccaagaccacccgcttcttcaacagagaccccaacctgggctaccccctgtggaggctgaagaccccagaggagcacgagctggagaccggcatcaagagcaaggaggccaggaagtacatcttcaactgcctggatgacatggcccaggtgaacatgagcacagacctggagggcacagacatgctggccgagaaggctgaccggcgggagtacatcgacctgctgaagaagatgctgaccattgatgctgacaagaggatcacccccctgaagaccctgaaccaccagtttgtgaccatgacccacctgctggacttcccccacagcaaccacgtgaagagctgcttccagaacatggagatctgcaagagaagagtgcacatgtatgacacagtgtcccagatcaagagccccttcaccacccacgtggcccccaacaccagcaccaacctgaccatgtccttcagcaaccagctgaacacagtgcacaaccaggcctctgtgctggccagcagcagcacagctgctgctgccaccctgagcctggccaacagtgatgtgtccctgctgaactaccagagcgccctgtaccccagcagcgctgcccctgtgcctggggtggcccagcagggcgtgtccctgcagcccggcaccacccagatctgcacccagacagaccccttccagcagaccttcatcgtgtgccccccagccttccagacaggcctgcaggccaccaccaagcacagcggcttccctgtgaggatggacaatgctgtgcccatcgtgccccaggccccagctgcccagcccctgcagatccagagcggcgtgctgacccagggcagctgcacccccctgatggtggccaccctgcacccccaggtggccaccatcaccccccagtatgctgtgcccttcaccctgagctgtgccgccggccggcctgccctggtggagcagacagctgctgtgctgcaggcctggccaggcggcacccagcagatcctgctgcccagcacctggcagcagctgcccggggtggccctgcacaacagcgtgcagcccacagccatgatccctgaggccatgggcagcggccagcagctggccgactggagaaatgcccacagccacggcaaccagtacagcaccatcatgcagcagcccagcctgctgaccaaccacgtgaccctggccacagcccagcccctgaatgtgggcgtggcccacgtggtgcggcagcagcagagcagcagcctgcccagcaagaagaacaagcagagcgcccctgtgagcagcaagagcagcctggatgtgctgcccagccaggtgtacagcctggtgggcagcagccccctgcggaccaccagcagctacaacagcctggtgcctgtgcaggaccagcaccagcccatcatcatcccagacacccccagcccccctgtgtctgtcatcaccatccgcagtgacacagatgaggaggaggacaacaagtacaagcccagcagcagcggcctgaagcccaggagcaatgtcatctcctatgtgacagtgaatgacagcccagacagcgacagcagcctgagcagcccctacagcacagacaccctgagcgccctgcggggcaacagcggctctgtgctggagggccctggccgggtggtggctgatggcaccggcaccaggaccatcatcgtgccccccctgaagacccagctgggggactgcaccgtggccacccaggccagcggcctgctgagcaacaagaccaagcctgtggcctctgtgtctggccagagcagcggctgctgcatcacccccaccggctaccgggcccagaggggcggcaccagcgctgcccagcccctgaacctgagccagaaccagcagagcagcgctgcccccaccagccaggagaggagcagcaacccagccccccggcggcagcaggcctttgtggcccccctgagccaggccccctacaccttccagcacggcagccccctgcacagcacaggccacccccacctggccccagccccagcccacctgcccagccaggcccacctgtacacctatgctgcccccaccagcgctgctgccctgggcagcaccagcagcatcgcccacctgttcagcccccagggcagcagcagacatgctgctgcctacaccacccaccccagcaccctggtgcaccaggtgcctgtgtctgtgggccccagcctgctgaccagcgcctctgtggccccagcccagtaccagcaccagtttgccacccagagctacatcggcagcagccggggcagcaccatctacacaggctaccccctgagccccaccaagatcagccagtacagctacctgtag

SEQ ID NO: 19254 - DNA, 2352 bp, Artificial Sequence
  Description of Artificial Sequence: Synthetic coding sequence
atgagccaggtgaagagcagctacagctatgatgcccccagcgacttcatcaacttcagcagcctggatgatgaaggagacacccagaacatcgacagctggtttgaggagaaggccaacctggagaacaagctgctgggcaagaatggaactggaggcctcttccagggcaagacccccctgaggaaggccaacctgcagcaggccatcgtgacccccctgaagcctgtggacaacacctactacaaggaggccgagaaggagaacctggtggagcagagcatccccagcaatgcctgcagcagcctggaggtggaggccgccatcagcaggaagaccccagcccagccccagaggaggagcctgcggctgagcgcccagaaggacctggagcagaaggagaagcaccacgtgaagatgaaggccaagagatgtgccacccctgtgatcattgatgagatcctgcccagcaagaagatgaaggtgagcaacaacaagaagaagccagaggaggagggcagcgcccaccaggacacagctgagaagaatgccagcagccctgagaaggccaagggccgccacacagtgccctgcatgcccccagccaagcagaagttcctgaagagcacagaggagcaggagctggagaagtccatgaagatgcagcaggaggtggtggagatgaggaagaagaatgaggagttcaagaagctggccctggccggcatcggccagcctgtgaagaagtctgtgtcccaggtgaccaagtctgtggacttccacttcagaacagatgagcgcatcaagcagcaccccaagaaccaggaggagtacaaggaggtgaacttcaccagcgagctgaggaagcaccccagcagccctgcccgggtgaccaagggctgcaccatcgtgaagcccttcaacctgagccagggcaagaagaggacctttgatgagaccgtgtccacctacgtgcccctggcccagcaggtggaggacttccacaagaggacccccaaccgctaccacctgcggagcaagaaggatgacatcaagacaggcagctgcagcgtgacccaggccggcgtgcagtggagggaccacggcagcctgcagtgccccaccccaggcctgaagcagagcagctgcctgagcctgcccaacctgctgcccagcaagagctctgtgaccaagatctgccgggacccccagacccctgtgctgcagaccaagcaccgggcccgggctgtgacctgcaagagcacagctgagctggaggccgaggagctggagaagctgcagcagtacaagttcaaggcccgggagctggacccccgcatcctggagggcggccccatcctgcccaagaagccccctgtgaagccacccacagagcccatcggctttgacctggagattgagaagaggatccaggagcgggagagcaagaagaagacagaagatgagcactttgagttccacagccggccctgccccaccaagatcctggaggatgtggtgggcgtgcctgagaagaaggtgctgcccatcaccgtgcccaagagccctgcctttgccctgaagaaccgcatccgcatgcccaccaaggaggatgaggaggaggatgagcctgtggtgatcaaggcccagcctgtgccccactatggagtgcccttcaagccccagatccctgaggccaggacagtggagatctgccccttctcctttgacagccgggacaaggagcggcagctgcagaaggagaagaagatcaaggagctgcagaagggggaggtgcccaagttcaaggccctgcccctgccccactttgacaccatcaacctgcctgagaagaaggtgaagaatgtgacccagatcgagcccttctgcctggagacagacagaagaggagccctgaaggcccagacctggaagcaccagctggaggaggagctgcggcagcagaaggaggccgcctgcttcaaggcccggcccaacacagtcatcagccaggagccctttgtgcccaagaaggagaagaagtctgtggccgagggcctgagcggcagcctggtgcaggagcccttccagctggccacagagaagagggccaaggagcggcaggagctggagaagaggatggccgaggtggaggcccagaaggcccagcagctggaggaggcccggctgcaggaggaggagcagaagaaggaggagctggcccggctgcggcgggagctggtgcacaaggccaaccccatcaggaagtaccagggcctggagatcaagagcagtgaccagcccctgactgtgcctgtgagccccaagttcagcacccgcttccactgctag

SEQ ID NO: 19255 - DNA, 2061 bp, Artificial Sequence
  Description of Artificial Sequence: Synthetic coding sequence
atgggcagctacctgtctgtgcctgcctacttcaccagccgggacctcttccgctgcagcgagtgccaggacagcctgaccaactggtactatgagaaggatggcaagctgtactgccccaaggactactggggcaagtttggagagttctgccacggctgcagcctgctgatgacaggccccttcatggtggccggggagttcaagtaccacccagaatgttttgcctgcatgagctgcaaggtgatcattgaagatggagatgcctatgccctggtgcagcacgccaccctgtactgtgggaagtgccacaatgaggtggtgctggcccccatgtttgagcggctgagcacagagagcgtgcaggagcagctgccctacagcgtgaccctcatctccatgcctgccaccacagagggcagaagaggcttctctgtgtctgtggagagcgcctgcagcaactatgccaccaccgtgcaggtgaaggaggtgaacaggatgcacatcagccccaacaacagaaatgccatccaccctggggaccgcatcctggagatcaatggcacccctgtgaggaccctgcgggtggaggaggtggaggatgccatcagccagaccagccagaccctgcagctgctgattgaacatgaccctgtgtcccagaggctggaccagctgcggctggaggcccggctggccccccacatgcagaatgccggccacccccacgccctgagcaccctggacaccaaggagaacctggagggcaccctgcggcggcgcagcctgcggcgcagcaacagcatcagcaagagccctggccccagcagccccaaggagcccctgctcttcagccgggacatcagccgctctgagagcctgcgctgcagcagcagctacagccagcagatcttccggccctgtgacctgatccacggggaggtgctgggcaagggcttcttcggccaggccatcaaggtgacccacaaggccaccgggaaggtgatggtgatgaaggagctgatccgctgtgatgaggagacccagaagaccttcctgacagaggtgaaggtgatgaggagcctggaccaccccaacgtgctgaagttcatcggcgtgctgtacaaggacaagaagctgaacctgctgacagagtacattgaaggaggcaccctgaaggacttcctgcgctccatggaccccttcccctggcagcagaaggtgcgctttgccaagggcatcgccagcggcatggcctacctgcacagcatgtgcatcatccaccgggacctgaacagccacaactgcctgatcaagctggacaagacagtggtggtggccgactttggcctgagccggctgattgtggaggagaggaagagggcccccatggagaaggccaccaccaagaagaggaccctgaggaagaatgacaggaagaagcgctacacagtggtgggcaacccctactggatggcccctgagatgctgaatggcaagagctatgatgaaacagtggacatcttctcctttggaattgtgctgtgtgagatcatcggccaggtgtatgctgaccctgactgcctgcccaggaccctggactttggcctgaatgtgaagctgttctgggagaagtttgtgcccacagactgccccccagccttcttccccctggccgccatctgctgccgcctggagcctgagagccgggcccctcctggagctgctggggagggccctggctgtgctgatgatgagggccctgtgcggcggcagggcaaggtgaccatcaagtatgaccccaaggagctgaggaagcacctgaacctggaggagtggatcctggagcagctgacccggctgtatgactgccaggaggaggagatcagcgagctggagattgatgtggatgagctgctggacatggagagtgatgatgcctgggccagccgggtgaaggagctgctggtggactgctacaagcccacagaggccttcatcagcggcctgctggacaagatccgggccatgcagaagctgagcaccccccagaagaagtag

SEQ ID NO: 19256 - DNA, 840 bp, Artificial Sequence
  Description of Artificial Sequence: Synthetic coding sequence
atgagggccctgactgtgcagagggtgaagtttgccatggacctgcccctgctgaagagagctggccaggacctggccgagaagaccaagaactttgtgagccgcagcctggtgattggagaggtgctgtccatggctgacatggccaccggggtgaagtgtggcatcatctactggctgtttggaggagccatccggaacctgggcagccctgagcacgtgaccaagtggttccagcccctgcaggagcagaagtacacaggcatgtttgccatgacagagcggggccacggcagcaatgcccggggcatccagacagaggccacctttgacctgagcgcccaggagtttgtgattgacaccccctgtgaaaatgctgagaagatgtacatcggaaatgccatgtatggcaactatgctgctgtgtttgcccagctgatcattgatggccgcagccagggcccccactgcttcatcgtgcctgtgagagatgaaaatggcagcctgtacccaggagtgacagccatcgacatgatgtacaaggagggcctgcatggagtggacaatggcatcctgatctttgacaaggtgcgcatcccccgggagaacctgctggacaagtttggatctgtggccccagatggccagtaccacagccccatccggaacaagagcgcccgcttcaatgccatgctggccgccctgacccccagccggctggccgtggccttccaggccatgggcgccatgaagctgggcctgaccatcgccatccgctacagccacaggagccgcatcatcagccagaactgctgcagcgccccagctggcctgtactag

SEQ ID NO: 19257 - DNA, 597 bp, Artificial Sequence
  Description of Artificial Sequence: Synthetic coding sequence
atgaccctgcgctgcctggagcccagcggaaatggaggagagggcaccaggagccagtggggcacagctggcagcgctgaggagcccagcccccaggccgcccggctggccaaggccctgcgggagctgggccagacaggctggtactggggctccatgacagtgaatgaggccaaggagaagctgaaggaggcccctgagggcaccttcctgatccgggacagcagccacagcgactacctgctgaccatctctgtgaagaccagcgctggccccaccaacctgagaattgagtaccaggacggcaagttccggctggacagcatcatctgtgtgaagagcaagctgaagcagtttgattctgtggtgcacctgattgactactacgtgcagatgtgcaaggacaagaggacaggccctgaggcccccagaaatggaacagtgcacctgtacctgaccaagcccctgtacaccagcgcccccagcctgcagcacctgtgccgcctgaccatcaacaagtgcacaggagccatctggggcctgcccctgcccacccggctgaaggactacctggaggagtacaagttccaggtgtag

SEQ ID NO: 19258 - DNA, 570 bp, Artificial Sequence
  Description of Artificial Sequence: Synthetic coding sequence
atggaggctgatggagatggagaggagctggcccggctgcggtctgtgtttgctgcctgtgatgccaacagaagtggccgcctggagcgggaggagttccgggccctgtgcacagagctgcgggtgcggccagcagatgctgaggccgtgttccagaggctggatgctgacagagatggagccatcaccttccaggagtttgcccggggcttcctgggcagcctgcggggcggcagaagaagagactggggccccctggaccctgccccagctgtgtctgaggccggccctgagacccatgacagcgaggaggatgaaggagatgaagatgctgctgctgccctggccaccagctgtggccctgccagccctggccgggcctggcaggacttccaggcccggctgggagatgaggccaagttcatccccaggtttggctacaccatcagcaagccagcctttgtgtttgtgcgccacctgatcaccctgtgtgccctgtcctgggccaagaaggagggccgggagaccctgtggaccatcgaggagggcggggccaagatggccgagtag

SEQ ID NO: 19259 - DNA, 300 bp, Artificial Sequence
  Description of Artificial Sequence: Synthetic coding sequence
gccctggatgtggccgtgaagaccttccccccagagcggcacgtggccgtgaagtgcttcggcaagaagaaggagaagaagaacaatgccaacagccctgcctctgtgagcaaccccaccgtgaccaagcacgccttcggcatggaggaggagctgcagcgggagggcagcattgagaccctgagcaacagcagcggcagcaccagcggcagcatccccaggaactttgatggctaccgcagccccctgcccaccaatgaaagccagcccctgagcctcttccccaccggcttcccctag

SEQ ID NO: 19260 - DNA, 1170 bp, Artificial Sequence
  Description of Artificial Sequence: Synthetic coding sequence
atggagaggaaggactttgagacctggctggacaacatctctgtgaccttcctgagcctgacagacctgcagaagaatgagaccctggaccacctgatcagcctgagcggggctgtgcagctgcggcacctgagcaacaacctggagaccctgctgaagagggacttcctgaagctgctgcccctggagctgtccttctacctgctgaagtggctggacccccagaccctgctgacctgctgcctggtgtccaagcagtggaacaaggtgatcagcgcctgcacagaggtgtggcagacagcctgcaagaacctgggctggcagattgatgacagcgtgcaggatgccctgcactggaagaaggtgtacctgaaggccatcctgaggatgaagcagctggaggaccacgaggcctttgagaccagcagcctgattggccacagcgcccgggtgtatgccctgtactacaaggatggcctgctgtgcaccgtcttctctgtggactacaatgatgagctggacatcctggtgtctggcagcgctgacttcaccgtgaaggtgtgggccctgtctgctggcacctgcctgaacaccctgaccggccacacagagtgggtgaccaaggtggtgctgcagaagtgcaaggtgaagagcctgctgcacagccctggggactacatcctgctgtctgctgacaagtatgagatcaagatctggcccatcggccgggagatcaactgcaagtgcctgaagaccctgtctgtgtctgaagatagaagcatctgcctgcagccccggctgcactttgatggcaagtacatcgtgtgcagcagcgccctgggcctgtaccagtgggactttgccagctatgacatcctgcgggtcatcaagaccccagaaattgccaacctggccctgctgggctttggagacatctttgccctgctgtttgacaaccgctacctgtacatcatggacctgaggacagagagcctcatcagccgctggcccctgcctgagtacaggaagagcaagaggggcagcagcttcctggccggggaggcctcctggctgaatggcctggatggccacaatgacaccggcctggtgtttgccacctccatgccagaccacagcatccacctggtgctgtggaaggagcacggctag

SEQ ID NO: 19261 - DNA, 2439 bp, Artificial Sequence
  Description of Artificial Sequence: Synthetic coding sequence
atgaagaagcagttcaacaggatgaggcagctggccaaccagacagtgggccgggcagagaagacagaggtgctgtctgaggacctgctgcaggtggagaagaggctggagctggtgaagcaggtgagccacagcacccacaagaagctgacagcctgcctgcagggccagcagggcgctgaggccgacaagaggagcaagaagctgcccctgaccaccctggcccagtgcctgatggagggcagcgccatcctgggagatgacaccctgctgggcaagatgctgaagctgtgtggggagacagaggacaagctggcccaggagctgatccactttgagctgcaggtggagagagatgtgattgagcccctcttcctgctggccgaggtggagatccccaacatccagaagcagaggaagcacctggccaagctggtgctggacatggacagcagcaggacccgctggcagcagaccagcaagagcagcggcctgagcagcagcctgcagcctgctggggccaaggcagatgccctgcgggaggagatggaggaggccgccaacagagtggagatctgccgggaccagctgtctgctgacatgtacagctttgtggccaaggagattgattatgccaactacttccagaccctgattgaggtgcaggccgagtaccacaggaagagcctgaccctgctgcaggccgtgctgccccagatcaaggcccagcaggaggcctgggtggagaagcccagctttgggaagcccctggaggagcacctgaccatcagcggccgggagatcgccttccccatcgaggcctgtgtgaccatgctgctggagtgtggcatgcaggaggagggcctcttccgggtggcccccagcgccagcaagctgaagaagctgaaggccgccctggactgctgcgtggtggatgtgcaggagtacagcgctgacccccacgccatcgccggggccctgaagagctacctgcgggagctgcctgagcccctgatgacctttgagctgtatgatgagtggatccaggccagcaatgtgcaggagcaggacaagaagctgcaggccctgtggaatgcctgtgagaagctgcccaaggccaaccacaacaacatccgctacctgatcaagttcctgagcaagctgtctgagtaccaggatgtgaacaagatgacccccagcaacatggccatcgtgctgggccccaacctgctgtggccccaggccgagggcaacatcacagagatgatgaccaccgtgtccctgcagatcgtgggcatcatcgagcccatcatccagcacgccgactggttcttccctggagaaattgagttcaacatcaccggcaactacggcagccctgtgcacgtgaaccacaatgccaactacagctccatgcccagcccagacatggaccctgctgaccggcggcagcctgagcaggcccggcggcccctgtctgtggccacagacaacatgatgctggagttctacaagaaggatggcatgggcgtgcgggtgatggacaccaactgggtggcccggcggggcagcagcgctggcaggaaggtgtcctgtgccccacccagcatgcagcccccagcccccccagctgagctggccgcccccctgcccagccccctgcctgagcagcccctggacagccctgctgccccagccctgagccccagcggcctgggcctgcagcccggccctgagaggaccagcaccaccaagagcaaggagctgagccctggcagcgcccagaagggcagccctggcagcagccagggcacagcctgtgccggcacccagcccggggcccagcccggggcccagcccggggccagccccagccccagccagcccccagctgaccagagcccccacaccctgaggaaggtgtccaagaagctggcccccatcccccccaaggtgcccttcggccagcccggggccatggctgaccagagcgctggccagcccagccctgtgtccctgagccccaccccacccagcacccccagcccctacggcctgagctacccccagggctacagcctggccagcggccagctgagccctgctgctgccccacccctggccagccccagcgtcttcaccagcaccctgagcaagagccggcccacccccaagccccggcagaggcccaccctgcccccaccccagcccccaacagtgaacctgagcgccagcagcccccagagcacagaggcccccatgctggatggcatgagccctggagagagcatgagcacagacctggtgcactttgacatccccagcatccacatcgagctgggcagcaccctgcggctgagccccctggagcacatgagaagacacagcgtgacagacaagagggacagcgaggaggagagcgagagcacagccctgtag

SEQ ID NO: 19262 - DNA, 1119 bp, Artificial Sequence
  Description of Artificial Sequence: Synthetic coding sequence
atgagcaagtctgagagccccaaggagcctgagcagctgaggaagctgttcatcggcggcctgagctttgagaccacagatgagagcctgcggagccactttgagcagtggggcaccctgacagactgtgtggtgatgagggaccccaacaccaagaggagccggggctttggatttgtgacctacgccaccgtggaggaggtggatgctgccatgaatgcccggccccacaaggtggatggccgggtggtggagcccaagagagctgtgtcccgggaggacagccagaggcctggggcccacctgactgtgaagaagatctttgtgggcggcatcaaggaggacacagaggagcaccacctgcgggactactttgagcagtatggcaagattgaagtcatcgagatcatgacagaccggggcagcggcaagaagaggggctttgcctttgtgacctttgatgaccatgacagcgtggacaagatcgtcatccagaagtaccacacagtgaatggccacaactgtgaggtgaggaaggccctgagcaagcaggagatggccagcgccagcagcagccagaggggccgcagcggcagcggcaactttggaggcggccggggcggcggctttggaggaaatgacaactttggccggggcggcaacttcagcggccggggcggctttggaggcagcagaggaggcggcggctatggaggcagcggagatggctacaatggatttggaaatgatggcggctatggaggcggcggccctggctacagcggcggcagccggggctacggcagcggcggccagggctacggcaaccagggcagcggctatggaggcagcggcagctatgacagctacaacaacggcggcggcggcggctttggaggcggcagcggcagcaactttggaggcggcggcagctacaatgactttggaaactacaacaaccagagcagcaactttggccccatgaagggcggcaactttggaggccgcagcagcggcccctatggaggcggcggccagtactttgccaagcccaggaaccagggcggctatggaggcagcagcagcagcagcagctatggcagcggccgccgcttctag

SEQ ID NO: 19263 - DNA, 1491 bp, Artificial Sequence
  Description of Artificial Sequence: Synthetic coding sequence
atgaagctgggcaagaagcccatgtacaagcctgtggacccctacagcaggatgcagagcacctacaactacaacatgaggggcggggcctacccaccccgctacttctaccccttccctgtgccccccctgctgtaccaggtggagctgtctgtgggcggccagcagttcaacgggaagggcaagacccggcaggccgccaagcatgatgctgctgccaaggccctgcgcatcctgcagaatgagcccctgcctgagcggctggaggtgaatggccgggagagcgaggaggagaacctgaacaagtctgagatcagccaggtgtttgaaattgccctgaagaggaacctgcctgtgaactttgaggtggcccgggagagcggccccccccacatgaagaactttgtgaccaaggtgtctgtgggggagtttgtgggggagggggagggcaagagcaagaagatcagcaagaagaatgctgccatcgctgtgctggaggagctgaagaagctgccccccctgcctgctgtggagcgggtgaagccccgcatcaagaagaagaccaagcccatcgtgaagccccagaccagcccagaatatggccagggcatcaaccccatcagccggctggcccagatccagcaggccaagaaggagaaggagcctgagtacaccctgctgacagagcggggcctgcccaggagaagagaatttgtgatgcaggtgaaggtgggcaaccacacagctgagggcaccggcaccaacaagaaggtggccaagagaaatgctgctgagaacatgctggagatcctgggcttcaaggtgccccaggcccagcccaccaagccagccctgaagtctgaggagaagacccccatcaagaagccaggagatggcaggaaggtgaccttctttgagcccggcagcggagatgaaaatggcaccagcaacaaggaggatgagttcaggatgccctacctgagccaccagcagctgcctgctggcatcctgcccatggtgcctgaggtggcccaggccgtgggcgtgtcccagggccaccacaccaaggacttcaccagggctgcccccaacccagccaaggccaccgtgacagccatgattgcccgggagctgctgtatggaggcaccagccccacagctgagaccatcctgaagaacaacatcagcagcggccacgtgccccacggccccctgacccggcccagcgagcagctggactacctgagccgggtgcagggcttccaggtggagtacaaggacttccccaagaacaacaagaatgaatttgtgtccctcatcaactgcagcagccagcccccactcatcagccatggaattggcaaggatgtggagagctgccacgacatggccgccctgaacatcctgaagctgctgtctgagctggaccagcagagcacagagatgcccaggactggaaatggccccatgtctgtgtgtggccgctgctag

SEQ ID NO: 19264 - DNA, 5835 bp, Artificial Sequence
  Description of Artificial Sequence: Synthetic coding sequence
atgagcaacttctatgaggagaggaccaccatgattgctgcccgggacctgcaggagtttgtgcccttcggccgggaccactgcaagcaccaccccaatgccctgaacctgcagctgcggcagctgcagcctgccagcgagctgtggagcagtgatggagctgctggcctggtgggcagcctgcaggaggtgaccatccacgagaagcagaaggagagctggcagctgaggaagggcgtgtctgaaattggagaagatgtggactatgatgaggagctgtatgtggccggcaacatggtgatctggagcaagggcagcaagagccaggccctggccgtgtacaaggccttcaccgtggacagccctgtgcagcaggccctgtggtgtgacttcatcatcagccaggacaagtctgagaaggcctacagcagcaatgaggtggagaagtgcatctgcatcctgcagagcagctgcatcaacatgcacagcattgagggcaaggactacatcgccagcctgcccttccaggtggccaacgtgtggcccaccaagtatggcctgctgtttgagaggtctgccagcagccatgaggtgcccccaggcagcccccgggagcccctgcccaccatgttctccatgctgcaccccctggatgagatcacccccctggtgtgcaagagcggcagcctgtttggcagcagccgggtgcagtatgtggtggaccacgccatgaagatcgtgttcctgaacacagaccccagcatcgtgatgacctatgatgctgtgcagaatgtgcacagcgtgtggaccctgcggcgggtgaagtctgaggaggagaatgtggtgctgaagttcagcgagcagggcggcaccccccagaatgtggccaccagcagcagcctgacagcccacctgcggagcctgagcaagggggacagccctgtgaccagccccttccagaactacagcagcatccacagccagagccgcagcaccagcagccccagcctgcacagccgcagccccagcatcagcaacatggccgccctgagccgggcccacagccctgccctgggcgtgcacagcttcagcggcgtgcagcgcttcaacatcagcagccacaaccagagccccaagaggcacagcatcagccacagccccaacagcaacagcaatggcagcttcctggcccctgagacagagcccatcgtgcctgagctgtgcatcgaccacctgtggacagagaccatcaccaacatccgggagaagaacagccaggccagcaaggtgttcatcaccagtgacctgtgtggccagaagttcctgtgcttcctggtggagagccagctgcagctgcgctgtgtgaagttccaggagagcaatgacaagacccagctgatcttcggctctgtgaccaacatcccagccaaggatgctgcccctgtggagaagattgacaccatgctggtgctggagggcagcggcaacctggtgctgtacacaggagtggtgcgggtgggcaaggtgttcatccctggcctgcctgcccccagcctgaccatgagcaacaccatgccccggcccagcacccccctggatggagtgtccacccccaagcccctgagcaagctgctgggcagcctggatgaggtggtgctgctgagccctgtgcctgagctgcgggacagcagcaagctgcatgacagcctgtacaatgaagactgcaccttccagcagctgggcacctacatccacagcatccgggaccctgtgcacaacagagtgaccctggagctgagcaatggctccatggtgcgcatcaccatccctgagatcgccaccagcgagctggtgcagacctgcctgcaggccatcaagttcatcctgcccaaggagattgctgtgcagatgctggtgaagtggtacaacgtgcacagcgcccctgggggccccagctaccacagcgagtggaacctgtttgtgacctgcctgatgaacatgatgggctacaacacagaccggctggcctggaccaggaactttgattttgagggcagcctgagccctgtgattgcccccaagaaggcccggcccagcgagactggaagtgatgatgactgggagtacctgctgaacagcgactaccaccagaatgtggagagccacctgctgaacagaagcctgtgcctgagccccagcgaggccagccagatgaaggatgaggacttcagccagaacctgagcctggacagcagcaccctgctcttcacccacatcccagccatcttctttgtgctgcacctggtgtatgaggagctgaagctgaacaccctgatgggagagggcatctgcagcctggtggagctgctggtgcagctggcccgggacctgaagctgggcccctacgtggaccactactacagagactaccccaccctggtgaggaccaccggccaggtgtgcaccattgatcctggccagacaggcttcatgcaccaccccagcttcttcaccagcgagcccccatccatctaccagtgggtgagcagctgcctgaagggggagggcatgccaccctacccctacctgcccggcatctgtgagaggagccggctggtggtgctgagcatcgccctgtacatcctgggagatgagagcctggtgtctgatgagagcagccagtacctgacccgcatcaccatcgccccccagaagctgcaggtggagcaggaggagaaccgcttctccttccgccacagcacctctgtgagcagcctggccgagcggctggtggtgtggatgaccaacgtgggcttcaccctgcgggacctggagaccctgccctttggaattgccctgcccatcagagatgccatctaccactgccgggagcagcctgccagtgactggccagaggccgtgtgcctgctgattggccggcaggacctgagcaagcaggcctgtgagggcaacctgcccaagggcaagtctgtgctgagcagtgatgtgcccagcggcacagaaacagaggaggaggatgatggcatgaatgacatgaaccacgaggtgatgagcctcatctggagcgaggacctgcgggtgcaggatgtgcggcggctgctgcagagcgcccaccctgtgcgggtgaatgtggtgcagtacccagagctgagtgaccacgagttcatcgaggagaaggaaaatcggctgctgcagctgtgccagaggaccatggccctgcctgtgggccggggcatgttcaccctcttctcctaccaccctgtgcccacagagcccctgcccatccccaagctgaacctgaccggccgggccccacccaggaacaccaccgtggacctgaacagcggcaacattgatgtgccccccaacatgacctcctgggccagcttccacaatggagtggccgccggcctgaagatcgccccagccagccagattgattctgcctggatcgtgtacaacaagcccaagcacgccgagctggccaatgaatatgccggcttcctgatggccctgggcctgaatggccacctgaccaagctggccaccctgaacatccatgactacctgaccaagggccacgagatgaccagcatcggcctgctgctgggcgtgtctgctgccaagctgggcaccatggacatgagcatcacccggctgctgagcatccacatcccagccctgctgccccccaccagcacagagctggatgtgccccacaacgtgcaggtggccgctgtggtgggcatcggcctggtgtaccagggcacagcccaccgccacacagctgaggtgctgctggccgagatcggccggcccccaggccctgagatggagtactgcacagaccgggagagctacagcctggccgccggcctggccctgggcatggtgtgcctgggccacggcagcaacctgattggcatgtctgacctgaatgtgcctgagcagctgtaccagtacatggtgggcggccaccggcgcttccagacaggcatgcaccgggagaagcacaagagccccagctaccagatcaaggagggggacaccatcaacgtggatgtgacctgccctggggccaccctggccctggccatgatctacctgaagaccaacaacagaagcattgctgactggctgcgggccccagacaccatgtacctgctggactttgtgaagccagagttcctgctgctgcggaccctggcccgctgcctgatcctgtgggatgacatcctgcccaacagcaagtgggtggacagcaatgtgccccagatcatccgggagaacagcatcagcctgtctgaaattgagctgccctgcagcgaggacctgaacctggagaccctgagccaggcccacgtgtacatcatcgccggggcctgcctgagcctgggcttccgctttgctggcagcgagaacctgagcgccttcaactgcctgcacaagtttgccaaggacttcatgacctacctgagcgccccaaatgcctctgtgacaggcccccacaacctggagacctgcctgtctgtggtgctgctgagcctggccatggtgatggccggcagcggcaacctgaaggtgctgcagctgtgccgcttcctgcacatgaagacaggaggagagatgaactacggcttccacctggcccaccacatggccctgggcctgctcttcctgggcggcggccgctacagcctgagcaccagcaacagcagcattgctgccctgctgtgtgccctgtacccccacttccctgcccacagcacagacaaccgctaccacctgcaggccctgcggcacctgtatgtgctggccgctgagccccggctgctggtgcctgtggatgtggacaccaacaccccctgctacgccctgctggaggtgacctacaagggcacccagtggtatgagcagaccaaggaggagctgatggcccccaccctgctgcctgagctgcacctgctgaagcagatcaaggtgaagggcccccgctactgggagctgctgattgacctgagcaagggcacccagcacctgaagagcatcctgagcaaggatggagtgctgtatgtgaagctgcgggccggccagctgagctacaaggaggaccccatgggctggcagagcctgctggcccagacagtggccaacagaaacagcgaggcccgggccttcaagccagagaccatcagcgccttcaccagtgaccctgccctgctgagctttgctgagtacttctgcaagcccaccgtgaacatgggccagaagcaggagatcctggacctcttcagctctgtgctgtatgaatgtgtgacccaggagaccccagagatgctgcctgcctacatcgccatggaccaggccatccggcggctgggccggcgggagatgtctgagaccagcgagctgtggcagatcaagctggtgctggagttcttcagcagccgcagccaccaggagcggctgcagaaccaccccaagaggggcctcttcatgaacagcgagttcctgcctgtggtgaagtgcaccatcgacaacaccctggaccagtggctgcaggtgggcggggacatgtgtgtgcacgcctacctgagcggccagcccctggaggagagccagctgtccatgctggcctgcttcctggtgtaccacagcgtgcctgccccccagcacctgccccccatcggcctggagggcagcaccagctttgctgagctgctcttcaagttcaagcagctgaagatgcctgtgcgggccctgctgcggctggcccccctgctgctgggcaacccccagcccatggtgatgtag

SEQ ID NO: 19265 - DNA, 1263 bp, Artificial Sequence; identical to SEQ ID NO: 18898
  Description of Artificial Sequence: Synthetic coding sequence

SEQ ID NO: 19266 - DNA, 1257 bp, Artificial Sequence
  Description of Artificial Sequence: Synthetic coding sequence
atgagggagtgcatcagcatccacgtgggccaggccggcgtgcagattggaaatgcctgctgggagctgtactgcctggagcacggcatccagccagatggccagatgcccagcgacaagaccatcggcggcggagatgacagcttcaacaccttcttcagcgagaccggggccggcaagcacgtgcccagggctgtgtttgtggacctggagcccaccgtggtggatgaggtgaggacaggcacctaccggcagctgttccaccctgagcagctgatcaccgggaaggaggatgctgccaacaactatgcccggggccactacaccatcggcaaggagatcgtggacctggtgctggaccgcatcaggaagctggccgacctgtgcaccggcctgcagggcttcctgatcttccacagctttggaggcggcactggaagtggctttgccagcctgctgatggagcggctgtctgtggactatggcaagaagagcaagctggagtttgccatctacccagccccccaggtgtccacagctgtggtggagccctacaacagcatcctgaccacccacaccaccctggagcacagcgactgtgccttcatggtggacaatgaggccatctatgacatctgcagaagaaacctggacatcgagcggcccacctacaccaacctgaaccggctgattggccagatcgtgagcagcatcacagccagcctgcgctttgatggagccctgaatgtggacctgacagagttccagaccaacctggtgccctacccccgcatccacttccccctggccacctacgcccctgtgatctctgctgagaaggcctaccacgagcagctgtctgtggccgagatcaccaatgcctgctttgagcccgccaaccagatggtgaagtgtgaccccaggcatggcaagtacatggcctgctgcatgctgtacagaggagatgtggtgcccaaggatgtgaatgctgccatcgccaccatcaagaccaagaggaccatccagtttgtggactggtgccccaccggcttcaaggtgggcatcaactaccagcccccaacagtggtgcctggaggagacctggccaaggtgcagagagctgtgtgcatgctgagcaacaccacagccatcgccgaggcctgggcccggctggacctggccgccctggagaaggactatgaggaggtgggcgtggacagcgtggaggccgaggccgaggagggggaggagtactag

SEQ ID NO: 19267 - DNA, 417 bp, Artificial Sequence
  Description of Artificial Sequence: Synthetic coding sequence
atgcagctgcccccatttgacatgtggaaggactacttcaacctgagccaggtggtgtgggccctgattgccagccggggccagaggctggagacccaggagattgaggagcccagccctggcccccccctgggccaggaccagggcctgggcgcccctggggccaacggcggcctgggcaccctgtgcaacttctgcaagcacaatggagagagccgccacgtgtacagcagccaccagctgaagaccccagatggagtggtggtgtgccccatcctgcggcactacgtgtgccctgtgtgtggggccaccggggaccaggcccacaccctgaagtactgccccctgaatggaggccagcagagcctgtacagaagaagtggaagaaattctgctggccggcgggtgaagaggtag

SEQ ID NO: 19268 - DNA, 375 bp, Artificial Sequence
  Description of Artificial Sequence: Synthetic coding sequence
atgagggccagcccctgcatcagccagcctgctgcctcctggcacccccggcccagcgccctgcggcccacagctggcagcggccctgacaccaggaccccaggcaccgtggaggatggcagcgccccctgcccagccttccgcagccctgctgtgagcccctgtggggaggagccctgctgcttccagatcagccctgctgaggagaccctggagctgggccgcctggtgtccccaggcaactgtgacaccctgagccccagggctgctggcttctacgcctgccacgtgcgcagcctcatcccctgccgcagcaccaagggccgctggcccctgacagccagcgctgctggcctgagcagcttctctggatag

SEQ ID NO: 19269 - DNA, 363 bp, Artificial Sequence
  Description of Artificial Sequence: Synthetic coding sequence
atggccgagcccagcagcgcccggcggcctgtgcccctcatcgagagcgagctgtacttcctgattgcccgctacctgtctgctggcccctgccggcgggccgcccaggtgctggtgcaggagctggagcagtaccagctgctgcccaagaggctggactgggagggcaatgagcacaacagaagctatgaggagctggtgctgagcaacaagcacgtggccccagaccacctgctgcagatctgccagagaattggccccatgctggacaaggagatcccccccagcatcagccgggtgaccagcctgctgggcgccggccggcagagcctgctgaggacagccaagggcaccctcatctag

SEQ ID NO: 19270 - DNA, 2607 bp, Artificial Sequence
  Description of Artificial Sequence: Synthetic coding sequence
atgatccccaagagcctggtgcaggccgctgagacccagaggggcctgtgtgagcccggcggcaagggccgggagggccgcagcggcggcaaaggagagacccggccccggggcgtgggcacccaggagggcaagggcaccatccctggcagcccccgggagaagagaggagagcggggggagggggaccctgccctgctgcctgctgaggacctgtggaggctgcccggcagcaaggaccggctgcggagcagcctgctgcccccacctggcccccccagcagtgacagcggccctggcccccccagcagccacagcggcaagacagcccagggccccaggaccctgaactgggccaggaagcagagcgcccggaccagcagcaacctgtgtgcctggagcctggccatggccaccaagatggccgagatccccagcagcccctatgagcccggccagaggggcatgaaggacacccagagaggagatgccccccagaggggcagccctgagccccgcatcctgcagctggcccgggtgggcaatgtgtacctgaaggaggagagcagccgcagcggccgcctggaggccaagaagtggatccccaccaagttcctggagaacctgtctgtgccccacgtggacctgggcggcaaccagctgtggagcggcggcatggaggccctgaccacccagctgggccctggccgggagggcagcagcagccccaacagcaagcaggagctgcagccctacagcggcagcagcgccctgaagcccaaccaggtgggggagaccagcctgtatggagtgcccatcgtgtccctggtgattgatggccaggagcggctgtgcctggcccagatcagcaacaccctgctgaagaactacagctacaatgagatccacaacagaagagtggccctgggcatcacctgtgtgcagtgcacccctgtgcagctggagatcctgcggcgggccggggccatgcccatcagcagcagaagatgtggcatgatcaccaagcgggaggccgagcggctgtgcaagagcttcctgggggagcacaagccacccaagctgcctgaaaattttgcctttgatgtggtgcatgaatgtgcctggggcagccggggcagcttcatcccagcccgctacaacagcagccgggccaagtgcatcaagtgtggctactgcagcatgtacttcagccccaacaagttcatcttccacagccacaggaccccagatgccaagtacacccagccagatgctgccaacttcaacagctggaggaggcacctgaagctgagtgacaagagcgccacagatgagctgagccacgcctgggaggaccggggcctgggcctggccactggagccagcggccctgctggccctgggggccctgggggcggggccggcgtgcgcagctaccctgtgattcctgtgcccagcaaaggatttggcctgctgcagaagctgcccccacccctcttcccccacccctacggcttccccacagccttcggcctgtgccccaagaaggatgatcctgtgctgggcgctggggagcccaagggcggcagctatgtgtctgccttccggcctgtggtgaaggacacagagagcatcgccaagctgtatggcagcgcccgggaggcctacggggccggccctgcccggggccctggccctggggccggcagcggcggctacgtgtccccagacttcctgtctgagggcagcagcagctacaacagcgccagcccagatgtggacacagcagatgagcctgaggtggatgtggagagcaaccgcttcccagatgatgaagatgcccaggaggagacagagcccagcgcccccagcgctgggggcggcccagatgctggccggcctgccttcggggacctggccgctgaggacctggtgcggcggcctgagaggagcccccccagcggcggcggcggctatgagctgcgggagccctgtggccccctgggcggccctgccccagccaaggtgtttgcccctgagagagatgagcacgtgaagtctgctgctgtggccctgggccctgctgccagctatgtgtgcaccccagaggcccacgagccagacaaggaggacaaccacagccctgcagatgacctggagaccaggaagagctacccagaccagaggagcatcagccagcccagccctgccaacacagacagaggagaagatggcctgaccctggatgtgacaggcacccacctggtggagaaggacatcgagaacctggcccgggaggagctgcagaagctgctgctggagcagatggagctgaggaagaagctggagcgggagttccagagcctgaaggacaacttccaggaccagatgaagcgggagctggcctaccgggaggagatggtgcagcagctgcagatcgtgcgggacaccctgtgcaatgagctggaccaggagaggaaggcccgctatgccatccagcagaagctgaaggaggcccatgatgccctgcaccacttcagctgcaagatgctgacccccaggcactgcaccggcaactgcagcttcaagccacccctgctgccctag

SEQ ID NO: 19271 - DNA, 3585 bp, Artificial Sequence
  Description of Artificial Sequence: Synthetic coding sequence
atgcatgacctgcccccagacagcggggccaggagaggaggccggggcctggccgaccacagcttccctgctggggcccgggcccctggccagccccccagcagaggagctgcctaccgccgggcctgccccagagatggagagcggggcggcggcggccggccccggcagcaggtgtccccacccaggagcccccagcgggagccccggggcggccagctgcggacccccaggatgaggcccagctgcagccgcagcctggagagcctgcgggtgggcgccaagcccccacccttccagcgctggcccagcgacagctggatccgctgtggggcccaccgggactgggatgagcccccaccccggggcggccgcatggatggctggagcggggaccgggcccgggctgctgcccccaccggcctgcagcccccaggctgcaaggaccacggctgcagcagcggcagccccttccgggaccctgctggcagcagcgtcatccgctctggaaaaggagaccggcaggagggccccagcttcctgcggcccccagctgtgacagtgaagaagctgcagaagtggatgtacaagggccgcctgctgagcctgggcatgaagggccgggcccggggcacagcccccaaggtgacaggcacccaggccgccagccccaacgtgggcgccctgaaggtgagagaaaatagagtgctgtctgtgcccccagaccagaggatcaccctgacagacctgtttgaaaatgcctacggcagctccatgaagggccgggagctggaggagctgaaggacaacatcgagttccggggccacaagcccctgaacagcatcaccgtgtccaagaagaggaactggctgtaccagagcaccctgcggcccctgaacctggaggaggagaacaagaagtgccaggacaggagccacctgagcatcagccctgtgtccctgcccaagcaccagctgagccagagcttcctgaagagcagcaaggagtactgcacctacgtggtgtgcaatgccaccaacagcagcctgagcaagaactgtgccctggacttcaatgaagaaaatgatgctgatgatgaaggagagatctggtacaaccccatcccagaagatgatgacctgggcatcagcagcgccctgagctttggagaggccgacagcgctgtgctgaagctgcctgctgtgaacctgtccatgctgagcggcagtgacctgatgaaggccgagcggcacacagaggacagcctgtgcagcagcgagcacgccggggacatccagaccaccaggagcaatggcatgaaccccatccacccagcccacagcacagaatttgtgcagcagtacaagcagaagctgggccacaagacccaggagggcatcatggtggaggacagccccatgctgaagagcccctttgctggcagcggcatcctggccgccaccaacagcacagagctgggcatcatggagcccagcagccccaaccccagccctgtgaagaagggcagcagcatcaactggagcctgcctgacaagatcaagagccccaggacagtgaggaagctgtccatgaagatgaagaagctgcctgagttcagcaggaagctgtctgtgaagggcaccctgaactacatcaacagcccagacaacacccccagcctgagcaagtacaactgccgggaggtgcaccacacagacatcctgcccagcggcaacaccaccacagctgccaagagaaatgtcatcagccgctaccacctggacacctctgtgagcagccagcagagctaccagaagaagaacagcatgagcagcaagtacagctgcaagggcggctacctgagtgatggagacagccctgagctgaccaccaaggccagcaagcacggcagcgagaacaagtttgggaagggcaaggagatcatcagcaacagctgcagcaagaatgaaattgatattgatgccttccgccactacagcttcagtgaccagcccaagtgcagccagtacatcagcggcctgatgtctgtgcacttctatggagctgaggacctgaagcccccaagaattgacagcaaggatgtgttctgtgccatccaggtggacagcgtgaacaaggccaggacagccctgctgacctgcaggaccaccttcctggacatggaccacaccttcaacatcgagattgaaaatgcccagcacctgaagctggtggtgttctcctgggagcccacccccaggaagaacagagtgtgctgccacggcaccgtggtgctgcccaccctcttccgggtgaccaagacccaccagctggccgtgaagctggagccccggggcctcatctacgtgaaggtgaccctgatggagcagtgggagaacagcctgcacggcctggacatcaaccaggagcccatcatcttcggcgtggacatccagaaggtggtggagaaggaaaatattggcctgatggtgcccctgctgatccagaagtgcatcatggagattgagaagaggggctgccaggtggtgggcctgtaccgcctgtgtggcagcgctgctgtgaagaaggagctgcgggaggcctttgagcgggacagcaaggctgtgggcctgtgtgagaaccagtacccagacatcaacgtcatcaccggggtgctgaaggactacctgcgggagctgcccagccccctcatcaccaagcagctgtatgaggccgtgctggatgccatggccaagagccccctgaagatgagcagcaatggctgtgaaaatgaccccggggacagcaagtacacagtggacctgctggactgcctgcctgagattgagaaggccaccctgaagatgctgctggaccacctgaagctggtggccagctaccacgaggtgaacaagatgacctgccagaacctggccgtgtgcttcggccctgtgctgctgagccagaggcaggagcccagcacccacaacaacagagtcttcacagacagcgaggagctggccagcgccctggacttcaagaagcacatcgaggtgctgcactacctgctgcagctgtggcctgtgcagaggctgactgtgaagaagagcacagacaacctcttccctgagcagaagagcagcctgaactacctgcggcagaagaaggagcggccccacatgctgaacctgtctggaacagacagcagcggcgtgctgcggccccggcagaaccggctggacagccccctgagcaacagatatgctggggactggagcagctgtggggagaactacttcctgaacaccaaggagaacctgaatgatgtggactatgatgatgtgcccagcgaggacaggaagatcggggagaactacagcaagatggatggccctgaggtgatgattgagcagcccatccccatgagcaaagaatgtaccttccagacctacctgaccatgcagacagtggagagcacagtggacaggaagaacaacctgaaggacctgcaggagagcattgacaccctcatcggcaacctggagcgggagctgaacaagaacaagctgaacatgtccttctag

SEQ ID NO: 19272 - DNA, 1353 bp, Artificial Sequence
  Description of Artificial Sequence: Synthetic coding sequence
atggaccctggaaatgaaaacagcgccacagaggccgccgccatcatcgacctggaccctgactttgagccccagagccggcccaggagctgcacctggcccctgcccaggcctgagatcgccaaccagcccagcgagcccccagaggtggagccagacctgggggagaaggccattgaaagtgcccctgagaagaggctgaccctggcccagatctatgagtggatggtgaggacagtgccctacttcaaggacaagggggacagcaacagcagcgctggctggaagaacagcatccgccacaacctgagcctgcacagcaagttcatcaaggtgcacaatgaggccaccgggaagagctcctggtggatgctgaaccctgagggcggcaagagcggcaaggccccccggcggcgggccgcctccatggacagcagcagcaagctgctgcggggccgcagcaaggcccccaagaagaagcccagcgtgctgcctgcccctcctgagggcgccacccccaccagccctgtgggccactttgccaagtggagcggcagcccctgcagcaggaaccgggaggaggccgacatgtggaccaccttccggcccaggagcagcagcaatgccagctctgtgtccacccggctgagccccctgcggcctgagagcgaggtgctggccgaggagatcccagcctctgtgagcagctatgctgggggcgtgccccccaccctgaatgaaggcctggagctgctggatggcctgaacctgaccagcagccacagcctgctgagccgcagcggcctgagcggcttcagcctgcagcaccctggggtgacaggccccctgcacacctacagcagcagcctcttctccccagctgagggccccctgtctgctggggagggctgcttcagcagcagccaggccctggaggccctgctgaccagtgacaccccacctcctccagcagatgtgctgatgacccaggtggaccccatcctgagccaggcccccaccctgctgctgctgggcggcctgcccagcagcagcaagctggccactggagtgggcctgtgccccaagcccctggaggcccctggccccagcagcctggtgcccaccctgtccatgattgcccctcctcctgtgatggccagcgcccccatccccaaggccctgggcacccctgtgctgaccccacccacagaagctgccagccaggacaggatgccccaggacctggacctggacatgtacatggagaacctggagtgtgacatggacaacatcatcagtgacctgatggatgaaggagagggcctggacttcaactttgagccagacccctag

SEQ ID NO: 19273 - DNA, 1125 bp, Artificial Sequence
  Description of Artificial Sequence: Synthetic coding sequence
atggccggctacctgtctgagagtgactttgtgatggtggaggagggcttcagcacccgggacctgctgaaggagctgaccctgggcgccagccaggccaccacagatgaggtggccgccttctttgtggccgacctgggcgccatcgtgaggaagcacttctgcttcctgaagtgcctgccccgggtgcggcccttctatgctgtgaagtgcaacagcagccctggggtgctgaaggtgctggcccagctgggcctgggcttcagctgtgccaacaaggccgagatggagctggtgcagcacatcggcatcccagccagcaagatcatctgtgccaacccctgcaagcagatcgcccagatcaagtatgctgccaagcacggcatccagctgctgagctttgacaatgagatggagctggccaaggtggtgaagagccaccccagcgccaagtttgtgcagcagaggggcacagcctgcctgatccgcatggtgctgtgcatcgccacagatgacagccacagcctgagctgcctgagcctgaagtttggagtgtccctgaagagctgccgccacctgctggagaatgccaagaagcaccacgtggaggtggtgggcgtgtccttccacatcggcagcggctgcccagacccccaggcctatgcccagagcattgctgatgcccggctggtgtttgagatgggcacagagctgggccacaagatgcacgtgctggacctgggcggcggcttccctggaacagagggcgccaaggtgcgctttgaggagatcgccagcgtcatcaacagcgccctggacctgtacttccctgagggctgcggcgtggacatctttgctgagctgggccgctactacgtgaccagcgccttcaccgtggccgtgtccatcatcgccaagaaggaggtgctgctggaccagcccggccgggaggaggagaatggcagcaccagcaagaccatcgtgtaccacctggatgagggcgtgtatggcatcttcaacagcgtgctgtttgacaacatctgccccacccccatcctgcagaagagcaagaaccacagcccctgctacatgagcctggagagcatccacttcatcgctgtgtag

SEQ ID NO: 19274 - DNA, 1629 bp, Artificial Sequence
  Description of Artificial Sequence: Synthetic coding sequence
atggacaggagcaagaggaacagcattgctggcttccccccccgggtggagcggctggaggagtttgagggcggcggcggcggggagggcaatgtgtcccaggtgggccgggtgtggcccagcagctaccgggccctgatcagcgccttcagccggctgacccggctggatgacttcacctgtgagaagattggcagcggcttcttcagcgaggtgttcaaggtgcgccaccgggccagcggccaggtgatggccctgaagatgaacaccctgagcagcaacagagccaacatgctgaaggaggtgcagctgatgaaccggctgagccaccccaacatcctgcgcttcatgggcgtgtgtgtgcaccagggccagctgcacgccctgacagagtacatcaacagcggcaacctggagcagctgctggacagcaacctgcacctgccctggacagtgcgggtgaagctggcctatgacattgctgtgggcctgagctacctgcacttcaagggcatcttccaccgggacctgaccagcaagaactgcctgatcaagagagatgaaaatggctacagcgctgtggtggccgactttggcctggccgagaagatcccagatgtgtccatgggcagcgagaagctggccgtggtgggcagccccttctggatggcccctgaggtgctgagagatgagccctacaatgagaaggcagatgtgttctcctatggcatcatcctgtgtgagatcatcgcccgcatccaggccgaccctgactacctgcccaggacagagatggaccccaagctgcggcccagctttgtggagatcggcaagaccctggaggagatcctgagccggctgcaggaggaggagcaggagcgggacaggaagctgcagcccacagcccggggcctgctggagaaggcccctggggtgaagaggctgagcagcctggatgacaagatcccccacaagagcccctgccccaggaggaccatctggctgagccgcagccagagcgacatcttcagcaggaagccacccaggacagtgtctgtgctggacccctactaccggcccagagatggagctgcccggacccccaaggtgaaccccttcagcgcccggcaggacctgatgggcggcaagatcaagttctttgacctgcccagcaagagcgtcatcagcctggtgtttgacctggatgcccctggccctggcaccatgcccctggccgactggcaggagcccctggccccacccatccgccgctggaggagcctgcccggcagccctgagttcctgcaccaggaggcctgcccctttgtgggccgggaggagagcctgagtgatggccccccaccccggctgagcagcctgaagtacagagtgaaggagatcccccccttccgggccagcgccctgcctgctgcccaggcccacgaggccatggactgcagcatcctgcaggaggagaatggatttggcagccggccccagggcaccagcccctgcccagctggggccagcgaggagatggaggtggaggagaggcctgctggcagcaccccagccaccttcagcaccagcggcatcggcctgcagacccagggcaagcaggatggatag

SEQ ID NO: 19275 - DNA, 786 bp, Artificial Sequence
  Description of Artificial Sequence: Synthetic coding sequence
atgggcagcaggaagaaggagatcgccctgcaggtgaacatcagcacccaggagctgtgggaggagatgctgagcagcaagggcctgactgtggtggatgtgtaccagggctggtgtggcccctgcaagcctgtggtgtccctcttccagaagatgagaattgaggtgggcctggacctgctgcactttgccctgatcaaggatgaggccctgagtgatgaagatgaatgtgtgagccacggcaagaacaacggggaggatgaggacatggtgtcctctgagaggacctgcaccctggccatcatcaagccagatgctgtggcccacggcaagacagatgagatcatcatgaagatccaggaggccggctttgagatcctgaccaatgaggagaggaccatgacagaagctgaggtgcggctcttctaccagcacaaggccggggaggaggcctttgagaagctggtgcaccacatgtgcagcggccccagccacctgctgatcctgaccaggacagagggctttgaagatgtggtgaccacctggaggacagtgatgggcccccgggaccccaacgtggcccggcgggagcagcctgagagcctgcgggcccagtatggaacagagatgcccttcaatgctgtgcacggcagccgggaccgggaggatgctgaccgggagctggccctgctcttccccagcctgaagttcagtgacaaggacacagaggccccccagggcgagagcagcacccagccccggctgaagatcacagacctggactag

SEQ ID NO: 19276 - DNA, 1767 bp, Artificial Sequence
  Description of Artificial Sequence: Synthetic coding sequence
atggaggccgcagatgccagccgcagcaatggcagcagccctgaggccagagatgcccggagccccagcggccccagcggcagcctggagaatggcaccaaggcagatggcaaggatgccaagaccaccaacggccacggcggggaggccgctgagggcaagagcctgggcagcgccctgaagccaggagagggccgcagcgccctgtttgctggaaatgagtggaggcggcccatcatccagtttgtggagagcggagatgacaagaacagcaactacttctccatggacagcatggagggcaagaggagcccctatgccggcctgcagctgggcgccgccaagaagccccctgtgacctttgctgagaagggggagctgaggaagagcatcttcagcgagagcaggaagcccaccgtgtccatcatggagcctggagagaccaggaggaacagctaccccagggctgacaccggcctcttcagccgcagcaagagcggcagcgaggaggtgctgtgtgacagctgcatcggcaacaagcagaaggctgtgaagagctgcctggtgtgccaggccagcttctgtgagctgcacctgaagccccacctggagggcgccgccttccgggaccaccagctgctggagcccatccgggactttgaggccaggaagtgccctgtgcacggcaagaccatggagctgttctgccagacagaccagacctgcatctgctacctgtgcatgttccaggagcacaagaaccacagcacagtgacagtggaggaggccaaggccgagaaggagacagagctgagcctgcagaaggagcagctgcagctgaagatcattgaaattgaagatgaagctgagaagtggcagaaggagaaggaccgcatcaagagcttcaccaccaatgagaaggccatcctggagcagaacttccgggacctggtgcgggacctggagaagcagaaggaggaggtgcgggccgccctggagcagcgggagcaggatgctgtggaccaggtgaaggtgatcatggatgccctggatgagcgggccaaggtgctgcacgaggacaagcagacccgggagcagctgcacagcatcagtgacagcgtgctcttcctgcaggagtttggagccctgatgagcaactacagcctgcccccacccctgcccacctaccacgtgctgctggagggggagggcctgggccagagcctgggcaacttcaaggatgacctgctgaatgtgtgcatgagacatgtggagaagatgtgcaaggctgacctgagcaggaacttcattgaaagaaaccacatggagaatggaggagaccaccgctacgtgaacaactacaccaacagctttggaggagagtggagcgccccagacaccatgaagcgctacagcatgtacctgacccccaagggcggcgtgaggaccagctaccagcccagcagccctggccgcttcaccaaggagaccacccagaagaacttcaacaacctgtatggcaccaagggcaactacaccagccgggtgtgggagtacagcagcagcatccagaacagcgacaatgacctgcctgtggtgcagggcagcagcagcttcagcctgaagggctaccccagcctgatgaggagccagagccccaaggcccagccccagacctggaagagcggcaagcagaccatgctgagccactaccggcccttctacgtgaacaagggaaatggcatcggcagcaatgaggccccctag

SEQ ID NO: 19277 - DNA, 3567 bp, Artificial Sequence
  Description of Artificial Sequence: Synthetic coding sequence
atgaagaagaagcagacagtgcagggcaccttcagcaagctgtttgggaagaagcacaccaccacccccagcaccagcctgtatgccaccaaccccccctggatcttcacccaggaggcccctgaggagggcactggaggctttgatggcatctactatggagacaaccgcttcaacacagtgtctgagagcggcacagccaccctgaaggcccggccccgggtgcggcccctgctgaccttcctgcccctgaatgcccaggagaaccacggcctggccgtgcccacccccagcgtgcctgatgactttgctgacaaggaggtgacaggcaccagcagcctggtgaatggaaacctgcggctgtacagctctgtgggggacctgcggcccggccagtatggccaggacctgctgatccccccacctcctcctggccctgcccctggccccccccaggacatcagcgagcccccaggcggcagccccctgcccagcccccccagcacagcccctcctcctccacccctgctgctggagcccccacctcctccttccatggcccctcctcctcctcctgtgctggaggccctgagccccccccacaccctgagcagccccagcatccccaccccaccagacttcatccccccagccccacccctggccttcctggcccctcctcctcctcctgtgcctgccccagcccccccagccccagccagcccccacacagtgggcaccaggctcttccccccaggcggcgtgaccaagtggaagagtgatgtggccctgaatggccggcaggccgaggccacccgggccagcccccccaggagccctgctgagcccaagggcagcgccctgggccccaaccctgagccccacctgaccttccccaggagcttcaaggtgcccccacccacccctgtgaggaccagcagcatccctgtgcaggaggcccaggaggcccccaggaaggaggagggcgccaccaagaaggcccccagccggctgcccctgcccccatccttccacatccggcctgccagccaggtgtacccagaccgggcccctgagccagactgccctggagagctgaaggccacagccccagccagcccccggctgggccagagccagagccaggctgatgaaagagctggcaccccacctccagccccacccctgcccccaccagccccacccctgcccccaccagccccacccctgcccccagctgccccacccctgccctgtgcccagaaggccgcccaccccccagctggcttcaccaagacccccaagagcagcagccctgccctgaagcccaagcccaacccccccagcccagaaaatacagccagcagcgcccctgtggactggagggaccccagccagatggagaagctgagaaatgagctggccgcctacctgtgtggcagccggcgggaggaccgcttcctgagccaccggcccggccccaccgtggccccccagagcaaggagggcaagaagggcccccggctgcctgagaaggagaccctgctgagcctgcctgccaaggacaccccacctggggtgcctgagaagagcctgggcggcagcagcctgacagaaacagaggccgcccccagcctgaccctgcccagcgtggactacatcccccaggacagccccacccccagcgtgcggcagatcagaaatgagctggaggcccggctgagcagcgctgctgagaaggaggccaagcccagcatcggcagcctgccccccaagccccggctggagggcggccgcatctgtgaaaatggagcagatgatgacaagctgagcaagcctgtggccaagaacctgcccccccagagcaccaccctgctgcccaccaccagcctgcagcccaaggccatgctgggccctgccatcccccccaaggccaccccagagcccgccatcccccccaaggccaccctgtggccagccaccccacccaaggccaccctgggccctgccacccccctgaaggccaccagcggccccaccacccccctgaaggccaccagcggccctgccatcgccagcacagccaccaccctgcccaccaccaccagccagctgatggccgagaaggacagcggccctgctggccagcctgagaagccagccagccaggaggtgtccacccccagccaggcccggggggagggcagccccagcgaggccacccggctgcccacccagggcgcccggagcagcgctgccttcccccccaagaccagccctgggggcggggaggtgccctgcctgtacaagccccactgccaccagagcagcctgagccgggaggtggccgtggtgatgcccaccctggcccggggcggcgctgctggccctggagagcctgtggaggtgaaggagcccccaggcctgcctgccaagcccccagccagcgcccagcccacagatgagctgctgcggcaccctgtgactggagaggtggtggagcggggcagccccatggccctgctgctggccgcccggcagagggcccagaagggccgctctgtgggcgccgccctgggccgcagcagcctgcccggcagcctgcgggaccacagccaccaggccgaggccagcagtgacagcatcttccacagccagggcacccccaacagcttcaccgtggtgcccaagctgcccaaggaggccgagaaggacagccccctgaccacagagatccccaacaagtggggcccccggctgggcagagatgctgagggcacagagctgagcagaagacacaactggaccaagccagagccccaggcccctgtggcctgggagcgggtggcccccagcaacctgccccagggccaccccctgcccaagagcttcagcagcccccccagccccagcaacaagcgggaggaggaggaggaggagttcaactttgaagtcatccccccacctcctgagttcagcaatgaccctgagcccccagccccagccctgcagtacctgggccggcagagcagcccccccaggaacaactacagcgacctgcggcagctgcccaatgccggccctggggcccccccagccctgggcttcagccgcttccctgctggggcccgctatgctggggccggcggcctggagcgcttcagcggcggcggccgcagcctcatcaagaagaggctgtatgtgggggagccccaccggggccctggcctgccccatggaggcaccggccgcagcctgagcagccccaactgcttcggcccccagcccggcggccctgagatgagaagagtgaacagcgctggccgggcccctcctgggggcctgcacgccccccggctgagcctggagggcgccgcccggggagctgctgaggccaagcacaaggcccctggcagcgctgactatggctttgccccagctgctggccgcagcccctacaccaccaccaggtatggcagccccatcaacaccttcaccgtgcggcccggcaccaggcaccccatctcctatgtgtgcagcggggcccacaggaaggccaccagctag

SEQ ID NO: 19278 - DNA, 2598 bp, Artificial Sequence
  Description of Artificial Sequence: Synthetic coding sequence
atggctgtggcccgggtggatgctgccctgcccccaggagagggctctgtggtgaactggagcggccagggcctgcagaagctgggccccaacctgccctgtgaggccgacatccacaccctcatcctggacaagaaccagatcatcaagctggagaacctggagaagtgcaagaggctcatccagctgtctgtggccaacaaccggctggtgaggatgatgggcgtggccaagctgaccctgctgcgggtgctgaacctgccccacaacagcatcggctgtgtggagggcctgaaggagctggtgcacctggagtggctgaacctggccggcaacaacctgaaggccatggagcagatcaacagctgcacagccctgcagcacctggacctgagtgacaacaacatcagccagattggagacctgagcaagctggtgtccctgaagaccctgctgctgcacggcaacatcatcaccagcctgaggatggccccagcctacctgcccaggagcctggccatcctgagcctggctgaaaatgagatccgggacctgaatgagatctccttcctggccagcctgacagagctggagcagctgagcatcatgaacaacccctgtgtgatggccacccccagcatccctggctttgactaccggccctacatcgtgtcctggtgcctgaacctgcgggtgctggatggctacgtgatcagccagaaggagagcctgaaggccgagtggctgtacagccagggcaagggccgggcctaccggcccggccagcacatccagctggtgcagtacctggccaccgtgtgccccctgaccagcaccctgggcctgcagacagcagaagatgccaagctggagaagatcctgagcaagcagcgcttccaccagaggcagctgatgaaccagagccagaatgaggagctgagccccctggtgcctgtggagacccgggccagcctcatccctgagcacagcagccctgtgcaggactgccagatcagccaggagagcgagcccgtcatccaggtgaacagctgggtgggcatcaacagcaatgatgaccagctgtttgctgtgaagaacaacttccctgcctctgtgcacaccacccgctacagcagaaatgacctgcacctggaggacatccagacagatgaggacaagctgaactgcagcctgctgagcagcgagagcaccttcatgcctgtggccagcggcctgagccccctgagccccaccgtggagctgcggctgcagggcatcaacctgggcctggaggatgatggagtggctgatgaatctgtgaagggcctggagagccaggtgctggacaaggaggaggagcagcccctgtgggccgccaatgaaaattctgtgcagatgatgaggtctgagatcaacacagaggtgaatgagaaggccggcctgctgccctgcccagagcccaccatcatcagcgccatcctgaaggatgacaaccacagcctgaccttcttccctgagagcacagagcagaagcagagcgacatcaagaagccagagaacacccagcctgagaacaaggagaccatcagccaggccaccagcgagaagctgcccatgatcctgacccagaggtctgtggccctgggccaggacaaggtggccctgcagaagctgaatgatgctgccaccaagctgcaggcctgctggaggggcttctacgccaggaactacaacccccaggccaaggatgtgcgctatgagatccggctgcggaggatgcaggagcacatcgtgtgcctgacagatgagatccggcggctgaggaaggagagagatgaggagcgcatcaagaagtttgtgcaggaggaggccttccgcttcctgtggaaccaggtgcgcagcctgcaggtgtggcagcagacagtggaccagaggctgagctcctggcacacagatgtgccccccatcagcagcaccctggtgcccagcaagcaccccctcttcacccagagccaggagagcagctgtgaccagaatgctgactggttcatcgccagtgatgtggccccccaggagaagagcctgcctgagttcccagattctggcttccacagcagcctgacagagcaggtgcacagcctgcagcacagcctggactttgagaagagcagcacagagggcagcgagagcagcatcatgggcaacagcattgacacagtgcgctatggcaaggagagtgacctgggagatgtgtctgaggagcacggggagtggaacaaggagagcagcaacaatgagcaggacaacagcctgctggagcagtacctgacctctgtgcagcagctggaggatgctgatgagaggaccaactttgacacagagacccgggacagcaagctgcacatcgcctgcttccctgtgcagctggacaccctgagtgatggagcctctgtggatgagagccacggcatcagcccccccctgcagggcgagatcagccagacccaggagaacagcaagctgaatgctgaggtgcagggccagcagccagaatgtgacagcaccttccagctgctgcacgtgggcgtgacagtgtag

SEQ ID NO: 19279 - DNA, 1275 bp, Artificial Sequence
  Description of Artificial Sequence: Synthetic coding sequence
atgtctgtgggctgcccagagcctgagccccccaggagcctgacctgctgcggccctggaacagcccctggccctggagctggggtgcccctgctgacagaggacatgcaggccctgaccctgcggaccctggccgccagtgatgtgaccaagcactatgagctggtgcgggagctgggcaagggcacctacggcaaggtggacctggtggtgtacaagggcaccggcaccaagatggccctgaagtttgtgaacaagagcaagaccaagctgaagaacttcctgcgggaggtgtccatcaccaacagcctgagcagcagccccttcatcatcaaggtgtttgatgtggtgtttgaaacagaggactgctacgtgtttgcccaggagtatgccccagctggggacctgtttgacatcatccccccccaggtgggcctgcctgaggacacagtgaagagatgtgtgcagcagctgggcctggccctggacttcatgcacggccggcagctggtgcaccgggacatcaagccagaaaatgtgctgctgtttgaccgggagtgccggcgggtgaagctggccgactttggcatgaccaggagagtgggctgccgggtgaagagggtgtctggcaccatcccctacacagcccctgaggtgtgccaggccggccgggcagatggcctggccgtggacaccggggtggatgtgtgggcctttggagtgctgatcttctgtgtgctgaccggcaacttcccctgggaggccgccagcggggctgatgccttctttgaggagtttgtgcgctggcagaggggccgcctgcccggcctgcccagccagtggaggcgcttcacagagcccgccctgaggatgttccagaggctgctggccctggagcctgagcggcggggccctgccaaggaggtgttccgcttcctgaagcatgagctgaccagcgagctgcggcggcggcccagccaccgggccaggaagcccccaggggacaggcctcctgctgctggccccctgcggctggaggcccctggccccctgaagaggacagtgctgacagaaagtggcagcggcagcaggcctgcccctcctgctgtgggctctgtgcccctgcctgtgcctgtgcctgtgcctgtgcctgtgcctgtgcctgtgcctgagcccggcctggccccccagggccccccaggccgcacagatggccgggctgacaagagcaagggccaggtggtgctggccacagccatcgagatctgtgtgtag

SEQ ID NO: 19280 - DNA, 1632 bp, Artificial Sequence
  Description of Artificial Sequence: Synthetic coding sequence
atggccacccggcggctgggcgtgggggagaccctgggcgccctgaatgctgccctgggccctgggggccctgtgtggatcaaggagaccaggaccaggcacctgcggagccgggacttcctggccccccaccgggccctgcaggccaggtttgatgatggccaggtgcctgagcacctgctgcacgccctggcctgcctgcagggccctggggtggcccctgtgctgcgctgtgcccccaccccagctggcctgagcctgcagctgcagaggtctgctgtgtttgagcgggtgctgtctgctgtggccgcctatgccaccccagccagccctgccagcctgggccagagggtgctgctgcactgcccagccctgcggagcagcccctgtgccctgcggctgagccagctgaggacagtgctggtggccgaccacctggcccgggccctgcgggcccatggagtgtgtgtgcggctggtgcctgctgtgcgggacccccacatgctgaccttcctgcagcagctgcgggtggactggccagctgccagcgagcgggccagcagccacaccctgcggagccacgccctggaggagctgaccagcgccaatgatggccgcaccctgagccctggcatcctgggccgcctgtgcctgaaggagctggtggaggagcagggccgcacagctggctatgaccccaacctggacaactgcctggtgacagaggacctgctgtctgtgctggccgagctgcaggaggccctgtggcactggccagaggacagccaccctggcctggccggggccagtgacaccggcaccggcggctgcctggtggtgcacgtggtgtcctgtgaggaggagttccagcagcagaagctggacctgctgtggcagaagctggtggacaaggcccccctgcggcagaagcacctgatctgtggccctgtgaaggtggccggggcccctggcaccctgatgacagcccctgagtactatgagttccgccacacccaggtgtgcaaggccagcgccctgaagcacggcggggacctggcccaggaccctgcctggacagagatcttcggcgtgctgtctgtggccaccatcaagtttgagatgctgagcacagccccccagagccagctgttcctggccctggccgacagcagcatcagcaccaagggcaccaagagcggcacctttgtgatgtacaactgtgcccggctggccaccctgtttgagagctacaagtgcagcatggagcagggcctgtaccccaccttcccccctgtgagcagcctggacttcagcctgctgcatgatgaaggagagtggctgctgctcttcaacagcatcctgcccttcccagacctgctgagcaggacagctgtgctggactgcacagcccctggcctgcacatcgctgtgaggacagagatgatctgcaagttcctggtgcagctgtccatggacttcagcagctactacaacagagtgcacatcctgggggagccccggccccacctgtttggccagatgtttgtgcggctgcagctgctgcgggctgtgcgggaggtgctgcacacaggcctggccatgctgggcctgccccccctgagccacatctag

SEQ ID NO: 19281 - DNA, 1353 bp, Artificial Sequence
  Description of Artificial Sequence: Synthetic coding sequence
atgggcaagagctttgccaacttcatgtgcaagaaggacttccacccagccagcaagagcaacatcaagaaggtgtggatggccgagcagaagatctcctatgacaagaagaagcaggaggagctgatgcagcagtacctgaaggagcaggagagctatgacaaccggctgctgatgggagatgagcgggtgaagaatggcctgaacttcatgtatgaggcccctcctggggccaagaaggagaacaaggagaaggaggagacagaaggagaaacagagtacaagtttgagtggcagaagggggccccccgggagaagtatgccaaggatgacatgaacatccgggaccagcccttcggcatccaggtgagaaatgtgcgctgcatcaagtgccacaagtggggccacgtgaacacagaccgggagtgccccctgtttggcctgagcggcatcaatgccagctctgtgcccacagatggcagcggccccagcatgcaccccagcgagctgattgctgagatgagaaattctggctttgccctgaagagaaatgtgctgggcaggaacctgacagccaatgaccccagccaggagtatgtggccagcgagggggaggaggaccctgaggtggagttcctgaagagcctgaccaccaagcagaagcagaagctgctgaggaagctggaccggctggagaagaagaagaagaagaaggacaggaagaagaagaagttccagaagagccgcagcaagcacaagaagcacaagagcagcagcagcagcagcagcagcagcagcagcagcagcagcacagagaccagcgagagcagcagcgagagcgagagcaacaacaaggagaagaagatccagaggaagaagaggaagaagaacaagtgcagcggccacaacaacagcgacagcgaggagaaggacaagagcaagaagaggaagctgcacgaggagctgagcagcagccaccacaaccgggagaaggccaaggagaagccccgcttcctgaagcatgagagcagccgggaggacagcaagtggagccacagcgacagcgacaagaagagcaggacccacaagcacagccctgagaagaggggcagcgagaggaaggagggcagcagccgcagccacggccgggaggagaggagccgccgcagccgcagccgcagccctggcagctacaagcagcgggagaccaggaagagggcccagagaaatcctggagaggagcagagcagaagaaatgacagccgcagccacggcacagacctgtacagaggagagaagatgtaccgggagcaccctgggggcacccacaccaaggtgacccagcgggagtag

SEQ ID NO: 19282 - DNA, 1152 bp, Artificial Sequence
  Description of Artificial Sequence: Synthetic coding sequence
atgagccctgaggtggccctgaaccgcatcagccccatgctgagccccttcatcagctctgtggtgagaaatggcaaggtgggcctggatgccaccaactgcctgcgcatcacagacctgaagagcggctgcaccagcctgaccccaggccccaactgtgaccgcttcaagctgcacatcccctatgctggggagaccctgaagtgggacatcatcttcaatgcccagtacccagagctgcccccagacttcatctttggagaagatgctgagttcctgcctgaccccagcgccctgcagaacctggcctcctggaaccccagcaacccagaatgtctgctgctggtggtgaaggagctggtgcagcagtaccaccagttccagtgcagccggctgcgggagagcagccggctgatgtttgagtaccagaccctgctggaggagccccagtatggagagaacatggagatctatgccggcaagaagaacaactggacaggagagttcagcgcccgcttcctgctgaagctgcctgtggacttcagcaacatccccacctacctgctgaaggatgtgaatgaagaccccggggaggatgtggccctgctgtctgtgtcctttgaggacacagaggccacccaggtgtaccccaagctgtacctgagccccagaattgaacatgccctgggcggcagcagcgccctgcacatcccagccttccctgggggcggctgcctgattgattatgtgccccaggtgtgccacctgctgaccaacaaggtgcagtatgtgatccagggctaccacaagagaagagagtacatcgccgccttcctgagccacttcggcaccggggtggtggagtatgatgctgagggcttcaccaagctgaccctgctgctgatgtggaaggacttctgcttcctggtgcacatcgacctgcccctcttcttcccccgggaccagcccaccctgaccttccagagcgtgtaccacttcaccaacagcggccagctgtacagccaggcccagaagaactacccctacagcccccgctgggatggaaatgagatggccaagagggccaaggcctacttcaagacctttgtgccccagttccaggaggccgcctttgccaacgggaagctgtag

SEQ ID NO: 19283 - DNA, 675 bp, Artificial Sequence
  Description of Artificial Sequence: Synthetic coding sequence
atgcccaacagatgtggcatcatccacgtgcggggccccatgccacccaaccgcatcagccatggagaggtgctggagtggcagaagacctttgaggagaagctgacccccctgctgtctgtgcgggagagcctgtctgaggaggaggcccagaagatgggcaggaaggaccctgagcaggaggtggagaagtttgtgaccagcaacacccaggagctgggcaaggacaagtggctgtgccccctgagcggcaagaagttcaagggccctgagtttgtgaggaagcacatcttcaacaagcacgccgagaagattgaggaggtgaagaaggaggtggccttcttcaacaacttcctgacagatgccaagaggcctgccctgcctgagatcaagccagcccagcccccaggccctgcccagatcctgcccccaggcctgaccccaggcctgccctacccccaccagaccccccagggcctgatgccctacggccagccccggccccccatcggcctgtggagctggtgctgccccccctgcagcccccaggaggccctgcacacccccatgcccaggatggtgctggtggagggcaccatgatgcccagcgaggcccgggaggtgatcctgggcaacctggccaccggctggtttgtggagacccagggcccctag

SEQ ID NO: 19284 - DNA, 4806 bp, Artificial Sequence
  Description of Artificial Sequence: Synthetic coding sequence
atggaggccggctctgtggtgcgggccatctttgacttctgccccagcgtgtctgaggagctgcccctgtttgtgggggacatcatcgaggtgctggccgtggtggatgagttctggctgctgggcaagaaggaggatgtgacaggccagttccccagcagctttgtggagatcgtgaccatccccagcctgaaggagggggagcggctgtttgtgtgcatctgtgagttcaccagccaggagctggacaacctgcccctgcacagaggagacctggtgatcctggatggcatccccacagctggctggctgcagggccgcagctgctggggcgcccggggcttcttccccagcagctgtgtgcgggagctgtgcctgagcagccagagccggcagtggcacagccagagcgccctcttccagatccctgagtacagcatgggccaggcccgggccctgatgggcctgagcgcccagctggatgaggagctggacttccgggagggagatgtgatcaccatcattggagtgcctgagcccggctggtttgaaggagagctggagggccggcggggcatcttccctgagggctttgtggagctgctgggccccctgaggacagtggatgaatctgtgagcagcggcaaccaggatgactgcatcgtgaatggagaggtggacacccctgtgggggaggaggagattggaccagatgaagatgaggaggagcccggcacctatggagtggccctgtaccgcttccaggccctggagcccaatgagctggactttgaggtgggggacaagatccgcatcctggccaccctggaggatggctggctggagggcagcctgaagggccgcacaggcatcttcccctacagatttgtgaagctgtgcccagacaccagggtggaggagaccatggccctgccccaggagggcagcctggcccgcatccctgagaccagcctggactgcctggagaacaccctgggcgtggaggagcagagacatgagaccagtgaccacgaggccgaggagccagactgcatcatcagcgaggcccccaccagccccctgggccacctgaccagtgaatatgacacagacaggaacagctaccaggatgaggacacagctgggggcccccccaggagccctggggtggagtgggagatgcccctggccacagacagccccaccagtgaccccacagaggtggtgaatggcatcagcagccagccccaggtgcccttccaccccaacctgcagaagagccagtactacagcacagtgggcggcagccacccccacagcgagcagtacccagacctgctgcccctggaggcccggacccgggactatgccagcctgccccccaagaggatgtacagccagctgaagaccctgcagaagcctgtgctgcccctgtaccggggcagctctgtgtctgccagccgggtggtgaagccccggcagagcagcccccagctgcacaacctggccagctacaccaagaagcaccacaccagctctgtgtacagcatcagcgagcggctggagatgaagccaggcccccaggcccagggcctggtgatggaggccgccacccacagccagggagatggcagcacagacctggacagcaagctgacccagcagctgattgaatttgagaagagcctggccggccctggaacagagccagacaagatcctgcggcacttcagcatcatggacttcaacagcgagaaggacatcgtgcggggcagcagcaagctgatcacagagcaggagctgcctgagaggaggaaggccctgcggcccccaccaccccggccctgcacccctgtgtccaccagcccccacctgctggtggaccagaacctgaagccagccccacccctggtggtgcggcccagcaggcctgcccccctgccccccagcgcccagcagaggaccaatgctgtgagccccaagctgctgagccgccaccggcccacctgtgagaccctggagaaggagggccctggccacatgggccgcagcctggaccagaccagcccctgccccctggtgctggtgcgcatcgaggagatggagcgggacctggacatgtacagccgggcccaggaggagctgaacctgatgctggaggagaagcaggatgagagcagcagagctgagaccctggaggacctgaagttctgtgagagcaacatcgagagcctgaacatggagctgcagcagctgcgggagatgaccctgctgagcagccagagcagcagcctggtggcccccagcggctctgtgtctgcagaaaatcctgagcagaggatgctggagaagagggccaaggtgattgaggagctgctgcagacagagcgggactacatccgggacctggagatgtgcatcgagcgcatcatggtgcccatgcagcaggcccaggtgcccaacatcgactttgagggcctgtttggaaacatgcagatggtgatcaaggtgtccaagcagctgctggccgccctggagatcagtgatgctgtgggccctgtgttcctgggccacagagatgagctggagggcacctacaagatctactgccagaaccatgatgaggccatcgccctgctggagatctatgagaaggatgagaagatccagaagcacctgcaggacagcctggccgacctgaagagcctgtacaatgagtggggctgcaccaactacatcaacctgggcagcttcctgatcaagcctgtgcagagggtgatgagataccccctgctgctgatggagctgctgaacagcaccccagagagccacccagacaaggtgcccctgaccaatgctgtgctggccgtgaaggagatcaacgtgaacatcaatgagtacaagaggaggaaggacctgggcaagaacagcatcatcgccgagaaggagtatgcccatgctgaggagagcgccttcctgacctacagcctggtgctgaagtacagaaaaggagatgaggacagcctgatggagaagatcagcaagctgaacatccacagcatcatcaagaagagcaacagagtgagcagccacctgaagcacctgaccggctttgccccccagatcaaggatgaggtgtttgaggagacagagaagaacttcaggatgcaggagcggctcatcaagagcttcatccgggacctgagcctgtacctgcagcacatccgggagagcgcctgtgtgaaggtggtggccgctgtgtccatgtgggatgtgtgcatggagcggggccaccgggacctggagcagtttgagcgggtgcaccgctacatcagtgaccagctgttcaccaacttcaaggagaggacagagcggctggtgatcagccccctgaaccagctgctgtccatgttcaccggcccccacaagctggtgcagaagagatttgacaagctgctggacttctacaactgcacagagcgggcagagaagctgaaggacaagaagaccctggaggagctgcagagcgccaggaacaactatgaggccctgaatgcccagctgctggatgagctgcccaagttccaccagtatgcccagggcctcttcaccaactgtgtgcacggctatgcagaggcccactgtgactttgtgcaccaggccctggagcagctgaagcccctgctgagcctgctgaaggtggccggccgggagggcaacctgattgccatcttccacgaggagcacagccgggtgctgcagcagctgcaggtgttcaccttcttccctgagagcctgcctgccaccaagaagccctttgagaggaagaccatcgaccggcagagcgccaggaagcccctgctgggcctgcccagctacatgctgcagagcgaggagctgcgggccagcctgctggcccgctacccacctgagaagctgttccaggccgagaggaacttcaatgctgcccaggacctggatgtgtccctgctggagggggacctggtgggcgtcatcaagaagaaggaccccatgggcagccagaaccgctggctgattgacaatggagtgaccaagggctttgtgtacagcagcttcctgaagccctacaaccccaggaggagccacagtgatgcctctgtgggcagccacagcagcacagaaagtgaacatggcagcagcagcccccgcttcccccggcagaacagcggcagcaccctgaccttcaaccccagctccatggctgtgtccttcaccagcggcagctgccagaagcagccccaggatgccagccccccacccaaggaatgtgaccagggcaccctgagcgccagcctgaaccccagcaacagcgagagcagccccagccgctgccccagcgaccctgacagcaccagccagcccaggtctggggacagcgcagatgtggccagagatgtgaagcagcccacagccacccccaggagctacagaaacttccgccaccctgagatcgtgggctacagcgtgcccggcagaaatggccagagccaggacctggtgaagggctgtgccaggacagcccaggccccagaagatagaagcacagagccagatggcagcgaggccgagggcaaccaggtgtactttgctgtgtacaccttcaaggccaggaaccccaatgagctgtctgtgtctgccaaccagaagctgaagatcctggagttcaaggatgtgactggaaacacagagtggtggctggccgaggtgaatggcaagaagggctacgtgcccagcaactacatcaggaagacagagtacacctag

SEQ ID NO: 19285 - DNA, 1596 bp, Artificial Sequence
  Description of Artificial Sequence: Synthetic coding sequence
atgaagtgccactatgaggccctgggcgtgagaagagatgccagcgaggaggagctgaagaaggcctacaggaagctggccctgaagtggcacccagacaagaacctggacaatgctgctgaggccgctgagcagttcaagctgatccaggccgcctatgatgtgctgagtgacccccaggagcgggcctggtatgacaaccaccgggaggccctgctgaagggcggctttgatggagagtaccaggatgacagcctggacctgctgcgctacttcaccgtgacctgctacagcggctatggagatgatgagaagggcttctacacagtgtacagaaatgtgtttgagatgattgccaaggaggagctggagagcgtgctggaggaggaggtggatgacttccccacctttggagacagccagagcgactatgacacagtggtgcaccccttctacgcctactggcagagcttctgcacccagaagaactttgcctggaaggaggagtatgacacccggcaggccagcaaccgctgggagaagagggccatggagaaggagaacaagaagatccgggacaaggccaggaaggagaagaatgagctggtgcggcagctggtggccttcatcaggaagagggacaagagggtgcaggcccacaggaagctggtggaggagcagaatgctgagaaggccaggaaggccgaggagatgaggcggcagcagaagctgaagcaggccaagctggtggagcagtaccgggagcagagctggatgaccatggccaacctggagaaggagctgcaggagatggaggcccgctatgagaaggagtttggagatggcagtgatgaaaatgagatggaggagcacgagctgaaggatgaagaagatggcaaggacagtgatgaagcagaagatgctgagctgtatgatgacctgtactgcccagcctgtgacaagagcttcaagacagagaaggccatgaagaaccacgagaagagcaagaagcaccgggagatggtggccctgctgaagcagcagctggaggaggaggaggagaacttcagccggccccagattgatgagaaccccctggatgacaacagcgaggaggagatggaggatgcccccaagcagaagctgagcaagaagcagaagaagaagaagcagaagccagcccagaactatgatgacaacttcaacgtgaatggacctggagaaggagtgaaggtggaccctgaggacaccaacctgaaccaggacagcgccaaggagctggaggacagcccccaggagaatgtgtctgtgacagagatcatcaagccctgtgatgaccccaagtctgaggccaagtctgtgcccaagcccaagggcaagaagaccaaggacatgaagaagcctgtgcgggtgcctgctgagccccagaccatgtctgtgctgatcagctgcaccacctgccacagcgagttccccagcaggaacaagctgtttgaccacctgaaggccaccggccacgcccgggcccccagcagcagcagcctgaacagcgccaccagcagccagagcaagaaggagaagaggaagaacagatag

SEQ ID NO: 19286 - DNA, 1353 bp, Artificial Sequence
  Description of Artificial Sequence: Synthetic coding sequence
atggtggtgcaggccgctgtggcccccaacagaagccagaggctgctgctgaagatcccctacggcagcctgcggcggcgctctgtggagaggatgacagagggccgccgctgccaggtgcacctgctggatgacaggaagctggagctgctggtgcagcccaagctgctggccaaggagctgctggacctggtggccagccacttcaacctgaaggagaaggagtactttggaattgccttcacagatgaaacaggccacctgaactggctgcagctggacagaagagtgctggagcatgacttccccaagaagagcggccctgtggtgctgtacttctgtgtgcgcttctacatcgagagcatctcctacctgaaggacaatgccaccatcgagctgttcttcctgaatgccaagagctgcatctacaaggagctgattgatgtggacagcgaggtggtgtttgagctggccagctacatcctgcaggaggccaagggggacttcagcagcaatgaggtggtgcggagtgacctgaagaagctgcctgccctgcccacccaggccctgaaggagcaccccagcctggcctactgtgaggacagagtcatcgagcactacaagaagctgaatggccagacccggggccaggccatcgtgaactacatgagcatcgtggagagcctgcccacctacggcgtgcactactatgctgtgaaggacaagcagggcatcccctggtggctgggcctgagctacaagggcatcttccagtatgactaccatgacaaggtgaagcccaggaagatcttccagtggaggcagctggagaacctgtacttccgggagaagaagttctctgtggaggtgcatgacccccggcgggcctctgtgaccaggaggaccttcggccacagcggcattgctgtgcacacctggtacgcctgcccagccctgatcaagagcatctgggccatggccatcagccagcaccagttctacctggacaggaagcagagcaagagcaagatccacgccgcccggagcctgtctgaaattgccatcgacctgacagagaccggcaccctgaagaccagcaagctggccaacatgggcagcaagggcaagatcatcagcggcagcagcggcagcctgctgagcagcggccggcagaggcctgctgggggcaccccacctgagcacggctgggaccccaggggggaccccggccgctggggcgagctgcagctgggccgcctgcagggcaagctgctgcagagctggctgtgcttcccagaccagggctgggaccccaatgccaacctgaggaagctgctgcccggcatcaagtag

SEQ ID NO: 19287 - DNA, 1020 bp, Artificial Sequence
  Description of Artificial Sequence: Synthetic coding sequence
atggagggggagcccccacctgtggaggagcggcggcggctgcaggaggagctgaatgaatttgtggagagcggctgcaggaccctggaggaggtgacagccagcctgggctgggacctggacagcctggaccctggagaggaggaggccgcagaagatgaggtggtgatctgcccctatgacagcaaccaccacatgcccaagagcagcctggccaagcacatggccagctgccgcctgaggaagatgggctacaccaaggaggaggaggatgagatgtacaaccctgagttcttctatgaaaatgtgaagatccccagcatcaccctgaacaaggacagccagttccagatcatcaagcaggccaggacagctgtgggcaaggacagcgactgctacaaccagaggatctacagcagcctgcctgtggaggtgcccctgaaccacaagagatttgtgtgtgacctgacccaggccgaccggctggccctgtatgactttgtggtggaggagaccaagaagaagagaagtgacagccagatcattgaaaatgacagcgacctgtttgtggacctggccgccaagatcaaccaggacaacagcaggaagagccccaagagctacctggagatcctggccgaggtgcgggactacaagagaagacggcagagctaccgggccaagaatgtgcacatcaccaagaagagctacacagaggtgatcagagatgtgatcaacgtgcacatggaggagctgagcaaccactggcaggaggagcaggagaaggccgaggatgatgctgagaagaatgaggagaggagaagtgcctctgtggacagccggcagagcggcggcagctacctggatgctgaatgtagccgccaccggcgggacaggagccgcagcccccacaagaggaagaggaacaaggacaaggacaagaactgtgagagcagaagaaggaaggagagagatggagagcggcaccacagccacaagaggaggaagcagaagatctag

SEQ ID NO: 19288 - DNA, 6810 bp, Artificial Sequence
  Description of Artificial Sequence: Synthetic coding sequence
atggccgagcccagcagcgcccggcggcctgtgcccctcatcgagagcgagctgtacttcctgattgcccgctacctgtctgctggcccctgccggcgggccgcccaggtgctggtgcaggagctggagcagtaccagctgctgcccaagaggctggactgggagggcaatgagcacaacagaagctatgaggagctggtgctgagcaacaagcacgtggccccagaccacctgctgcagatctgccagagaattggccccatgctggacaaggagatcccccccagcatcagccgggtgaccagcctgctgggcgccggccggcagagcctgctgaggacagccaaggactgccgccacacagtgtggaagggcagcgcctttgctgccctgcaccggggccggcccccagagatgcctgtgaactacggcagcccccccaacctggtggagatccaccggggcaagcagctgaccggctgcagcaccttcagcacagccttccctggcaccatgtaccagcacatcaagatgcaccggcgcatcctgggccacctgtctgctgtgtactgtgtggcctttgacagaacaggccaccgcatcttcaccggcagtgatgactgcctggtgaagatctggagcacccacaacggccgcctgctgagcaccctgcggggccacagcgctgagatcagtgacatggctgtgaactatgagaacaccatgattgctgctggcagctgtgacaagatcatccgggtgtggtgcctgcggacctgtgcccctgtggccgtgctgcagggccacacaggcagcatcaccagcctgcagttcagccccatggccaagggcagccagcgctacatggtgtccactggagcagatggcaccgtgtgcttctggcagtgggacctggagagcctgaagttcagcccccggcccctgaagttcacagagaagcccaggcctggggtgcagatgctgtgcagcagcttctctgtgggcggcatgttcctggccaccggcagcacagaccacgtgatccgcatgtacttcctgggctttgaggcccctgagaagattgctgagctggagagccacacagacaaggtggacagcatccagttctgcaacaatggagaccgcttcctgagcggcagcagagatggaacagcccgcatctggaggtttgagcagctggagtggaggagcatcctgctggacatggccacccgcatcagcggggacctgagcagcgaggaggagcgcttcatgaagcccaaggtgaccatgattgcctggaaccagaatgacagcatcgtggtgacagctgtgaatgaccacgtgctgaaggtgtggaacagctacacaggccagctgctgcacaacctgatgggccacgcagatgaggtgtttgtgctggagacccacccctttgacagccgcatcatgctgtctgctggccatgatggcagcatcttcatctgggacatcaccaagggcaccaagatgaagcactacttcaacatgattgagggccagggccacggggctgtgtttgactgcaagttcagccaggacggccagcactttgcctgcacagacagccacggccacctgctgatctttggatttggctgcagcaagccctatgagaagatcccagaccagatgttcttccacacagactaccggcccctcatccgggacagcaacaactacgtgctggatgagcagacccagcaggccccccacctgatgcccccacccttcctggtggatgtggatggcaacccccaccccaccaagtaccagaggctggtgcccggccgggagaacagcgcagatgagcacctgatcccccagctgggctacgtggccaccagtgatggagaggtgattgagcagatcatcagcctgcagaccaatgacaatgatgagaggagccctgagagcagcatcctggatggcatgatccggcagctgcagcagcagcaggaccagaggatgggcgctgaccaggacaccatcccccggggcctgagcaatggagaggagaccccaagaagaggcttccggcggctgagcctggacatccagagcccccccaacatcggcctgcggcgcagcggccaggtggagggcgtgcggcagatgcaccagaatgcccccaggagccagatcgccacagagcgggacctgcaggcctggaagagaagagtggtggtgcctgaggtgcccctgggcatcttcaggaagctggaggacttccggctggagaagggggaggaggagaggaacctgtacatcattggaaggaagaggaagaccctgcagctgagccacaagagtgacagcgtggtgctggtgtcccagagccggcagaggacctgcaggaggaagtaccccaactatggaagaagaaacagatcctggagggagctgagcagtggaaatgaaagcagcagctctgtgagacatgagaccagctgtgaccagagcgagggcagcggcagcagcgaggaggatgagtggaggagtgacaggaagtctgagagctacagcgagagcagcagtgacagcagcagccgctacagcgactggacagcagatgctggcatcaacctgcagccccccctgcggaccagctgcagaagacgcatcacccgcttctgcagcagcagtgaagatgagatcagcacagagaacctgagcccccccaagagaagaaggaagaggaagaaggagaacaagcccaagaaggagaacctgcggaggatgaccccagctgagctggccaacatggagcacctgtatgagttccacccccctgtgtggatcacagacaccaccctgaggaagagcccctttgtgccccagatgggagatgaagtcatctacttccggcagggccacgaggcctacatcgaggccgtgagaagaaacaacatctatgagctgaaccccaacaaggagccctggaggaagatggacctgcgggaccaggagctggtgaagatcgtgggcatccgctatgaggtgggcccccccaccctgtgctgcctgaagctggccttcattgatcctgccaccgggaagctgatggacaagagcttcagcatccgctaccatgacatgccagatgtgattgacttcctggtgctgcggcagttctatgatgaggcccggcagaggaactggcagagctgtgaccgcttccgcagcatcattgatgatgcctggtggtttggaacagtgctgagccaggagccctaccagccccagtacccagacagccacttccagtgctacatcgtgcgctgggacaacacagaaattgagaagctgagcccctgggacatggagcccatcccagacaacgtggaccccccagaggagctgggcgccagcatctctgtgaccacagatgagctggagaagctgctgtacaagccccaggccggggagtggggccagaagagcagagatgaagaatgtgaccgcatcatctctggaattgaccagctgctgaacctggacattgctgctgcctttgctggccctgtggacctgtgcacctaccccaagtactgcaccgtggtggcctaccccacagacctgtacaccatccgcatgaggctggtgaaccgcttctaccgccgcctgagcgccctggtgtgggaggtgcgctacatcgagcacaatgcccggaccttcaatgaacctgagagcgtcatcgcccggagcgccaagaagatcacagaccagctgctgaagttcatcaagaaccagcactgcaccaacatcagcgagctgagcaacaccagtgaaaatgatgagcagaatgctgaggacctggatgacagcgacctgcccaagaccagcagcggcagaagaagagtgcatgatggcaagaagagcatccgggccaccaactacgtggagagcaactggaagaagcagtgcaaggagctggtgaacctgatcttccagtgtgaagattctgagcccttccggcagcctgtggacctggtggagtacccagactacagagacatcatcgacacccccatggactttggcaccgtgcgggagaccctggatgctggcaactatgacagccccctggagttctgcaaggacatccgcctcatcttcagcaatgccaaggcctacacccccaacaagaggagcaagatctacagcatgaccctgcggctgagcgccctgtttgaggagaagatgaagaagatcagcagtgacttcaagattggccagaagttcaatgagaagctgcggcgcagccagcgcttcaagcagaggcagaactgcaagggggacagccagcccaacaagagcatccggaacctgaagcccaagaggctgaagagccagaccaagatcatccctgagctggtgggcagccccacccagagcaccagcagcaggacagcctacctgggcacccacaagaccagcgctggcatcagcagcggcgtgaccagcggggacagcagtgacagcgctgagagcagcgagaggaggaagaggaaccggcccatcaccaacggcagcaccctgtctgagagcgaggtggaggacagcctggccaccagcctgagcagcagcgccagcagcagcagcgaggagagcaaggagagcagccgggcccgggagagcagcagccgcagcggcctgagccgcagcagcaacctgcgggtgaccaggaccagggctgcccagaggaagacaggccctgtgtccctggccaacggctgcggcaggaaggccaccaggaagagggtgtacctgagtgacagcgacaacaacagcctggagaccggggagatcctgaaggcccgggccggcaacaacaggaaggtgctgaggaaatgtgccgctgtggccgccaacaagatcaagctgatgtctgatgtggaggagaacagcagcagcgagagcgtgtgcagcggcaggaagctgccccacagaaatgccagcgctgtggccaggaagaagctgctgcacaacagtgaagatgagcagagcctgaagtcagaaattgaggaggaggagctgaaggatgagaaccagctgctgcctgtgagcagcagccacacagcccagagcaatgtggatgaaagtgagaacagagacagcgagagcgagagtgacctgcgggtggccaggaagaactggcacgccaacggctacaagagccacaccccagcccccagcaagaccaagttcctgaagattgagagcagcgaggaggacagcaagagccatgacagcgaccacgcctgcaacagaacagctggccccagcacctctgtgcagaagctgaaggccgagagcatcagcgaggaggccgacagcgagcccggccgcagcggcggcaggaagtacaacaccttccacaagaatgccagcttcttcaagaagaccaagatcctgagtgacagtgaagattctgagagcgaggagcaggacagagaagatggcaagtgccacaagatggagatgaaccccatcagcggcaacctgaactgtgaccccatcgccatgagccagtgcagcagtgaccacggctgtgaaacagacctggacagtgatgatgacaagattgagaagcccaacaacttcatgaaggacagcgccagccaggacaatggcctgagcaggaagatcagcaggaagagggtgtgcagcagtgacagcgacagcagcctgcaggtggtgaagaagagcagcaaggccaggacaggcctgctgcgcatcacccggcgctgtgccgccacagctgccaacaagatcaagctgatgtctgatgtggaggatgtgtccctggagaatgtgcacaccaggagcaagaatggaaggaagaagcccctgcacctggcctgcaccacagccaagaagaagctgagtgactgtgagggctctgtgcactgtgaggtgcccagcgagcagtatgcctgtgagggcaagcccccagaccctgattctgagggcagcaccaaggtgctgagccaggccctgaatggagacagcgacagcgaggacatgctgaacagcgagcacaagcaccgccacaccaacatccacaagattgatgcccccagcaagaggaagagcagctctgtgaccagcagcggggaggacagcaagagccacatccctggcagcgagacagacaggaccttcagcagcgagagcaccctggcccagaaggccacagctgagaacaactttgaggtggagctgaactacggcctgcggcgctggaatggaagaaggctgcggacctacggcaaggcccccttcagcaagaccaaggtgattcatgacagccaggagacagctgagaaggaggtgaagaggaagaggagccaccctgagctggagaatgtgaagatcagcgagaccaccggcaacagcaagttccggccagacaccagcagcaagagcagtgacctgggctctgtgacagaaagtgacatcgactgcacagacaacaccaagaccaagaggaggaagaccaagggcaaggccaaggtggtgaggaagggcaagaccttcaccgccaacatcagcaagacagtgcggcggcagaggcagagcaagaggccccggctgtctgtggatgacaatgactgggaggacctggactatgccaagagcaagagggtgctgcggcgcagcaagatcaagaccaggaaccagggccgcaggacagtgcgctaccatgatggagatgatgacaggagcctggagaatgtgctggacttcaacggctgcaccctgtag

SEQ ID NO: 19289 - DNA, 492 bp, Artificial Sequence
  Description of Artificial Sequence: Synthetic coding sequence
atgacagcccccagctgtgccttccctgtgcagttccggcagcccagcgtgtctggcctgagccagatcaccaagagcctgtacatcagcaatggagtggccgccaacaacaagctgatgctgagcagcaaccagatcaccatggtgatcaacgtgtctgtggaggtggtgaacaccctgtatgaggacatccagtacatgcaggtgcctgtggccgacagccccaacagccggctgtgtgacttctttgaccccatcgctgaccacatccacagcgtggagatgaagcagggccgcaccctgctgcactgtgccgccggcgtgagccgctctgctgccctgtgcctggcctacctgatgaagtaccacgccatgagcctgctggatgcccacacctggaccaagagctgccggcccatcatccggcccaacagcggcttctgggagcagctgatccactatgagttccagctgtttgggaagaacacctag

SEQ ID NO: 19290 - DNA, 756 bp, Artificial Sequence
  Description of Artificial Sequence: Synthetic coding sequence
atgatcagcaccaccagcaaggagaccaagaaggacaccaagctgtactgcatctgcaagaccccctatgatgagagcaagttctacatcggctgtgacctgtgcaccaactggtaccacggggagtgtgtgggcatcacagagaaggaggccaagaagatggatgtgtacatctgcaatgactgcaagagggcccaggagggcagcagcgaggagctgtactgcatctgcaggaccccctatgatgagagccagttctacatcggctgtgaccgctgccagaactggtaccacggccgctgtgtgggcatcctgcagagcgaggccgagctgattgatgaatatgtgtgcccccagtgccagagcacagaagatgccatgacagtgctgacccccctgacagagaaggactatgagggcctgaagagggtgctgcggagcctgcaggcccacaagatggcctggcccttcctggagcctgtggaccccaatgatgccccagactactacggcgtcatcaaggagcccatggacctggccaccatggaggagcgggtgcagaggcgctactatgagaagctgacagaatttgtggccgacatgaccaagatctttgacaactgccgctactacaaccccagcgacagccccttctaccagtgtgccgaggtgctggagagcttctttgtgcagaagctgaagggcttcaaggccagccgcagccacaacaacaagctgcagagcacagccagctag

SEQ ID NO: 19291 - DNA, 501 bp, Artificial Sequence
  Description of Artificial Sequence: Synthetic coding sequence
atgtacagcctgaaccaggagatcaaggccttcagcaggaacaacctgaggaagcagtgcaccagggtgaccaccctgaccgggaagaagatcatcgagacctggaaggatgcccgcatccacgtggtggaggaggtggagcccagcagcggcggcggctgcggctacgtgcaggacctgagcagtgacctgcaggtgggcgtcatcaagccctggctgctgctgggcagccaggatgctgcccatgacctggacaccctgaagaagaacaaggatggagtggtgctggtgcactgcaatgccggcgtgtccagagctgctgccatcgtgattggcttcctgatgaacagcgagcagaccagcttcaccagcgccttcagcctggtgaagaatgcccggcccagcatctgccccaacagcggcttcatggagcagctgcggacctaccaggagggcaaggagagcaacaagtgtgaccgcatccaggagaacagcagctag

SEQ ID NO: 19292 - DNA, 963 bp, Artificial Sequence
  Description of Artificial Sequence: Synthetic coding sequence
atgagcaagagcgccagccccaaggagcctgagcagctgaggaagctgttcatcggcggcctgagctttgagaccacagatgagagcctgcggagccactttgagcagtggggcaccctgacagactgtgtggtgatgagggaccccaacaccaagaggagccggggctttggatttgtgacctacgccaccgtggaggaggtggatgctgccatgaacaccaccccccacaaggtggatggccgggtggtggagcccaagagagctgtgtcccgggaggacagccagaggcctggggcccacctgactgtgaagaagatctttgtgggcggcatcaaggaggacacagaggagcaccacctgcgggactactttgagcagtatggcaagattgaagtcatcgagatcatgacagaccggggcagcggcaagaagaggggctttgcctttgtgacctttgatgaccatgacagcgtggacaagatcgtcatccagaagtaccacacagtgaagggccacaactgtgaggtgaggaaggccctgcccaagcaggagatggccagcgccagcagcagccagaggggccggcggggcagcggcaactttggaggcggcagaggagatggctttggaggaaatgacaactttggccggggcggcaacttcagcggccggggcggctttggaggcagctgtggcggcggcggctatggaggcagcggagatggctacaatggatttggaaatgatggcagcaactttggaggcggcggcagctacaatgactttggaaactacaacaaccagagcagcaactttggccccatgaagggcggcaactttggaggccgcagcagcggcccctatggaggcggcggccagtactttgccaagccccagaaccagggcggctatggagtgagcagcagcagcagcagctatggcagcggccgccgcttctag

SEQ ID NO: 19293 - DNA, 357 bp, Artificial Sequence
  Description of Artificial Sequence: Synthetic coding sequence
atgagcctgctgaacaagcccaagtctgagatgaccccagaggagctgcagaagcgggaggaggaggagttcaacacaggccccctgtctgtgctgacccagagcgtgaagaacaacacccaggtgctgatcaactgcaggaacaacaagaagctgctgggccgggtgaaggcctttgacagacactgcaacatggtgctggagaatgtgaaggagatgtggacagaggtgcccaagagcggcaagggcaagaagaagagcaagcctgtgaacaaggaccgctacatcagcaagatgttcctgcggggggacagcgtgattgtggtgctgaggaaccccctgattgctgggaagtag

SEQ ID NO: 19294 - DNA, 1179 bp, Artificial Sequence
  Description of Artificial Sequence: Synthetic coding sequence
atgaaggacaccctgggccaggcccagcagagggtggccgagctggagcccctgaaggagcagctgcggggggcccaggagctggccgccagcagccagcagaaggccaccctgctgggggaggagctggccagcgctgctgctgcccgggacaggaccatcgccgagctgcacaggagccggctggaggtggccgaggtgaatggccgcctggccgagctgggcctgcacctgaaggaggagaagtgccagtggagcaaggagcgggccggcctgctgcagagcgtggaggccgagaaggacaagatcctgaagctgtctgctgagatcctgcggctggagaaggctgtgcaggaggagaggacccagaaccaggtgttcaagacagagctggcccgggagaaggacagcagcctggtgcagctgtctgagagcaagcgggagctgacagagctgcggagcgccctgcgggtgctgcagaaggagaaggagcagctgcaggaggagaagcaggagctgctggagtacatgaggaagctggaggcccggctggagaaggtggctgatgagaagtggaatgaagatgccaccacagaagatgaggaggccgctgtgggcctgagctgcccagctgccctgacagacagtgaagatgagagccctgaggacatgaggctgcccccctacggcctgtgtgagcggggggaccccggcagcagccctgctggcccccgggaggccagccccctggtggtgatcagccagcctgcccccatcagcccccacctgagcggccctgctgaggacagcagcagtgacagcgaggctgaagatgagaagtctgtgctgatggctgctgtgcagagcggcggggaggaggccaacctgctgctgcctgagctgggcagcgccttctatgacatggccagcaccatcttctgccgggcccagatcgccctgctgcccctgagccctgccagcacccccagccccaccaccagcggcttcaccgtgggcaccctgtctgagaccagcactggaggccctgccacccccacctggaaggagtgccccatctgcaaggagcgcttccctgctgagagtgacaaggatgccctggaggaccacatggatggccacttcttcttcagcacccaggaccccttcacctttgaatag

SEQ ID NO: 19295 - DNA, 600 bp, Artificial Sequence
  Description of Artificial Sequence: Synthetic coding sequence
atgacccccctggccccctgggaccccaagtatgaggccaaggccggccccaggcctgtgtggggcgccaactgcagcagcggggccagcttcagcggccgcaccctgtgccaccccagcttctggcccctgtatgaagctgccagcggccggggcctgcggcctgtggccccagccaccggccactggaatggccagcaggcccccccagatgctggcttccctgtggtgtgctgtgaagatgtgttcctgagtgaccccctgctgccccggggccagagggtgcccctgtacctgagcaaggccccccagcagatgatgggcagcctgaagctgctgcccccaccacccatcatgtctgcccgggtgctgccccggcccagccccagccggggccccagcacagcctggctgagcggccctgagctgattgccctgaccggcctgctgcagatgagccagggcgagccccggcccagcagcagcgctgtgggccccccagaccacaccagtgacccccccagcccctgtggcagccccagcagcagccagggcgctgacctgagcctgccccagaccccagacacccactgcccctag

SEQ ID NO: 19296 - DNA, 1155 bp, Artificial Sequence
  Description of Artificial Sequence: Synthetic coding sequence
atggagggcctgggccgcagctgcctgtggctgcggcgggagctgagccccccccggccccggctgctgctgctggactgccgcagccgggagctgtatgaaagtgcccgcatcggcggggccctgtctgtggccctgcctgccctgctgctgcggcggctgcggcggggcagcctgtctgtgcgggccctgctgcccggcccccccctgcagcccccacctccagcccctgtgctgctgtatgaccagggcggcggcagaagaagaagaggagaggccgaggccgaggccgaggagtgggaggccgagagcgtgctgggcaccctgctgcagaagctgcgggaggagggctacctggcctactacctgcagggcggcttcagccgcttccaggctgaatgtccccacctgtgtgagaccagcctggccggccgggccggcagctccatggcccctgtgcccggccctgtgcctgtggtgggcctgggcagcctgtgcctgggcagtgactgcagtgatgctgagagcgaggccgaccgggacagcatgagctgtggcctggacagcgagggcgccaccccacctcctgtgggcctgcgggccagcttccctgtgcagatcctgcccaacctgtacctgggcagcgcccgggacagcgccaacctggagagcctggccaagctgggcatccgctacatcctgaatgtgacccccaacctgcccaacttctttgagaagaatggagacttccactacaagcagatccccatcagtgaccactggagccagaacctgagccgcttcttccctgaggccatcgagttcattgatgaggccctgagccagaactgtggggtgctggtgcactgcctggccggcgtgagccgctctgtgacagtgacagtggcctacctgatgcagaagctgcacctgagcctgaatgatgcctatgacctggtgaagaggaagaagagcaacatcagccccaacttcaacttcatgggccagctgctggactttgagaggagcctgcggctggaggagcggcacagccaggagcagggcagcggcggccaggccagcgctgccagcaacccccccagcttcttcaccacccccaccagtgatggagcctttgagctggcccccacctag

SEQ ID NO: 19297 - DNA, 2208 bp, Artificial Sequence
  Description of Artificial Sequence: Synthetic coding sequence
atggccgagcccctgctgaggaagaccttcagccggctgcggggccgggagaagctgcccaggaagaagagtgatgccaaggagcggggccacccagcccagaggcctgagcccagccccccagagcctgagccccaggcccctgagggcagccaggccggggctgagggccccagcagccctgaggccagccgcagccctgcccggggggcctacctgcagagcctggagcccagcagccgccgctgggtgctgggcggggccaagccagctgaggacaccagcctgggccctggggtgcccggcactggagagcctgctggggagatctggtacaaccccatccctgaggaggacccccggcccccagcccctgagcccccaggcccccagcccggcagcgctgagagcgagggcctggccccccagggcgccgccccagccagcccccccaccaaggccagcaggaccaagagccctggccctgcccggcggctgagcatcaagatgaagaagctgcctgagctgcggcggcggctgagcctgcggggccccagggctggccgggagcgggagcgggccgccccagctggcagcgtcatcagccgctaccacctggacagctctgtgggcggccctggccctgctgctggccctgggggcaccaggagccccagggctggctacctgagtgatggagacagccctgagaggcctgctggcccccccagccccaccagcttccggccctatgaggtgggccctgctgcccgggcccccccagctgccctgtggggccgcctgagcctgcacctgtatggcctgggcggcctgcggcctgcccctggggccaccccccgggacctgtgctgcctgctgcaggtggatggagaggcccgggccaggacaggccccctgcggggcggccctgacttcctgcggctggaccacaccttccacctggagctggaggccgcccggctgctgcgggccctggtgctggcctgggaccccggggtgagaagacaccggccctgtgcccagggcaccgtgctgctgcccaccgtcttccggggctgccaggcccagcagctggccgtgcggctggagccccagggcctgctgtatgccaagctgaccctgtctgagcagcaggaggccccagccacagctgagccccgggtgtttggcctgcccctgcccctgctggtggagcgggagaggcctcctggccaggtgcccctcatcatccagaagtgtgtgggccagatcgagcggcggggcctgcgggtggtgggcctgtaccgcctgtgtggcagcgctgctgtgaagaaggagctgagagatgcctttgagcgggacagcgctgctgtgtgcctgtctgaggacctgtacccagacatcaacgtcatcaccggcatcctgaaggactacctgcgggagctgcccacccccctcatcacccagcccctgtacaaggtggtgctggaggccatggcccgggacccccccaacagagtgccccccaccacagagggcacccggggcctgctgagctgcctgcctgatgtggagcgggccaccctgaccctgctgctggaccacctgcggctggtgtcctccttccacgcctacaacaggatgaccccccagaacctggccgtgtgctttggacctgtgctgctgcctgcccggcaggcccccacccggccccgggcccggagcagcggccctggcctggccagcgctgtggacttcaagcaccacatcgaggtgctgcactacctgctgcagagctggccagacccccggctgccccggcagagcccagatgtggccccctacctgcggcccaagaggcagccccccctgcacctgcccctggccgaccctgaggtggtgacccggccccggggccggggcggccctgagagcccccccagcaacagatatgctggggactggagcgtgtgtggccgggacttcctgccctgtggccgggacttcctgagcggccctgactatgaccacgtgactggaagtgacagtgaagatgaagatgaggaggtgggggagccccgggtgactggagactttgaagatgactttgatgcccccttcaacccccacctgaacctgaaggactttgatgccctgatcctggacctggagcgggagctgagcaagcagatcaacgtgtgcctgtag

SEQ ID NO: 19298 - DNA, 660 bp, Artificial Sequence
  Description of Artificial Sequence: Synthetic coding sequence
atgccccggggcaggaagagcagaagaagaagaaatgcccgggctgctgaggagaacagaaacaacaggaagatccaggccagcgaggccagcgagacccccatggccgcctctgtggtggccagcaccccagaagatgacctgagcggccctgaggaggaccccagcaccccagaggaggccagcaccaccccagaggaggccagcagcacagcccaggcccagaagcccagcgtgcccaggagcaacttccagggcaccaagaagagcctgctgatgagcatcctggccctgatcttcatcatgggcaacagcgccaaggaggccctggtgtggaaggtgctgggcaagctgggcatgcagcccggccggcagcacagcatctttggagaccccaagaagatcgtgacagaggagtttgtgcggcggggctacctgatctacaagcctgtgcccaggagcagccctgtggagtatgagttcttctggggcccccgggcccacgtggagagcagcaagctgaaggtgatgcactttgtggcccgggtgaggaaccgctgcagcaaggactggccctgcaactatgactgggacagtgatgatgatgctgaggtggaggccatcctgaacagcggggcccggggctacagcgccccctag

SEQ ID NO: 19299 - DNA, 702 bp, Artificial Sequence
  Description of Artificial Sequence: Synthetic coding sequence
atgaacctgaacttcaccagccccctgcacccagccagcagccagaggcccaccagcttcttcatcgaggacatcctgctgcacaagcccaagcccctgcgggaggtggccccagaccactttgccagcagcctggccagccgggtgcccctgctggactatggctaccccctgatgcccacccccaccctgctggccccccacgcccaccaccccctgcacaagggggaccaccaccacccctacttcctgaccaccagcggcatgcctgtgcctgccctcttcccccacccccagcacgccgagctgcccgggaagcactgcagaagaaggaaggccaggacagtgttcagtgacagccagctgagcggcctggagaagagatttgagatccagcgctacctgagcaccccagagcgggtggagctggccacagccctgagcctgtctgagacccaggtgaagacctggttccagaacagaaggatgaagcacaagaagcagctgaggaagagccaggatgagcccaaggccccagatggccctgagagccctgagggcagcccccggggcagcgaggccgccacagctgctgaggcccggctgagcctgcctgctggcccctttgtgctgacagagccagaagatgaggtggacattggagatgaaggagagctgggcagcggcccccacgtgctgtag

SEQ ID NO: 19300 - DNA, 873 bp, Artificial Sequence
  Description of Artificial Sequence: Synthetic coding sequence
atggagctgcctgctgtgggggagcacgtgtttgctgtggagagcattgagaagaagaggatcaggaagggccgggtggagtacctggtgaagtggaggggctggagccccaagtacaacacctgggagcctgaggagaacatcctggacccccggctgctgattgccttccagaaccgggagcggcaggagcagctgatgggctacaggaagaggggccccaagcccaagcccctggtggtgcaggtgcccacctttgcccggcgcagcaatgtgctgaccggcctgcaggacagcagcacagacaacagagccaagctggacctgggcgcccagggcaagggccagggccaccagtatgagctgaacagcaagaagcaccaccaccacgctgtgggcctgaacctgagccacgtgaggaagcgctgcctgtctgagacccacggggagcgggagccctgcaagaagaggctgacagcccggagcatcagcacccccacctgcctgggcggcagccctgctgctgagaggcctgctgacctgcccccagctgctgccctgccccagcctgaggtgatcctgctggacagcgacctggatgagcccatcgacctgcgctgtgtgaagaccaggtctgaggccggggagccccccagcagcctgcaggtgaagccagagaccccagccagcgctgctgtggccgtggccgctgctgctgcccccaccaccacagctgagaagcccccagctgaggcccaggatgagcctgctgagagcctgtctgagttcaagcccttctttggaaacatcatcatcacagatgtgacagccaactgcctgactgtgaccttcaaggagtatgtgacagtgtag

SEQ ID NO: 19301 - DNA, 744 bp, Artificial Sequence
  Description of Artificial Sequence: Synthetic coding sequence
atgacagaggacagccagaggaacttccgctctgtgtactatgagaaggtgggcttccggggcgtggaggagaagaagagcctggagatcctgctgaaggatgaccggctggacacagagaagctgtgcaccttcagccagcgcttccccctgcccagcatgtaccgggccctggtgtggaaggtgctgctgggcatcctgcccccccaccacgagagccacgccaaggtgatgatgtacaggaaggagcagtacctggatgtgctgcacgccctgaaggtggtgcgctttgtgtctgatgccaccccccaggccgaggtgtacctgaggatgtaccagctggagagcggcaagctgcccaggagccccagcttccccctgcccaaggcctttgagcagtacctgaacctggaggatggccgcctgctgacccacctgaggatgtgcagcgctgcccccaagctgccctatgacctgtggttcaagcgctgctttgctggctgcctgcctgagagcagcctgcagagggtgtgggacaaggtggtgtctggcagctgcaagatcctggtgtttgtggccgtggagatcctgctgaccttcaagatcaaggtgatggccctgaacagcgctgagaagatcaccaagttcctggagaacatcccccaggacagcagtgatgccatcgtgtccaaggccatcgacctgtggcacaagcactgcggcacccctgtgcacagcagctag

SEQ ID NO: 19302 - DNA, 546 bp, Artificial Sequence
  Description of Artificial Sequence: Synthetic coding sequence
atggtgagcagctgctgcggctctgtgtcctctgagcagagctgtggcctggagaactgctgccggcccagctgctgccagaccacctgctgcaggaccacctgctgccggcccagctgctgcaagccccagtgctgccagagcgtgtgctaccagcccacctgctgccaccccagctgctgcatcagcagctgctgccggccctactgctgtgagagcagctgctgccggccctgctgctgccagaccacctgctgcaggaccacctgctgcaggaccacctgctgctgccccagctgctgcgtgagcagctgctgccggccccagtgctgccagagcgtgtgctgccagcccacctgctgccggcccagctgctgcatcagcagctgctgccaccccagctgctgtgagagcagctgctgccggccctgctgctgcgtgcggcctgtgtgtggccgggtgtcctgccacaccacctgctaccggcccacctgtgtgatcagcacctgcccccggcccctgtgctgtgccagcagctgctgctag

SEQ ID NO: 19303 - DNA, 1086 bp, Artificial Sequence
  Description of Artificial Sequence: Synthetic coding sequence
atggccctgaatgtggcccctgtgcgggacaccaagtggctgaccctggaggtgtgccggcagttccagaggggcacctgcagcagaagtgatgaggagtgcaagtttgcccacccccccaagagctgccaggtggagaatggccgggtgattgcctgctttgacagcctgaagggccgctgcagccgggagaactgcaagtacctgcacccccccacccacctgaagacccagctggagatcaatggaagaaacaacctgatccagcagaagacagctgctgccatgctggcccagcagatgcagttcatgtttcctggcacccccctgcaccctgtgcccaccttccctgtgggccctgccatcggcaccaacacagccatcagctttgccccctacctggcccctgtgaccccaggagtgggcctggtgcccacagagatcctgcccaccacccctgtgattgtgcccggcagcccccctgtgacagtgcccggcagcacagccacccagaagctgctgaggacagacaagctggaggtgtgccgggagttccagaggggcaactgtgcccggggggagacagactgccgctttgcccaccctgctgacagcaccatgattgacaccagtgacaacacagtgacagtgtgcatggactacatcaagggccgctgcatgagggagaagtgcaagtacttccaccccccagcccacctgcaggccaagatcaaggccgcccagcaccaggccaaccaggccgctgtggccgcccaggccgctgctgctgctgccaccgtgatggccttccccccaggggccctgcaccccctgcccaagaggcaggccctggagaagagcaatggcaccagcgctgtgttcaaccccagcgtgctgcactaccagcaggccctgaccagcgcccagctgcagcagcacgccgccttcatccccacagacaacagcgagatcatcagcagaaatggcatggagtgccaggagagcgccctgcgcatcaccaagcactgctactgcacctactaccctgtgagcagcagcattgagctgccccagacagcctgctag

SEQ ID NO: 19304 - DNA, 1017 bp, Artificial Sequence
  Description of Artificial Sequence: Synthetic coding sequence
atgctgaagaacaagggccacagcagcaagaaggacaacctggccgtgaatgctgtggccctgcaggaccacatcctgcatgacctgcagctgaggaacctgtctgtggccgaccacagcaagacccaggtgcagaagaaggagaacaagagcctgaagagggacaccaaggccatcatcgacaccggcctgaagaagaccacccagtgccccaagctggaggacagcgagaaggagtatgtgctggaccccaagcccccacccctgaccctggcccagaagctgggcctcatcggccccccacctccacccctgagcagtgatgagtgggagaaggtgaagcagaggagcctgctgcagggcgacagcgtgcagccctgccccatctgcaaggaggagtttgagctgcggccccaggtgttcagcatccggggcaagaaccagtaccagaccagggtcatccatgatggagcccggctcttccgcatcaagtgtgtgacccgcatccaggcctactggaggggctgtgtggtgaggaagtggtacagaaacctgaggaagacagtgcccccaacagatgccaagctgaggaagaagttctttgagaagaagttcacagagatcagccaccgcatcctgtgcagctacaacaccaacatcgaggagctgtttgctgagattgaccagtgcctggccatcaacagatctgtgctgcagcagctggaggagaagtgtggccacgagatcacagaggaggagtgggagaagatccaggtgcaggccctgcggcgggagacccatgagtgcagcatctgcctggcccccctgtctgctgctgggggccagagggtgggcgccggccgccgcagccgggagatggccctgctgagctgcagccacgtgttccaccacgcctgcctgctggccctggaggagttctctgtgggggacaggcctcccttccacgcctgccccctgtgccgcagctgctaccagaagaagatcctggagtgctag

SEQ ID NO: 19305 - DNA, 1098 bp, Artificial Sequence
  Description of Artificial Sequence: Synthetic coding sequence
atggctgctgctgctgctggaacagccaccagccagcgcttcttccagagcttcagtgatgccctgattgatgaggacccccaggccgccctggaggagctgaccaaggccctggagcagaagccagatgatgcccagtactactgccagagggcctactgccacatcctgctgggcaactactgtgtggccgtggctgatgccaagaagagcctggagctgaaccccaacaacagcacagccatgctgaggaagggcatctgtgagtaccacgagaagaactatgctgctgccctggagaccttcacagagggccagaagctggacatcgagaccggcttccaccgggtgggccaggccggcctgcagctgctgaccagcagtgaccccccagccctggacagccagagcgctggcatcactggagcagatgccaacttctctgtgtggatcaagcgctgccaggaggcccagaatggaagtgaaagtgaggtgtggacccaccagagcaagatcaagtatgactggtaccagacagagagccaggtggtgatcaccctgatgatcaagaatgtgcagaagaatgatgtgaatgtggagttcagcgagaaggagctgagcgccctggtgaagctgcccagcggggaggactacaacctgaagctggagctgctgcaccccatcatccctgagcagagcaccttcaaggtgctgagcaccaagattgagatcaagctgaagaagccagaggccgtgcgctgggagaagctggagggccagggagatgtgcccacccccaagcagtttgtggctgatgtgaagaacctgtaccccagcagcagcccctacaccaggaactgggacaagctggtgggggagatcaaggaggaggagaagaatgagaagctggagggagatgctgccctgaacagactcttccagcagatctacagtgatggcagtgatgaggtgaagagggccatgaacaagagcttcatggagagcggcggcaccgtgctgagcaccaactggagcgatgtgggcaagaggaaggtggagatcaaccccccagatgacatggagtggaagaagtactag

SEQ ID NO: 19306 - DNA, 1389 bp, Artificial Sequence
  Description of Artificial Sequence: Synthetic coding sequence
atggacaaggacagccagggcctgctggacagcagcctgatggccagcggcacagccagccgctcagaagatgaggagagcctggccggccagaagagggccagcagccaggccctgggcaccatccccaagagaagaagcagcagccgcttcatcaagaggaagaagtttgatgatgagctggtggagagcagcctggccaagagcagcacccgggccaagggggccagcggcgtggagcccggccgctgcagcggcagcgagcccagcagcagcgagaagaagaaggtgtccaaggcccccagcacccctgtgccccccagccctgccccagcccctggcctgaccaagagggtgaagaagagcaagcagcccctgcaggtgaccaaggacctgggccgctggaagccagcagatgacctgctgctgatcaatgctgtgctgcagaccaatgacctgacctctgtgcacctgggcgtgaagttcagctgccgcttcaccctgcgggaggtgcaggagcgctggtacgccctgctgtatgaccccgtcatcagcaagctggcctgccaggccatgaggcagctgcaccctgaggccatcgccgccatccagagcaaggccctcttcagcaaggccgaggagcagctgctgagcaaggtgggcagcaccagccagcccaccctggagaccttccaggacctgctgcaccgccacccagatgccttctacctggccaggacagccaaggccctgcaggcccactggcagctgatgaagcagtactacctgctggaggaccagacagtgcagcccctgcccaagggggaccaggtgctgaacttcagtgatgctgaggacctgattgatgacagcaagctgaaggacatgagagatgaggtgctggagcacgagctgatggtggccgaccggcggcagaagcgggagatccggcagctggagcaggagctgcacaagtggcaggtgctggtggacagcatcaccggcatgagcagcccagactttgacaaccagaccctggccgtgctgcggggccgcatggtgcgctacctgatgaggagccgggagatcaccctgggccgggccaccaaggacaaccagattgatgtggacctgagcctggagggccctgcctggaagatcagcaggaagcagggcgtcatcaagctgaagaacaatggagacttcttcatcgccaatgaaggaagaagacccatctacattgatggccggcctgtgctgtgtggcagcaagtggaggctgagcaacaacagcgtggtggagatcgccagcctgcgctttgtgttcctgatcaaccaggacctgattgccctgatccgggcagaggccgccaagatcaccccccagtag

SEQ ID NO: 19307 - DNA, 963 bp, Artificial Sequence
  Description of Artificial Sequence: Synthetic coding sequence
atgtctgtgggcttcatcggggccggccagctggcctatgccctggcccggggcttcaccgctgctggcatcctgagcgcccacaagatcatcgccagcagccctgagatgaacctgcccaccgtgtctgccctgaggaagatgggcgtgaacctgaccaggagcaacaaggagaccgtgaagcacagtgatgtgctcttcctggccgtgaagccccacatcatccccttcatcctggatgagatcggggctgatgtgcaggcccggcacatcgtggtgtcctgtgccgccggcgtgaccatcagctctgtggagaagaagctgatggccttccagcctgcccccaaggtgatccgctgcatgaccaacacccctgtggtggtgcaggagggcgccaccgtgtatgccaccggcacccacgccctggtggaggatggccagctgctggagcagctgatgagctctgtgggcttctgcacagaggtggaggaggacctgattgatgctgtgacaggcctgagcggcagcggccctgcctatgccttcatggccctggatgccctggctgatggcggcgtgaagatgggcctgccccggcggctggccatccagctgggcgcccaggccctgctgggcgccgccaagatgctgctggacagcgagcagcacccctgccagctgaaggacaacgtgtgcagccctgggggcgccaccatccacgccctgcacttcctggagagcggcggcttccgcagcctgctgatcaatgctgtggaggccagctgcatccgcacccgggagctgcagagcatggctgaccaggagaagatcagccctgctgccctgaagaagaccctgctggacagagtgaagctggagagccccaccgtgtccaccctgacccccagcagccctgggaagctgctgaccaggagcctggccctgggcggcaagaaggactag

SEQ ID NO: 19308 - DNA, 2370 bp, Artificial Sequence
  Description of Artificial Sequence: Synthetic coding sequence
atggaggatggccccagcaacaatgccagctgcttccggcggctgacagagtgcttcctgagccccagcctgacagatgagaaggtgaaggcctacctgagcctgcacccccaggtgctggatgaatttgtgtctgagagcgtgtctgctgagaccgtggagaagtggctgaagaggaagaacaacaagtcagaagatgagagcgcccccaaggaggtgagccgctaccaggacaccaacatgcagggcgtggtgtatgagctgaacagctacatcgagcagaggctggacaccggcggggacaaccagctgctgctgtatgagctgagcagcatcatcaagatcgccaccaaggcagatggctttgccctgtacttcctgggggagtgcaacaacagcctgtgcatcttcaccccacctggcatcaaggagggcaagcccaggctcatcccagctggccccatcacccagggcaccaccgtgtctgcctacgtggccaagagcaggaagaccctgctggtggaggacatcctgggagatgagcgcttcccccggggcaccggcctggagagcggcacccgcatccagagcgtgctgtgcctgcccatcgtgacagccatcggggacctgattggcatcctggagctgtaccgccactggggcaaggaggccttctgcctgagccaccaggaggtggccacagccaacctggcctgggcctctgtggccatccaccaggtgcaggtgtgccggggcctggccaagcagacagagctgaatgacttcctgctggatgtgtccaagacctactttgacaacatcgtggccatcgacagcctgctggagcacatcatgatctatgccaagaacctggtgaatgctgacagatgtgccctcttccaggtggaccacaagaacaaggagctgtacagcgacctgtttgacatcggggaggagaaggagggcaagcctgtgttcaagaagaccaaggagatccgcttcagcattgagaagggcattgctggccaggtggccaggactggagaggtgctgaacatcccagatgcctatgctgacccccgcttcaaccgggaggtggacctgtacacaggctacaccaccaggaacatcctgtgcatgcccatcgtgtcccggggctctgtgattggagtggtgcagatggtgaacaagatcagcggcagcgccttcagcaagacagatgagaacaacttcaagatgtttgctgtgttctgtgccctggccctgcactgtgccaacatgtaccaccgcatccgccacagcgagtgcatctacagagtgaccatggagaagctgagctaccacagcatctgcaccagcgaggagtggcagggcctgatgcagttcaccctgcctgtgcggctgtgcaaggagattgagctgttccactttgatattggcccctttgagaacatgtggccaggcatctttgtgtacatggtgcacaggagctgtggcaccagctgctttgagctggagaagctgtgccgcttcatcatgtctgtgaagaagaactaccgccgggtgccctaccacaactggaagcatgctgtgacagtggcccactgcatgtatgccatcctgcagaacaaccacaccctcttcacagacctggagaggaagggcctgctgattgcctgcctgtgccacgacctggaccaccggggcttcagcaacagctacctgcagaagtttgaccaccccctggccgccctgtacagcaccagcaccatggagcagcaccacttcagccagacagtgtccatcctgcagctggagggccacaacatcttcagcaccctgagcagcagtgaatatgagcaggtgctggagatcatcaggaaggccatcatcgccacagacctggccctgtactttggaaacaggaagcagctggaggagatgtaccagacaggcagcctgaacctgaacaaccagagccaccgggacagagtcatcggcctgatgatgacagcctgtgacctgtgcagcgtgaccaagctgtggcctgtgaccaagctgacagccaatgacatctatgcagagttctgggccgagggagatgagatgaagaagctgggcatccagcccatccccatgatggaccgggacaagaaggatgaggtgccccagggccagctgggcttctacaatgctgtggccatcccctgctacaccaccctgacccagatcctgcccccaacagagcccctgctgaaggcctgccgggacaacctgagccagtgggagaaggtgatccggggggaggagacagccacctggatcagcagccccagcgtggcccagaaggctgctgccagcgaggactag

SEQ ID NO: 19309 - DNA, 645 bp, Artificial Sequence
  Description of Artificial Sequence: Synthetic coding sequence
atggatgacagcgagaccggcttcaacctgaaggtggtgctggtgtccttcaagcagtgcctggatgagaaggaggaggtgctgctggacccctacatcgcctcctggaagggcctggtgcgcttcctgaacagcctgggcaccatcttctccttcatcagcaaggatgtggtgtccaagctgcgcatcatggagcggctgcggggcggcccccagagcgagcactaccgcagcctgcaggccatggtggcccacgagctgagcaaccggctggtggacctggagcggcgcagccaccaccctgagagcggctgcaggacagtgctgcggctgcaccgggccctgcactggctgcagctgttcctggagggcctgcggaccagcccagaagatgcccggaccagcgccctgtgtgccgacagctacaatgccagcctggccgcctaccacccctgggtggtgagaagagctgtgacagtggccttctgcaccctgcccacccgggaggtgttcctggaggccatgaatgtgggccccccagagcaggccgtgcagatgctgggggaggccctgcccttcatccagagggtgtacaacgtgtcccagaagctgtatgcagagcacagcctgctggacctgccctag

SEQ ID NO: 19310 - DNA, 4293 bp, Artificial Sequence
  Description of Artificial Sequence: Synthetic coding sequence
atgaccagcgctgctgagatcaagaagccccctgtggcccccaagcccaagtttgtggtggccaacaacaagccagcccccccacccatcgcccccaagccagacatcgtcatcagctctgtgccccagagcaccaagaagatgaagccagccatcgcccccaagcccaaggtgctgaagaccagccctgtgcgggagatcggccagagccccagcaggaagatcatgctgaacctggagggccacaagcaggagctggccgagagcacagacaacttcaactgcaagtatgagggcaaccagagcaatgactacatcagccccatgtgcagctgcagcagcgagtgcatccacaagctgggccaccgggagaacctgtgtgtgaagcagctggtgctggagcccctggagatgaatgaaaacctggagaacagcaagattgatgagaccctgaccatcaagaccaggagcaaatgtgacctgtatggagagaaggccaagaaccagggcggcgtggtgctgaaggcctctgtgctggaggaggagctgaaggatgccctgatccaccagatgccacccttcatcagcgcccagaagcaccggcccacagacagccctgagatgaatggaggctgcaacagcaatggccagttccgcatcgagtttgctgacctgagccccagccccagcagctttgagaaggtgcctgaccaccacagctgccacctgcagctgcccagtgatgaatgtgagcactttgagacctgccaggatgacagcgagaagagcaacaactgcttccagagcagcgagctggaggccctggagaatggcaagaggagcaccctcatcagcagtgatggagtgtccaagaagtctgaggtgaaggacctgggccccctggagatccacctggtgccctacacccccaagttccccacccccaagcccaggaagaccaggacagcccggctgctgcggcagaagtgtgtggacaccccatctgagagcacagaggagcccggcaacagcgacagcagcagcagctgcctgacagagaacagcctgaagatcaacaagatctctgtgctgcaccagaatgtgctgtgcaagcaggagcaggtggacaagatgaagctgggcaacaagtctgagctgaacatggagagcaacagtgatgcccaggacctggtgaacagccagaaggccatgtgcaatgagaccaccagctttgagaagatggcccccagctttgacaaggacagcaacctgagcagtgacagcaccaccgtggatggcagctccatgagcctggccgtggatgagggcaccggcttcatccgctgcaccgtgtccatgagcctgcccaagcagctgaagctgacctgcaatgagcacctgcagagcggcaggaacctgggcgtgtctgccccccagatgcagaaggagagcgtcatcaaggaggagaacagcctgcgcatcgtgcccaagaagccccagaggcacagcctgcctgccactggagtgctgaagaaggccgccagcgaggagctgctggagaagagcagctaccccagcagcgaggagaagagcagcgagaagagcctggagaggaaccacctgcagcacctgtgtgcccagaacagaggagtgagcagcagctttgacatgcccaagagggccagcgagaagcctgtgtggaagctgccccaccccatcctgcccttcagcggcaaccctgagttcctgaagtctgtgacagtgagcagcaacagcgagcccagcacagccctgaccaagccccgggccaagagcctgagcgccatggatgtggagaagtgcaccaagccctgcaaggacagcaccaagaagaacagcttcaagaagctgctgtccatgaagctgagcatctgcttcatgaagagtgacttccagaagttctggagcaagagcagccagctgggggacaccaccaccggccacctgagcagcggggagcagaagggcatcgagagtgactggcagggcctgctggtgggggaggagaagaggagcaagcccatcaaggcctacagcacagagaactacagcctggagagccagaagaagaggaagaagagccggggccagaccagcgctgccaacggcctgcgggcagagagcctggatgaccagatgctgagccgggagagcagcagccaggccccctacaagtctgtgaccagcctgtgtgccccagaatatgagaacatccgccactatgaggagatcccagaatatgagaacctgcccttcatcatggccatcaggaagacccaggagctggagtggcagaacagcagctccatggaggatgctgatgccaacgtgtatgaggtggaggagccctatgaggccccagatggccagctgcagctgggccccaggcaccagcacagcagcagcggggccagccaggaggagcagaatgacctgggcctgggggacctgcccagtgatgaggaggagatcatcaacagcagtgatgaagatgatgtgagcagcgagagcagcaagggggagccagaccccctggaggacaagcaggatgaggacaatggcatgaagagcaaggtgcaccacatcgccaaggagatcatgagcagcgagaaggtgtttgtggatgtgctgaagctgctgcacatcgacttcagagatgctgtggcccacgccagccggcagctgggcaagcctgtgattgaggaccgcatcctgaaccagatcctgtactacctgccccagctgtatgagctgaacagagacctgctgaaggagctggaggagaggatgctgcactggacagagcagcagagaattgctgacatctttgtgaagaagggcccctacctgaagatgtacagcacctacatcaaggagtttgacaagaacatcgccctgctggatgagcagtgcaagaagaaccctggctttgctgctgtggtgcgggagtttgagatgagcccccgctgtgccaacctggccctgaagcactacctgctgaagcctgtgcagaggatcccccagtaccgcctgctgctgacagactacctgaagaacctgattgaagatgctggggactacagagacacccaggatgccctggccgtggtgattgaggtggccaaccacgccaatgacaccatgaagcagggcgacaacttccagaagctgatgcagatccagtacagcctgaatggccaccatgaaattgtgcagcccggccgggtcttcctgaaggagggcatcctgatgaagctgagcaggaaggtgatgcagcccaggatgttcttcctgttcaatgatgccctgctgtacaccacccctgtgcagagcggcatgtacaagctgaacaacatgctgagcctggccggcatgaaggtgaggaagcccacccaggaggcctaccagaatgagctgaagattgagagcgtggagaggagcttcatcctgagcgccagcagcgccacagaaagagatgagtggctggaggccatcagccgggccatcgaggagtatgccaagaagaggatcaccttctgccccagccgcagcctggatgaagctgacagcgagaacaaggaggaggtgagccccctgggcagcaaggcccccatctggatcccagacacccgggccaccatgtgcatgatctgcaccagcgagttcaccctgacctggaggaggcaccactgccgggcctgtgggaagatcgtgtgccaggcctgcagcagcaacaagtatggcctggactacctgaagaaccagcctgcccgggtgtgtgagcactgcttccaggagctgcagaagctggaccaccagcacagccccagaattggcagccctggcaaccacaagagccccagcagcgccctgagctctgtgctgcacagcatccccagcggcaggaagcagaagaagatcccagctgccctgaaggaggtgtctgccaacacagaggacagctccatgagcggctacctgtaccgcagcaagggcaacaagaagccctggaagcacttctggtttgtgatcaagaacaaggtgctgtacacctacgccgcctctgaagatgtggccgccctggagagccagcccctgctgggcttcaccgtcatccaggtgaaggatgagaacagcgagagcaaggtgttccagctgctgcacaagaacatgctgttctacgtgttcaaggccgaggatgcccacagcgcccagaagtggattgaggccttccaggagggcaccatcctgtag

SEQ ID NO: 19311 - DNA, 1641 bp, Artificial Sequence
  Description of Artificial Sequence: Synthetic coding sequence
atgggcgcctacctgagccagcccaacacagtgaagtgcagcggagatggagtgggcgccccccggctgcccctgccctacggcttcagcgccatgcagggctggagggtgtccatggaggatgcccacaactgcatccctgagctggacagcgagacagccatgttttctgtgtatgatggccacggcggggaggaggtggccctgtactgtgccaagtacctgcctgacatcatcaaggaccagaaggcctacaaggagggcaagctgcagaaggccctggaggatgccttcctggccattgatgccaagctgaccacagaggaggtgatcaaggagctggcccagattgctggccggcccacagaagatgaagatgagaaggagaaggtggctgatgaagatgatgtggacaatgaggaggccgccctgctgcacgaggaggccaccatgaccatcgaggagctgctgaccaggtatggccagaactgccacaagggccccccccacagcaagagcggcggcggcactggagaggagcccggcagccagggcctgaatggagaggccggccctgaggacagcacccgggagacccccagccaggagaatggccccacagccaaggcctacacaggcttcagcagcaacagcgagcggggcacagaggccggccaggtgggggagcccggcatccccaccggggaggccggccccagctgcagcagcgccagtgacaagctgccccgggtggccaagagcaagttctttgaggacagtgaagatgaaagtgatgaagctgaggaggaggaggaggacagcgaggagtgcagcgaggaggaggatggctacagcagcgaggaggccgagaatgaagaagatgaagatgacacagaggaggccgaggaggatgatgaggaggaggaggaggagatgatggtgcccggcatggagggcaaggaggagcccggcagtgacagcggcaccacagctgtggtggccctgatccggggcaagcagctgattgtggccaatgctggggacagccgctgtgtggtgtctgaggccggcaaggccctggacatgtcctatgaccacaagccagaagatgaggtggagctggcccgcatcaagaatgctgggggcaaggtgaccatggatggccgggtgaatggaggcctgaacctgagccgggccatcggggaccacttctacaagaggaacaagaacctgcccccagaggagcagatgatcagcgccctgcctgacatcaaggtgctgaccctgacagatgaccacgagttcatggtgattgcctgtgatggcatctggaatgtgatgagcagccaggaggtggtggacttcatccagagcaagatcagccagagagatgaaaatggagagctgcggctgctgagcagcatcgtggaggagctgctggaccagtgcctggccccagacaccagcggagatggcaccggctgtgacaacatgacctgcatcatcatctgcttcaagcccaggaacacagctgagctgcagcctgagagcggcaagaggaagctggaggaggtgctgagcacagagggcgcagaagaaaatggaaacagcgacaagaagaagaaggccaagagggactag

SEQ ID NO: 19312 - DNA, 273 bp, Artificial Sequence
  Description of Artificial Sequence: Synthetic coding sequence
atgagcacagccatgaactttggcaccaagagcttccagccccggcccccagacaagggcagcttccccctggaccacctgggggagtgcaagagcttcaaggagaagttcatgaagtgcctgcacaacaacaactttgaaaatgccctgtgcaggaaggagagcaaggagtacctggagtgcaggatggagaggaagctgatgctgcaggagcccctggagaagctgggctttggagacctgaccagcggcaagtctgaggccaagaagtag

SEQ ID NO: 19313 - DNA, 726 bp, Artificial Sequence
  Description of Artificial Sequence: Synthetic coding sequence
atgaacagcggccggcctgagaccatggagaacctgcctgccctgtacaccatcttccagggcgaggtggccatggtgacagattatggagccttcatcaagatccctggctgcaggaagcagggcctggtgcacaggacccacatgagcagctgccgggtggacaagcccagcgagatcgtggatgtgggggacaaggtgtgggtgaagctgattggccgggagatgaagaatgaccgcatcaaggtgtccctgtccatgaaggtggtgaaccagggcaccgggaaggacctggaccccaacaacgtcatcatcgagcaggaggagaggagaagaagaagcttccaggactacacaggccagaagatcaccctggaggccgtgctgaacaccacctgcaagaagtgtggctgcaagggccactttgccaaggactgcttcatgcagcccggcggcaccaagtacagcctcatcccagatgaggaggaggagaaggaggaggccaagtctgctgagtttgagaagccagaccccaccaggaaccccagcaggaagaggaagaaggagaagaagaagaagaagcaccgggacaggaagagcagtgacagcgacagcagtgacagcgagagtgacaccgggaagagggcccggcacaccagcaaggacagcaaggccgccaagaagaagaagaagaagaagaagcacaagaagaagcacaaggagtag

SEQ ID NO: 19314 - DNA, 1758 bp, Artificial Sequence
  Description of Artificial Sequence: Synthetic coding sequence
atggctgctgctgctgctgctgtgggccctggggccggcggggccggcagcgctgtgcctgggggcgccggcccctgtgccaccgtgtctgtgtttcctggggcccggctgctgaccatcggagatgccaacggggagatccagagacatgctgagcagcaggccctgcggctggaggtgcgggccggccctgacagcgctggcatcgccctgtacagccatgaagatgtgtgtgtgttcaagtgcagcgtgtcccgggagacagaatgttcccgggtgggcaagcagagcttcatcatcaccctgggctgcaacagcgtgctgatccagtttgccaccccaaatgacttctgcagcttctacaacatcctgaagacctgccggggccacaccctggagaggtctgtgttcagcgagaggacagaggagagcagcgctgtgcagtacttccagttctacggctacctgagccagcagcagaacatgatgcaggactatgtgaggacaggcacctaccagagggccatcctgcagaaccacacagacttcaaggacaagatcgtgctggatgtgggctgcggcagcggcatcctgtccttctttgctgcccaggccggggccaggaagatctatgctgtggaggccagcaccatggcccagcacgccgaggtgctggtgaagagcaacaacctgacagacagaattgtggtgattcctgggaaggtggaggaggtgtccctgcctgagcaggtggacatcatcatcagcgagcccatgggctacatgctgttcaatgaaagaatgctggagagctacctgcacgccaagaagtacctgaagcccagcggcaacatgttccccaccatcggagatgtgcacctggcccccttcacagatgagcagctgtacatggagcagttcaccaaggccaacttctggtaccagcccagcttccatggagtggacctgagcgccctgcggggagctgctgtggatgagtacttccggcagcctgtggtggacacctttgacatccgcatcctgatggccaagtctgtgaagtacacagtgaacttcctggaggccaaggagggggacctgcaccgcatcgagatccccttcaagttccacatgctgcacagcggcctggtgcacggcctggccttctggtttgatgtggccttcatcggcagcatcatgacagtgtggctgagcacagcccccacagagcccctgacccactggtaccaggtgcgctgcctcttccagagccccctgtttgccaaggccggggacaccctgagcggcacctgcctgctgattgccaacaagaggcagagctatgacatcagcatcgtggcccaggtggaccagacaggcagcaagagcagcaacctgctggacctgaagaaccccttcttccgctacacaggcaccacccccagccccccacctggcagccactacaccagccccagcgagaacatgtggaacacaggcagcacctacaacctgagcagcggcatggctgtggccggcatgcccacagcctatgacctgagcagcgtcatcgccagcggcagctctgtgggccacaacaacctgatccccctgggcagcagcggggcccagggcagcggcggcggcagcaccagcgcccactatgctgtgaacagccagttcaccatgggcggccctgccatctccatggccagccccatgagcatccccaccaacaccatgcactacggcagctag

SEQ ID NO: 19315 - DNA, 771 bp, Artificial Sequence
  Description of Artificial Sequence: Synthetic coding sequence
atggccagcggccggcctgaggagctgtgggaggccgtggtgggcgctgctgagcgcttccgggccaggactggaacagagctggtgctgctgacagctgcccctcctcctccacccaggcctggcccctgtgcctatgctgcccacggccgcggggccctggccgaggccgcccggcgctgcctgcatgacatcgccctggcccacagagctgccacagctgcccggcccccagcccctcctccagccccccagccccccagccccacccccagccccccccggcccaccctggccagagaagataatgaagaagatgaagatgagcccacagaaacagagaccagcggggagcagctgggcatcagtgacaatggaggcctgtttgtgatggatgaagatgccaccctgcaggacctgccccccttctgtgagagtgaccctgagagcacagatgatggcagcctgtctgaggagaccccagctggcccccccacctgcagcgtgcccccagccagcgccctgcccacccagcagtatgccaagagcctgcctgtgtctgtgcctgtgtggggcttcaaggagaagaggacagaggcccggagcagtgatgaggagaatggaccacccagcagcccagacctggacagaattgctgcctccatgagggccctggtgctgcgggaggccgaggacacccaggtgtttggagacctgccccggccccggctgaacaccagtgacttccagaagctgaagaggaagtactag

SEQ ID NO: 19316 - DNA, 4293 bp, Artificial Sequence
  Description of Artificial Sequence: Synthetic coding sequence
atgtgcctggagagcaacctgagcagctgcaagcacctgccctgctgcggcaagctgcacttccagagctgccacggcaatgtgcacaagctgcaccagttccccagcctgcagggctgcaccagcgctggctacttcccctgcagcgacttcaccagcggggcccctggccacctggaggagcacatcagccagagcgagctgaccccccacctgtgcaccaacagcctgcacctgaatgtggtgccccctgtgtgcctgaagggcagcctgtactgtgaggactgcctgaacaagccagccaggaacagcatcattgatgctgccaaggtgtggcccaacatccccccacccaacacccagcctgcccccctggccgtgcccctgtgcaatggctgcggcaccaagggcaccgggaaggagaccaccctgctgctggccaccagcctgggcaaggccgccagcaagtttggcagccctgaggtggccgtggccggccaggtgctggagaacctgccccccatcggggtcttctgggacatcgagaactgcagcgtgcccagcggccgcagcgccacagctgtggtgcagaggatccgggagaagttcttcaagggccaccgggaggccgagttcatctgtgtgtgtgacatcagcaaagaaaacaaggaggtgatccaggagctgaacaactgccaggtgacagtggcccacatcaatgccacagccaagaatgctgctgatgacaagctgcggcagagcctgcggagatttgccaacacccacacagccccagccaccgtggtgctggtgtccacagatgtgaactttgccctggagctgagtgacctgcggcaccgccacggcttccacatcatcctggtgcacaagaaccaggccagcgaggccctgctgcaccacgccaatgaactcatccgctttgaggagttcatcagtgacctgcccccccggctgcccctgaagatgccccagtgccacaccctgctgtatgtgtacaacctgcctgccaacaaggatggcaagtctgtgagcaaccggctgcggcggctgagtgacaactgtggcggcaaggtgctgagcatcaccggctgcagcgccatcctgcgcttcatcaaccaggacagcgctgagcgggcccagaagaggatggagaatgaagatgtgtttgagaagaaggacaaggaggagaccgtcttccaggtgtcctaccccagcgccttcagcaagctggtggccagccggcaggtgagccccctgctggccagccagagctggagcagccgggccagccccctggccttcaacatcgccaacagcagcagcgaggccgactgcccagacccctttgccaacggggctgatgtgcaggtgagcaacatcgactaccgcctgagcaggaaggagctgcagcagctgctgcaggaggcctttgcccggcacggcaaggtgaagtctgtggagctgagcccccacacagactaccagctgaaggctgtggtgcagatggagaacctgcaggatgccatcggggctgtgaacagcctgcaccgctacaagattggcagcaagaagatcctggtgtccctggccaccggggccgccagcaagagcctgagcctgctgcgcttcggccacaagctgaatgtgtctgacctgtacaagctgacagacacagtggccatccgggagcagggcaatggccgcctggtgtgcctgctgcccagcagccaggcccggcagagccccctgggcagcagccagagccatgatggcagcagcaccaactgcagccccatcatctttgaggagctggagtaccacgagcctgtgtgccggcagcactgcagcaacaaggacttctccttcccagactgctacatcgccgagtttggagacctggaggtggtgcaggagaaccagggcggcgtgcccctggagcacttcatcacctgtgtgcctggggtgaacatcgccacagcccagaatggcatcaaggtggtgaagtggatccacaacaagcccccaccacccaacacagacccctggctgctgcggagcaagagccctgtgggcaacccccagctgatccagttcagccgggaggtgattgacctgctgaagagccagcccagctgtgtgatccccatcagccacttcatccccagctaccaccaccactttgccaagcagtgccgggtgtctgactatggctacagcaagctgattgagctgctggaggccgtgccccacgtgctgcagatcctgggcatgggcagcaagaggctgctgaccctgacccaccgggcccaggtgaagcgcttcacccaggacctgctgaagctgctgaagagccaggccagcaagcaggtgattgtgcgggagttcagccaggcctaccactggtgcttcagcaaggactgggatgtgacagaatatggagtgtgtgagctgattgatattgtgtctgagatcccagacaccaccatctgcctgagccagcaggacaatgagatggtgatctgcatccccaagcgggagaggacccaggatgaaattgaaagaaccaagcagttcagcaaggatgtggtggacctgctgcggcaccagccccacttcaggatgcccttcaacaagttcatccccagctaccaccaccacttcggccggcagtgcaagctggcctactacggcttcaccaagctgctggagctgtttgaggccatcccagacaccctgcaggtgctggagtgtggggaggagaagatcctgaccctgacagaggtggagcgcttcaaggccctggccgcccagtttgtgaagctgctgcggagccagaaggacaactgcctgatgatgacagacctgctgacagaatatgccaagaccttcggctacaccttccggctgcaggactatgatgtgagcagcatcagcgccctgacccagaagctgtgccacgtggtgaaggtggccgacatcgagagcggccggcagatccagctgatcaacaggaagagcctgcggagcctgacagcccagctgctggtgctgctgatgtcctgggagggcaccacccacctgtctgtggaggagctgaagaggcactatgagagcacccacaacacccccctgaacccctgtgaatatggcttcatgaccctgacagagctgctgaagagcctgccctacctggtggagacagctgctgcctttgacctgcagatcgagctgaagtttgctgggggctacagcctgctgctggaggagatcctggagtacatccccccacccttcctgagccccctgcccagcttcctgcccccaccacccttcttcttctttgtgttcttcgtcatcttcatcttcttcatctttgtgtttgtgcagtttgtggtgtttgtgttcttcatcgtggtgtttgtgttcttcatcgtggtgtttgtgttcaccaatgacaagatggaggagtgtgtgaagctgaccagcctgtacctgtttgccaagaatgtgcgcagcctgctgcacacctaccactaccagcagatcttcctgcacgagttctccatggcctacaccaagtatgtgggggagaccctgcagcccaagacctacggccacagctctgtggaggagctgctgggcgccatcccccaggtggtggtgcagttcctgcagaagaatggcaaggagctgagctgtgagaactacctgaacctgtatgccaaggccggccgcctgagcagcctgagcctgagccctgccaaccacgagaaccagcccagcgagggggagcgcatcctggaggtgcctgagagccacacagccagcgagctgaagctgggcgcagatggcagcggccccagccacacagagcaggagctgctgcggctgacagatgacagccctgtggacctgctgtgtgcccctgtgcccagctgcctgcccagcccccagctgcggccagaccccgtcatcctgcagagcgctgacctgatccagtttgaggagcggccccaggagcccagcgagatcatgatcctgaaccaggaggagaagatggagatccccatccctgggaagagcaagaccctgaccagtgacagcagcagcagctgcatctctgctgctgtgcctgtgcccccctgccccagcagcgagaccagcgagagcctgctgagcaaggaccctgtggagagccctgccaagaagcagcccaagaacagagtgaagctggccgccaacttcagcctggcccccatcaccaagctgtag

SEQ ID NO: 19317 - DNA, 2346 bp, Artificial Sequence
  Description of Artificial Sequence: Synthetic coding sequence
atgggccagctgcgggactggttccccaacacccaggacctggccggaaatgaccaggagaacatcagacatgctgacaggaacaacagtgatgacaaccacctggccagcgaggacaccagcgccaagcagagcggcaagccaggcatctatgaggaccgggaccccctgcgggtgtccatcagccgggagcagagcttcttcggcagccccctggcccatgaccccttcagctgcctgcagctggtgggccaggagaatgtgtgtggagatgattatgatgaggccgtgaagctgaaggagagcgtggtggagaaccacgctgtgctgtcctatgctgtggaggaggagcacgcctacctgggccccaccgtgaagccagatgacaaggccaagaccctgtcctatgagcccctgagcagcgccaccgtgtccacaggcagcctgctgtcctatgaaaatacagacctgagcctgacagatcctgagagcttcagcgagcacatggatgacagcaagcaggagagcaccaccagcaaggaggaggagaccaacatcatcagcagcatcgtgcccagcacccaggacatctaccagaggcagaacagcagtgatgtgcacaagagcctgctgcctgctgtggatgagaccacctgtggccacacccacttccagcagatgattgacaagtacatcaatgaggccaacctgatccctgagaagacagacctgcaggagctggagcacatcttccccaacctgcaccaccagctgttcaagcccctggagccccacccagactttgacctgagcagcagcagcagcggcatcagcccagacaacagagacttctaccagaggagtgacagcagcagcgagagccactgtgccaccggcctgagcaagagcacagtgtacttcaccgccctgcggaggacctccatgcacagcagcctgaacaccagccccaaccagcagcctgacaccaacctggcccacgtgggcgcccacagctttgccacagagaacatcattggaggcagcgagcagtgctttgagcagctgcagcctgagtacagcagccaggaggagagccagcacgccgacctgcccagcatcttcagcattgaggcccgggacagcagccagggcatgaagaaccagaactaccccagcgaggagcacacagagatcctgcagaacaagaagaagatcgtgcacttccagctgagcatcggcaacctgagctctgtgtacagcagcagtgatgaggccaacgtgtttgaccagctgaatgtgcagcacagcaccccctgtggcagcaacagcagtgaatgttccaccaagcaccagctggagagcaggaaggagagcatgggctttgaggagctgagcaagaggggcgtggtgaccatgctgcagagccagggcctgattgaggacaacaagaatgagacctgccgggtgctggacatcaacccccaggtggaggagacagacagccggctgtgtgtgaggacagtggagatgggcaccagcatccaggccccctacagcctgaccacccagaatgagaagtactttgaaaattctgctgagacagacatccccaagatcaccaagaagctgagccagctgggggagagcgagctgtttgccagcagcggcagcttcagcctgcagagcagcatccctgtgtgggagacagaaacaggccacggcatcatggaggagcctgagctgaccctcatcagcaccacagacaccagcattgctgagatggactttgccaacctgaccctggaggagaagtcagaaaatgaggccaagtgcttcttccaggtgtctgagttcctgcccctggtgtctgccacagaggccagtgactacccagctgtgtctgagctgagcattgagaagcccaggacagccagcacagagaccccccggcggctgacccctgtgcccggcagcctgcaggaggccttcatcaagaggaagaagagcttcatggagaggagccaccagaggcagaaggagatccggaacaagatccacgtgtctgagaacagccagatcaagacagtgaaggagaagcccagcatcagcagctctgtgtcccggctgaagggcgtgaacaaggtgcgggccagcttccctgaggacaggaagaccacccaggccctgcggcaccagaggggcctgcggctgtacaaccagctggccgaggtgaagcagcagaaggaggagaagaccaagcaggaggcctatgcccagaacagagcccgggccaaggagttccacaagaagaccctggagaagctgcgggccaagaacacctgctag

SEQ ID NO: 19318 - DNA, 513 bp, Artificial Sequence
  Description of Artificial Sequence: Synthetic coding sequence
atgggcaagcgctacttctgtgactactgtgaccgctccttccaggacaacctgcacaacaggaagaagcacctgaatggcctgcagcacctgaaggccaagaaggtgtggtatgacatgttcagagatgctgctgccatcctgctggatgagcagaacaagaggccctgcaggaagttcctgctgaccggccagtgtgactttggcagcaactgccgcttcagccacatgtctgagcgggacctgcaggagctgagcatccaggtggaggaggagcggcgggcccgggagtggctgctggatgcccctgagctgcctgagggccacctggaggactggctggagaagagggccaagaggctgagcagcgcccccagcagcagagctgagcccatccgcaccaccgtcttccagtaccctgtgggctggccccctgtgcaggagctgccccccagcctgcgggcccctcctcctgggggctggcccctgcagccccgggtgcagtggggctag

SEQ ID NO: 19319 - DNA, 1542 bp, Artificial Sequence
  Description of Artificial Sequence: Synthetic coding sequence
atggcctctgtgctgagccggcggctgggcaagaggagcctgctgggcgcccgggtgctgggccccagcgccagcgagggccccagcgctgccccacccagcgagcccctgctggagggcgccgccccccagcccttcaccaccagtgatgacaccccctgccaggagcagcccaaggaggtgctgaaggcccccagcaccagcggcctgcagcaggtggccttccagcccggccagaaggtgtatgtgtggtatggaggccaggagtgcaccggcctggtggagcagcacagctggatggagggccaggtgacagtgtggctgctggagcagaagctgcaggtgtgctgccgggtggaggaggtgtggctggccgagctgcagggcccctgcccccaggccccacccctggagcccggggcccaggccctggcctacagacctgtgtccagaaatattgatgtgcccaagaggaagagtgatgctgtggagatggatgagatgatggccgccatggtgctgaccagcctgagctgcagccctgtggtgcagagccccccaggcacagaggccaacttcagcgccagccgggccgcctgtgacccctggaaggagagcggggacatcagtgacagcggcagcagcaccaccagcggccactggagcggcagcagtggagtgtccacccccagccccccccacccccaggccagccccaagtacctgggagatgccttcggcagcccccagacagaccacggctttgaaacagatcctgaccccttcctgctggatgagcccgcccccaggaagaggaagaacagcgtgaaggtgatgtacaagtgcctgtggcccaactgtgggaaggtgctgcggagcatcgtgggcatcaagagacatgtgaaggccctgcacctgggggacacagtggacagcgaccagttcaagcgggaggaggacttctactacacagaggtgcagctgaaggaggagagcgctgctgctgctgctgctgctgctgctggcacccctgtgcccggcacccccaccagcgagcccgcccccacccccagcatgacaggcctgcccctgagcgccctgcccccacccctgcacaaggcccagagcagcggccctgagcaccctggccctgagagcagcctgcccagcggggccctgagcaagagcgcccctggcagcttctggcacatccaggccgaccacgcctaccaggccctgcccagcttccagatccctgtgagcccccacatctacacctctgtgtcctgggccgccgcccccagcgctgcctgcagcctgagccctgtgcgcagccgcagcctgtccttcagcgagccccagcagcctgccccagccatgaagagccacctgattgtgaccagccccccccgggcccagagcggggccaggaaggcccggggggaggccaagaagtgcaggaaggtgtatggcatcgagcaccgggaccagtggtgcacagcctgccgctggaagaaggcctgccagcgcttcctggactag

SEQ ID NO: 19320 - DNA, 555 bp, Artificial Sequence
  Description of Artificial Sequence: Synthetic coding sequence
atgggaaatggcatgaacaagatcctgcccggcctgtacatcggcaacttcaaggatgccagagatgctgagcagctgagcaagaacaaggtgacccacatcctgtctgtgcatgacagcgcccggcccatgctggagggcgtgaagtacctgtgcatcccagctgctgacagccccagccagaacctgaccaggcacttcaaggagagcatcaagttcatccacgagtgccgcctgcggggggagagctgcctggtgcactgcctggccggcgtgagccgctctgtgaccctggtgattgcctacatcatgacagtgacagactttggctgggaggatgccctgcacacagtgcgggccggccgcagctgtgccaaccccaacgtgggcttccagaggcagctgcaggagtttgagaagcatgaggtgcaccagtaccggcagtggctgaaggaggagtatggagagagccccctgcaggatgctgaggaggccaagaacatcctggccgcccctggcatcctgaagttctgggccttcctgcggcggctgtag

SEQ ID NO: 19321 - DNA, 642 bp, Artificial Sequence
  Description of Artificial Sequence: Synthetic coding sequence
atgctgcagctgcgggacagcgtggacagcgctggcaccagccccacagctgtgctggccgccggggaggaggtgggcgccggcggcggccctgggggcggccggcctggggccggcacccccctgcggcagaccctgtggcccctgagcatccatgaccccacccggcgggcccgggtgaaggagtactttgtgttccggcccggcagcattgagcaggccgtggaggagatccgggtggtggtgcggcctgtggaggatggagagatccagggcgtgtggctgctgacagagcgggagggcttcggcatccgcatccagtgggacaagcagagccggcccagcttcatcaaccgctggaacccctggagcaccaacgtgccctatgccaccttcacagagcaccccatggccggggctgatgagaagacagccagcctgtgccagctggagagcttcaaggccctgctgatccaggccgtgaagaaggcccagaaggagagccccctgcccggccaggccaatggagtgctgatcctggagcggcccctgctgattgagacctacgtgggcctgatgtccttcatcaacaatgaggccaagctgggctacagcatgacccggggcaagattggcttctag

SEQ ID NO: 19322 - DNA, 888 bp, Artificial Sequence; identical to SEQ ID NO: 19226
  Description of Artificial Sequence: Synthetic coding sequence

SEQ ID NO: 19323 - DNA, 3867 bp, Artificial Sequence
  Description of Artificial Sequence: Synthetic coding sequence
atgcccaggaagggcacccagcccagcacagccaggagaagagaggagggccccccaccacccagcccagatggagccagcagtgatgctgagcctgagccccccagcggccgcacagagagccctgccacagctgctgagacagccagcgaggagctggacaacagaagcctggaggagatcctgaacagcatccccccacctcctcctccagccatgaccaatgaagctggggccccccggctgatgatcacccacatcgtgaaccagaacttcaagagctatgctggggagaagatcctgggccccttccacaagcgcttcagctgcatcatcggccccaatggaagtggcaagagcaatgtgattgacagcatgctgtttgtgtttggctaccgggcccagaagatccgcagcaagaagctgtctgtgctgatccacaacagtgatgagcacaaggacatccagagctgcaccgtggaggtgcacttccagaagatcatcgacaaggagggagatgattatgaagtcatccccaacagcaacttctacgtgtccaggacagcctgccgggacaacacctctgtgtaccacatcagcggcaagaagaagaccttcaaggatgtgggcaacctgctgcggagccacggcatcgacctggaccacaaccgcttcctgatcctgcagggcgaggtggagcagatcgccatgatgaagcccaagggccagacagaacatgatgagggcatgctggagtacctggaggacatcatcggctgcggccgcctgaatgagcccatcaaggtgctgtgccggcgggtggagatcctgaatgagcacagaggagagaagctgaacagagtgaagatggtggagaaggagaaggatgccctggagggggagaagaacatcgccatcgagttcctgaccctggagaatgagatcttcaggaagaagaaccacgtgtgccagtactacatctatgagctgcagaagagaattgctgagatggagacccagaaggagaagatccacgaggacaccaaggagatcaatgagaagagcaacatcctgagcaatgagatgaaggccaagaacaaggatgtgaaggacacagagaagaagctgaacaagatcaccaagttcatcgaggagaacaaggagaagttcacccagctggacctggaggatgtgcaggtgcgggagaagctgaagcacgccaccagcaaggccaagaagctggagaagcagctgcagaaggacaaggagaaggtggaggagttcaagagcatcccagccaagagcaacaacatcatcaatgagaccaccaccagaaataatgccctggagaaggagaaggagaaggaggagaagaagctgaaggaggtgatggacagcctgaagcaggagacccagggcctgcagaaggagaaggagagccgggagaaggagctgatgggcttcagcaagtctgtgaatgaggcccggagcaagatggatgtggcccagagcgagctggacatctacctgagccgccacaacacagctgtgtcccagctgaccaaggccaaggaggccctgattgctgccagcgagaccctgaaggagaggaaggccgccatccgggacatcgagggcaagctgccccagacagagcaggagctgaaggagaaggagaaggagctgcagaagctgacccaggaggagaccaacttcaagagcctggtgcatgacctcttccagaaggtggaggaggccaagagcagcctggccatgaacagaagccggggcaaggtgctggatgccatcatccaggagaagaagagcggccgcatccctggcatctacggccgcctgggggacctgggcgccattgatgagaagtatgatgtggccatcagcagctgctgccacgccctggactacatcgtggtggacagcattgacatcgcccaggagtgtgtgaacttcctgaagaggcagaacattggagtggccaccttcatcggcctggacaagatggctgtgtgggccaagaagatgacagagatccagaccccagagaacaccccccggctgtttgacctggtgaaggtgaaggatgagaagatccggcaggccttctactttgccctgcgggacaccctggtggccgacaacctggaccaggccaccagggtggcctaccagaaggaccggcgctggagggtggtgaccctgcagggccagatcatcgagcagagcggcaccatgactggaggcggcagcaaggtgatgaagggccgcatgggcagcagcctggtgattgagatcagcgaggaggaggtgaacaagatggagagccagctgcagaatgacagcaagaaggccatgcagatccaggagcagaaggtgcagctggaggagcgggtggtgaagctgcggcacagcgagcgggagatgaggaacaccctggagaagttcaccgccagcatccagaggctgattgagcaggaggagtacctgaatgtgcaggtgaaggagctggaggccaacgtgctggccacagccccagacaagaagaagcagaagctgctggaggagaatgtgtctgccttcaagacagaatatgatgctgtggccgagaaggccggcaaggtggaggccgaggtgaagaggctgcacaacaccatcgtggagatcaacaaccacaagctgaaggcccagcaggacaagctggacaagatcaacaagcagctggatgaatgtgccagcgccatcaccaaggcccaggtggccatcaagacagctgacaggaacctgcagaaggcccaggacagcgtgctgaggacagagaaggagatcaaggacacagagaaggaggtggatgacctgacagctgagctgaagagcctggaggacaaggctgctgaggtggtgaagaacaccaatgctgctgaggagagcctgcctgagatccagaaggagcacaggaacctgctgcaggagctgaaggtgatccaggagaatgaacatgccctgcagaaggatgccctgagcatcaagctgaagctggagcagattgatggccacatcgccgagcacaacagcaagatcaagtactggcacaaggagatcagcaagatcagcctgcaccccatcgaggacaaccccatcgaggagatctctgtgctgagccctgaggacctggaggccatcaagaacccagacagcatcaccaaccagatcgccctgctggaggcccgctgccacgagatgaagcccaacctgggcgccatcgccgagtacaagaagaaggaggagctgtacctgcagagggtggccgagctggacaagatcacctatgagcgggacagcttccggcaggcctatgaggacctgaggaagcagaggctgaatgagttcatggccggcttctacatcatcaccaacaagctgaaggagaactaccagatgctgaccctgggcggagatgctgagctggagctggtggacagcctggaccccttcagcgagggcatcatgttttctgtgcggccccccaagaagtcctggaagaagatcttcaacctgagcggcggggagaagaccctgagcagcctggccctggtgtttgccctgcaccactacaagcccacccccctgtacttcatggatgaaattgatgctgccctggacttcaagaatgtgtccatcgtggccttctacatctatgagcagaccaagaatgcccagttcatcatcatcagcctgaggaacaacatgtttgagatcagtgaccggctgattggcatctacaagacctacaacatcaccaagtctgtggccgtgaaccccaaggagatcgccagcaagggcctgtgctag

SEQ ID NO: 19324 - DNA, 2856 bp, Artificial Sequence
  Description of Artificial Sequence: Synthetic coding sequence
atgctgggctccatggccaggaagaagcccaggaacaccagccggctgcccctggccctgaaccccctgaagagcaaggatgtgctggccgtgctggccgagagaaatgaggccatcgtgcctgtgggcgcctgggtggagcccgccagccctggcagcagcgagatcccagcctacaccagcgcctacctgattgaggaggagctgaaggagcagctgaggaagaagcaggaggccctgaagcacttccagaagcaggtgaagtacagagtgaaccagcagatccggctgaggaagaagcagcagctgcagaagagctatgagcgggcccagaaggagggcagcatcgccatgcagagcagcgccacccacctgaccagcaagaggacctctgtgttccccaacaacctgaatgtggccatcggcagcagccggctgccccccagcctgatgcctggagatggcattgaagatgaggagaaccagaatgaactcttccagcagcaggcccaggccctgtctgagaccatgaagcaggcccggcaccggctggccagcttcaagacagtcatcaagaagaagggcagcgtcttcccagatgatggcaggaagagcttcctgacccgggaggaggtgctgagcaggaagccagccagcacaggcatcaacacaggcatccggggggagctgcccatcaaggtgcaccagggcctgctggccgctgtgccctaccagaactacatggagaaccaggagctggactatgaggagccagactatgaggagagcagcagcctggtgacagatgagaagggcaaggaggacctgtttggccggggccagcaggaccagcaggccatccacagcgaggacaagaacaagcccttcagccgggtgcagaaggtgaagttcaagaaccccctgtttgtgctgatggaggaggaggagcagaagcagctgcactttgagggcctgcaggacatcctgcctgaggcccaggactacttcctggaggcccagggcgacctgctggagacccagggcgacctgaccggcatccagagcgtgaagccagacacccaggccgtggagatgaaggtgcaggtgacagagcctgagggccaggccatcgagcctgagggccagcccatcaagacagagacccagggcatcatgctgaaggcccagagcattgagctggaggagggcagcatcgtgctgaagacccaggacttcctgcccaccaaccaggccctgctgaccaagaaccaggatgtgctgctgaaggaccactgtgtgctgcccaaggaccagagcatcctgctgaagtaccaggaccaggacttcctgccccgggaccagcacgtgctgcacaaggaccaggacatcctgcccaagtaccaggaccagaacttcctgcccaaggaccagaacttcctgagccgggaccagcacgtgctgcccaaggaccaggacatcctgcccaagtaccaggaccagaacttcctgcccaaggaccagaacttcctgagccgggaccagcacgtgctgcccaaggaccagaacatcctgcccaagtaccagggccaggacttcctgcccaaggaccaggacttcctgagccgggaccagcacgtgctgcccaaggactggaacatcctgcccaagtgccaggaccaggacttcctgccccgggaccagggcgtgctgcccaaggaccagaacatcctgcccatctgccaggaccaggacttcctgccccgggaccagggctacctgcccaaggaccagaacatcctgcccatctgccaggaccgggacttcctgccccgggacctgcacgtgctgagcaatgaccagaacatcctgcccaagtgccaggaccaggacttcctgcccaagtaccagaaggtgcacttcaaggagccctacagcgacatgacagatgagaagggccgggaggacttcagcctggccgactaccagtgcctgccccccaagagccaggaccaggatgacatcaagaaccagcagcctgccagcttcatgagggaggagcgggtgcgggaggagctgcccctggactaccaccagtatgtggtgcccaagatccaggaccaggacagcccccgggagcagaacaagcacatcaagctgcccagcagctttgagaagtgggagatcgcccggggcaacaccccaggagtgcccctggcctatgaccgctaccagagcggcctgagcacagagttccaggcccccctggccttccagagtgatgtggacaaggaggaggacaagaaggagcggcagaagcagtacctgcggcaccggcggctcttcatggacatcgagcgggagcaggtgaaggagcagcagaggcagaaggagcagaagaagaagattgagaagatcaagaagaagcgggagcaggagtgctatgctgctgagcagaggatcctgaggatgaacttccacgaggacccctacagcggggagaagctgtctgagatcctggcccagctgcagctgcaggagatcaagggcacccgggagaagcagcagcgggagaaggagtacctgcgctacgtggaggccctgcgggcccagatccaggagaagatgcagctgtacaacatcaccctgccccccctgtgctgctgcggccctgacttctgggatgcccacccagacacctgtgccaacaactgcatcttctacaagaaccaccgggcctacacccgggccctgcacagcttcatcaacagctgtgatgtgcctgggggcaacagcaccctgcgggtggccatccacaactttgccagcgcccacaggaggaccctgaagaacctgtag

SEQ ID NO: 19325 - DNA, 1248 bp, Artificial Sequence
  Description of Artificial Sequence: Synthetic coding sequence
atgagccctgaggtggccctgaaccgcatcagccccatgctgagccccttcatcagctctgtggtgagaaatggcaaggtgggcctggatgccaccaactgcctgcgcatcacagacctgaagagcggctgcaccagcctgaccccaggccccaactgtgaccgcttcaagctgcacatcccctatgctggggagaccctgaagtgggacatcatcttcaatgcccagtacccagagctgcccccagacttcatctttggagaagatgctgagttcctgcctgaccccagcgccctgcagaacctggcctcctggaaccccagcaacccagaatgtctgctgctggtggtgaaggagctggtgcagcagtaccaccagttccagtgcagccggctgcgggagagcagccggctgatgtttgagtaccagaccctgctggaggagccccagtatggagagaacatggagatctatgccggcaagaagaacaactggacaggagagttcagcgcccgcttcctgctgaagctgcctgtggacttcagcaacatccccacctacctgctgaaggatgtgaatgaagaccccggggaggatgtggccctgctgtctgtgtcctttgaggacacagaggccacccaggtgtaccccaagctgtacctgagccccagaattgaacatgccctgggcggcagcagcgccctgcacatcccagccttccctgggggcggctgcctgattgattatgtgccccaggtgtgccacctgctgaccaacaaggtgcagtatgtgatccagggctaccacaagagaagagagtacatcgccgccttcctgagccacttcggcaccggggtggtggagtatgatgctgagggcttcaccaagctgaccctgctgctgatgtggaaggacttctgcttcctggtgcacatcgacctgcccctcttcttcccccgggaccagcccaccctgaccttccagagcgtgtaccacttcaccaacagcggccagctgtacagccaggcccagaagaactacccctacagcccccgctgggatggaaatgagatggccaagagggccaagggctgccagggcagcagagatgcctgcagcccctgggagcaggtgctggcctttgctgtggccaagacaggctgcaagctgctgcagccccagaggaactggcccagcagccggggccccccctggagggccagcgagggggagaggacagcccagtag

SEQ ID NO: 19326 - DNA, 903 bp, Artificial Sequence
  Description of Artificial Sequence: Synthetic coding sequence
atgctgtctgctgtggcccggggctaccagggctggttccacccctgtgcccggctgtctgtgaggatgagcagcacaggcatcgacagaaaaggagtgctggccaacagagtggccgtggtgacaggcagcaccagcggcatcggctttgccatcgcccggcggctggccagagatggagcccacgtggtgatcagcagcaggaagcagcagaatgtggaccgggccatggccaagctgcagggcgagggcctgtctgtggccggcatcgtgtgccacgtgggcaaggccgaggaccgggagcagctggtggccaaggccctggagcactgcggcggcgtggacttcctggtgtgcagcgctggggtgaaccccctggtgggcagcaccctgggcaccagcgagcagatctgggacaagatcctgtctgtgaatgtgaagagccctgccctgctgctgagccagctgctgccctacatggagaacagaagaggagctgtgatcctggtgagcagcattgctgcctacaaccctgtggtggccctgggcgtgtacaacgtgtccaagacagccctgctgggcctgaccaggaccctggccctggagctggcccccaaggacatccgggtgaactgtgtggtgcccggcatcatcaagacagacttcagcaaggtggtgcgcatcggcttcatgggcatgagcctgagcggccgcaccagcaggaacatcatcagctgccggggcctgggcagccagaggacagtgcaggagagctgccccagctgtgccctgcagatgcctgccaccagcactggaagaaccctgcgctggcaggccacccccctgggcagcgagaggtctgggggcggctgtgtggccgtggtgcccggccctggggcctag

SEQ ID NO: 19327 - DNA, 1014 bp, Artificial Sequence
  Description of Artificial Sequence: Synthetic coding sequence
atgagatttgacaccctgtgggagaacaagctgatgcagagcagagctgtggatggcttccacagcgaggagcagcagctgctgctgcaggtgcagcagcagcaccagccccagcagcagcagcaccaccaccaccaccaccaccagcaggcccagccccagcagacagtgccccagcaggcccagacccagcaggtgctgatcccagccagccagcaggccacagccccccaggtgattgtgcctgacagcaagctgatccagcacatgaatgccagcaacatgtctgctgctgccacagctgccaccctggccctgcctgctggggtgacccctgtgcagcagatcctgaccaacagcggccagctgctgcaggtggtgcgggccgccaatggagcccagtacatcttccagccccagcagagcgtggtgctgcagcagcaggtgatcccccagatgcagcctggaggagtgcaggcccctgtgatccagcaggtgctggcccccctgcccggcggcatcagcccccagacaggagtcatcatccagccccagcagatcctcttcaccggcaacaagacccaggtgatccccaccaccgtggccgcccccaccccagcccaggcccagatcacagccaccggccagcagcagccccaggcccagcctgcccagacccaggcccccctggtgctgcaggtggatggcactggagacaccagcagcgaggaggatgaagatgaggaggaggactatgatgatgatgaggaggaggacaaggagaaggatggagcagaagatggccaggtggaggaggagcccctgaacagtgaagatgatgtgtctgatgaggagggccaggagctgtttgacacagaaaatgtggtggtgtgccagtatgacaagatccacaggagcaagaacaagtggaagttccacctgaaggatggcatcatgaacctgaatggccgggactacatcttcagcaaggccatcggagatgctgagtggtag

SEQ ID NO: 19328 - DNA, 282 bp, Artificial Sequence
  Description of Artificial Sequence: Synthetic coding sequence
atggcccagagcggcggggaggcccggcccggccccaagacagctgtgcagatccgggtggccatccaggaggccgaggatgtggatgagctggaggatgaggaggagggcgctgagaccagaggagctggggaccctgcccgctacctgagccctggctggggcagcgccagcgaggaggagcccagccggggccacaggaacagaagctctgtgaacagcaggaccatgctggccagcttcatcgtgtcctctgcccccagcacagcccccagcacctag

SEQ ID NO: 19329 - DNA, 255 bp, Artificial Sequence
  Description of Artificial Sequence: Synthetic coding sequence
atgaaggtgaagatcaagtgctggaatggagtggccacctggctgtgggtggccaatgatgagaactgtggcatctgcaggatggccttcaacggctgctgcccagactgcaaggtgcctggagatgactgccccctggtgtggggccagtgcagccactgcttccacatgcactgcatcctgaagtggctgcacgcccagcaggtgcagcagcactgccccatgtgccggcaggagtggaagttcaaggagtag

SEQ ID NO: 19330 - DNA, 612 bp, Artificial Sequence; identical to SEQ ID NO: 18852
  Description of Artificial Sequence: Synthetic coding sequence

SEQ ID NO: 19331 - DNA, 1794 bp, Artificial Sequence
  Description of Artificial Sequence: Synthetic coding sequence
atgcccagcccccagctgctggtgctgtttggcagccagacaggaacagcccaggatgtgtctgagcggctgggccgggaggccaggagaagaaggctgggctgccgggtgcaggccctggacagctaccctgtggtgaacctgatcaatgagcccctggtgatctttgtgtgtgccaccaccggccagggcgaccccccagacaacatgaagaacttctggaggttcatcttcaggaagaacctgcccagcacagccctgtgccagatggactttgctgtgctgggcctgggggacagcagctatgccaagttcaactttgtggccaagaagctgcaccggcggctgctgcagctgggcggcagcgccctgctgcctgtgtgcctgggagatgaccagcacgagctgggcccagatgctgctgtggacccctggctgcgggacctgtgggacagagtgctgggcctgtacccacctcctcctggcctgacagagatccccccaggagtgcccctgcccagcaagttcaccctgctcttcctgcaggaggcccccagcactggaagtgagggccagagggtggcccaccctggcagccaggagccccccagcgagagcaagcccttcctggcccccatgatcagcaaccagagggtgacaggccccagccacttccaggatgtgcggctgattgaatttgacatcctgggcagcggcatcagctttgctgctggagatgtggtgctgatccagcccagcaacagcgctgcccacgtgcagcgcttctgccaggtgctgggcctggaccctgaccagctgttcatgctgcagccccgggagccagatgtgagcagccccacccggctgccccagccctgcagcatgaggcacctggtgagccactacctggacatcgcctctgtgccccggcgctccttctttgagctgctggcctgcctgagcctgcacgagctggagcgggagaagctgctggagttcagcagcgcccagggccaggaggagctgtttgagtactgcaaccggcccaggaggaccatcctggaggtgctgtgtgacttcccccacacagctgctgccatccccccagactacctgctggacctgatccctgtgatccggccccgggccttcagcatcgccagcagcctgctgacccaccccagccggctgcagatcctggtggccgtggtgcagttccagacccggctgaaggagccccggcggggcctgtgcagctcctggctggccagcctggaccccggccagggccctgtgcgggtgcccctgtgggtgcggcccggcagcctggccttccctgagaccccagacacccctgtgatcatggtgggccctggcaccggggtggcccccttccgggccgccatccaggagcgggtggcccagggccagacaggcaacttcctgttcttcggctgccgctggagggaccaggacttctactgggaggccgagtggcaggagctggagaagagggactgcctgaccctcatcccagccttcagccgggagcaggagcagaaggtgtatgtgcagcaccggctgcgggagctgggcagcctggtgtgggagctgctggaccggcagggcgcctacttctacctggccggaaatgccaagtccatgccagcagatgtgtctgaggccctgatgagcatcttccaggaggagggcggcctgtgcagcccagatgctgctgcctacctggcccggctgcagcagacccggcgcttccagacagagacctgggcctag

SEQ ID NO: 19332 - DNA, 1860 bp, Artificial Sequence
  Description of Artificial Sequence: Synthetic coding sequence
atggatgaccagcaggccctgaacagcatcatgcaggacctggccgtgctgcacaaggccagcaggcctgccctgagcctgcaggagaccaggaaggccaagagcagcagccccaagaagcagaatgatgtgcgggtgaagtttgagcacagaggagagaagaggatcctgcagttccccaggcctgtgaagctggaggacctgcggagcaaggccaagatcgccttcggccagagcatggacctgcactacaccaacaatgagctggtgatccccctgaccacccaggatgacctggacaaggctgtggagctgctggacaggagcatccacatgaagagcctgaagatcctgctggtgatcaatggcagcacccaggccaccaacctggagcccctgcccagcctggaggacctggacaacacagtgtttggagctgagaggaagaagaggctgagcatcatcggccccaccagccgggacaggagcagccccccacctggctacatcccagatgagctgcaccaggtggccagaaatggcagcttcaccagcatcaacagcgagggggagttcatccctgagagcatggaccagatgctggaccccctgagcctgagcagccctgagaacagcggcagcggcagctgccccagcctggacagccccctggatggagagagctaccccaagagcaggatgccccgggcccagagctacccagacaaccaccaggagttcagtgactatgacaaccccatctttgagaagtttgggaagggcggcacctacccccggcgctaccacgtgtcctaccaccaccaggagtacaatgatggcaggaagaccttcccccgggcccggaggacccagggcaccagcctgcggagccctgtgtccttcagccccacagaccacagcctgagcaccagcagcggcagcagcatcttcaccccagaatatgatgacagccgcatcagaagaagaggaagtgacatcgacaaccccaccctgactgtgatggacatcagcccccccagccgcagcccccgggcccccaccaactggaggctgggcaagctgctgggccagggcgccttcggccgggtgtacctgtgctatgatgtggacaccggccgggagctggccgtgaagcaggtgcagtttgatcctgacagccctgagaccagcaaggaggtgaatgccctggagtgtgagatccagctgctgaagaacctgctgcacgagcgcatcgtgcagtactacggctgcctgcgggacccccaggagaagaccctgagcatcttcatggagtacatgcctgggggcagcatcaaggaccagctgaaggcctacggggccctgacagaaaatgtgaccaggaagtacacccggcagatcctggagggcgtgcactacctgcacagcaacatgattgtgcaccgggacatcaagggggccaacatcctgcgggacagcactggaaatgtgaagctgggggactttggagccagcaagaggctgcagaccatctgcctgagcggcaccggcatgaagtctgtgacaggcaccccctactggatgagccctgaggtgatcagcggggagggctacggcaggaaggctgacatctggagcgtggcctgcaccgtggtggagatgctgacagagaagccaccctgggccgagtttgaggccatggccgccatcttcaagatcgccacccagcccaccaaccccaagctgccccctcatgtgtctgactacacccgggacttcctgaagaggatctttgtggaggccaagctgcggcccagcgcagatgagctgctgcggcacatgtttgtgcactaccactag

SEQ ID NO: 19333 - DNA, 828 bp, Artificial Sequence
  Description of Artificial Sequence: Synthetic coding sequence
atgagcaccatcggcagctttgagggcttccaggccgtgtccctgaagcaggagggagatgaccagcccagcgagacagaccacctgtccatggaggaggaggaccccatgccccggcagatcagccggcagagctctgtgacagagagcaccctgtaccccaacccctaccaccagccctacatcagcaggaagtactttgccaccaggcctggggccatcgagacagccatggaggacctgaagggccacgtggccgagaccagcggggagaccatccagggcttctggctgctgaccaagattgaccactggaacaatgagaaggagcgcatcctgctggtgacagacaagaccctgctgatctgcaagtatgacttcatcatgctgagctgtgtgcagctgcagaggatccccctgtctgctgtgtaccgcatctgcctgggcaagttcaccttccctggcatgagcctggacaagaggcagggcgagggcctgcgcatctactggggcagccctgaggagcagagcctgctgagccgctggaacccctggagcacagaggtgccctatgccaccttcacagagcaccccatgaagtacaccagcgagaagttcctggagatctgcaagctgagcggcttcatgagcaagctggtgcctgccatccagaatgcccacaagaacagcactggaagtggccggggcaagaagctgatggtgctgacagagcccatcctgattgagacctacacaggcctgatgtccttcatcggcaacagaaacaagctgggctacagcctggcccggggcagcatcggcttctag

SEQ ID NO: 19334 - DNA, 1629 bp, Artificial Sequence
  Description of Artificial Sequence: Synthetic coding sequence
atggctgctgctgctggagctgctgctgcccctggcagccgggagccccaggacagaccagaatgtggggccggccaccctggcccccgctactaccgccaccctgagcgctggctgctgcggcctgaggccttcctgggccccctgcggacccgggcccccagcgctgaggacagccagcgggagaggcctgctgcccggagcggccctgccatgagccggcgggtggtgcggcagagcaagttccgccacgtgtttggccaggccgccaaggctgaccaggcctatgaggacatccgggtgtccaaggtgacctgggacagcagcttctgtgctgtgaaccccaagttcctggccatcatcgtggaggccggcggcggcggggccttcatcgtgctgcccctggccaagacaggccgggtggacaagaactaccccctggtgacaggccacacagcccctgtgctggacatcgactggtgcccccacaatgacaacgtcatcgccagcgccagtgatgacaccaccatcatggtgtggcagatcccagactacacccccatgaggaacatcacagagcccatcatcaccctggagggccacagcaagagggtgggcatcctgtcctggcaccccacagccagaaatgtgctgctgtctgctggaggagacaacgtcatcatcatctggaatgtgggcaccggggaggtgctgctgagcctggatgacatgcacccagatgtgatccacagcgtgtgctggaacagcaatggcagcctgctggccaccacctgcaaggacaagaccctgcgcatcatcgaccccaggaagggccaggtggtggccgagagatttgctgcccacgagggcatgaggcccatgagagctgtgttcacccggcagggccacatcttcaccaccggcttcaccaggatgagccagcgggagctgggcctgtgggaccccaacaactttgaggagcctgtggccctgcaggagatggacaccagcaatggagtgctgctgcccttctatgaccctgacagcagcatcgtgtacctgtgtgggaaaggagacagcagcatccgctactttgagatcacagatgagcccccatttgtgcactacctgaacaccttcagcagcaaggagccccagaggggcatgggcttcatgcccaagaggggcctggatgtgtccaaatgtgagatcgcccgcttctacaagctgcacgagaggaaatgtgagcccatcatcatgacagtgcccaggaagagtgacctcttccaggatgacctgtacccagacaccccaggccctgagcccgccctggaggctgatgagtggctgagcggccaggatgctgagcctgtgctgatcagcctgagagatggctacgtgccccccaagcaccgggagctgcgggtgaccaagaggaacatcctggatgtgcggccccccagcggccccaggaggagccagagcgccagtgatgcccccctgagccagcacaccctggagaccctgctggaggagatcaaggccctgcgggagcgggtgcaggcccaggagcagaggatcacagccctggagaacatgctgtgtgagctggtggatggaacagactag

SEQ ID NO: 19335 - DNA, 2550 bp, Artificial Sequence
  Description of Artificial Sequence: Synthetic coding sequence
atgtctgacacccggcggcgggtgaaggtgtacaccctgaatgaagatcggcagtgggatgaccggggcaccggccacgtgagcagcacctacgtggaggagctgaagggcatgagcctgctggtgcgggcagagagtgatggcagcctgctgctggagagcaagatcaaccccaacacagcctaccagaagcagcaggacaccctcatcgtgtggagcgaggccgagaactatgacctggccctgtccttccaggagaaggccggctgtgatgagatctgggagaagatctgccaggtgcagggcaaggaccccagcgtggaggtgacccaggacctgattgatgaaagtgaggaggagagatttgaggagatgcctgagaccagccacctgattgacctgcccacctgtgagctgaacaagctggaggagattgctgacctggtgacctctgtgctgagcagccccatccggcgggagaagctggccctggccctggagaatgaaggctacatcaagaagctgctgcagctgttccaggcctgtgagaacctggagaacacagagggcctgcaccacctgtatgagatcatccggggcatcctcttcctgaacaaggccaccctgtttgaggtgatgttcagtgatgagtgcatcatggatgtggtgggctgcctggagtatgaccctgccctggcccagcccaagaggcaccgggagttcctgaccaagacagccaagttcaaggaggtgatccccatcacagattctgagctgcggcagaagatccaccagacctacagagtgcagtacatccaggacatcatcctgcccaccccatctgtgtttgaggagaacttcctgagcaccctgaccagcttcatcttcttcaacaaggtggagatcgtgtccatgctgcaggaggatgagaagttcctgtctgaggtgtttgcccagctgacagatgaggccacagatgatgacaagaggcgggagctggtgaacttcttcaaggagttctgtgccttcagccagaccctgcagccccagaacagagatgccttcttcaagaccctggccaagctgggcatcctgcctgccctggagatcgtgatgggcatggatgacctgcaggtgcgctctgctgccacagacatcttctcctacctggtggagttcagccccagcatggtgcgggagtttgtgatgcaggaggcccagcagagtgatgatgacatcctgctgatcaacgtggtgattgagcagatgatctgtgacacagatcctgagctgggcggcgctgtgcagctgatgggcctgctgcggaccctgattgatcctgagaacatgctggccaccaccaacaagacagagaagtctgagttcctgaacttcttctacaaccactgcatgcacgtgctgacagcccccctgctgaccaacaccagcgaggacaagtgtgagaaggacttcttcctgaagcactaccgctacagctggagcttcatctgcacccccagccacagccacagccacagcacccccagcagcagcatcagccaggacaacatcgtgggcagcaacaagaacaacaccatctgcccagacaactaccagacagcccagctgctggccctgatcctggagctgctgaccttctgtgtggagcaccacacctaccacatcaagaactacatcatgaacaaggacctgctgcggcgggtgctggtgctgatgaacagcaagcacaccttcctggccctgtgtgccctgcgcttcatgaggcgcatcatcggcctgaaggatgagttctacaaccgctacatcaccaagggcaacctgtttgagcctgtgatcaatgccctgctggacaatggcacccgctacaacctgctgaacagcgctgtgattgagctgtttgagttcatccgggtggaggacatcaagagcctgacagcccacatcgtggagaacttctacaaggccctggagagcattgaatatgtgcagaccttcaagggcctgaagaccaagtatgagcaggagaaggaccggcagaaccagaagctgaacagcgtgcccagcatcctgcggagcaaccgcttcagaagagatgccaaggccctggaggaggatgaggagatgtggttcaatgaagatgaggaggaggagggcaaggctgtggtggcccctgtggagaagcccaagccagaagatgacttcccagacaactatgagaagttcatggagaccaagaaggccaaggagagcgaggacaaggagaacctgcccaagaggaccagccctgggggcttcaagttcaccttcagccacagcgccagcgctgccaacggcaccaacagcaagtctgtggtggcccagatccccccagccaccagcaatggcagcagcagcaagaccaccaacctgcccacctctgtgacagccaccaagggcagcctggtgggcctggtggactacccagatgatgaggaggaggatgaggaggaggagagcagccccaggaagaggccccggctgggcagctag

SEQ ID NO: 19336 - DNA, 669 bp, Artificial Sequence
  Description of Artificial Sequence: Synthetic coding sequence
atgggagacatcccagctgtgggcctgagctcctggaaggccagccctgggaaggtgacagaggccgtgaaggaggccattgatgctggctaccgccactttgactgtgcctacttctaccacaatgaaagagaggtgggcgccggcatccgctgcaagatcaaggagggcgctgtgcggcgggaggacctcttcatcgccaccaagctgtggtgcacctgccacaagaagagcctggtggagacagcctgcaggaagagcctgaaggccctgaagctgaactacctggacctgtacctgatccactggcccatgggcttcaagccaccccaccctgagtggatcatgagctgcagcgagctgtccttctgcctgagccacccccgggtgcaggacctgcccctggatgagagcaacatggtgatccccagcgacacagacttcctggacacctgggagatcctgatccgcttccagatccagagaaatgtgattgtcatccctggcagcatcacccccagccacatcaaggagaacatccaggtgtttgattttgagctgacccagcacgacatggacaacatcctgagcctgaacagaaacctgcggctggccatgttccccatcaccaagaaccacaaggactaccccttccacatcgagtactag

SEQ ID NO: 19337 - DNA, 1080 bp, Artificial Sequence
  Description of Artificial Sequence: Synthetic coding sequence
atgcccaaccccagcagcaccagcagcccctaccccctgcctgaggagatccggaacctgctggctgatgtggagacctttgtggccgacatcctgaagggggagaacctgagcaagaaggccaaggagaagcgggagagcctcatcaagaagatcaaggatgtgaagagcatctacctgcaggagttccaggacaagggagatgctgaagatggagaggagtatgatgacccctttgctggccccccagacaccatcagcctggccagcgagagatatgacaaggatgatgaggcccccagtgatggagcccagtttcctcccatcgccgcccaggacctgccctttgtgctgaaggccggctacctggagaagaggaggaaggaccacagcttcctgggctttgagtggcagaagcgctggtgtgccctgagcaagacagtgttctactactacggcagtgacaaggacaagcagcagaagggggagtttgccattgatggctacagcgtgaggatgaacaacaccctgaggaaggatggcaagaaggactgctgctttgagatcagcgccccagacaagaggatctaccagttcaccgctgccagccccaaggatgctgaggagtgggtgcagcagctgaagtttgtgctgcaggacatggagagtgacatcatccctgaggactatgatgagcggggggagctgtatgatgatgtggaccaccccctgcccatcagcaaccccctgaccagcagccagcccattgatgatgagatctatgaggagctgcctgaggaggaggaggacagcgcccctgtgaaggtggaggagcagaggaagatgagccaggacagcgtgcaccacaccagcggggacaagagcacagattatgccaacttctaccagggcctgtgggactgcacaggagccttcagtgatgagctgtccttcaagagaggagatgtgatctacatcctgagcaaggagtacaacagatatggctggtgggtgggggagatgaagggggccatcggcctggtgcccaaggcctacatcatggagatgtatgacatctag

SEQ ID NO: 19338 - DNA, 1227 bp, Artificial Sequence
  Description of Artificial Sequence: Synthetic coding sequence
atgaagtgtgagcactgcaccaggaaggagtgcagcaagaagaccaagacagatgaccaggagaatgtgtctgcagatgcccccagccctgcccaggagaatggagagaagtgtgacaccagcaagcacaaggtgctggtggtgtctgtgtgcccccagagcctgccctactttgctgccaagttcaacctgtctgtgacagatgccagccggcggctgtgtggcttcctgaagagcctgggcgtgcactacgtgtttgacaccaccatcgctgctgacttcagcatcctggagagccagaaggagtttgtgcggcgctaccggcagcacagcgaggaggagaggaccctgcccatgctgaccagcgcctgccccggctgggtgcgctatgcagagcgggtgctgggccggcccatcacagcccacctgtgcacagccaagagcccccagcaggtgatgggcagcctggtgaaggactactttgcccggcagcagaacctgagccctgagaagatcttccacgtgattgtggccccctgctatgacaagaagctggaggccctgcaggagagcctgcccccagccctgcacggcagcagaggagctgactgtgtgctgaccagcggggagatcgcccagatcatggagcagggcgacctgtctgtgagagatgctgctgtggacaccctgtttggagacctgaaggaggacaaggtgaccaggcatgatggagccagcagtgatggccacctggcccacatcttcagacatgctgccaaggagctgttcaatgaagatgtggaggaggtgacctaccgggccctgaggaacaaggacttccaggaggtgaccctggagaagaatggagaggtggtgctgcgctttgctgctgcctacggcttcaggaacatccagaacatgatcctgaagctgaagaagggcaagttccccttccactttgtggaggtgctggcctgtgccggcggctgcctgaatggccggggccaggcccagaccccagatggccacgccgacaaggccctgctgcggcagatggagggcatctatgctgacatccctgtgcggcggcctgagagcagcgcccacgtgcaggagctgtaccaggagtggctggagggcatcaacagccccaaggcccgggaggtgctgcacaccacctaccagagccaggagcggggcacccacagcctggacatcaagtggtag

SEQ ID NO: 19339 - DNA, 1104 bp, Artificial Sequence
  Description of Artificial Sequence: Synthetic coding sequence
atggccctgaatgtggcccctgtgcgggacaccaagtggctgaccctggaggtgtgccggcagttccagaggggcacctgcagcagaagtgatgaggagtgcaagtttgcccacccccccaagagctgccaggtggagaatggccgggtgattgcctgctttgacagcctgaagggccgctgcagccgggagaactgcaagtacctgcacccccccacccacctgaagacccagctggagatcaatggaagaaacaacctgatccagcagaagacagctgctgccatgctggcccagcagatgcagttcatgtttcctggcacccccctgcaccctgtgcccaccttccctgtgggccctgccatcggcaccaacacagccatcagctttgccccctacctggcccctgtgaccccaggagtgggcctggtgcccacagagatcctgcccaccacccctgtgattgtgcccggcagcccccctgtgacagtgcccggcagcacagccacccagaagctgctgaggacagacaagctggaggtgtgccgggagttccagaggggcaactgtgcccggggggagacagactgccgctttgcccaccctgctgacagcaccatgattgacaccagtgacaacacagtgacagtgtgcatggactacatcaagggccgctgcatgagggagaagtgcaagtacttccaccccccagcccacctgcaggccaagatcaaggccgcccagcaccaggccaaccaggccgctgtggccgcccaggccgctgctgctgctgccaccgtgatggccttccccccaggggccctgcaccccctgcccaagaggcaggccctggagaagagcaatggcaccagcgctgtgttcaaccccagcgtgctgcactaccagcaggccctgaccagcgcccagctgcagcagcacgccgccttcatccccactggatctgtgctgtgcatgaccccagccaccagcatcgtgcccatgatgcacagcgccaccagcgccaccgtgtctgctgccaccaccccagccacctctgtgccctttgctgccacagccacagccaaccagatcatcctgaagtag

SEQ ID NO: 19340 - DNA, 3909 bp, Artificial Sequence
  Description of Artificial Sequence: Synthetic coding sequence
atggccctgcggcctggagctggcagcggcggcggcggcgctgctggagctggagctggcagcgctgggggcggcggcttcatgtttcctgtggccggcggcatccggcccccccaggccggcctgatgcccatgcagcagcagggcttccccatggtgtctgtgatgcagcccaacatgcagggcatcatgggcatgaactacagcagccagatgagccagggccccatcgccatgcaggccggcatccccatgggccccatgcctgctgctggcatgccctacctgggccaggcccccttcctgggcatgaggcctcctggcccccagtacaccccagacatgcagaagcagtttgctgaggagcagcagaagagatttgagcagcagcagaagctgctggaggaggagaggaagaggcggcagtttgaggagcagaagcagaagctgcggctgctgagctctgtgaagcccaagacaggagagaagagcagagatgatgccctggaggccatcaagggcaacctggatggcttcagcagagatgccaagatgcaccccaccccagccagccaccccaagaagccaggccccagcctggaggagaagttcctggtgtcctgtgacatcagcaccagcggccaggagcagatcaagctgaacaccagcgaggtgggccacaaggccctgggccctggcagcagcaagaagtaccccagcctgatggccagcaatggagtggccgtggatggctgtgtgtctggcaccaccacagctgaggccgagaacaccagtgaccagaacctgagcattgaggagagcggcgtgggcgtcttccccagccaggaccctgcccagcccaggatgccaccctggatctacaatgaaagcctggtgcctgatgcctacaagaagatcctggagaccaccatgacccccaccggcatcgacacagccaagctgtaccccatcctgatgagcagcggcctgccccgggagaccctgggccagatctgggccctggccaacagaaccaccccaggcaagctgaccaaggaggagctgtacacagtgctggccatgattgctgtgacccagaggggcgtgcctgccatgagcccagatgccctgaaccagtttcctgctgcccccatccccaccctgagcggcttctccatgaccctgcccacccctgtgtcccagcccaccgtcatccccagcggccctgctggctccatgcccctgagcctgggccagcctgtgatgggcatcaacctggtgggccctgtgggcggggccgccgcccaggccagcagcggcttcatccccacctacccagccaaccaggtggtgaagccagaagaagatgacttccaggacttccaggatgccagcaagagcggcagcctggatgacagcttcagtgacttccaggagctgcctgccagcagcaagaccagcaacagccagcacggcaacagcgcccccagcctgctgatgcccctgcccggcaccaaggccctgcccagcatggacaagtatgctgtgttcaagggcattgctgctgacaagagcagtgaaaatacagtgcccccaggggaccccggggacaagtacagcgccttccgggagctggagcagacagctgagaacaagcccctgggggagagctttgctgagttccgctctgctggaacagatgatggcttcacagacttcaagacagctgacagcgtgagccccctggagccccccaccaaggacaagaccttcccccccagcttccccagcggcaccatccagcagaagcagcagacccaggtgaagaaccccctgaacctggccgacctggacatgttcagctctgtgaactgcagcagcgagaagcccctgtccttctctgctgtgttcagcaccagcaagtctgtgtccaccccccagagcactggatctgctgccaccatgacagccctggccgccaccaagaccagcagcctggctgatgactttggagagttcagcctgtttggagagtacagcggcctggcccctgtgggggagcaggatgactttgctgacttcatggccttcagcaacagcagcatcagcagcgagcagaagccagatgacaagtatgatgccctgaaggaggaggccagccctgtgcccctgaccagcaatgtgggcagcacagtgaagggcggccagaacagcacagctgccagcaccaagtatgatgtgttccggcagctgagcctggagggcagcggcctgggcgtggaggacctgaaggacaacaccccatctgggaagagtgatgatgactttgctgacttccacagcagcaagttcagcagcatcaacagcgacaagagcctgggggagaaggctgtggccttccgccacaccaaggaggacagcgcctctgtgaagagcctggacctgcccagcatcggcggcagctctgtgggcaaggaggacagtgaagatgccctgtctgtgcagtttgacatgaagctggctgatgtgggcggggacctgaagcacgtgatgtctgacagcagcctggacctgcccaccgtgtctggccagcaccccccagctgctgacatcgaggacctgaagtatgctgccttcggcagctacagcagcaactttgctgtgtccaccctgaccagctatgactggagcgacagagatgatgccacccagggcaggaagctgagcccctttgtgctgtctgctggcagcggcagccccagcgccaccagcatcctgcagaagaaggagaccagctttggcagcagcgagaacatcaccatgaccagcctgagcaaggtgaccacctttgtgtctgaagatgccctgcctgagaccaccttccctgccctggccagcttcaaggacaccatcccccagaccagcgagcagaaggagtatgaaaatagagactacaaggacttcaccaagcaggacctgcccacagctgagaggagccaggaggccacctgccccagccctgccagcagcggggccagccaggagaccccaaatgaatgttctgatgactttggagagttccagagcgagaagcccaagatcagcaagtttgacttcctggtggccaccagccagagcaagatgaagagcagcgaggagatgatcaagtctgagctggccacctttgacctgtctgtgcagggcagccacaagaggagcctgagcctgggggacaaggagatcagccgcagcagccccagccctgccctggagcagcccttccgggacaggagcaacaccctgaatgagaagccagccctgcccgtcatccgggacaagtacaaggacctgaccggggaggtggaggagaatgaaagatatgcctatgagtggcagcgctgcctgggcagcgccctgaatgtcatcaagaaggccaatgacaccctgaatggcatcagcagcagctctgtgtgcacagaggtgatccagagcgcccagggcatggagtacctgctgggcgtggtggaggtgtacagagtgaccaagagggtggagctgggcatcaaggccacagctgtgtgcagcgagaagctgcagcagctgctgaaggacatcgacaaggtgtggaacaacctgattggcttcatgagcctggccaccctgaccccagatgagaacagcctggacttcagcagctgcatgctgcggcccggcatcaagaatgcccaggagctggcctgtggggtgtgcctgctgaatgtggacagccgcagccgggccttcaacagcgagacagacagcttcaagctggcctacggcggccaccagtaccacgccagctgtgccaacttctggatcaactgtgtggagcccaagcccccaggcctggtgctgcctgacctgctgtag

SEQ ID NO: 19341 - DNA, 1011 bp, Artificial Sequence
  Description of Artificial Sequence: Synthetic coding sequence
atggagagcgtgctgagcaaatatgaggaccagatcaccatcttcacagactacctggaggagtacccagacacagatgagctggtgtggatcctgggcaagcagcacctgctgaagacagagaagagcaagctgctgagtgacatcagcgcccggctgtggttcacctacagaaggaagttcagccccatcggcggcaccggccccagcagtgatgctggctggggctgcatgctgcgctgtggccagatgatgctggcccaggccctgatctgccgccacctgggccgggactggagctgggagaagcagaaggagcagcccaaggagtaccagaggatcctgcagtgcttcctggacaggaaggactgctgctacagcatccaccagatggcccagatgggcgtgggggagggcaagagcatcggggagtggtttggccccaacacagtggcccaggtgctgaagaagctggccctgtttgatgagtggaacagcctggccgtgtatgtgtccatggacaacacagtggtgattgaggacatcaagaagatgtgccgggtgctgcccctgtctgctgacacagctggggaccggcccccagacagcctgacagccagcaaccagagtgatgagctgatcttcctggacccccacaccacccagacctttgtggacacagaagaaaatggcaccgtgaatgaccagaccttccactgcctgcagagcccccagaggatgaacatcctgaacctggaccccagcgtggccctgggcttcttctgcaaggaggagaaggactttgacaactggtgcagcctggtgcagaaggagatcctgaaggagaacctgaggatgtttgagctggtgcagaagcaccccagccactggcccccatttgtgcccccagccaagccagaggtgaccaccactggagctgagttcatcgacagcacagagcagctggaggagtttgacctggaggaggactttgagatcctgtctgtgtag

SEQ ID NO: 19342 - DNA, 3018 bp, Artificial Sequence
  Description of Artificial Sequence: Synthetic coding sequence
atgctgaggacagctggaagagatggcctgtgccgcctgagcacctacctggaggagctggaggccgtggagctgaagaagttcaagctgtacctgggcacagccacagagctgggggagggcaagatcccctggggctccatggagaaggccggccccctggagatggcccagctgctgatcacccacttcggccctgaggaggcctggaggctggccctgagcacctttgagcgcatcaacaggaaggacctgtgggagcggggccagcgggaggacctggtgcgggacaccccacctgggggccccagcagcctgggcaaccagagcacctgcctgctggaggtgtccctggtgacccccaggaaggacccccaggagacctacagagattatgtgcggaggaagttccggctgatggaggacagaaatgcccggctgggagaatgtgtgaacctgagccaccgctacacccggctgctgctggtgaaggagcacagcaaccccatgcaggtgcagcagcagctgctggacaccggccggggccacgccaggacagtgggccaccaggccagccccatcaagattgagaccctgtttgagccagatgaggagaggcctgagccccccaggacagtggtgatgcagggcgctgctggcatcggcaagtccatgctggcccacaaggtgatgctggactgggcagatggcaagctgttccagggccgctttgactacctgttctacatcaactgccgggagatgaaccagagcgccacagaatgttccatgcaggacctgatcttcagctgctggccagagcccagcgcccccctgcaggagctgatccgggtgcctgagcggctgctcttcatcattgatggctttgatgagctgaagcccagcttccatgacccccagggcccctggtgcctgtgctgggaggagaagaggcccacagagctgctgctgaacagcctcatcaggaagaagctgctgcctgagctgagcctgctgatcaccacccggcccacagccctggagaagctgcaccggctgctggagcaccccaggcatgtggagatcctgggcttcagcgaggccgagaggaaggagtacttctacaagtacttccacaatgctgagcaggccggccaggtgttcaactacgtgcgggacaatgagcccctcttcaccatgtgctttgtgcccctggtgtgctgggtggtgtgcacctgcctgcagcagcagctggagggcggcggcctgctgcggcagaccagcaggaccaccacagctgtgtacatgctgtacctgctgagcctgatgcagcccaagccaggggccccccggctgcagcccccacccaaccagaggggcctgtgcagcctggccgcagatggcctgtggaaccagaagatcctgtttgaggagcaggacctgaggaagcacggcctggatggagaagatgtgtctgccttcctgaacatgaacatcttccagaaggacatcaactgtgagcgctactacagcttcatccacctgtccttccaggagttctttgctgccatgtactacatcctggatgaaggagagggcggggccggccctgaccaggatgtgacccggctgctgacagaatatgccttcagcgagaggagcttcctggccctgaccagccgcttcctgtttggcctgctgaatgaggagaccaggagccacctggagaagagcctgtgctggaaggtgagcccccacatcaagatggacctgctgcagtggatccagagcaaggcccagagtgatggcagcaccctgcagcagggcagcctggagttcttcagctgcctgtatgagatccaggaggaggagttcatccagcaggccctgagccacttccaggtgattgtggtgagcaacatcgccagcaagatggagcacatggtgtcctccttctgcctgaagcgctgccgcagcgcccaggtgctgcacctgtatggagccacctacagcgcagatggagaagatcgggcccgctgcagcgctggggcccacaccctgctggtgcagctgcggcctgagaggacagtgctgctggatgcctacagcgagcacctggccgccgccctgtgcaccaaccccaacctgattgagctgagcctgtacagaaatgccctgggcagccggggcgtgaagctgctgtgccagggcctgcggcaccccaactgcaagctgcagaacctgcggctgaagcgctgccgcatcagcagcagcgcctgtgaggacctgtctgctgccctgattgccaacaagaacctgaccaggatggacctgtctggaaatggagtgggcttccctggcatgatgctgctgtgtgagggcctgcggcacccccagtgccgcctgcagatgatccagctgaggaagtgccagctggagagcggggcctgccaggagatggcctctgtgctgggcaccaacccccacctggtggagctggacctgactggaaatgccctggaggacctgggcctgcggctgctgtgccagggcctgcggcaccctgtgtgccgcctgcggaccctgtggctgaagatctgccgcctgacagctgctgcctgtgatgagctggccagcaccctgtctgtgaaccagagcctgcgggagctggacctgagcctgaatgagctgggggacctgggcgtgctgctgctgtgtgagggcctgcggcaccccacctgcaagctgcagaccctgcggctgggcatctgccgcctgggcagcgctgcctgtgagggcctgtctgtggtgctgcaggccaaccacaacctgcgggagctggacctgtccttcaatgacctgggggactggggcctgtggctgctggccgagggcctgcagcacccagcctgccgcctgcagaagctgtggctgtttggcatggacctgaacaagatgacccacagccggctggccgccctgcgggtgaccaagccctacctggacatcggctgctag

SEQ ID NO: 19343 - DNA, 618 bp, Artificial Sequence
  Description of Artificial Sequence: Synthetic coding sequence
atggtgagcagctgctgcggctctgtgtgcagcgaccagggctgcggcctggagacctgctgccggcccagctgctgccagaccacctgctgcaggaccacctgctgccggcccagctgctgcgtgagcagctgctgccggccccagtgctgccagagcgtgtgctgccagcccacctgctgccggcccagctgctgccccagctgctgccagaccacctgctgcaggaccacctgctgccggcccagctgctgcgtgagcagctgctgccggccccagtgctgccagagcgtgtgctgccagcccacctgctgccggcccagctgcagcatcagcagctgctgccggcccagctgctgcgtgagccgctgctgccgcagccagtgctgccagagcgtgtgctgccagcccacctgctgccggcccagctgctgcatcagcagctgctgccggcccagctgctgtgagagcagctgctgccggccctgctgctgccggccctgctgctgcctgcggcctgtgtgtggccgggtgtcctgccacaccacctgctaccggcccacctgtgtgatcagcacctgcccccggcccctgtgctgtgccagcagctgctgctag

SEQ ID NO: 19344 - DNA, 573 bp, Artificial Sequence
  Description of Artificial Sequence: Synthetic coding sequence
atgcagagctgtgagagcagcggggacagcgcagatgaccccctgagccggggcctgcggcggcggggccagccccgggtggtggtgattggagctggcctggccggcctggccgccgccaaggccctgctggagcagggcttcacagatgtgacagtgctggaggccagcagccacatcggcggccgggtgcagagcgtgaagctgggccacgccacctttgagctgggcgccacctggatccacggcagccacggcaaccccatctaccacctggccgaggccaacggcctgctggaggagaccacagatggagagaggtctgtgggccgcatcagcctgtacagcaagaatggagtggcctgctacctgaccaaccacggccgccgcatccccaaggatgtggtggaggagttcagtgacctgtacaatgagcccatgcaggtgctcttcagcggggaggccacccacaggaagtactacagcaccacccatggagccctgctgagcggccagcgggaggccgcccggctgattgagatgtacagagacctcttccagcagggcacctag

SEQ ID NO: 19345 - DNA, 3945 bp, Artificial Sequence
  Description of Artificial Sequence: Synthetic coding sequence
atggccctgcggcctggagctggcagcggcggcggcggcgctgctggagctggagctggcagcgctgggggcggcggcttcatgtttcctgtggccggcggcatccggcccccccaggccggcctgatgcccatgcagcagcagggcttccccatggtgtctgtgatgcagcccaacatgcagggcatcatgggcatgaactacagcagccagatgagccagggccccatcgccatgcaggccggcatccccatgggccccatgcctgctgctggcatgccctacctgggccaggcccccttcctgggcatgaggcctcctggcccccagtacaccccagacatgcagaagcagtttgctgaggagcagcagaagagatttgagcagcagcagaagctgctggaggaggagaggaagaggcggcagtttgaggagcagaagcagaagctgcggctgctgagctctgtgaagcccaagacaggagagaagagcagagatgatgccctggaggccatcaagggcaacctggatggcttcagcagagatgccaagatgcaccccaccccagccagccaccccaagaagccaggccccagcctggaggagaagttcctggtgtcctgtgacatcagcaccagcggccaggagcagatcaagctgaacaccagcgaggtgggccacaaggccctgggccctggcagcagcaagaagtaccccagcctgatggccagcaatggagtggccgtggatggctgtgtgtctggcaccaccacagctgaggccgagaacaccagtgaccagaacctgagcattgaggagagcggcgtgggcgtcttccccagccaggaccctgcccagcccaggatgccaccctggatctacaatgaaagcctggtgcctgatgcctacaagaagatcctggagaccaccatgacccccaccggcatcgacacagccaagctgtaccccatcctgatgagcagcggcctgccccgggagaccctgggccagatctgggccctggccaacagaaccaccccaggcaagctgaccaaggaggagctgtacacagtgctggccatgattgctgtgacccagaggggcgtgcctgccatgagcccagatgccctgaaccagtttcctgctgcccccatccccaccctgagcggcttctccatgaccctgcccacccctgtgtcccagcccaccgtcatccccagcggccctgctggctccatgcccctgagcctgggccagcctgtgatgggcatcaacctggtgggccctgtgggcggggccgccgcccaggccagcagcggcttcatccccacctacccagccaaccaggtggtgaagccagaagaagatgacttccaggacttccaggatgccagcaagagcggcagcctggatgacagcttcagtgacttccaggagctgcctgccagcagcaagaccagcaacagccagcacggcaacagcgcccccagcctgctgatgcccctgcccggcaccaaggccctgcccagcatggacaagtatgctgtgttcaagggcattgctgctgacaagagcagtgaaaatacagtgcccccaggggaccccggggacaagtacagcgccttccgggagctggagcagacagctgagaacaagcccctgggggagagctttgctgagttccgctctgctggaacagatgatggcttcacagacttcaagacagctgacagcgtgagccccctggagccccccaccaaggacaagaccttcccccccagcttccccagcggcaccatccagcagaagcagcagacccaggtgaagaaccccctgaacctggccgacctggacatgttcagctctgtgaactgcagcagcgagaagcccctgtccttctctgctgtgttcagcaccagcaagtctgtgtccaccccccagagcactggatctgctgccaccatgacagccctggccgccaccaagaccagcagcctggctgatgactttggagagttcagcctgtttggagagtacagcggcctggcccctgtgggggagcaggatgactttgctgacttcatggccttcagcaacagcagcatcagcagcgagcagaagccagatgacaagtatgatgccctgaaggaggaggccagccctgtgcccctgaccagcaatgtgggcagcacagtgaagggcggccagaacagcacagctgccagcaccaagtatgatgtgttccggcagctgagcctggagggcagcggcctgggcgtggaggacctgaaggacaacaccccatctgggaagagtgatgatgactttgctgacttccacagcagcaagttcagcagcatcaacagcgacaagagcctgggggagaaggctgtggccttccgccacaccaaggaggacagcgcctctgtgaagagcctggacctgcccagcatcggcggcagctctgtgggcaaggaggacagtgaagatgccctgtctgtgcagtttgacatgaagctggctgatgtgggcggggacctgaagcacgtgatgtctgacagcagcctggacctgcccaccgtgtctggccagcaccccccagctgctgacatcgaggacctgaagtatgctgccttcggcagctacagcagcaactttgctgtgtccaccctgaccagctatgactggagcgacagagatgatgccacccagggcaggaagctgagcccctttgtgctgtctgctggcagcggcagccccagcgccaccagcatcctgcagaagaaggagaccagctttggcagcagcgagaacatcaccatgaccagcctgagcaaggtgaccacctttgtgtctgaagatgccctgcctgagaccaccttccctgccctggccagcttcaaggacaccatcccccagaccagcgagcagaaggagtatgaaaatagagactacaaggacttcaccaagcaggacctgcccacagctgagaggagccaggaggccacctgccccagccctgccagcagcggggccagccaggagaccccaaatgaatgttctgatgactttggagagttccagagcgagaagcccaagatcagcaagtttgacttcctggtggccaccagccagagcaagatgaagagcagcgaggagatgatcaagtctgagctggccacctttgacctgtctgtgcagggcagccacaagaggagcctgagcctgggggacaaggagatcagccgcagcagccccagccctgccctggagcagcccttccgggacaggagcaacaccctgaatgagaagccagccctgcccgtcatccgggacaagtacaaggacctgaccggggaggtggaggagaatgaaagatatgcctatgagtggcagcgctgcctgggcagcgccctgaatgtcatcaagaaggccaatgacaccctgaatggcatcagcagcagctctgtgtgcacagaggtgatccagagcgcccagggcatggagtacctgctgggcgtggtggaggtgtacagagtgaccaagagggtggagctgggcatcaaggccacagctgtgtgcagcgagaagctgcagcagctgctgaaggacatcgacaaggtgtggaacaacctgattggcttcatgagcctggccaccctgaccccagatgagaacagcctggacttcagcagctgcatgctgcggcccggcatcaagaatgcccaggagctggcctgtggggtgtgcctgctgaatgtggacagccgcagcaggaaggaggagaagccagctgaggagcaccccaagaaggccttcaacagcgagacagacagcttcaagctggcctacggcggccaccagtaccacgccagctgtgccaacttctggatcaactgtgtggagcccaagcccccaggcctggtgctgcctgacctgctgtag

SEQ ID NO: 19346 - DNA, 531 bp, Artificial Sequence
  Description of Artificial Sequence: Synthetic coding sequence
atgtctgatgatgacagccgggccagcaccagcagcagcagcagcagcagcagcaaccagcagacagagaaggagaccaacacccccaagaagaaggagagcaaggtgtccatgagcaagaacagcaagctgctgagcaccagcgccaagtctgctggccccaagggggacaacatctatgagtggaggagcaccatcctgggccccccaggctctgtgtatgagggcggcgtcttcttcctggacatcaccttcaccccagagtaccccttcaagccacccaaggtgaccttccgcacccgcatctaccactgcaacatcaacagccagggcgtcatctgcctggacatcctgaaggacaactggagccctgccctgaccatcagcaaggtgctgctgagcatctgcagcctgctgacagactgcaacccagctgaccccctggtgggcagcatcgccacccagtacatgaccaacagagctgagcatgacaggatggcccggcagtggaccaagagatatgccacctag

SEQ ID NO: 19347 - DNA, 7029 bp, Artificial Sequence
  Description of Artificial Sequence: Synthetic coding sequence
atggatggagtgagcagcgaggccaatgaagaaaatgacaacatcgagaggcctgtgagaagaagacacagcagcatcctgaagcccccaagaagccccctgcaggacctgcggggcggcaatgaaagagtgcaggagagcaatgccctgaggaacaagaagaacagcagaagagtgtcctttgctgacaccatcaaggtgttccagacagagagccacatgaagatcgtgaggaagtctgagatggagggctgcagcgccatggtgcccagccagctgcagctgctgcccccaggcttcaagcgcttcagctgcctgagcctgcctgagacagaaacaggagagaacctgctgctgatccagaacaagaagctggaggacaactactgtgagatcaccggcatgaacaccctgctgagcgcccccatccacacccagatgcagcagaaggagttcagcatcatcgagcacacccgggagaggaagcacgccaatgaccagaccgtcatcttcagtgatgagaaccagatggacctgaccagcagccacacagtgatgatcaccaagggcctgctggacaaccccatcagcgagaagagcaccaagattgacaccaccagcttcctggccaacctgaagctgcacacagaggacagcaggatgaagaaggaggtgaacttctctgtggaccagaacaccagcagcgagaacaagattgacttcaatgacttcatcaagaggctgaagacaggcaagtgcagcgccttcccagatgtgcctgacaaggaaaattttgagatccccatctacagcaaggagcccaacagcgccagcagcacccaccagatgcacgtgtccctgaaggaggatgagaacaacagcaacatcaccaggctcttccgggagaaggatgatggcatgaacttcacccagtgccacacagccaacatccagaccctcatccccaccagcagcgagaccaacagccgggagagcaaaggaaatgacatcaccatctatggaaatgacttcatggacctgaccttcaaccacaccctgcagatcctgcctgccactggaaacttcagcgagattgagaaccagacccagaatgccatggatgtgaccaccggctacggcaccaaggccagcggcaacaagacagtgttcaagagcaagcagaacacagccttccaggacctgagcatcaacagcgctgacaagatccacatcaccaggagccacatcatgggcgctgagacccacatcgtgtcccagacctgcaaccaggatgcccgcatcctggccatgaccccagagagcatctacagcaaccccagcatccagggctgcaagacagtgttctacagcagctgcaatgatgccatggagatgaccaagtgcctgagcaacatgagggaggagaagaacctgctgaagcatgacagcaactatgccaagatgtactgcaacccagatgccatgagcagcctgacagagaagaccatctacagcggggaggagaacatggacatcaccaagagccacacagtggccatcgacaaccagatcttcaagcaggaccagagcaatgtgcagattgctgctgcccccaccccagagaaggagatgatgctgcagaacctgatgaccaccagtgaagatggcaagatgaatgtgaactgcaacagcgtgccccacgtgtccaaggagcgcatccagcagagcctgagcaaccccctgagcatcagcctgacagacaggaagacagagctgctgagcggggagaacatggacctgacagagagccacaccagcaacctgggcagccaggtgcccctggccgcctacaacctggcccctgagagcaccagcgagagccacagccagagcaagagcagcagtgatgaatgtgaggagatcaccaagagcagaaatgagcccttccagaggagtgacatcatcgccaagaacagcctgacagacacctggaacaaggacaaggactgggtgctgaagatcctgccctacctggacaaggacagcccccagagcgctgactgcaaccaggagatcgccaccagccacaacatcgtgtactgcggcggcgtgctggacaagcagatcaccaacagaaacacagtgtcctgggagcagagcctcttcagcaccaccaagcccctcttcagcagcggccagttctccatgaagaaccacgacacagccatcagcagccacacagtgaagtctgtgctgggccagaacagcaagctggccgagcccctgaggaagagcctgagcaaccccaccccagactactgccacgacaagatgatcatctgcagcgaggaggagcagaacatggacctgaccaagagccacacagtggtgattggcttcggccccagcgagctgcaggagctgggcaagaccaacctggagcacaccaccggccagctgaccaccatgaaccggcagattgctgtgaaggtggagaagtgtgggaagagccccatcgagaagagcggcgtgctgaagagcaactgcatcatggatgtgctggaggatgagagcgtgcagaagcccaagttccccaaggagaagcagaatgtgaagatctggggcaggaagtctgtgggcggccccaagattgacaagaccatcgtgttttctgaagatgacaagaatgacatggacatcaccaagagctacaccatcgagatcaaccaccggcccctgctggagaagagggactgccacctggtgcccctggccggcaccagcgagaccatcctgtacacctgccggcaggatgacatggagatcaccaggagccacaccacagccctggagtgcaagacagtgtccccagatgagatcaccacccggcccatggacaagacagtggtgtttgtggacaaccacgtggagctggagatgacagagagccacacagtgttcatcgactaccaggagaaggagaggacagaccggcccaactttgagctgagccagaggaagagcctgggcacccccaccgtcatctgcacccccacagaggagagcgtcttcttccctggaaatggagagagtgaccggctggtggccaatgacagccagctgacccccctggaggagtggagcaacaacagaggccctgtggaggtggccgacaacatggagctgagcaagagcgccacctgcaagaacatcaaggatgtgcagagccctggcttcctgaatgagcccctgagcagcaagagccagaggaggaagagcctgaagctgaagaatgacaagaccatcgtgttttctgagaaccacaagaatgacatggacatcacccagagctgcatggtggagattgacaatgaaagtgccctggaggacaaggaggacttccacctggccggggccagcaagaccatcctgtacagctgtggccaggatgacatggagatcaccaggagccacaccacagccctggagtgcaagaccctgctgcccaatgagatcgccatccggcccatggacaagacagtgctcttcacagacaactacagcgacctggaggtgacagacagccacacagtgttcatcgactgccaggccacagagaagatcctggaggagaaccccaagtttggaattggcaagggcaagaacctgggcgtgtccttccccaaggacaacagctgtgtgcaggagattgctgagaagcaggccctggccgtgggcaacaagatcgtgctgcacacagagcagaagcagcagctgtttgctgccaccaacagaaccaccaatgagatcatcaagttccacagcgctgccatggatgagaaggtgattggcaaggtggtggaccaggcctgcaccctggagaaggcccaggtggagagctgccagctgaacaacagagacagaagaaatgtggacttcaccagcagccacgccacagctgtgtgtggcagcagtgacaactacagctgcctgcccaacgtcatcagctgcacagacaacctggagggcagcgccatgctgctgtgtgacaaggatgaggagaaggccaactactgccctgtgcagaatgacctggcctatgccaatgactttgccagcgagtactacctggagagcgagggccagcccctgagcgccccctgccccctgctggagaaggaggaggtgatccagaccagcaccaagggccagctggactgtgtgatcaccctgcacaaggaccaggacctgatcaaggaccccaggaacctgctggccaaccagaccctggtgtacagccaggacctgggggagatgaccaagctgaacagcaagagggtgtccttcaagctgcccaaggaccagatgaaggtgtatgtggatgacatctacgtgatcccccagccccacttcagcacagaccagccccccctgcccaagaagggccagagcagcatcaacaaggaggaggtgatcctgagcaaggccggcaacaagagcctgaacatcatcgagaacagcagcgcccccatctgtgagaacaagcccaagatcctgaacagcgaggagtggtttgctgctgcctgcaagaaggagctgaaggagaacatccagaccaccaactacaacacagccctggacttccacagcaacagtgatgtgaccaagcaggtgatccagacccacgtgaatgctggggaggccccagaccctgtgatcaccagcaatgtgccctgcttccacagcatcaagcccaacctgaacaacctgaatggcaagacaggagagttcctggccttccagacagtgcacctgccccccctgcctgagcagctgctggagctgggcaacaaggcccacaatgacatgcacatcgtgcaggccacagagatccacaacatcaacatcatcagcagcaatgccaaggacagcagagatgaggagaacaagaagagccacaacggggctgagaccaccagcctgccccccaagacagtgttcaaggacaaggtgcggcgctgcagcctgggcatcttcctgccccggctgcccaacaagaggaactgcagcgtgactggaattgatgacctggagcagatcccagctgacaccacagacatcaaccacctggagacccagcctgtgagcagcaaggacagcggcatcggctctgtggccggcaagctgaacctgagccccagccagtacatcaatgaggagaacctgcctgtgtacccagatgagatcaacagcagtgacagcatcaacattgaaacagaggagaaggccctgattgagacctaccagaaggagatcagcccctatgagaacaagatgggcaagacctgcaacagccagaagaggacctgggtgcaggaggaggaggacatccacaaggagaagaagatcaggaagaatgagatcaagttcagtgacaccacccaggaccgggagatctttgaccaccacacagaggaggacatcgacaagagcgccaacagcgtgctgatcaagaacctgagcaggacccccagcagctgcagcagcagcctggacagcatcaaggcagatggcaccagcctggacttcagcacctaccgcagcagccagatggagagccagttcctgcgggacaccatctgtgaggagagcctgcgggagaagctgcaggacggccgcatcaccatccgggagttcttcatcctgctgcaggtgcacatcctgatccagaagccccggcagagcaacctgcccggcaacttcaccgtgaacaccccacccaccccagaggacctgatgctgagccagtatgtgtaccggcccaagatccagatctaccgggaggactgtgaggcccggcggcagaagattgaggagctgaagctgagcgccagcaaccaggacaagctgctggtggacatcaacaagaacctgtgggagaagatgaggcactgcagcgacaaggagctgaaggccttcggcatctacctgaacaagatcaagagctgcttcaccaagatgaccaaggtgttcacccaccagggcaaggtggccctgtatggcaagctggtgcagagcgcccagaatgaaagagagaagctgcagatcaagattgatgagatggacaagatcctgaagaagattgacaactgcctgacagagatggagacagagaccaagaacctggaggatgaggagaagaacaaccctgtggaggagtgggacagcgagatgagagctgctgagaaggagctggagcagctgaagacagaggaggaggagctgcagaggaacctgctggagctggaggtgcagaaggagcagaccctggcccagattgacttcatgcagaagcagaggaacagaacagaggagctgctggaccagctgagcctgtctgagtgggatgtggtggagtggagcgatgaccaggccgtgttcacctttgtgtatgacaccatccagctgaccatcacctttgaggagagcgtggtgggcttccccttcctggacaagcgctacaggaagatcgtggatgtgaacttccagagcctgctggatgaggaccaggccccacccagcagcctgctggtgcacaagctgatcttccagtatgtggaggagaaggagagctggaagaagacctgcaccacccagcaccagctgcccaagatgctggaggagttcagcctggtggtgcaccactgccgcctgctgggggaggagattgagtacctgaagcgctggggccccaactacaacctgatgaacatcgacatcaacaacaatgagctgcggctgctcttcagcagcagcgctgcctttgccaagtttgagatcaccctcttcctgagcgcctactaccccagcgtgcccctgcccagcaccatccagaaccacgtgggcaacaccagccaggatgacatcgccaccatcctgagcaaggtgcccctggagaacaactacctgaagaatgtggtgaagcagatctaccaggacctcttccaggactgccacttctaccactag

SEQ ID NO: 19348 - DNA, 1638 bp, Artificial Sequence
  Description of Artificial Sequence: Synthetic coding sequence
atgagcagctgtgtgagcagccagcccagcagcaacagagctgccccccaggatgagctgggcggccggggcagcagcagcagcgagagccagaagccctgtgaggccctgcggggcctgagcagcctgagcatccacctgggcatggagagcttcatcgtggtgacagaatgtgagcccggctgtgctgtggacctgggcctggcccgggaccggcccctggaggctgatggccaggaggtgcccctggacaccagcggcagccaggcccggccccacctgagcggcaggaagctgagcctgcaggagaggagccagggcggcctggccgccggcggcagcctggacatgaatggccgctgcatctgccccagcctgccctacagccctgtgagcagcccccagagcagcccccggctgccccggcggcccaccgtggagagccaccacgtgtccatcaccggcatgcaggactgtgtgcagctgaaccagtacaccctgaaggatgaaattggcaagggcagctatggagtggtgaagctggcctacaatgaaaatgacaacacctactatgccatgaaggtgctgagcaagaagaagctgatccggcaggccggcttcccccggcggcccccaccccggggcaccaggcctgcccctgggggctgcatccagccccggggccccatcgagcaggtgtaccaggagatcgccatcctgaagaagctggaccaccccaacgtggtgaagctggtggaggtgctggatgaccccaatgaagaccacctgtacatggtgtttgagctggtgaaccagggccctgtgatggaggtgcccaccctgaagcccctgtctgaggaccaggcccgcttctacttccaggacctgatcaagggcatcgagtacctgcactaccagaagatcatccaccgggacatcaagcccagcaacctgctggtgggggaggatggccacatcaagattgctgactttggagtgtccaatgagttcaagggcagtgatgccctgctgagcaacacagtgggcaccccagccttcatggcccctgagagcctgtctgagaccaggaagatcttcagcggcaaggccctggatgtgtgggccatgggcgtgaccctgtactgctttgtgtttggccagtgccccttcatggatgagcgcatcatgtgcctgcacagcaagatcaagagccaggccctggagttcccagaccagcctgacattgctgaggacctgaaggacctgatcaccaggatgctggacaagaaccctgagagcagaattgtggtgcctgagatcaagatcctggtgaagaccatgatcaggaagaggagctttggaaacccctttgagggcagcagaagagaggagaggagcctgagcgcccctggcaacctgctgaccaagaagcccaccagagaatgtgagagcctgtctgagctgaaggaggcccggcagaggcggcagcccccaggccacaggcctgccccccggggcggcggcggcagcgccctggtgcggggcagcccctgtgtggagagctgctgggccccagcccctggcagccctgccaggatgcaccccctgcggcctgaggaggccatggagcctgagtag

SEQ ID NO: 19349 - DNA, 333 bp, Artificial Sequence
  Description of Artificial Sequence: Synthetic coding sequence
atgcccaagaggagctgcccctttgctgatgtggcccccctgcagctgaaggtgcgggtgtcccagcgggagctgagccggggcgtgtgtgccgagcgctacagccaggaggtgtttgaccccagcggcgtggccagcatcgcctgcagcagctgtgtgcgggctgtggatggcaaggctgtgtgtggccagtgtgagcgggccctgtgtggccagtgtgtgaggacctgctggggctgcggctctgtggcctgcaccctgtgtggcctggtggactgcagcgacatgtatgagaaggtgctgtgcaccagctgtgccatgtttgagacctag

SEQ ID NO: 19350 - DNA, 2253 bp, Artificial Sequence
  Description of Artificial Sequence: Synthetic coding sequence
atggaggacctgtttgagaccttccaggatgagatgggcttcagcaacatggaggatgatggccctgaggaggaggagcgggtggccgagccccaggccaacttcaacaccccccaggccctgcgctttgaggagctgctggccaacctgctgaatgagcagcaccagatcgccaaggagctgtttgagcagctgaagatgaagaagcccagcgccaagcagcagaaggaggtggagaaggtgaagccccagtgcaaggaggtgcaccagaccctcatcctggaccctgcccagaggaagaggctgcagcagcagatgcagcagcacgtgcagctgctgacccagatccacctgctggccacctgcaaccccaacctgaaccctgaggccagcagcacccgcatctgcctgaaggagctgggcacctttgcccagagcagcatcgccctgcaccaccagtacaaccccaagttccagaccctcttccagccctgcaacctgatgggcgccatgcagctgattgaggacttcagcacccacgtgtccattgactgcagcccccacaagacagtgaagaagacagccaatgagttcccctgcctgcccaagcaggtggcctggatcctggccaccagcaaggtgttcatgtacccagagctgctgcctgtgtgcagcctgaaggccaagaacccccaggacaagatcctcttcaccaaggccgaggacaacctgctggccctgggcctgaagcactttgagggcacagagttcctgaaccccctcatcagcaagtacctgctgacctgcaagacagcccggcagctgactgtgcgcatcaagaacctgaacatgaacagagccccagacaacatcatcaagttctacaagaagaccaagcagctgcctgtgctgggcaagtgctgtgaggagatccagccccaccagtggaagccacccatcgagcgggaggagcaccggctgcccttctggctgaaggccagcctgcccagcatccaggaggagctgcggcacatggctgatggagcccgggaggtgggcaacatgacaggcaccacagagatcaacagcgaccagggcctggagaaggacaacagcgagctgggcagcgagacccgctaccccctgctgctgcccaagggcgtggtgctgaagctgaagcctgtggccgaccgcttccccaagaaggcctggaggcagaagaggagctctgtgctgaagcccctgctgatccagcccagccccagcctgcagcccagcttcaaccctgggaagaccccagcccagagcacccacagcgaggccccacccagcaagatggtgctgcgcatcccccaccccatccagcctgccaccgtgctgcagacagtgcctggggtgccccccctgggcgtgtctggaggagagagctttgagagccctgctgccctgcctgccatgcctcctgaggcccggaccagcttccccctgtctgagagccagaccctgctgagcagcgcccctgtgcccaaggtgatgatgcccagccctgccagctccatgttcaggaagccctacgtgagaagaagacccagcaagagaagaggagcccgggccttccgctgcatcaagccagcccctgtgatccacccagccagcgtcatcttcaccgtgcctgccaccaccgtgaagatcgtgtccctgggcggcggctgcaacatgatccagcctgtgaatgctgctgtggcccagagcccccagaccatccccatcgccaccctgctggtgaaccccaccagcttcccctgccccctgaaccagcccctggtggccagctctgtgagccccctgattgtgtctggcaacagcgtgaacctgcccatccccagcaccccagaggacaaggcccacatgaatgtggacatcgcctgtgctgtggctgatggagaaaatgccttccagggcctggagcccaagctggagccccaggagctgagccccctgagcgccaccgtcttccccaaggtggagcacagccctggccccccacctgtggacaagcagtgccaggagggcctgtctgagaacagcgcctaccgctggacagtggtgaagacagaggagggccggcaggccctggagcccctgccccagggcatccaggagagcctgaacaacagcagccctggggacctggaggaggtggtgaagatggagccagaagatgccacagaggagatcagcggcttcctgtag

SEQ ID NO: 19351 - DNA, 2604 bp, Artificial Sequence
  Description of Artificial Sequence: Synthetic coding sequence
atgcaggccgaggccgctgactggttcagctccatgcccttccagaagcacgtgtactaccccctggccagcggccctgagggcccagatgtggccgtggccgctgctgctgctggggccgcctccatggcctgtgcccctccttctgctgccagcggccccctgcccttcttccagttccggccccggctggagagcgtggactggaggcggctgagcgccattgatgtggacaaggtggccggggctgtggatgtgctgaccctgcaggagaacatcatgaacatcaccttctgcaagctggaggatgagaagtgcccccactgccagagcggcgtggaccctgtgctgctgaagctgatccggctggcccagttcaccatcgagtacctgctgcacagccaggagttcctgaccagccagctgcacaccctggaggagcggctgcggctgagccactgtgatggagagcagagcaagaagctgctgaccaagcaggccggggagatcaagaccctgaaggaggagtgcaagaggaggaagaagatgatcagcacccagcagctgatgattgaggccaaggccaactactaccagtgccacttctgtgacaaggccttcatgaaccaggccttcctgcagagccacatccagaggaggcacacagaggagaacagccactttgagtaccagaagaatgcccagatcgagaagctgcggagtgaaattgtggtgctgaaggaggagctgcagctgaccaggtctgagctggaggccgcccaccacgccagcgctgtgcgcttcagcaaggagtatgagatgcagaagaccaaggaggaggacttcctgaagctgtttgaccgctggaaggaggaggagaaggagaagctggtggatgagatggagaaggtgaaggagatgttcatgaaggagttcaaggagctgaccagcaagaacagcgccctggagtaccagctgtctgagatccagaagagcaacatgcagatcaagagcaacatcggcaccctgaaggatgcccacgagttcaaggaggacaggagcccctacccccaggacttccacaacgtgatgcagctgctggacagccaggagagcaagtggacagcccgggtgcaggccatccaccaggagcacaagaaggagaagggccgcctgctgagccacatcgagaagctgcggacctccatgattgatgacctgaatgccagcaatgtgttctacaagaagagaattgaggagctgggccagaggctgcaggagcagaatgaactcatcatcacccagaggcagcagatcaaggacttcacctgcaaccccctgaacagcatcagcgagcccaagggcaaccccctggcctggcaggcctttgagagccagcctgctgccccagctgtgcccatgaatgccccagccctgcacaccctggagaccaagagcagcctgcccatggtgcatgagcaggccttcagcagccacatcctggagcccatcgaggagctgtctgaggaggagaagggcagagaaaatgagcagaagctgaacaacaacaagatgcacctgaggaaggccctgaagagcaacagcagcctgaccaagggcctgcggaccatggtggagcagaacctgatggagaagctggagaccctgggcatcaatgctgacatccggggcatcagcagtgaccagctgcaccgggtgctgaagtctgtggagagcgagcggcacaagcaggagcgggagatccccaacttccaccagatccgggagttcctggagcaccaggtgtcctgcaagattgaggagaaggccctgctgagcagtgaccagtgcagcgtgtcccagatggacaccctgagcactggagaggtgcccaagatgatccagctgcccagcaagaaccggcagctgatccggcagaaggctgtgtccacagacaggacctctgtgcccaagatcaagaagaatgtgatggaggaccccttccccaggaagagcagcaccatcaccaccccacccttcagcagcgaggaggagcaggaggatgatgacctgatccgggcctatgccagccctggccccctgcctgtgcccccaccccagaacaagggcagctttgggaagaacacagtgaagagtgatgctgatggaacagagggcagcgagattgaggacacagatgacagccccaagccagctggggtggccgtgaagacccccacagagaaggtggagaagatgttcccccacaggaagaatgtgaacaagcctgtgggcggcaccaacgtgcctgagatgttcatcaagaaggaggagctgcaggagctgaagtgtgctgatgtggaggatgaggactgggacatcagcagcctggaggaggagatcagcctgggcaagaagagcggcaaggagcagaaggagcccccaccagccaagaatgagccccactttgcccacgtgctgaatgcctggggcgccttcaaccccaagggccccaagggggagggcctgcaggagaatgaaagcagcaccctgaagagcagcctggtgacagtgacagactggagcgacaccagtgatgtgtag

SEQ ID NO: 19352 - DNA, 1860 bp, Artificial Sequence
  Description of Artificial Sequence: Synthetic coding sequence
atgagcggcctggtgctgggccagagagatgagcctgctggccaccggctgagccaggaggagatcctgggcagcacccggctggtgtcccagggcctggaggccctgcggtctgagcaccaggccgtgctgcagagcctgagccagaccatcgagtgcctgcagcagggcggccacgaggagggcctggtgcatgagaaggcccggcagctgcggcgctccatggagaacatcgagctgggcctgtctgaggcccaggtgatgctggccctggccagccacctgagcacagtggagagcgagaagcagaagctgcgggcccaggtgcggcggctgtgccaggagaaccagtggctgagagatgagctggccggcacccagcagaggctgcagaggtctgagcaggccgtggcccagctggaggaggagaagaagcacctggagttcctgggccagctgcggcagtatgatgaagatggccacaccagcgaggagaaggagggagatgccaccaaggacagcctggatgacctcttccccaatgaggaggaggaggaccccagcaatggcctgagccggggccagggcgccacagctgcccagcagggcggctatgagatcccagcccggctgcggaccctgcacaacctggtgatccagtatgctgcccagggccgctatgaggtggccgtgcccctgtgcaagcaggccctggaggacctggagaggaccagcggccggggccacccagatgtggccaccatgctgaacatcctggccctggtgtacagagaccagaacaagtacaaggaggccgcccacctgctgaatgatgccctgagcatccgggagagcaccctgggccctgaccaccctgctgtggccgccaccctgaacaacctggccgtgctgtatggcaagaggggcaagtacaaggaggccgagcccctgtgccagagggccctggagatccgggagaaggtgctgggcaccaaccacccagatgtggccaagcagctgaacaacctggccctgctgtgccagaaccagggcaagtatgaagctgtggagcgctactaccagagggccctggccatctatgagggccagctgggccctgacaaccccaacgtggcccggaccaagaacaacctggccagctgctacctgaagcagggcaagtatgcagaggccgagaccctgtacaaggagatcctgacccgggcccacgtgcaggagtttggatctgtggatgatgaccacaagcccatctggatgcacgccgaggagcgggaggagatgagcaagagccgccaccacgagggcggcaccccctatgcagaatatggaggctggtacaaggcctgcaaggtgagcagccccaccgtgaacaccaccctgaggaacctgggcgccctgtaccgccggcagggcaagctggaggccgctgagaccctggaggagtgtgccctgcggagccggcggcagggcacagaccccatcagccagaccaaggtggccgagctgctgggggagagtgatggccgccgcaccagccaggagggccctggggacagcgtgaagtttgaaggaggagaagatgcctctgtggccgtggagtggagcggagatggcagcggcaccctgcagaggagcggcagcctgggcaagatcagagatgtgctgcggcgcagcagcgagctgctggtgaggaagctgcagggcacagagccccggcccagcagcagcaacatgaagagagctgccagcctgaactacctgaaccagcccagcgctgcccccctgcaggtgtcccggggcctgagcgccagcaccatggacctgagcagcagcagctag

SEQ ID NO: 19353 - DNA, 1137 bp, Artificial Sequence
  Description of Artificial Sequence: Synthetic coding sequence
atgaaggagcagctgcctgacctgcacagccacttcagtgacctgaacctggaggcccacatgtatgccagccagtggttcctgaccctcttcaccgccaagttccccctgtgcatggtgttccacatcatcgacctgctgctgtgtgagggcctgaacatcatcttccacgtggccctggccctgctgaagaccagcaaggaggacctgctgcaggccgactttgaaggagccctgaagttcttccgggtgcagctgcccaagcgctacagagctgaggagaatgcccggcggctgatggagcaggcctgcaacatcaaggtgcccaccaagaagctgaagaagtatgagaaggagtaccagaccatgagggagagccagctgcagcaggaggaccccatggaccgctacaagcgggagaacagaaggctgcaggaggcctccatgaggctggagcaggagaatgatgacctggcccacgagctggtgaccagcaagatcgccctgagaaatgacctggaccaggccgaggacaaggcagatgtgctgaacaaggagctgctgctgaccaagcagaggctggtggagacagaggaggagaagaggaagcaggaggaggagacagcccagctgaaggaggtgttcaggaagcagctggagaaggccgagtatgagatcaagaagaccacagccatcatcgccgagtacaagcagatctgcagccagctgagcacccggctggagaagcagcaggccgccagcaaggaggagctggaggtggtgaagggcaagatgatggcctgcaagcactgcagcgacatcttcagcaaggagggcgccctgaagctggccgccaccggccgggaggaccagggcattgaaacagatgatgagaaggacagcctgaagaagcagctgcgggagatggagctggagctggcccagaccaagctgcagctggtggaggccaagtgcaagatccaggagctggagcaccagagaggagccctgatgaatgagatccaggccgccaagaacagctggttcagcaagaccctgaacagcatcaagacagccaccggcacccagcccctgcagcctgcccctgtgacccagccccccaaggagagcacctag

SEQ ID NO: 19354 - DNA, 2631 bp, Artificial Sequence
  Description of Artificial Sequence: Synthetic coding sequence
atgggagacagtgatgatgaatatgacagaagaagaagagacaagttcagaagagagaggagtgactatgacaggagccgggagagagatgagaggagaagaggagatgactggaatgaccgggagtgggaccggggccgggagaggaggagcagaggagagtacagagattatgacaggaacagaagagagcgcttcagcccccccaggcatgagctgagccccccccagaagaggatgagaagagactgggatgagcacagcagtgacccctaccacagcggctatgagatgccctatgccggcggcggcggcggccccacctacggccccccccagccctggggccacccagatgtgcacatcatgcagcaccacgtgctgcccatccaggcccggctgggcagcattgctgagattgacctgggcgtgcccccacctgtgatgaagaccttcaaggagttcctgctgagcctggatgacagcgtggatgaaacagaggccgtgaagcgctacaatgactacaagctggacttccggcggcagcagatgcaggacttcttcctggcccacaaggatgaggagtggttccgcagcaagtaccacccagatgaggtgggcaagaggcggcaggaggcccggggggccctgcagaaccggctgcgggtcttcctgagcctgatggagaccggctggtttgacaacctgctgctggacatcgacaaggcagatgccatcgtgaagatgctggatgctgctgtgatcaagatggagggcggcacagaaaatgacctgcgcatcctggagcaggaggaggaggaggagcaggccggcaagccaggagagcccagcaagaaggaggagggccgggccggggccggcctgggagatggagagaggaagaccaatgacaaggatgagaagaaggaggatggcaagcaggccgagaatgacagcagcaatgatgacaagaccaagaagtcagaaggagatggagacaaggaggagaagaaggaggacagcgagaaggaggccaagaagagcagcaagaagaggaacaggaagcacagcggagatgacagctttgatgagggctctgtgtctgagagcgagagcgagagcgagagcggccaggccgaggaggagaaggaggaggccgaggaggccctgaaggagaaggagaagcccaaggaggaggagtgggagaagcccaaggatgctgctggcctggagtgcaagccccggcccctgcacaagacctgcagcctcttcatgaggaacatcgcccccaacatcagcagagctgagatcatcagcctgtgcaagcgctacccaggcttcatgagggtggccctgtctgagccccagcctgagcggcgcttcttcagaagaggctgggtgacctttgacagatctgtgaacatcaaggagatctgctggaacctgcagaacatccggctgagagaatgtgagctgagccctggggtgaacagagacctgacccggcgggtgaggaacatcaatggcatcacccagcacaagcagatcgtgagaaatgacatcaagctggccgccaagctgatccacaccctggatgacaggacccagctgtgggccagcgagcccggcaccccacccctgcccaccagcctgcccagccagaaccccatcctgaagaacatcacagactacctgattgaggaggtgtctgctgaggaggaggagctgctgggcagcagcggcggggcccctcctgaggagccccccaaggagggcaacccagctgagatcaacgtggagagagatgagaagctgatcaaggtgctggacaagctgctgctgtacctgcgcatcgtgcacagcctggactactacaacacctgtgagtacccaaatgaagatgagatgcccaacagatgtggcatcatccacgtgcggggccccatgccacccaaccgcatcagccacggggaggtgctggagtggcagaagacctttgaggagaagctgacccccctgctgtctgtgcgggagagcctgtctgaggaggaggcccagaagatgggcaggaaggaccctgagcaggaggtggagaagtttgtgaccagcaacacccaggagctgggcaaggacaagtggctgtgccccctgagcggcaagaagttcaagggccctgagtttgtgaggaagcacatcttcaacaagcatgctgagaagattgaggaggtgaagaaggaggtggccttcttcaacaacttcctgacagatgccaagaggcctgccctgcctgagatcaagccagcccagcccccaggccctgcccagatcctgcccccaggcctgaccccaggcctgccctacccccaccagaccccccagggcctgatgccctacggccagcccaggcctcccatcctgggctacggggccggggctgtgcggcctgctgtgcccactggaggccccccctacccccacgccccctatggagctggccggggcaactatgatgccttccggggccagggcggctacccaggcaagcccaggaacaggatggtgcggggggacccccgggccatcgtggagtacagagacctggatgccccagatgatgtggacttcttctag

SEQ ID NO: 19355 - DNA, 1491 bp, Artificial Sequence; identical to SEQ ID NO: 19263
  Description of Artificial Sequence: Synthetic coding sequence

SEQ ID NO: 19356 - DNA, 318 bp, Artificial Sequence
  Description of Artificial Sequence: Synthetic coding sequence
atggccctgcgctaccccatggctgtgggcctgaacaagggccacaaggtgaccaagaatgtgtccaagcccaggcacagcagaagaagaggccgcctgaccaagcacaccaagtttgtgcgggacatgatccgggaggtgtgtggctttgccccctatgaaagaagagccatggagctgctgaaggtgtccaaggacaagagggccctgaagttcatcaagaagagggtgggcacccacatccgggccaagaggaagcgggaggagctgagcaatgtgctggccgccatgaggaaggctgctgccaagaaggactag

SEQ ID NO: 19357 - DNA, 3720 bp, Artificial Sequence
  Description of Artificial Sequence: Synthetic coding sequence
atggccaatgacagccctgccaagagcctggtggacatcgacctgagcagcctgcgggaccctgctggcatctttgagctggtggaggtggtgggcaatggcacctacggccaggtgtacaagggccgccacgtgaagacaggccagctggccgccatcaaggtgatggatgtgacagaagatgaggaggaggagatcaagctggagatcaacatgctgaagaagtacagccaccacaggaacatcgccacctactacggggccttcatcaagaagagccccccaggccatgatgaccagctgtggctggtgatggagttctgtggggccggcagcatcacagacctggtgaagaacaccaagggcaacaccctgaaggaggactggatcgcctacatcagccgggagatcctgcggggcctggcccacctgcacatccaccacgtgatccaccgggacatcaagggccagaatgtgctgctgacagaaaatgctgaggtgaagctggtggactttggagtgtctgcccagctggacagaacagtgggcagaagaaacaccttcatcggcaccccctactggatggcccctgaggtgattgcctgtgatgagaacccagatgccacctatgactacagaagtgacctgtggagctgtggcatcacagccatcgagatggccgagggcgccccacccctgtgtgacatgcaccccatgagggccctcttcctgatccccagaaatcctccaccccggctgaagagcaagaagtggagcaagaagttcttctccttcatcgagggctgcctggtgaagaactacatgcagaggcccagcacagagcagctgctgaagcaccccttcatccgggaccagcccaatgaaaggcaggtgcgcatccagctgaaggaccacatcgacaggaccaggaagaagagaggagagaaggatgaaacagaatatgagtacagcggcagcgaggaggaggaggaggaggtgcctgagcaggagggggagcccagcagcatcgtgaatgtgcctggagagagcaccctgcggcgggacttcctgcggctgcagcaggagaacaaggagaggtctgaggccctgcggcggcagcagctgctgcaggagcagcagctgcgggagcaggaggagtacaagaggcagctgctggccgagcggcagaagagaattgagcagcagaaggagcagaggcggcggctggaggagcagcagaggcgggagcgggaggcccggcggcagcaggagcgggagcagaggagaagagagcaggaggagaagaggcggctggaggagctggagaggaggaggaaggaggaggaggagcggcggcgggcagaggaggagaagagaagagtggagcgggagcaggagtacatccggcggcagctggaggaggagcagaggcacctggaggtgctgcagcagcagctgctgcaggagcaggccatgctgctggagtgccgctggagggagatggaggagcaccggcaggccgagcggctgcagaggcagctgcagcaggagcaggcctacctgctgagcctgcagcacgaccacagaagaccccacccccagcacagccagcagcccccaccaccccagcaggagaggagcaagcccagcttccacgcccctgagcccaaggcccactatgagcctgctgaccgggcccgggaggtggaggaccgcttcaggaagaccaaccacagcagccctgaggcccagagcaagcagacaggccgggtgctggagccccctgtgcccagccgctctgagagcttcagcaatggaaacagcgagagcgtgcacccagccctgcagaggcctgctgagccccaggtgcctgtgaggaccaccagccgcagccctgtgctgagccggcgggacagccccctgcagggcagcggccagcagaacagccaggccggccagaggaacagcaccagcattgagccccggctgctgtgggagcgggtggagaagctggtgcccaggcctggcagcggcagcagcagcggcagcagcaacagcggcagccagcccggcagccaccctggcagccagagcggcagcggggagcgcttccgggtgcgcagcagcagcaagtctgagggcagccccagccagaggctggagaatgctgtgaagaagccagaggacaagaaggaggtgttccggcccctgaagccagctgacctgacagccctggccaaggagctgcgggctgtggaggatgtgcggcccccccacaaggtgacagactacagcagcagcagcgaggagagcggcaccacagatgaagaagatgatgatgtggagcaggagggcgcagatgagagcaccagcggccctgaggacacccgggccgccagcagcctgaacctgagcaatggagaaacagaatctgtgaagaccatgattgtgcatgatgatgtggagagcgagcccgccatgacccccagcaaggagggcaccctcatcgtgcggcagacccagagcgccagcagcaccctgcagaagcacaagagcagcagcagcttcacccccttcatcgacccccggctgctgcagatcagccccagcagcggcaccaccgtgacctctgtggtgggcttcagctgtgatggcatgaggcctgaggccatccggcaggaccccaccaggaagggctctgtggtgaatgtgaaccccaccaacacccggccccagagcgacaccccagagatcaggaagtacaagaagcgcttcaacagcgagatcctgtgtgccgccctgtggggcgtgaacctgctggtgggcacagaaagtggcctgatgctgctggacagaagtggccagggcaaggtgtaccccctcatcaacagaagacgcttccagcagatggatgtgctggagggcctgaatgtgctggtgaccatcagcggcaagaaggacaagctgcgggtgtactacctgtcctggctgaggaacaagatcctgcacaatgaccctgaggtggagaagaagcagggctggaccaccgtgggggacctggagggctgtgtgcactacaaggtggtgaagtatgagcgcatcaagttcctggtgattgccctgaagagctctgtggaggtgtatgcctgggcccccaagccctaccacaagttcatggccttcaagagctttggagagctggtgcacaagcccctgctggtggacctgactgtggaggagggccagaggctgaaggtgatctacggcagctgtgccggcttccacgctgtggatgtggacagcggctctgtgtatgacatctacctgcccacccacatccagtgcagcatcaagccccacgccatcatcatcctgcccaacacagatggcatggagctgctggtgtgctatgaagatgaaggagtgtatgtgaacacctacggccgcatcaccaaggatgtggtgctgcagtggggcgagatgcccacctctgtggcctacatccgcagcaaccagaccatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgtacttcatgaccctgggccgcaccagcctgctgtcctggtag

SEQ ID NO: 19358 - DNA, 2847 bp, Artificial Sequence
  Description of Artificial Sequence: Synthetic coding sequence
atgtatggcagcgcccggtctgtgggcaaggtggagcccagcagccagagccctggccgcagcccccggctgcccaggagcccccggctgggccacaggaggaccaacagcactggaggcagcagcggcagctctgtgggcggcggcagcggcaagaccctgtccatggagaacatccagagcctgaatgctgcctatgccaccagcggccccatgtacctgagtgaccatgaaaatgtgggcagcgagacccccaagagcaccatgaccctgggccgcagcggcggccgcctgccctacggcgtgaggatgacagccatgggcagcagccccaacatcgccagcagcggcgtggccagtgacaccatcgcctttggagagcaccacctgccccctgtgtccatggccagcacagtgccccacagcctgcggcaggcccgggacaacaccatcatggacctgcagacccagctgaaggaggtgctgcgggagaatgacctgctgaggaaggatgtggaggtgaaggagagcaagctgagcagctccatgaacagcatcaagaccttctggagccctgagctgaagaaggagcgggccctgaggaaggatgaggccagcaagatcaccatctggaaggagcagtacagagtggtgcaggaggagaaccagcacatgcagatgaccatccaggccctgcaggatgagctgcgcatccagagggacctgaaccagctgttccagcaggacagcagcagcaggactggagagccctgtgtggccgagctgacagaggagaacttccagaggctgcacgccgagcacgagcggcaggccaaggagctgttcctgctgaggaagaccctggaggagatggagctgagaattgagacccagaagcagaccctgaatgccagagatgagagcatcaagaagctgctggagatgctgcagagcaagggcctgagcgccaaggccacagaggaggaccacgagaggacccggcggctggccgaggccgagatgcacgtgcaccacctggagagcctgctggagcagaaggagaaggagaacagcatgctgcgggaggagatgcacagaagatttgaaaatgccccagacagcgccaagaccaaggccctgcagaccgtcatcgagatgaaggacagcaagatcagctccatggagcggggcctgcgggacctggaggaggagatccagatgctgaagagcaatggagccctgagcacagaggagcgggaggaggagatgaagcagatggaggtgtaccgcagccacagcaagttcatgaagaacaagattggccaggtgaagcaggagctgagcaggaaggacacagagctgctggccctgcagaccaagctggagaccctgaccaaccagttcagtgacagcaagcagcacatcgaggtgctgaaggagagcctgacagccaaggagcagagagctgccatcctgcagacagaggtggatgccctgcggctgcggctggaggagaaggagaccatgctgaacaagaagaccaagcagatccaggacatggccgaggagaagggcacccaggccggggagatccatgacctgaaggacatgctggatgtgaaggagaggaaggtgaatgtgctgcagaagaagattgagaacctgcaggagcagctgcgggacaaggagaagcagatgagcagcctgaaggagcgggtgaagagcctgcaggccgacaccaccaacacagacacagccctgaccaccctggaggaggccctggccgagaaggagaggaccatcgagcggctgaaggagcagagggacagagatgagcgggagaagcaggaggagattgacaactacaagaaggacctgaaggacctgaaggagaaggtgtccctgctgcagggcgacctgtctgagaaggaggccagcctgctggacctgaaggagcacgccagcagcctggccagcagcggcctgaagaaggacagccggctgaagaccctggagatcgccctggagcagaagaaggaggagtgcctgaagatggagagccagctgaagaaggcccatgaagctgccctggaggcccgggccagccctgagatgtctgaccgcatccagcacctggagcgggagatcacccgctacaaggatgagagcagcaaggcccaggccgaggtggaccggctgctggagatcctgaaggaggtggagaatgagaagaatgacaaggacaagaagattgctgagctggagagcctgaccagccggcaggtgaaggaccagaacaagaaggtggccaacctgaagcacaaggagcaggtggagaagaagaagagcgcccagatgctggaggaggcccggcggcgggaggacaacctgaatgacagcagccagcagctgcaggtggaggagctgctgatggccatggagaaggtgaagcaggagctggagagcatgaaggccaagctgagcagcacccagcagagcctggccgagaaggagacccacctgaccaacctgcgggcagagaggaggaagcacctggaggaggtgctggagatgaagcaggaggccctgctggccgccatcagcgagaaggatgccaacatcgccctgctggagctgagcagcagcaagaagaagacccaggaggaggtggccgccctgaagcgggagaaggaccggctggtgcagcagctgaagcagcagacccagaacaggatgaagctgatggctgacaactatgaagatgaccacttcaagagcagccacagcaaccagaccaaccacaagcccagcccagaccaggatgaggaggagggcatctgggcctag

SEQ ID NO: 19359 - DNA, 2733 bp, Artificial Sequence
  Description of Artificial Sequence: Synthetic coding sequence
atggccgccaccgtggagggccctgagctggaggccgctgctgctgctggagatgcctctgaagattctgatgctggcagccgggccctgcccttcctgggcggcaaccggctgagcctggacctgtacccaggcggctgccagcagctgctgcacctgtgtgtgcagcagcccctgcagctgctgcaggtggagttcctgcggctgagcacccatgaggacccccagctgctggaggccaccctggcccagctgccccagagcctgagctgcctgcggagcctggtgctgaagggcggccagaggcgggacaccctgggcgcctgcctgcggggggccctgaccaacctgcctgctggcctgagcggcctggcccacctggcccacctggacctgtccttcaacagcctggagaccctgcctgcctgtgtgctgcagatgaggggcctgggcgccctgctgctgagccacaactgcctgtctgagctgcctgaggccctgggcgccctgcctgccctgaccttcctgactgtgacccacaaccggctgcagaccctgcccccagccctgggcgccctgagcaccctgcagaggctggacctgagccagaacctgctggacaccctgcccccagaaattggaggcctgggcagcctgctggagctgaacctggccagcaaccggctgcagagcctgcctgccagcctggccggcctgcggagcctgcggctgctggtgctgcacagcaacctgctggcctctgtgcctgctgacctggcccggctgcccctgctgacccggctggacctgcgggacaaccagctgcgggacctgcccccagagctgctggatgccccctttgtgcggctgcagggcaaccccctgggggaggccagcccagatgcccccagcagccctgtggccgccctgatccctgagatgcccaggctcttcctgaccagtgacctggacagcttccctgtgaccccccagggctgcagcgtgaccctggcctgtggggtgcggctgcagtttcctgctggggccacagccacccccatcaccatccgctaccgcctgctgctgcctgagcccggcctggtgcccctgggcccccatgatgccctgctgagccacgtgctggagctgcagccccacggcgtggccttccagcaggatgtgggcctgtggctgctcttcaccccaccccaggcccggcgctgccgggaggtggtggtgaggaccagaaatgacaacagctggggagacctggagacctacctggaggaggaggccccccagaggctgtgggcccactgccaggtgccccacttctcctggttcctggtggtgtccaggcctgtgtccaatgcctgcctggtgcccccagagggcaccctgctgtgcagcagcggccaccctggggtgaaggtgatcttccccccaggggccacagaggagcccaggagagtgtccatgcaggtggtgaggatggccggccgggagctgcaggccctgctgggggagcctgaggccgctgtgagccccctgctgtgcctgagccagagcggccccccatccttcctgcagcctgtgacagtgcagctgcccctgcccagcggcatcaccggcctgagcctggacaggagccggctgcacctgctgtactgggcccctcctgctgccacctgggatgacatcacagcccaggtggtgctggagctgacccacctgtatgcccgcttccaggtgacccacttctcctggtactggctgtggtacaccaccaagaactgtgtgggcggcctggccaggaaggcctgggagcggctgcggctgcaccgggtgaacctgattgccctgcagaggcggcgggaccctgagcaggtgctgctgcagtgcctgcccaggaacaaggtggatgccaccctgcggcggctgctggagcgctaccggggccctgagcccagcgacacagtggagatgtttgaaggagaggagttctttgctgcctttgagcggggcattgatgtggatgctgacagaccagactgtgtggagggccgcatctgctttgtgttctacagccacctgaagaatgtgaaggaggtgtatgtgaccaccaccctggaccgggaggcccaggccgtgcggggccaggtgtccttctacagaggagctgtgcctgtgcgggtgcctgaggaggccgaggccgcccggcagaggaaaggagcagatgccctgtggatggccaccctgcccatcaagctgccccggctgcggggcagcgagggccccaggagaggagctggcctgagcctggcccccctgaacctgggagatgctgagaccggcttcctgacccagagcaacctgctgtctgtggccggccgcctgggcctggactggccagctgtggccctgcacctgggcgtgtcctaccgggaggtgcagaggatcagacatgagttcagagatgacctggatgagcagatccgccacatgctgttctcctgggccgagcggcaggccggccagcctggagctgtgggcctgctggtgcaggccctggagcagagcgaccggcaggatgtggccgaggaggtgcgggctgtgctggagctgggccgcaggaagtaccaggacagcatccggaggatgggcctggcccccaaggaccctgccctgcccggcagcagcgccccccagcccccagagcccgcccaggcctag

SEQ ID NO: 19360 - DNA, 2961 bp, Artificial Sequence
  Description of Artificial Sequence: Synthetic coding sequence
atgagccagtggaccccagagtacaatgagctgtacaccctgaaggtggacatgaagtctgagatccccagtgatgcccccaagacccaggagagcctgaagggcatcctgctgcaccctgagcccatcggggccgccaagagcttccctgctggggtggagatgatcaacagcaaggtgggcaatgagttcagccacctgtgtgatgacagccagaagcaggagaaggagatgaatggaaaccagcaggagcaggagaagagcctggtggtgaggaagaagaggaagagccagcaggccggccccagctatgtgcagaactgtgtgaaggagaaccagggcatcctgggcctgcggcagcacctgggcacccccagtgatgaggacaatgacagcagcttcagtgactgcctgagcagccccagcagcagcctgcactttggagacagcgacacagtgaccagtgatgaggacaaggaggtgtctgtgcgccacagccagaccatcctgaatgccaagagccgcagccacagcgcccggagccacaagtggcccaggacagaaacagaatctgtgtctggcctgctgatgaagaggccctgcctgcacggcagcagcctgcggcggctgccctgcaggaagagatttgtgaagaacaacagcagccagaggacccagaagcagaaggagcgcatcctgatgcagaggaagaagcgggaggtgctggcccggaggaaatatgccctgctgcccagcagcagcagcagcagtgaaaatgacctgagcagcgagagcagcagcagcagcagcacagaaggagaggaggacctgtttgtgtctgccagcgagaaccaccagaacaacccagctgtgcccagcggcagcattgatgaagatgtggtggtgattgaggccagcagcaccccccaggtgacagccaatgaggagatcaacgtgaccagcacagacagcgaggtggagatcgtgacagtgggggagagctaccgcagccgcagcaccctgggccacagccgcagccactggagccagggcagcagcagccacgccagccggccccaggagcccaggaacagaagccgcatcagcaccgtcatccagcccctgcggcagaatgctgctgaggtggtggacctgactgtggatgaagatgagcccaccgtggtgcccaccaccagcgccaggatggagagccaggccaccagcgccagcatcaacaacagcaaccccagcaccagcgagcaggccagtgacacagccagcgctgtgaccagcagccagcccagcacagtgtctgagaccagcgccaccctgaccagcaacagcaccaccggcaccagcattggagatgacagcaggaggaccaccagcagcgctgtgacagaaacaggccccccagccatgccccggctgcccagctgctgcccccagcacagcccctgtggcggcagcagccagaaccaccacgccctgggccacccccacaccagctgcttccagcagcacggccaccacttccagcaccaccaccaccaccaccacaccccccaccctgctgtgcctgtgagccccagcttcagtgaccctgcctgccctgtggagcggcccccccaggtgcaggccccctgtggggccaacagcagcagcggcaccagctaccacgagcagcaggccctgcctgtggacctgagcaacagcggcatccgcagccacggcagcggcagcttccatggagccagcgcctttgacccctgctgccctgtgagcagcagcagagctgccatcttcggccaccaggccgctgctgctgcccccagccagcccctgagcagcattgatggctacggcagctccatggtggcccagccccagccccagcccccaccccagcccagcctgagcagctgccgccactacatgcccccaccctatgccagcctgacccggcccctgcaccaccaggccagcgcctgcccccacagccacggcaaccccccaccccagacccagcccccaccccaggtggactatgtgatcccccaccctgtgcacgccttccacagccagatcagcagccacgccaccagccaccctgtggcccctcctccacccacccacctggccagcacagctgcccccatcccccagcacctgccccccacccaccagcccatcagccaccacatcccagccacagcccccccagcccagaggctgcacccccatgaggtgatgcagaggatggaggtgcagaggaggaggatgatgcagcaccccacccgggcccacgagcggcccccaccccacccccacaggatgcaccccaactacggccacggccaccacatccacgtgccccagaccatgagcagccacccccggcaggcccctgagaggtctgcctgggagctgggcatcgaggccggcgtgacagctgccacctacacccctggggccctgcacccccacctggcccactaccacgccccaccccggctgcaccacctgcagctgggcgccctgcccctgatggtgcctgacatggccggctacccccacatccgctacatcagcagcggcctggatggcaccagcttccggggccccttccggggcaactttgaggagctgatccacctggaggagcggctgggcaatgtgaacagaggagccagccagggcaccatcgagcgctgcacctacccccacaagtacaagaagaggaagctgcactgcaagcaggatggagaggagggcacagaggaggacacagaggagaagtgcaccatctgcctgagcatcctggaggagggagaagatgtgcggcggctgccctgcatgcacctgttccaccaggtgtgtgtggaccagtggctgatcaccaacaagaagtgccccatctgccgggtggacatcgaggcccagctgcccagcgagagctag

SEQ ID NO: 19361 - DNA, 372 bp, Artificial Sequence
  Description of Artificial Sequence: Synthetic coding sequence
atggccaagatcaaggcccgggacctgcggggcaagaagaaggaggagctgctgaagcagctggatgacctgaaggtggagctgagccagctgcgggtggccaaggtgactggaggagctgccagcaagctgagcaagatccgggtggtgaggaagagcatcgcccgggtgctgaccgtcatcaaccagacccagaaggagaacctgaggaagttctacaagggcaagaagtacaagcccctggacctgcggcccaagaagacccgggccatgagaagaaggctgaacaagcatgaggagaacctgaagaccaagaagcagcagaggaaggagcggctgtaccccctgaggaaatatgctgtgaaggcctag

SEQ ID NO: 19362 - DNA, 1635 bp, Artificial Sequence
  Description of Artificial Sequence: Synthetic coding sequence
atgaagatcttctgcagccgggccaaccccaccaccggctctgtggagtggctggaggaggatgagcactatgactaccaccaggagatcgcccggagcagctatgctgacatgctgcatgacaaggacagaaatgtgaagtactaccagggcatccgggctgctgtgtcccgggtgaaggaccggggccagaaggccctggtgctggacattggaactggaacaggcctgctgtccatgatggctgtgacagctggagctgacttctgctacgccatcgaggagaactgtgaggccgtgccccaccgggccaccgtgtatgcccagctggtggagagcggccgcatgtggagctggaacaagctgttccccatccacgtgcagaccagcctgggggagcaggtgattgtgccccctgtggatgtggagagctgccctggggcccccagcgtgtgtgacatccagctgaaccaggtgtccccagctgacttcaccgtgctgagtgatgtgctgcccatgttcagcattgacttcagcaagcaggtgagcagcagcgctgcctgccacagcagaagatttgagcccctgaccagcggccgggcccaggtggtgctgtcctggtgggacatcgagatggaccctgagggcaagatcaagtgcaccatggcccccttctgggcccacagcgaccctgaggagatgcagtggagggaccactggatgcagtgtgtgtacttcctgccccaggaggagcctgtggtgcagggcagcgccctgtacctggtggcccaccatgatgactactgtgtgtggtacagcctgcagaggaccagccctgagaagaatgaaagagtgcggcagatgaggcctgtgtgtgactgccaggcccacctgctgtggaaccggcccaggtttggagagatcaatgaccaggacagaacagacagatatgtgcaggccctgaggacagtgtccctgctgctgggggagcccttcttcaccaccagcctgctgccctggcacaacctgtacttctggtacgtgaggacagctgtggaccagcacctgggccctggggccatggtgatgccccaggccgccagcctgcatgctgtggtggtggagttccgggacctgtggaggatccgcagcccctgtggggactgtgagggctttgatgtgcacatcatggatgacatgatcaagagggccctggacttccgggagagccgggaggccgagccccaccccctgtgggagtacccctgccgcagcctgtctgagccctggcagatcctgacctttgacttccagcagcctgtgcccctgcagcccctgtgtgccgagggcaccgtggagctgcggcggcccggccagagccacgccgctgtgctgtggatggagtaccacctgaccccagagtgcaccctgagcacaggcctgctggagcctgctgaccctgagggcggctgctgctggaacccccactgcaagcaggccgtgtacttcttcagccctgccccagacccccgggccctgctgggcggccccaggacagtgtcctatgctgtggagttccacccagacaccggggacatcatcatggagttcagacatgctgacaccccagactag

SEQ ID NO: 19363 - DNA, 1131 bp, Artificial Sequence
  Description of Artificial Sequence: Synthetic coding sequence
atgcccctgcaggtgtctgactacagctggcagcagaccaagacagctgtgttcctgagcctgcccctgaagggcgtgtgtgtgcgggacacagatgtgttctgcacagagaactacctgaaggtgaacttcccccccttcctgtttgaggccttcctgtatgcccccattgatgatgagagcagcaaggccaagattggaaatgacaccatcgtgttcaccctgtacaagaaggaggccgccatgtgggagaccctgtctgtgactggagtggacaaggagatgatgcagaggatccgggagaagagcatcctgcaggcccaggagcgggccaaggaggccacagaggccaaggccgccgccaagcgggaggaccagaagtatgccctgtctgtgatgatgaagattgaggaggaggagaggaagaagattgaggacatgaaggaaaatgaaagaatcaaggccaccaaggccctggaggcctggaaggagtaccagaggaaggccgaggagcagaagaagatccagcgggaggagaagctgtgccagaaggagaagcagatcaaggaggagaggaagaagatcaagtacaagagcctgaccaggaacctggccagcaggaacctggcccccaagggcaggaacagcgagaacatcttcacagagaagctgaaggaggacagcatcccagcccccaggtctgtgggcagcatcaagatcaacttcacccccagggtcttccccacagccctgcgggagagccaggtggccgaggaggaggagtggctgcacaagcaggccgaggcccggcgggccatgaacacagacattgctgagctgtgtgacctgaaggaggaggagaagaaccctgagtggctgaaggacaagggcaacaagctgtttgccacagagaactacctggccgccatcaatgcctacaacctggccatccggctgaacaacaagatgcccctgctgtacctgaacagagctgcctgccacctgaagctgaagaacctgcacaaggccatcgaggacagcagcaaggcctaccgcatcatgaagaggcacctgcggctcatccaccccaccaagctgtacaagctgatgctgcggcgcttcggcatgtag

SEQ ID NO: 19364 - DNA, 4221 bp, Artificial Sequence
  Description of Artificial Sequence: Synthetic coding sequence
atgtggagcctgacagccagcgagggggagagcaccacagcccacttcttcctgggcgctggagatgagggcctgggcacccggggcatcggcatgaggcctgaggagagtgacagcgagctgctggaggatgaggaggatgaggtgcccccagagccccagatcatcgtgggcatctgtgccatgaccaagaagagcaagagcaagcccatgacccagatcctggagcggctgtgccgctttgactacctgactgtggtgatcctgggagaagatgtgatcctgaatgaacctgtggagaactggcccagctgccactgcctgatctccttccacagcaagggcttccccctggacaaggctgtggcctacagcaagctgaggaaccccttcctgatcaatgacctggccatgcagtactacatccaggacagaagagaggtgtaccgcatcctgcaggaggagggcatcgacctgcccaggtatgctgtgctgaacagagatcctgcccggcctgaggagtgcaacctgattgaaggagaggaccaggtggaggtgaatggagctgtgttccccaagccctttgtggagaagcctgtgtctgctgaggaccacaacgtgtacatctactaccccagcagcgctgggggcggcagccagaggctcttcaggaagattggcagccgcagctctgtgtacagccctgagagctctgtgaggaagacaggcagctacatctatgaggagttcatgcccacagatggaacagatgtgaaggtgtacacagtgggccctgactatgcccacgccgaggccaggaagagccctgccctggatggcaaggtggagcgggacagcgagggcaaggagatccgctaccctgtgatgctgacagccatggagaagctggtggccaggaaggtgtgtgtggccttcaagcagacagtgtgtggctttgacctgctgcgggccaacggccacagctttgtgtgtgatgtgaatggcttctcctttgtgaagaacagcatgaagtactatgatgactgtgccaagatcctgggcaacaccatcatgagggagctggccccccagttccagatcccctggagcatccccacagaagctgaggacatccccatcgtgcccaccaccagcggcaccatgatggagctgcgctgtgtgattgccatcatccgccacggggacaggacccccaagcagaagatgaagatggaggtgaagcacccccgcttctttgccctgtttgagaagcatggaggctacaagacaggcaagctgaagctgaagaggcctgagcagctgcaggaggtgctggacatcacccggctgctgctggccgagctggagaaggagcctggaggagaaattgaggagaagacaggcaagctggagcagctgaagtctgtgctggagatgtatggccacttcagcggcatcaacaggaaggtgcagctgacctactacccccatggagtgaaggccagcaatgaaggccaggacccccagcgggagaccctggcccccagcctgctgctggtgctgaagtggggcggggagctgaccccagctggccgggtgcaggccgaggagctgggccgggccttccgctgcatgtacccaggcggccagggcgactatgccggcttccctggctgcggcctgctgcggctgcacagcaccttcagacatgacctgaagatctatgccagtgatgagggccgggtgcagatgacagctgctgcctttgccaagggcctgctggccctggagggggagctgacccccatcctggtgcagatggtgaagagcgccaacatgaatggcctgctggacagtgatggagacagcctgagcagctgccagcaccgggtgaaggcccggctgcaccacatcctgcagcaggatgccccctttggacctgaggactatgaccagctggcccccaccaggagcaccagcctgctgaacagcatgaccatcatccagaaccctgtgaaggtgtgtgaccaggtgtttgccctgattgagaacctgacccaccagatccgggagaggatgcaggaccccaggtctgtggacctgcagctgtaccacagcgagaccctggagctgatgctgcagcgctggagcaagctggagcgggacttccggcagaagagcggccgctatgacatcagcaagatcccagacatctatgactgtgtgaagtatgatgtgcagcacaacggcagcctgggcctgcagggcacagctgagctgctgcggctgagcaaggccctggctgatgtggtgatcccccaggagtatggcatcagccgggaggagaagctggagattgctgtgggcttctgcctgcccctgctgaggaagatcctgctggacctgcagaggacccatgaagatgagagcgtgaacaagctgcaccccctgtacagcagaggagtgctgagccctggccgccacgtgaggacccggctgtacttcaccagcgagagccacgtgcacagcctgctgagcgtcttccgctatggaggcctgctggatgagacccaggatgcccagtggcagagggccctggactacctgagcgccatcagcgagctgaactacatgacccagatcgtcatcatgctgtatgaggacaacacccaggaccccctgtctgaggagcgcttccacgtggagctgcacttcagccctggggtgaagggcgtggaggaggagggcagcgccccagctggctgcggcttccggcctgccagcagtgaaaatgaggagatgaagaccaaccagggctccatggagaacctgtgccctgggaaggccagtgatgagccagaccgggccctgcagaccagcccccagcccccagagggccctggcctgcccaggaggagccccctcatccggaacaggaaggccggctccatggaggtgctgtctgagaccagcagcagcaggcctgggggctaccgcctcttcagcagcagccggcccccaacagagatgaagcagagcggcctgggctttgagggctgcagcatggtgcccaccatctaccccctggagaccctgcacaatgccctgagcctgcggcaggtgtctgagttcctgagccgggtgtgccagaggcacacagatgcccaggcccaggccagcgctgccctgtttgacagcatgcacagcagccaggccagtgacaaccccttcagcccccccaggaccctgcacagcccccccctgcagctgcagcagaggtctgagaagccaccctggctggagacccgcttctgccacgtgggccaggccggcctggagctgctgaccagcagtgacctgcctgccagcgccagccagagcgctggcatcactggagtgagccacaggacccagcctgacagcagcggccccagcagcacagtgagcagcgctggccccagcagccccaccaccgtggatggcaacagccagtttggcttcagtgaccagcccagcctgaacagccacgtggccgaggagcaccagggcctgggcctgctgcaggagaccccaggcagcggggcccaggagctgagcattgaaggagagcaggagctgtttgagcccaaccagagcccccaggtgccccccatggagaccagccagccctatgaggaggtgtcccagccctgccaggaggtgcctgacatcagccagccctgccaggacatcagcgaggccctgagccagccctgccagaaggtgcctgacatcagccagcagtgccaggagaaccacgacaatggaaaccacacctgccaggaggtgccccacatcagccagccctgccagaagagcagccagctgtgccagaaggtgtctgaggaggtgtgccagctgtgcctggagaacagcgaggaggtgtcccagccctgccagggcgtgtctgtggaggtgggcaagctggtgcacaagttccacgtgggcgtgggcagcctggtgcaggagaccctggtggaggtgggcagccctgctgaggagatccctgaggaggtgatccagccctaccaggagttctctgtggaggtgggccgcctggcccaggagaccagcgccatcaacctgctgagccagggcatccctgagattgacaagcccagccaggagttccctgaggagattgacctgcaggcccaggaggtgcctgaggagatcaactag

SEQ ID NO: 19365 - DNA, 1338 bp, Artificial Sequence
  Description of Artificial Sequence: Synthetic coding sequence
atggtgctggagggcaaccctgaggtgggcagccccaggaccagtgacctgcagcaccggggcaacaagggcagctgtgtgctgagcagccctggagaagatgcccagcctggagaggagcccatcaagtacggggagctgattgtgctgggctacaacggctgcctggccagcggggacaagggcagaagaagaagccggctggccctgagccgccgcagccacgccaatggagtgaagccagatgtgatgcaccacatcagcacccccctggtgtccaaggccctgagcaacagaggccagcacagcatctcctacaccctgagccgcagccacagcgtgattgtggagtacacccatgacagcgacacagacatgttccagatcggccgcagcacagagaacatgattgactttgtggtgacagacaccagccctgggggcggcgctgctgagggccccagcgcccagagcaccatcagccgctatgcctgccgcatcctgtgtgacagaagaccaccctacacagcccgcatctatgctgctggctttgatgccagcagcaacatcttcctgggggagcgggccgccaagtggaggaccccagatggcctgatggatggcctgaccaccaacggggtgctggtgatgcaccctgctgggggcttctctgaagattctgcccctggggtgtggagggagatctctgtgtgtggaaatgtgtacaccctgcgggacagccgcagcgcccagcagaggggcaagctggtggagaatgaaagcaatgtgctgcaggacggcagcctgattgacctgtgtggggccaccctgctgtggaggaccccagctggcctgctgcgggcccccaccctgaagcagctggaggcccagaggcaggaggccaatgctgcccggccccagtgccctgtgggcctgagcaccctggccttccccagccctgcccggggccgcacagccccagacaagcagcagccctgggtgtatgtgcgctgtggccacgtgcacggctaccacggctggggctgccggcgggagcggggcccccaggagagagaatgtcccctgtgccgcctggtgggcccctacgtgcccctgtggctgggccaggaggccggcctgtgcctggaccccggcccccccagccacgcctttgccccctgtggccacgtgtgcagcgagaagacagcccgctactgggcccagacccccctgccccacggcacccacgccttccacgccgcctgccccttctgtggggcctggctgaccggggagcacggctgtgtgcggctcatcttccagggccccctggactag

SEQ ID NO: 19366 - DNA, 1950 bp, Artificial Sequence
  Description of Artificial Sequence: Synthetic coding sequence
atgggcacagccctggtgtaccacgaggacatgacagccacccggctgctgtgggatgatcctgaatgtgaaattgaaagacctgagcggctgacagctgccctggaccggctgcggcagaggggcctggagcagcgctgcctgcggctgagcgcccgggaggccagcgaggaggagctgggcctggtgcacagcccagaatatgtgtccctggtgcgggagacccaggtgctgggcaaggaggagctgcaggccctgagcggccagtttgatgccatctacttccaccccagcaccttccactgtgcccggctggccgccggggccggcctgcagctggtggatgctgtgctgactggagctgtgcagaatggcctggccctggtgcggcccccaggccaccacggccagagagctgctgccaacggcttctgtgtgttcaacaacgtggccatcgccgccgcccacgccaagcagaagcacggcctgcaccgcatcctggtggtggactgggatgtgcaccacggccagggcatccagtacctgtttgaagatgaccccagcgtgctgtacttctcctggcacagatatgaacatggccgcttctggcccttcctgcgggagagtgatgctgatgctgtgggccggggccagggcctgggcttcaccgtgaacctgccctggaaccaggtgggcatgggaaatgctgactatgtggccgccttcctgcacctgctgctgcccctggcctttgagggccagatgcaggccaccccagagtgctttgcccacctgacccagctgctgcaggtgctggccggcggccgggtgtgtgctgtgctggagggcggctaccacctggagagcctggccgagagcgtgtgcatgacagtgcagaccctgctgggggaccctgccccacccctgagcggccccatggccccctgccagagcgccctggagagcatccagagcgcccgggccgcccaggccccccactggaagagcctgcagcagcaggatgtgacagctgtgcccatgagccccagcagccacagccctgagggccggcccccacccctgctgcccggcggccctgtgtgcaaggctgctgccagcgcccccagcagcctgctggaccagccctgcctgtgcccagcccccagcgtgaggacagctgtggccctgaccaccccagacatcaccctggtgctgcccccagatgtgatccagcaggaggccagcgccctgcgggaggagacagaggcctgggcccggccccatgagagcctggcccgggaggaggccctgacagccctgggcaagctgctgtacctgctggatggcatgctggatggccaggtgaacagcggcattgctgccaccccagccagcgctgctgctgccaccctggatgtggccgtgcggcggggcctgagccatggagcccagaggctgctgtgtgtggccctgggccagctggaccggcccccagacctggcccatgatggccgcagcctgtggctgaacatccggggcaaggaggccgccgccctgtccatgtttcatgtgtccacccccctgcctgtgatgactggaggcttcctgagctgcatcctgggcctggtgctgcccctggcctacggcttccagcctgacctggtgctggtggccctgggccctggccacggcctgcagggcccccacgccgccctgctggccgccatgctgcggggcctggccggcggccgggtgctggccctgctggaggagaacagcaccccccagctggccggcatcctggcccgggtgctgaatggagaggccccacccagcctgggccccagctctgtggccagcccagaagatgtgcaggccctgatgtacctgcggggccagctggagccccagtggaagatgctgcagtgccacccccacctggtggcctag

SEQ ID NO: 19367 - DNA, 795 bp, Artificial Sequence
  Description of Artificial Sequence: Synthetic coding sequence
atggccggggagcagaagcccagcagcaacctgctggagcagttcatcctgctggccaagggcaccagcggcagcgccctgacagccctgatcagccaggtgctggaggcccctggggtgtatgtgtttggagagctgctggagctggccaacgtgcaggagctggccgagggcgccaatgctgcctacctgcagctgctgaacctgtttgcctacggcacctacccagactacatcgccaacaaggagagcctgcctgagctgagcacagcccagcagaacaagctgaagcacctgaccatcgtgtccctggccagcaggatgaagtgcatcccctacagcgtgctgctgaaggacctggagatgaggaacctgcgggagctggaggacctgatcattgaagctgtgtacacagacatcatccagggcaagctggaccagaggaaccagctgctggaggtggacttctgcatcggccgggacatcaggaagaaggacatcaacaacatcgtgaagaccctgcacgagtggtgtgatggctgtgaggccgtgctgctgggcatcgagcagcaggtgctgcgggccaaccagtacaaggagaaccacaacagaacccagcagcaggtggaggccgaggtgaccaacatcaagaagaccctgaaggccacagccagcagcagcgcccaggagatggagcagcagctggccgagagagaatgtcctcctcatgctgagcagaggcagcccaccaagaagatgagcaaggtgaagggcctggtgagcagccgccactag

SEQ ID NO: 19368 - DNA, 726 bp, Artificial Sequence
  Description of Artificial Sequence: Synthetic coding sequence
atgtctgccagcctgaactacaagagcttcagcaaggagcagcagaccatggacaacctggagaagcagctgatctgccccatctgcctggagatgttcaccaagcctgtggtgatcctgccctgccagcacaacctgtgcaggaaatgtgccagtgacatcttccaggccagcaacccctacctgcccacccggggcggcaccaccatggccagcggcggccgcttccgctgccccagctgcagacatgaggtggtgctggacagacatggagtgtatggcctgcagaggaacctgctggtggagaacatcatcgacatctacaagcaggagagcaccaggcctgagaagaagagtgaccagcccatgtgtgaggagcacgaggaggagcgcatcaacatctactgcctgaactgtgaggtgcccacctgcagcctgtgcaaggtgtttggagcccacaaggactgccaggtggcccccctgacccacgtgttccagaggcagaagtctgagctgagtgatggcatcgccatcctggtgggcagcaatgacagagtgcagggcgtcatcagccagctggaggacacctgcaagaccatcgagatcggctttgaggccccacccctgcagggccaggccgccgccccagccagcggcagcggggctgacagcgagcccgcccggcacatcttctccttctcctggctgaacagcctgaatgaatag

SEQ ID NO: 19369 - DNA, 3501 bp, Artificial Sequence
  Description of Artificial Sequence: Synthetic coding sequence
atggccaatgacagccctgccaagagcctggtggacatcgacctgagcagcctgcgggaccctgctggcatctttgagctggtggaggtggtgggcaatggcacctacggccaggtgtacaagggccgccacgtgaagacaggccagctggccgccatcaaggtgatggatgtgacagaagatgaggaggaggagatcaagctggagatcaacatgctgaagaagtacagccaccacaggaacatcgccacctactacggggccttcatcaagaagagccccccaggccatgatgaccagctgtggctggtgatggagttctgtggggccggcagcatcacagacctggtgaagaacaccaagggcaacaccctgaaggaggactggatcgcctacatcagccgggagatcctgcggggcctggcccacctgcacatccaccacgtgatccaccgggacatcaagggccagaatgtgctgctgacagaaaatgctgaggtgaagctggtggactttggagtgtctgcccagctggacagaacagtgggcagaagaaacaccttcatcggcaccccctactggatggcccctgaggtgattgcctgtgatgagaacccagatgccacctatgactacagaagtgacctgtggagctgtggcatcacagccatcgagatggccgagggcgccccacccctgtgtgacatgcaccccatgagggccctcttcctgatccccagaaatcctccaccccggctgaagagcaagaagtggagcaagaagttcttctccttcatcgagggctgcctggtgaagaactacatgcagaggcccagcacagagcagctgctgaagcaccccttcatccgggaccagcccaatgaaaggcaggtgcgcatccagctgaaggaccacatcgacaggaccaggaagaagagaggagagaaggatgaaacagaatatgagtacagcggcagcgaggaggaggaggaggaggtgcctgagcaggagggggagcccagcagcatcgtgaatgtgcctggagagagcaccctgcggcgggacttcctgcggctgcagcaggagaacaaggagaggtctgaggccctgcggcggcagcagctgctgcaggagcagcagctgcgggagcaggaggagtacaagaggcagctgctggccgagcggcagaagagaattgagcagcagaaggagcagaggcggcggctggaggagcagcagaggcgggagcgggaggcccggcggcagcaggagcgggagcagaggagaagagagcaggaggagaagaggcggctggaggagctggagaggaggaggaaggaggaggaggagcggcggcgggcagaggaggagaagagaagagtggagcgggagcaggagtacatccggcggcagctggaggaggagcagaggcacctggaggtgctgcagcagcagctgctgcaggagcaggccatgctgctgcatgaccaccggcggccccacccccagcacagccagcagcccccaccaccccagcaggagaggagcaagcccagcttccacgcccctgagcccaaggcccactatgagcctgctgaccgggcccgggaggtgcctgtgaggaccaccagccgcagccctgtgctgagcagaagagacagccccctgcagggcagcggccagcagaacagccaggccggccagaggaacagcaccagcagcattgagccccggctgctgtgggagcgggtggagaagctggtgcccaggcctggcagcggcagcagcagcggcagcagcaacagcggcagccagcccggcagccaccctggcagccagagcggcagcggggagcgcttccgggtgcgcagcagcagcaagtctgagggcagccccagccagaggctggagaatgctgtgaagaagccagaggacaagaaggaggtgttccggcccctgaagccagctgtgagaattgacctgacagccctggccaaggagctgcgggctgtggaggatgtgcggcccccccacaaggtgacagactacagcagcagcagcgaggagagcggcaccacagatgaggaggatgatgatgtggagcaggagggcgcagatgagagcaccagcggccctgaggacaccagggctgccagcagcctgaacctgagcaatggagaaacagagagcgtgaagaccatgattgtgcatgatgatgtggagagcgagcccgccatgacccccagcaaggagggcaccctgattgtgcggcagacccagagcgccagcagcaccctgcagaagcacaagagcagcagcagcttcacccccttcatcgacccccggctgctgcagatcagccccagcagcggcaccaccgtgacctctgtggtgggcttcagctgtgatggcatgaggcctgaggccatccggcaggaccccaccaggaaaggatctgtggtgaatgtgaaccccaccaacacccggccccagagcgacaccccagagatcaggaagtacaagaagcgcttcaacagcgagatcctgtgtgccgccctgtggggcgtgaacctgctggtgggcacagagagcggcctgatgctgctggacaggagcggccagggcaaggtgtaccccctcatcaacagaagacgcttccagcagatggatgtgctggagggcctgaatgtgctggtgaccatcagcggcaagaaggacaagctgcgggtgtactacctgtcctggctgaggaacaagatcctgcacaatgaccctgaggtggagaagaagcagggctggaccaccgtgggggacctggagggctgtgtgcactacaaggtggtgaagtatgaaagaatcaagttcctggtgattgccctgaagagctctgtggaggtgtatgcctgggcccccaagccctaccacaagttcatggccttcaagagctttggagagctggtgcacaagcccctgctggtggacctgactgtggaggagggccagaggctgaaggtgatctacggcagctgtgccggcttccacgctgtggatgtggacagcggctctgtgtatgacatctacctgcccacccacgtgaggaagaacccccacagcatgatccagtgcagcatcaagccccacgccatcatcatcctgcccaacacagatggcatggagctgctggtgtgctatgaagatgagggcgtgtatgtgaacacctacggccgcatcaccaaggatgtggtgctgcagtggggcgagatgcccacctctgtggcctacatccgcagcaaccagaccatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgtacttcatgaccctgggccgcaccagcctgctgtcctggtag

SEQ ID NO: 19370 - DNA, 2466 bp, Artificial Sequence
  Description of Artificial Sequence: Synthetic coding sequence
atggtggcccctgtgctggagaccagccacgtgttctgctgccccaacagagtgcggggcgtgctgaactggagcagcggcccccggggcctgctggccttcggcaccagctgcagcgtggtgctgtatgaccccctgaagagggtggtggtgaccaacctgaatggccacacagcccgggtgaactgcatccagtggatctgcaagcaggacggcagccccagcacagagctggtgtctgggggcagtgacaaccaggtgatccactgggagattgaggacaaccagctgctgaaggctgtgcacctgcagggccacgagggccctgtgtatgctgtgcatgctgtgtaccagaggaggaccagtgaccctgccctgtgcaccctcatcgtgtctgctgctgctgacagcgctgtgcggctgtggagcaagaagggccctgaggtgacctggaagacaggccaggtggagcggggccgggcctggaagcccccagccagcctggccctgtgcagccgcagctgtgacagcatggtgtcctgctacgccagcatcctgtgcaaggccctgtggaaggagaagctgcacaccttctggcaccacaaccgcatctccttcctgcccagcgccttccggcccatccccatcctggcctgtggaaatgatgactgccgcatccacatctttgcccagcagaatgaccagttccagaaggtgctgagcctgtgtggccacgaggactggatccggggcgtggagtgggccgccttcggccgggacctcttcctggccagctgcagccaggactgcctgatccgcatctggaagctgtacatcaagagcaccagcctggagacccaggatgatgacaacatccggctgaaggagaacaccttcaccattgaaaatgaatctgtgaagatcgcctttgctgtgaccctggagaccgtgctggccggccacgagaactgggtgaatgctgtgcactggcagcccgtcttctacaaggatggagtgctgcagcagcctgtgcggctgctgagcgcctccatggacaagaccatgatcctgtgggccccagatgaggagagcggcgtgtggctggagcagcgggagtggaccccagaaattgtcatcagcggccactttgatggagtgcaggacctggtgtgggaccctgagggggagttcatcatcaccgtgggcacagaccagaccacccggctgtttgccccctggaagaggaaggaccagagccaggtgacctggcatgagatcgcccggccccagatccacggctatgacctgaagtgcctggccatgatcaaccgcttccagtttgtgtctggagcagatgagaaggtgctgcgggtcttcagcgcccccaggaactttgtggagaacttctgtgccatcaccggccagagcctgaaccacgtgctgtgcaaccaggacagcgacctgcctgagggcgccaccgtgcctgccctgggcctgagcaacaaggctgtgttccagggcgacatcgccagccagcccagtgatgaggaggagctgctgaccagcactggatttgagtaccagcaggtggccttccagcccagcatcctgacagagcccccaacagaggaccacctgctgcagaacaccctgtggccagaggtgcagaagctgtatggccacggctatgagatcttctgtgtgacctgcaacagcagcaagaccctgctggccagcgcctgcaaggccgccaagaaggagcacgccgccatcatcctgtggaacaccacctcctggaagcaggtgcagaacctggtgttccacagcctgactgtgacccagatggccttcagccccaatgagaagttcctgctggccgtgtcccgggacaggacctggagcctgtggaagaagcaggacaccatcagccctgagtttgagcccgtcttcagcctgtttgccttcaccaacaagatcacctctgtgcacagccgcatcatctggagctgtgactggagcccagacagcaagtacttcttcaccggcagccgggacaagaaggtggtggtgtggggagaatgtgacagcacagatgactgcatcgagcacaacatcggcccctgcagctctgtgctggatgtgggcggcgctgtgacagctgtgtctgtgtgccctgtgctgcaccccagccagagatatgtggtggccgtgggcctggagtgtgggaagatctgcctgtacacctggaagaagacagaccaggtgcctgagatcaatgactggacccactgtgtggagaccagccagagccagagccacaccctggccatcaggaagctgtgctggaagaactgcagcggcaagacagagcagaaggaggccgagggcgctgagtggctgcactttgccagctgtggggaggaccacacagtgaagatccaccgggtgaacaagtgtgccctgtag

SEQ ID NO: 19371 - DNA, 969 bp, Artificial Sequence
  Description of Artificial Sequence: Synthetic coding sequence
atggtgtctgtcatcaacacagtggacaccagccatgaggacatgattcatgatgcccagatggactactacggcacccggctggccacctgcagcagtgacagatctgtgaagatctttgatgtgagaaatggaggccagatcctgattgctgacctgcggggccacgagggccctgtgtggcaggtggcctgggcccaccccatgtatggcaacatcctggccagctgcagctatgacaggaaggtgatcatctggagagaagaaaatggcacctgggagaagagccatgaacatgctggccatgacagctctgtgaacagcgtgtgctgggcccctcatgactatggcctcatcctggcctgtggcagcagtgatggagccatcagcctgctgacctacacaggagagggccagtgggaggtgaagaagatcaacaatgcccacaccatcggctgcaatgctgtgtcctgggccccagctgtggtgcccggcagcctgattgaccaccccagcggccagaagcccaactacatcaagagatttgccagcggcggctgtgacaacctgatcaagctgtggaaggaggaggaggatggccagtggaaggaggagcagaagctggaggcccacagcgactgggtgagagatgtggcctgggcccccagcatcggcctgcccaccagcaccatcgccagctgcagccaggacggccgggtcttcatctggacctgtgatgatgccagcagcaacacctggagccccaagctgctgcacaagttcaatgatgtggtgtggcacgtgtcctggagcatcacagccaacatcctggccgtgtctggaggagacaacaaggtgaccctgtggaaggagagcgtggatggccagtgggtgtgcatcagtgatgtgaacaagggccagggctctgtgtctgcctctgtgacagagggccagcagaatgagcagtag

SEQ ID NO: 19372 - DNA, 1347 bp, Artificial Sequence
  Description of Artificial Sequence: Synthetic coding sequence
atgagcagcaggaagctgagcggccccaagggccggcggctgagcatccacgtggtgacctggaatgtggccagcgctgccccacccctggacctgagtgacctgctgcagctgaacaacagaaacctgaacctggacatctacgtgattggcctgcaggagctgaacagcggcatcatcagcctgctgagtgatgctgccttcaatgacagctggagcagcttcctgatggatgtgctgagccccctgtccttcatcaaggtgagccacgtgaggatgcagggcatcctgctgctggtgtttgccaagtaccagcacctgccctacatccagatcctgagcaccaagagcacccccaccggcctgtttggctactggggcaacaagggcggcgtgaacatctgcctgaagctgtatggctactacgtgtccatcatcaactgccacctgcccccccacatcagcaacaactaccagaggctggagcactttgaccgcatcctggagatgcagaactgtgagggccgggacatccccaacatcctggaccatgacctgatcatctggtttggagacatgaacttcagaattgaggactttggcctgcactttgtgcgggagagcatcaagaaccgctgctacggcggcctgtgggagaaggaccagctgagcatcgccaagaagcatgaccccctgctgcgggagttccaggagggccgcctgctcttcccccccacctacaagtttgacaggaacagcaatgactatgacaccagcgagaagaagaggaagccagcctggacagaccgcatcctgtggaggctgaagaggcagccctgtgccggccctgacacccccatccccccagccagccacttcagcctgagcctgcggggctacagcagccacatgacctacggcatcagtgaccacaagcctgtgtctggcacctttgacctggagctgaagcccctggtgtctgcccccctgattgtgctgatgcctgaggacctgtggacagtggagaatgacatgatggtgtcctacagcagcaccagtgacttccccagcagcccctgggactggattggcctgtacaaggtgggcctgagagatgtgaatgactatgtgtcctatgcctgggtgggggacagcaaggtgtcctgcagcgacaacctgaaccaggtgtacatcgacatcagcaacatccccaccacagaagatgagttcctgctgtgctactacagcaacagcctgcggtctgtggtgggcatcagccggcccttccagatccccccaggcagcctgcgggaggaccccctgggggaggcccagccccagatctag

SEQ ID NO: 19373 - DNA, 1641 bp, Artificial Sequence; identical to SEQ ID NO: 19311
  Description of Artificial Sequence: Synthetic coding sequence

SEQ ID NO: 19374 - DNA, 3840 bp, Artificial Sequence
  Description of Artificial Sequence: Synthetic coding sequence
atgctgcaggccctgcagctgaggacaggcttcttctgcttccgggtgctggtggccctgagcccctgtgccctgcatgacagcggccgcctgaccaccggcagcttcaacgtggtgagagatgaggaggaggagatcaagctggagatcaacatgctgaagaagtacagccaccacaggaacatcgccacctactacggggccttcatcaagaagagccccccaggccatgatgaccagctgtggctggtgatggagttctgtggggccggcagcatcacagacctggtgaagaacaccaagggcaacaccctgaaggaggactggatcgcctacatcagccgggagatcctgcggggcctggcccacctgcacatccaccacgtgatccaccgggacatcaagggccagaatgtgctgctgacagaaaatgctgaggtgaagctggtggactttggagtgtctgcccagctggacagaacagtgggcagaagaaacaccttcatcggcaccccctactggatggcccctgaggtgattgcctgtgatgagaacccagatgccacctatgactacagaagtgacctgtggagctgtggcatcacagccatcgagatggccgagggcgccccacccctgtgtgacatgcaccccatgagggccctcttcctgatccccagaaatcctccaccccggctgaagagcaagaagtggagcaagaagttcttctccttcatcgagggctgcctggtgaagaactacatgcagaggcccagcacagagcagctgctgaagcaccccttcatccgggaccagcccaatgaaaggcaggtgcgcatccagctgaaggaccacatcgacaggaccaggaagaagagaggagagaaggatgaaacagaatatgagtacagcggcagcgaggaggaggaggaggaggtgcctgagcaggagggggagcccagcagcatcgtgaatgtgcctggagagagcaccctgcggcgggacttcctgcggctgcagcaggagaacaaggagaggtctgaggccctgcggcggcagcagctgctgcaggagcagcagctgcgggagcaggaggagtacaagaggcagctgctggccgagcggcagaagagaattgagcagcagaaggagcagaggcggcggctggaggagcagcagaggcgggagcgggaggcccggcggcagcaggagcgggagcagaggagaagagagcaggaggagaagaggcggctggaggagctggagaggaggaggaaggaggaggaggagcggcggcgggcagaggaggagaagagaagagtggagcgggagcaggagtacatccggcggcagctggaggaggagcagaggcacctggaggtgctgcagcagcagctgctgcaggagcaggccatgctgctgcatgaccaccggcggccccacccccagcacagccagcagcccccaccaccccagcaggagaggagcaagcccagcttccacgcccctgagcccaaggcccactatgagcctgctgaccgggcccgggaggtgcagtggagccacctggccagcctgaagaacaacgtgtcccctgtgagccgcagccacagcttcagtgaccccagccccaagtttgcccaccaccacctgcggagccaggacccctgcccccccagccgctctgaggtgctgagccagagcagtgacagcaagtctgaggccccagaccccacccagaaggcctggagcagaagtgacagtgatgaggtgcccccccgggtgcctgtgaggaccaccagccgcagccctgtgctgagccggcgggacagccccctgcagggcagcggccagcagaacagccaggccggccagaggaacagcaccagcagcattgagccccggctgctgtgggagcgggtggagaagctggtgccccggcccggcagcggcagcagcagcggcagcagcaacagcggcagccagcccggcagccaccctggcagccagagcggcagcggggagcgcttccgggtgcgcagcagcagcaagtctgagggcagccccagccagaggctggagaatgctgtgaagaagccagaggacaagaaggaggtgttccggcccctgaagccagctgtgagaattgacctgacagccctggccaaggagctgcgggctgtggaggatgtgcggcccccccacaaggtgacagactacagcagcagcagcgaggagagcggcaccacagatgaagaagatgatgatgtggagcaggagggcgcagatgagagcaccagcggccctgaggacacccgggccgccagcagcctgaacctgagcaatggagaaacagaatctgtgaagaccatgattgtgcatgatgatgtggagagcgagcccgccatgacccccagcaaggagggcaccctcatcgtgcggcagagcacagtggaccagaagagggccagccaccacgagagcaatggatttgctggccgcatccacctgctgcctgacctgctgcagcagagccacagcagcagcaccagcagcaccagcagcagccccagcagcagccagcccacccccaccatgagcccccagaccccccaggacaagctgacagccaatgagacccagagcgccagcagcaccctgcagaagcacaagagcagcagcagcttcacccccttcatcgacccccggctgctgcagatcagccccagcagcggcaccaccgtgacctctgtggtgggcttcagctgtgatggcatgaggcctgaggccatccggcaggaccccaccaggaagggctctgtggtgaatgtgaaccccaccaacacccggccccagagcgacaccccagagatcaggaagtacaagaagcgcttcaacagcgagatcctgtgtgccgccctgtggggcgtgaacctgctggtgggcacagaaagtggcctgatgctgctggacagaagtggccagggcaaggtgtaccccctcatcaacagaagacgcttccagcagatggatgtgctggagggcctgaatgtgctggtgaccatcagcggcaagaaggacaagctgcgggtgtactacctgtcctggctgaggaacaagatcctgcacaatgaccctgaggtggagaagaagcagggctggaccaccgtgggggacctggagggctgtgtgcactacaaggtggtgaagtatgagcgcatcaagttcctggtgattgccctgaagagctctgtggaggtgtatgcctgggcccccaagccctaccacaagttcatggccttcaagagctttggagagctggtgcacaagcccctgctggtggacctgactgtggaggagggccagaggctgaaggtgatctacggcagctgtgccggcttccacgctgtggatgtggacagcggctctgtgtatgacatctacctgcccacccacatccagtgcagcatcaagccccacgccatcatcatcctgcccaacacagatggcatggagctgctggtgtgctatgaagatgaaggagtgtatgtgaacacctacggccgcatcaccaaggatgtggtgctgcagtggggcgagatgcccacctctgtggcctacatccgcagcaaccagaccatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgtacttcatgaccctgggccgcaccagcctgctgtcctggtag

SEQ ID NO: 19375 - DNA, 1989 bp, Artificial Sequence
  Description of Artificial Sequence: Synthetic coding sequence
atggccagctgcccagacagcgacaacagctgggtgctggccggcagcgagagcctgcctgtggagaccctgggccctgccagcaggatggaccctgagagcgagcgggccctgcaggccccccacagccccagcaagacagatggcaaggagctggccggcaccatggatggagagggcaccctcttccagacagagagcccccagagcggcagcatcctgacagaggagacagaggtgaagggcaccctggagggagatgtgtgtggggtggagcccccaggccctggggacacagtggtgcagggcgacctgcaggagaccaccgtggtgacaggcctgggccctgacacccaggacctggagggccagagccccccccagagcctgcccagcacccccaaggccgcctggatccgggaggagggccgctgcagcagcagtgatgatgacacagatgtggacatggagggcctgcggcggcggcggggccgggaggccggccccccccagcccatggtgcccctggccgtggagaaccaggccggcggggagggcgccggcggggagctgggcatcagcctgaacatgtgcctgctgggcgccctggtgctgctgggcctgggcgtgctgctcttcagcggcggcctgtctgagagcgagaccggccccatggaggaggtggagcggcaggtgctgcctgaccctgaggtgctggaggccgtgggggaccggcaggacggcctgcgggagcagctgcaggcccctgtgcccccagattctgtgcccagcctgcagaacatgggcctgctgctggacaagctggccaaggagaaccaggacatccggctgctgcaggcccagctgcaggcccagaaggaggagctgcagagcctgatgcaccagcccaagggcctggaggaggagaatgcccagctgcggggggccctgcagcagggcgaggccttccagagggccctggagagcgagctgcagcagctgcgggcccggctgcagggcctggaggccgactgtgtgcggggcccagatggagtgtgcctgagcggcggccggggcccccagggcgacaaggccatccgggagcagggcccccgggagcaggagcctgagctgtccttcctgaagcagaaggagcagctggaggccgaggcccaggccctgcggcaggagctggagcggcagaggcggctgctgggctctgtgcagcaggacctggagaggagcctgcaggatgccagcagaggagaccctgcccatgctggcctggccgagctgggccaccggctggcccagaagctgcagggcctggagaactggggccaggaccccggggtgtctgccaatgccagcaaggcctggcaccagaagagccacttccagaacagccgggagtggagcggcaaggagaagtggtgggatggccagagggacaggaaggccgagcactggaagcacaagaaggaggagagcggccgggagaggaagaagaactggggcggccaggaggaccgggagcccgccggccgctggaaggagggccggccccgggtggaggagagcggcagcaagaaggagggcaagaggcagggccccaaggagccccccaggaagagcggcagcttccacagcagtggagagaagcagaagcagccccgctggagggagggcaccaaggagctgcccctgagccctgccttcttcggggaggatggcatcttcagacatgaccggctgcgcttccgggactttgtggatgccctggaggacagcctggaggaggtggccgtgcagcagacaggagatgatgatgaggtggatgactttgaggacttcatcttcagccacttcttcggggacaaggccctgaagaagaggtctgggaagaaggacaagcacagccagagccccagggctgctggcccccgggagggccacagccacagccaccaccaccaccaccggggctag

SEQ ID NO: 19376 - DNA, 2403 bp, Artificial Sequence
  Description of Artificial Sequence: Synthetic coding sequence
atggtggcccctgtgctggagaccagccacgtgttctgctgccccaacagagtgcggggcgtgctgaactggagcagcggcccccggggcctgctggccttcggcaccagctgcagcgtggtgctgtatgaccccctgaagagggtggtggtgaccaacctgaatggccacacagcccgggtgaactgcatccagtggatctgcaagcaggacggcagccccagcacagagctggtgtctgggggcagtgacaaccaggtgatccactgggagattgaggacaaccagctgctgaaggctgtgcacctgcagggccacgagggccctgtgtatgctgtgcatgctgtgtaccagaggaggaccagtgaccctgccctgtgcaccctcatcgtgtctgctgctgctgacagcgctgtgcggctgtggagcaagaagggccctgaggtgcccatcctggcctgtggaaatgatgactgccgcatccacatctttgcccagcagaatgaccagttccagaaggtgctgagcctgtgtggccacgaggactggatccggggcgtggagtgggccgccttcggccgggacctcttcctggccagctgcagccaggactgcctgatccgcatctggaagctgtacatcaagagcaccagcctggagacccaggatgatgacaacatccggctgaaggagaacaccttcaccattgaaaatgaatctgtgaagatcgcctttgctgtgaccctggagaccgtgctggccggccacgagaactgggtgaatgctgtgcactggcagcctgtgttctacaaggatggagtgctgcagcagcctgtgcggctgctgagcgcctccatggacaagaccatgatcctgtgggccccagatgaggagagcggcgtgtggctggagcaggtgcgggtgggggaggtgggcggcaacaccctgggcttctatgactgccagttcaatgaagatggctccatgatcatcgcccacgccttccacggggccctgcacctgtggaagcagaacacagtgaacccccgggagtggaccccagagatcgtcatcagcggccactttgatggagtgcaggacctggtgtgggaccctgagggggagttcatcatcaccgtgggcacagaccagaccacccggctgtttgccccctggaagaggaaggaccagagccaggtgacctggcatgaaattgcccggccccagatccacggctatgacctgaagtgcctggccatgatcaaccgcttccagtttgtgtctggagcagatgagaaggtgctgcgggtcttcagcgcccccaggaactttgtggagaacttctgtgccatcaccggccagagcctgaaccacgtgctgtgcaaccaggacagcgacctgcctgagggcgccaccgtgcctgccctgggcctgagcaacaaggctgtgttccagggcgacatcgccagccagcccagtgatgaggaggagctgctgaccagcacaggctttgagtaccagcaggtggccttccagcccagcatcctgacagagcccccaacagaggaccacctgctgcagaacaccctgtggccagaggtgcagaagctgtatggccacggctatgagatcttctgtgtgacctgcaacagcagcaagaccctgctggccagcgcctgcaaggccgccaagaaggagcacgccgccatcatcctgtggaacaccacctcctggaagcaggtgcagaacctggtgttccacagcctgactgtgacccagatggccttcagccccaatgagaagttcctgctggccgtgtcccgggacaggacctggagcctgtggaagaagcaggacaccatcagccctgagtttgagcctgtgttcagcctgtttgccttcaccaacaagatcacctctgtgcacagccgcatcatctggagctgtgactggagcccagacagcaagtacttcttcaccggcagccgggacaagaaggtggtggtgtggggagaatgtgacagcacagatgactgcatcgagcacaacatcggcccctgcagctctgtgctggatgtgggcggcgctgtgacagctgtgtctgtgtgccctgtgctgcaccccagccagcgctacgtggtggccgtgggcctggagtgtgggaagatctgcctgtacacctggaagaagacagaccaggtgcctgagatcaatgactggacccactgtgtggagaccagccagagccagagccacaccctggccatcaggaagctgtgctggaagaactgcagcggcaagacagagcagaaggaggccgagggcgctgagtggctgcactttgccagctgtggggaggaccacacagtgaagatccaccgggtgaacaagtgtgccctgtag

SEQ ID NO: 19377 - DNA, 561 bp, Artificial Sequence
  Description of Artificial Sequence: Synthetic coding sequence
atggccggggagaactttgccacccccttccacggccacgtgggccgcggggccttcagtgatgtgtatgagcctgctgaggacaccttcctgctgctgaatgccctggaggccgctgctgctgagctggccggcgtggagatctgcctggaggtgggcagcggcagcggcgtggtgtctgccttcctggcctccatgattggcccccaggccctgtacatgtgcacagacatcaaccctgaggccgccgcctgcaccctggagacagcccgctgcaacaaggtgcacatccagcctgtgatcacagacctggtgggcagccacggcatcgaggccgcctgggccggcggcaagaatggccgggaggtgatggaccgcttcttccccctggtgcctgacctgctgagccccaagggcctcttctacctggtgaccatcaaggagaacaaccctgaggagatcctgaagatcatgaagaccaagggcctgcagggcaccacagccctgagccggcaggccggccaggagaccctgtctgtgctgaagttcaccaagagctag

SEQ ID NO: 19378 - DNA, 2352 bp, Artificial Sequence
  Description of Artificial Sequence: Synthetic coding sequence
atggccaagtacaacacaggaggcaaccccacagaagatgtgtctgtgaacagccggcccttccgggtgacaggccccaacagcagcagcggcatccaggccaggaagaacctcttcaacaaccagggcaatgccagccccccagctggccccagcaatgtgcccaagtttggcagccccaagccccctgtggccgtgaagcccagcagcgaggagaagccagacaaggagcccaagccacccttcctgaagcccaccggggccggccagcgcttcggcaccccagccagcctgaccacccgggaccctgaggccaaggtgggcttcctgaagcctgtgggccccaagcccatcaacctgcccaaggaggacagcaagcccaccttcccctggcccccaggcaacaagcccagcctgcacagcgtgaaccaggaccatgacctgaagcccctgggccccaagagcggccccaccccacccaccagtgaaaatgagcagaagcaggccttccccaagctgactggagtgaagggcaagttcatgtctgccagccaggacctggagcccaagcccctcttccccaagccagccttcggccagaagccacccctgagcacagagaacagccatgaagatgagagccccatgaagaatgtgagcagcagcaagggcagccctgcccccctgggcgtgcgcagcaagagcggccccctgaagccagccagagaagattctgagaacaaggaccatgctggggagatcagcagcctgcccttccctggggtggtgctgaagccagctgccagcagaggaggccctggcctgagcaagaatggagaggagaagaaggaggacaggaagattgatgctgccaagaacaccttccagagcaagatcaaccaggaggagctggccagcggcaccccaccagcccgcttccccaaggcccccagcaagctgactgtgggcggcccctggggccagagccaggagaaggagaagggggacaagaacagcgccacccccaagcagaagcccctgcccccactcttcaccctgggccccccaccacccaagcccaacagacctccaaatgtggacctgaccaagttccacaagaccagcagcggcaacagcaccagcaagggccagaccagctacagcaccaccagcctgcccccacctccacccagccacccagccagccagccccccctgcctgccagccaccccagccagccccctgtgcccagcctgccccccaggaacatcaagcccccatttgacctgaagagccctgtgaatgaagacaaccaggatggagtgacccacagtgatggagctggcaacctggatgaggagcaggacagcgagggggagacctatgaagatattgaggccagcaaggagcgggagaagaagcgggagaaggaggagaagaagaggctggagctggagaagaaggagcagaaggagaaggagaagaaggagcaggagatcaagaagaagttcaagctgaccggccccatccaggtgatccacctggccaaggcctgctgtgatgtgaagggcggcaagaatgagctgtccttcaagcagggcgagcagatcgagatcatccgcatcacagacaaccctgagggcaagtggctgggccgcacagcccggggcagctatggctacatcaagaccacagctgtggagattgattatgacagcctgaagctgaagaaggacagcctgggcgcccccagccggcccattgaagatgaccaggaggtgtatgatgatgtggccgagcaggatgacatcagcagccacagccagagcggcagcggcggcatcttccccccacctccagatgatgacatctatgatggcatcgaggaggaggatgctgatgatggcttccctgccccacccaagcagctggacatgggagatgaggtgtatgatgatgtggacaccagtgacttccctgtgtcctctgctgagatgagccagggcaccaacgtgggcaaggccaagacagaggagaaggacctgaagaagctgaagaagcaggagaaggaggagaaggacttcaggaagaagttcaagtatgatggagagatccgggtgctgtacagcaccaaggtgaccaccagcatcaccagcaagaagtggggcacccgggacctgcaggtgaagccaggagagagcctggaggtgatccagaccacagatgacaccaaggtgctgtgcagaaatgaggagggcaagtatggctacgtgctgcggagctacctggccgacaatgatggagagatctatgatgacattgctgatggctgcatctatgacaatgactag

SEQ ID NO: 19379 - DNA, 1722 bp, Artificial Sequence
  Description of Artificial Sequence: Synthetic coding sequence
atgatccccccccaggaggccagcgccaggagaagagaaattgaggacaagctgaagcaggaggaggagaccctgtccttcatccgggacagcctggagaagagtgaccagctgaccaagaacatggtgtccatcctgagcagctttgagagccggctgatgaagctggagaacagcatcatccctgtgcacaagcagacagagaacctgcagaggctgcaggagaatgtggagaagaccctgagctgcctggaccacgtgatctcctactaccacgtgatctctggagatgatgacctggaggcccaggaggatgtgaccctggagcacctgcctgagagcgtgctgcaggacgtcatccgcatcagccgctggctggtggagtatggaagaaaccaggacttcatgaatgtgtactaccagatccgcagcagccagctggacaggagcatcaagggcctgaaggagcacttccacaagagcagcagcagcagtggagtgccctacagccctgccatccccaacaagaggaaggacacccccaccaagaagcctgtgaagaggcctggaagagatgacatgctggatgtggagacagatgcctacatccactgtgtgtctgcctttgtgaagctggcccagagcgagtaccagctgctggccgacatcatccctgagcaccaccagaagaagacctttgacagcctcatccaggatgccctggatggcctgatgctggagggagaaaatattgtgtctgctgccaggaaggccatcgtgagacatgacttcagcacagtgctgactgtgttccccatcctgcggcacctgaagcagaccaagccagagtttgaccaggtgctgcagggcacagctgccagcaccaagaacaagctgcccggcctcatcacctccatggagaccatcggggccaaggccctggaggactttgctgacaacatcaagaatgaccctgacaaggagtacaacatgcccaaggatggcaccgtgcatgagctgaccagcaatgccatcctcttcctgcagcagctgctggacttccaggagacagctggggccatgctggccagccaggagaccagcagcagcgccaccagctacagcagcgagttcagcaagaggctgctgagcacctacatctgcaaggtgctgggcaacctgcagctgaacctgctgagcaagagcaaggtgtatgaggaccctgccctgagcgccatcttcctgcacaacaactacaactacatcctgaagagcctggagaagtctgagctgatccagctggtggccgtgacccagaagacagctgagaggagctaccgggagcacatcgagcagcagatccagacctaccagaggtcctggctgaaggtgacagactacatcgccgagaagaacctgcccgtcttccagcccggggtgaagctgcgggacaaggagcggcagatcatcaaggagcgcttcaagggcttcaatgatggcctggaggagctgtgcaagatccagaaggcctgggccatcccagacacagagcagagggaccgcatccggcaggcccagaagaccatcgtgaaggagacctacggggccttcctgcagaagtttggatctgtgcccttcaccaagaaccctgagaagtacatcaagtatggagtggagcaggtgggggacatgattgaccggctgtttgacaccagcgcctag

SEQ ID NO: 19380 - DNA, 2475 bp, Artificial Sequence
  Description of Artificial Sequence: Synthetic coding sequence
atgatgcagaatgtgcacctggcccctgagacagatgaagatgacctgtacagcggctacaatgactacaaccccatctatgacatcgaggagctggagaatgatgctgccttccagcaggccgtgaggaccagccacggccggcggccccccatcacagccaagatcagcagcacagctgtgacccggcccatcgccaccggctacggcagcaagaccagcctggccagcagcatcggccggcccatgaccggggccatccaggatggagtgacccggcccatgacagctgtgcgggctgctggcttcaccaaggccgccctgcggggcagcgcctttgaccccctgagccagagccggggccctgccagccccctggaggccaagaagaaggacagccctgaggagaagatcaagcagctggagaaggaggtgaatgagctggtggaggagagctgcatcgccaacagctgtggggacctgaagctggccctggagaaggccaaggatgctggcaggaaggagcgggtgctggtgcggcagcgggagcaggtgaccaccccagagaacatcaacctggacctgacctacagcgtgctcttcaacctggccagccagtacagcgtgaatgagatgtatgcagaggccctgaacacctaccaggtgattgtgaagaacaagatgttcagcaatgccggcatcctgaagatgaacatgggcaacatctacctgaagcagaggaactacagcaaggccatcaagttctacaggatggccctggaccaggtgcccagcgtgaacaagcagatgaggatcaagatcatgcagaacatcggcgtgaccttcatccaggccggccagtacagtgatgccatcaacagctatgagcacatcatgtccatggcccccaacctgaaggccggctacaacctgaccatctgctactttgccatcggggaccgggagaagatgaagaaggccttccagaagctgatcaccgtgcccctggagattgatgaggacaagtacatcagccccagtgatgacccccacaccaacctggtgacagaggccatcaagaatgaccacctgcggcagatggagcgggagaggaaggccatggccgagaagtacatcatgaccagcgccaagctgattgcccctgtgattgagaccagctttgctgctggctatgactggtgtgtggaggtggtgaaggccagccagtatgtggagctggccaatgacctggagatcaacaaggctgtgacctacctgcggcagaaggactacaaccaggccgtggagatcctgaaggtgctggagaagaaggacagccgggtgaagtctgctgctgccaccaacctgagcgccctgtactacatgggcaaggactttgcccaggccagcagctatgctgacattgctgtgaacagcgaccgctacaacccagctgccctgaccaacaagggcaacacagtgtttgccaatggagactatgagaaggctgctgagttctacaaggaggccctgagaaatgacagcagctgcacagaggccctgtacaacatcggcctgacctatgagaagctgaaccggctggatgaggccctggactgcttcctgaagctgcacgccatcctgagaaattctgctgaggtgctgtaccagatcgccaacatctatgagctgatggagaaccccagccaggccatcgagtggctgatgcaggtggtgtctgtcatccccacagacccccaggtgctgagcaagctgggggagctgtatgaccgggagggggacaagagccaggccttccagtactactatgagagctaccgctacttcccctgcaacatcgaggtgattgagtggctgggcgcctactacatcgacacccagttctgggagaaggccatccagtactttgagcgggccagcctcatccagcccacccaggtgaagtggcagctgatggtggccagctgcttcagaagaagtggcaactaccagaaggccctggacacctacaaggacacccacaggaagtttcctgaaaatgtggagtgcctgcgcttcctggtgcggctgtgcacagacctgggcctgaaggatgcccaggagtatgccaggaagctgaagaggctggagaagatgaaggagatccgggagcagaggatcaagagcggcagagatggcagcggcggcagccggggcaagcgggagggcagcgccagcggggacagcggccagaactacagcgccagcagcaagggggagcggctgagcgcccggctgcgggccctgcccggcaccaatgagccctatgagagcagcagcaacaaggagattgatgccagctatgtggaccccctgggcccccagatcgagcggcccaagacagctgccaagaagagaattgatgaagatgactttgctgatgaggagctgggagatgacctgctgcctgagtag

SEQ ID NO: 19381 - DNA, 2850 bp, Artificial Sequence
  Description of Artificial Sequence: Synthetic coding sequence
atgctgaggacagctggaagagatggcctgtgccgcctgagcacctacctggaggagctggaggccgtggagctgaagaagttcaagctgtacctgggcacagccacagagctgggggagggcaagatcccctggggctccatggagaaggccggccccctggagatggcccagctgctgatcacccacttcggccctgaggaggcctggaggctggccctgagcacctttgagcgcatcaacaggaaggacctgtgggagcggggccagcgggaggacctggtgcgggacaccccacctgggggccccagcagcctgggcaaccagagcacctgcctgctggaggtgtccctggtgacccccaggaaggacccccaggagacctacagagattatgtgcggaggaagttccggctgatggaggacagaaatgcccggctgggagaatgtgtgaacctgagccaccgctacacccggctgctgctggtgaaggagcacagcaaccccatgcaggtgcagcagcagctgctggacaccggccggggccacgccaggacagtgggccaccaggccagccccatcaagattgagaccctgtttgagccagatgaggagaggcctgagccccccaggacagtggtgatgcagggcgctgctggcatcggcaagtccatgctggcccacaaggtgatgctggactgggcagatggcaagctgttccagggccgctttgactacctgttctacatcaactgccgggagatgaaccagagcgccacagaatgttccatgcaggacctgatcttcagctgctggccagagcccagcgcccccctgcaggagctgatccgggtgcctgagcggctgctcttcatcattgatggctttgatgagctgaagcccagcttccatgacccccagggcccctggtgcctgtgctgggaggagaagaggcccacagagctgctgctgaacagcctcatcaggaagaagctgctgcctgagctgagcctgctgatcaccacccggcccacagccctggagaagctgcaccggctgctggagcaccccaggcatgtggagatcctgggcttcagcgaggccgagaggaaggagtacttctacaagtacttccacaatgctgagcaggccggccaggtgttcaactacgtgcgggacaatgagcccctcttcaccatgtgctttgtgcccctggtgtgctgggtggtgtgcacctgcctgcagcagcagctggagggcggcggcctgctgcggcagaccagcaggaccaccacagctgtgtacatgctgtacctgctgagcctgatgcagcccaagccaggggccccccggctgcagcccccacccaaccagaggggcctgtgcagcctggccgcagatggcctgtggaaccagaagatcctgtttgaggagcaggacctgaggaagcacggcctggatggagaagatgtgtctgccttcctgaacatgaacatcttccagaaggacatcaactgtgagcgctactacagcttcatccacctgtccttccaggagttctttgctgccatgtactacatcctggatgaaggagagggcggggccggccctgaccaggatgtgacccggctgctgacagaatatgccttcagcgagaggagcttcctggccctgaccagccgcttcctgtttggcctgctgaatgaggagaccaggagccacctggagaagagcctgtgctggaaggtgagcccccacatcaagatggacctgctgcagtggatccagagcaaggcccagagtgatggcagcaccctgcagcagggcagcctggagttcttcagctgcctgtatgagatccaggaggaggagttcatccagcaggccctgagccacttccaggtgattgtggtgagcaacatcgccagcaagatggagcacatggtgtcctccttctgcctgaagcgctgccgcagcgcccaggtgctgcacctgtatggagccacctacagcgcagatggagaagatcgggcccgctgcagcgctggggcccacaccctgctggtgcagctgcctgagaggacagtgctgctggatgcctacagcgagcacctggccgccgccctgtgcaccaaccccaacctgattgagctgagcctgtacagaaatgccctgggcagcagaggagtgaagctgctgtgccagggcctgcggcaccccaactgcaagctgcagaacctgcggctgaagcgctgccgcatcagcagcagcgcctgtgaggacctgtctgctgccctgattgccaacaagaacctgaccaggatggacctgtctggaaatggagtgggcttccctggcatgatgctgctgtgtgagggcctgcggcacccccagtgccgcctgcagatgatccagctgaggaagtgccagctggagagcggggcctgccaggagatggcctctgtgctgggcaccaacccccacctggtggagctggacctgactggaaatgccctggaggacctgggcctgcggctgctgtgccagggcctgcggcaccctgtgtgccgcctgcggaccctgtggctgcagctggacagctgtggcctgacagccaaggcctgtgagaacctgtacttcaccctgggcatcaaccagaccctgacagacctgtacctgaccaacaatgccctgggggacacaggagtgcggctgctgtgcaagaggctgagccaccctggctgcaagctgcgggtgctgtggctgtttggcatggacctgaacaagatgacccacagccggctggccgccctgcgggtgaccaagccctacctggacatcggctgctag

SEQ ID NO: 19382 - DNA, 5796 bp, Artificial Sequence
  Description of Artificial Sequence: Synthetic coding sequence
atggccgcccggagcgcccccagctgccacctgcggctggagtgggtgtatggctaccggggccaccagtgcaggaacaacctgtactacacagctgccaaggagatcgtgtactttgtggccggcgtgggcgtggtgtacagcccccgggagcaccggcagaagttctaccggggccacagtgatgacatcatcagcctggccctgcaccctgagcgggtgctggtggccaccggccaggtgggcaaggagccctacatctgcatctgggacagctacacagtgcagaccatctctgtgctgaaggatgtgcacacccatggaattgcctgcctggcctttgacctggatggccagaggctggtgtctgtgggcctggacagcaagaatgctgtgtgtgtgtgggactggaagaggggcaagatgctgtccatggcccctggccacacagaccgcatctttgacatctcctgggacctgtaccagcccaacaagctggtgtcctgtggggtgaagcacatcaagttctggagcctgtgtggaaatgccctgacccccaagaggggcgtgtttgggaagacaggagacctgcagaccatcctgtgcctggcctgtgccagagatgagctgacctacagcggggccctgaatggagacatctacgtgtggaagggcatcaacctgatccgcaccatccagggcgcccatgctgctggcatcttctccatgaatgcctgtgaggagggctttgccaccggcggcagagatggctgcatccggctgtgggacctgaccttcaagcccatcaccgtcatcgacctgcgggagacagaccagggctacaagggcctgtctgtgcgctctgtgtgctggaggggggaccacatcctggtgggcacccaggacagcgagatctttgagatcgtggtgcaggagaggaacaagcccttcctgatcatgcagggccactgtgagggggagctgtgggccctggccgtgcaccccaccaagcccctggccgtgacaggcagtgatgacagatctgtgcgcatctggagcctggtggaccacgccctgattgcccgctgcaacatggaggagcccatccgctgtgccgctgtgaatgctgatggcatccacctggccctgggcatgaaggatggcagcttcaccgtgctgcgggtgcgggacatgacagaggtggtgcacatcaaggacaggaaggaggccatccacgagctgaagtacagcccagatggcacctacctggccgtgggctgcaatgacagctctgtggacatctatggagtggcccagcgctacaagaaggtgggggagtgcctgggcagcctgtccttcatcacccacctggactggagcagtgacagccgctacctgcagaccaatgatggaaatggcaagaggctcttctacaggatgcctgggggcaaggaggtgaccagcacagaggagatcaagggcgtgcactgggcctcctggacctgtgtgtctggcctggaggtgaatggcatctggcccaagtacagcgacatcaatgacatcaacagcgtggatggcaactacatcggccaggtgctggtgacagcagatgattatggcatcatcaagctgttccgctacccctgcctgaggaagggggccaagttcaggaagtacatcggccacagcgcccacgtgaccaacgtgcgctggagccatgactaccagtgggtgatcagcattggaggagctgaccacagcgtcttccagtggaagttcatccctgagaggaagctgaaggatgctgtgcacatcgccccccaggagagcctggccgacagccacagtgatgaaagtgacagcgacctgagtgatgtgcctgagctggacagcgagattgagcaggagacccagctgacctaccgccggcaggtgtacaaggaggacctgccccagctgaaggagcagtgcaaggagaagcagaagagcgccaccagcaagaggcgggagcgggcccctggcaacagcatccggctgcactttgtgcacggctaccggggctatgactgccgcagcaacctcttctacacccagattggagagatcgtgtaccacgtggccgctgtgggcgtcatctacaaccggcagcagaacacccagcgcttctacctgggccatgatgatgacatcctgtgcctgaccatccaccccctgaaggactatgtggccaccggccaggtgggccgggaccccagcatccacatctgggacacagagaccatcaagcccctgagcatcctgaagggccaccaccagtatggagtgtctgctgtggacttcagcgcagatggcaagaggctggcctctgtgggcattgatgacagccacacagtggtgctgtgggactggaagaagggggagaagctgagcatcgcccggggcagcaaggacaagatctttgtggtgaagatgaacccctacgtgcctgacaagctgatcacagctggcatcaagcacatgaagttctggaggaaggctggagatgtgtgcatctggagggacatcttcctggtgaagacagtgaaggcccatgatggccctgtgttctccatgcacgccctggagaagggctttgtgactggaggcaaggatggcatcgtggccctgtgggatgacagctttgagcgctgcctgaagacctacgccatcaagagagctgccctggcccctggcagcaagggcctgctgctggaggacaaccccagcatccgggccatcagcctgggccacggccacatcctggtgggcaccaagaatggagagatcctggaggtggacaagagcggccccatcaccctgctggtgcagggccacatggagggggaggtgtggggcctggccacccacccctacctgcccatctgtgccaccgtgtctgatgacaagaccctgcgcatctgggacctgagccccagccactgcatgctggccgtgaggaagctgaagaagggcggccgctgctgctgcttctccccagatggcaaggccctggccgtgggcctgaatgatggcagcttcctgatggccaatgctgacaccctggaggacctggtgtccttccaccacaggaaggacatgatcagtgacatccgcttcagccctggcagcggcaagtacctggccgtggccagccatgacagcttcatcgacatctacaacgtgatgagcagcaagagggtgggcatctgcaagggggccaccagctacatcacccacatcgactgggacatccggggcaagctgctgcaggtgaacacaggagccaaggagcagctgttctttgaggccccccggggcaagaagcagaccatccccagcgtggaggtggagaagatcgcctgggcctcctggacctctgtgctgggcctgtgctgtgagggcatctggcctgtgattggagaggtgacagatgtgacagccagctgcctgaccagtgacaagatggtgctggccactggagatgacctgggctttgtgaagctgttccgctaccccaccaagggcaagtttgggaagttcaagcgctacgtggcccacagcacccacgtgaccaacgtgcgctggacctatgatgacagcatgctggtgaccctgggcggcacagacatgagcctgatggtgtggaccaatgagatggagggctaccgggagaagaggccctgtgacagcgaggagagtgacatcgacagcgaggaggatggcggctatgacagtgatgtgaccagagaaaatgagatctcctacaccatccgggccctgagcaccaacatccggcccatgctgggcatcaagccccacctgcagcagaaggagcccagcattgatgagcggccccctgtgtcccgggccccaccccagcctgagaagctgcagaccaacaacgtgggcaagaagaagaggcccatcgaggacctggtgctggagctgatcttcggctaccggggccgggactgcagaaataatgtgcactacctgaatgatggagatgacatcatctaccacacagcctctgtgggcatcctgcacaacgtggccaccggcagccagagcttctaccaggagcacaatgatgacatcctgtgcctgactgtgaaccagcaccccaagttcatcaacatcgtggccaccggccaggtggtgctgagctgcagcctgctgaccacagcccccagcatccacatctgggatgccatgaacaagcagaccctgagcatcctgcgctgctaccacagcaagggcgtgtgcagcgtgtccttcagcgccaccgggaagctgctgctgtctgtgggcctggaccctgagcacaccatcaccatctggcgctggcaggagggcgccaagatcgccagccgggccggccacaaccagaggatctttgtggccgagttccggccagacagcgacacccagtttgtgtctgtgggcgtgaagcacgtgaagttctggaccctggccggccgggccctgctgagcaagaagggcctgctgagcaccctggaggatgccaggatgcagaccatgctggccatcgccttcggggccaacaacctgaccttcaccggcaccatctctggagatgtgtgtgtgtggaaggaccacatcctgtgccgcatcgtggcccgggcccacaacggccctgtgtttgccatgtacaccaccctgagagatggcctgattgtgactggaggcaaggagcggcccagcaaggagggcggcgctgtgaagctgtgggaccaggagctgcggcgctgccgggccttccggctggagaccggccaggccacagactgtgtgcgctctgtgtgccggggcaagggcaagatcctggtgggcaccagaaatgctgagatcatcgaggtgggggagaagaatgctgcctgcaacatcctggtgaatggccacgtggatggccccatctggggcctggccacccaccccagccgggacttcttcctgtctgctgctgaagatggcaccgtgcggctgtgggacattgctgacaagaagatgctgaacaaggtgaacctgggccatgctgccaggacagtgtgctacagccctgagggggacatggtggccatcggcatgaagaatggagagttcatcatcctgctggtgagcagcctgaagatctggggcaagaagagggaccggcgctgtgccatccatgacatccgcttctccccagacagccgctacctggccgtgggcagcagcgagaacagcgtggacttctatgacctgaccctgggccccaccctgaaccgcatctcctactgcaaggacatccccagctttgtgatccagatggacttctctgctgacagcagctacctgcaggtgagcagcggctgctacaagagacatgtgtatgaggtgcccagcggcaagcacctgatggaccatgctgccatcgaccgcatcacctgggccacctggaccagcatcctgggagatgaggtgctgggcatctggagcagacatgctgagaaggcagatgtgaactgtgcctgtgtgagccacagcggcatcagcctggtgactggagatgactttggcatggtgaagctgtttgacttcccctgcccagagaagtttgccaagcacaagcgcttcctgggccacagcccccacgtgaccaacatccgcttcaccagcggggacagacatgtggtgtctgctggaggagatgactgcagcctgtttgtgtggaagtgtgtgcacaccccccactag

SEQ ID NO: 19383 - DNA, 429 bp, Artificial Sequence
  Description of Artificial Sequence: Synthetic coding sequence
atgagcatcagcagtgatgaggtgaacttcctggtgtaccgctacctgcaggagagcggcttcagccacagcgccttcaccttcggcatcgagagccacatcagccagagcaacatcaacggggccctggtgcccccagctgccctgatcagcatcatccagaagggcctgcagtatgtggaggccgaggtgtccatcaatgaagatggcaccctgtttgatggccggcccatcgagagcctgagcctgattgatgctgtgatgccagatgtggtgcagacccggcagcaggcctacagagacaagctggcccagcagcaggccgctgctgctgctgctgctgctgctgctgccagccagcagggcagcgccaagaatggagagaacacagccaacggggaggagaatggagcccacaccatcgcctag

SEQ ID NO: 19384 - DNA, 1704 bp, Artificial Sequence
  Description of Artificial Sequence: Synthetic coding sequence
atggagttcttcaccatgccacccaggacctggttcatgaggcagctgcagaggatgtggttcctgcggcccagcatggccatcatggtgttcaggatgattgaggagcggcccacccacgccatcaccgtgcgggtgtcctacctggagatctacaatgaaagcctgtttgacctgctgagcaccctgccctacgtgggccccagcgtgacccccatgaccatcgtggagaacccccagggcgtcttcatcaagggcctgtctgtgcacctgaccagccaggaggaggatgccttcagcctgctgtttgaaggagagaccaaccgcatcatcgccagccacaccatgaacaagaacagcagccgcagccactgcatcttcaccatctacctggaggcccacagcaggaccctgtctgaggagaagtacatcaccagcaagatcaacctggtggacctggccggcagcgagcggctgggcaagagcggcagcgagggccaggtgctgaaggaggccacctacatcaacaagagcctgtccttcctggagcaggccatcatcgccctgggggaccagaagagggaccacatccccttccggcagtgcaagctgacccacgccctgaaggacagcctgggcggcaactgcaacatggtgctggtgaccaacatctatggagaggccgcccagctggaggagaccctgagcagcctgcgctttgccagcaggatgaagctggtgaccacagagcccgccatcaatgagaagtatgatgctgagaggatggtgaagaacctggagaaggagctggccctgctgaagcaggagctggccatccatgacagcctgaccaacagaacatttgtgacctatgaccccatggatgagatccagattgctgagatcaacagccaggtgcggcgctacctggagggcaccctggatgaaattgacatcatcagcctgcggcagatcaaggaggtgttcaaccagttccgggtggtgctgagccagcaggagcaggaggtggagagcaccctgcggaggaagtacaccctgattgacagaaatgactttgctgccatcagcgccatccagaaggccggcctggtggatgtggatggccacctggtgggggagcctgagggccagaactttggcctgggcgtggcccccttcagcaccaagccaggcaagaaggccaagagcaagaagaccttcaaggagcccctgcggccagacaccccacccagcaagcctgtggcctttgaggagttcaagaatgagcagggcagcgagatcaaccgcatcttcaaggagaacaagagcatcctgaatgaaagaaggaagagggccagcgagaccacccagcacatcaatgccatcaagcgggagattgatgtgaccaaggaggccctgaacttccagaagagcctgcgggagaagcagggcaagtatgaaaataaaggcctgatgatcattgatgaggaggagttcctgctgatcctgaagctgaaggacctgaagaagcagtacagaagtgagtaccaggacctgcgggacctgcgggcagagatccagtactgccagcacctggtggaccagtgccgccaccggctgctgatgggcgccaccgtgggcaagaacctgaccagcggcaccatgagccccctgagcagcctgcggacctgccgctggcactag

SEQ ID NO: 19385 - DNA, 1428 bp, Artificial Sequence
  Description of Artificial Sequence: Synthetic coding sequence
atggccgagggctctgtgatgttcagtgatgtgtccattgacttcagccaggaggagtgggactgcctggaccctgtgcagagggacctgtacagagatgtgatgctggagaactacggcaacctggtgtccatgggcctgtacacccccaagccccaggtgatcagcctgctggagcagggcaaggagccctggatggtgggccgggagctgacccggggcctgtgcagcgacctggagagcatgtgtgagaccaagctgctgagcctgaagaaggaggtgtatgaaattgagctgtgccagcgggagatcatgggcctgaccaagcacggcctggagtacagcagctttggagatgtgctggagtaccgcagccacctggccaagcagctgggctacccaaatggccacttcagccaggagatcttcaccccagagtacatgcccaccttcatccagcagaccttcctgaccctgcaccagatcatcaacaatgaagatcggccctatgagtgcaagaagtgtgggaaggccttcagccagaacagccagttcatccagcaccagaggatccacatcggggagaagagctatgagtgcaaggaatgtgggaagttcttcagctgtggcagccacgtgaccaggcacctgaagatccacactggagagaagccctttgagtgcaaggaatgtgggaaggccttcagctgcagcagctacctgagccagcaccagaggatccacacaggcaagaagccctatgagtgcaaggaatgtgggaaggccttctcctactgcagcaacctgattgaccaccagaggatccacactggagagaagccctatgagtgcaaggtgtgtgggaaggccttcaccaagagcagccagctgttccagcacgcccgcatccacactggagagaagccctatgagtgcaaggaatgtgggaaggccttcacccagagcagcaagctggtgcagcaccagaggatccacactggagagaagccctatgagtgcaaggaatgtgggaaggccttcagcagcggcagcgccctgaccaaccaccagaggatccacactggagagaagccctatgactgcaaggaatgtgggaaggccttcacccagagcagccagctgcggcagcaccagagaattcatgctggggagaagccctttgaatgtctggagtgtgggaaggccttcacccagaacagccagctgttccagcaccagaggatccacacagatgagaagccctatgaatgtaatgaatgtgggaaggccttcaacaagtgcagcaacctgaccaggcacctgcgcatccacactggagagaagccctacaactgcaaggaatgtgggaaggccttcagcagcggcagtgacctgatccgccaccagggcatccacaccaacaagtag

SEQ ID NO: 19386 - DNA, 462 bp, Artificial Sequence; identical to SEQ ID NO: 18420
  Description of Artificial Sequence: Synthetic coding sequence

SEQ ID NO: 19387 - DNA, 2616 bp, Artificial Sequence
  Description of Artificial Sequence: Synthetic coding sequence
atgggagagggcggcctgcccccagccttccagctgctgctgcgggcctgtgaccagggcgacacagaaacagcccggcggctgctggagcctggagctgctgagcctgctgagagaggagctgagcctgaggccggggctgagcctgctggagctgaggtggccggccctggagctgctgctgctggagctgtgggcgcccctgtgcctgtggactgcagtgatgaagctggcaacacagccctgcagtttgctgctgctgggggccacgagcccctggtgcgcttcctgctgcggcggggggcctctgtgaacagcaggaaccactacggctggagcgccctgatgcaggccgccaggtttggacatgtgtctgtggcccacctgctgctggaccatggagcagatgtgaatgcccagaaccggctgggcgcctctgtgctgactgtggccagccggggcggccacctgggcgtggtgaagctgctgctggaggccggggcctttgtggaccaccaccaccccagcggggagcagctgggcctgggcggcagcagagatgagcccctggacatcacagccctgatggccgccatccagcacggccatgaagctgtggtgcggctgctgatggagtggggcgctgaccccaaccacgccgccaggacagtgggctggagccccctgatgctggccgccctgaccggccgcctgggcgtggcccagcagctggtggagaagggggccaacccagaccacctgtctgtgctggagaagacagcctttgaggtggccctggactgcaagcaccgggacctggtggactacctggaccccctgaccaccgtgcggcccaagacagatgaggagaagaggaggccagacatcttccacgccctgaagatgggcaacttccagctggtgaaggagattgctgatgaggaccccagccacgtgaacctggtgaatggagatggagccacccccctgatgctggccgctgtgacaggccagctggccctggtgcagctgctggtggagagacatgctgatgtggacaagcaggacagcgtgcacggctggacagccctgatgcaggccacctaccacggcaacaaggagatcgtgaagtacctgctgaaccagggcgcagatgtgaccctgcgggccaagaatggctacacagcctttgacctggtgatgctgctgaatgaccctgacacagagctggtgcggctgctggcctctgtgtgcatgcaggtgaacaaggacaagggccggcccagccaccagccccccctgccccacagcaaggtgcggcagccctggagcatccctgtgctgcctgatgacaagggcggcctgaagtcctggtggaacaggatgagcaaccgcttcaggaagctgaagctgatgcagaccctgccccggggcctgagcagcaaccagcccctgcccttcagtgatgagcctgagcccgccctggacagcaccatgagagctgccccccaggacaagaccagccgcagcgccctgcctgatgctgcccctgtgaccaaggacaatggacctggcagcaccagaggagagaaggaggacaccctgctgaccaccatgctgagaaatggagcccccctgacccggctgcccagcgacaagctgaaggccgtcatcccccccttcctgccccccagcagctttgagctgtggagcagtgacaggagcaggaccaggcacaacgggaaggctgaccccatgaagacagccctgccccagagggccagccggggccaccctgtgggcggcggcggcacagacaccacccctgtgcggcctgtgaagttccccagcctgcccaggagccctgccagcagcgccaacagcggcaacttcaaccacagcccccacagcagcggcggcagcagcggcgtgggcgtgtccagacatggaggagagctgctgaacagaagtggcggcagcattgacaacgtgctgagccagattgctgcccagaggaagaaggccgccggcctgctggagcagaagcccagccacaggagcagccctgtgggccctgcccctggcagcagccccagcgagctgcctgccagccctgctgggggcagcgcccctgtgggcaagaagctggagaccagcaagaggcctcccagcggcaccagcaccaccagcaagagcaccagccccaccctgacccccagccccagccccaagggccacacagctgagagctctgtgagcagcagcagcagccaccggcagagcaagagcagcggcggcagcagcagcggcaccatcacagatgaagatgagctgaccggcatcctgaagaagctgagcctggagaagtaccagcccatctttgaggagcaggaggtggacatggaggccttcctgaccctgacagatggagacctgaaggagctgggcatcaagacagatggcagccggcagcagatcctggccgccatcagcgagctgaatgctgggaagggccgggagcggcagatcctgcaggagaccatccacaacttccacagcagctttgagagcagcgccagcaacacccgggcccctggcaacagcccctgtgcctag

SEQ ID NO: 19388 - DNA, 1359 bp, Artificial Sequence
  Description of Artificial Sequence: Synthetic coding sequence
atgtctgccagcctgaactacaagagcttcagcaaggagcagcagaccatggacaacctggagaagcagctgatctgccccatctgcctggagatgttcaccaagcctgtggtgatcctgccctgccagcacaacctgtgcaggaaatgtgccagtgacatcttccaggccagcaacccctacctgcccacccggggcggcaccaccatggccagcggcggccgcttccgctgccccagctgcagacatgaggtggtgctggacagacatggagtgtatggcctgcagaggaacctgctggtggagaacatcatcgacatctacaagcaggagagcaccaggcctgagaagaagagtgaccagcccatgtgtgaggagcacgaggaggagcgcatcaacatctactgcctgaactgtgaggtgcccacctgcagcctgtgcaaggtgtttggagcccacaaggactgccaggtggcccccctgacccacgtgttccagaggcagaagtctgagctgagtgatggcatcgccatcctggtgggcagcaatgacagagtgcagggcgtcatcagccagctggaggacacctgcaagaccatcgaggagtgctgcaggaagcagaagcaggagctgtgtgagaagtttgactacctgtatggcatcctggaggagaggaagaatgagatgacccaggtgatcaccaggacccaggaggagaagctggagcacgtgcgggccctgatcaagaagtacagcgaccacctggagaatgtgtccaagctggtggagagcggcatccagttcatggatgagcctgagatggctgtgttcctgcagaatgccaagaccctgctgaagaagatcagcgaggccagcaaggccttccagatggagaagattgagcacggctatgagaacatgaaccacttcaccgtgaacctgaaccgggaggagaagatcatccgggagattgacttctacagagaagatgaagatgaggaggaggaggagggcggggagggggagaaggagggggagggggaggtgggcggggaggccgtggaggtggaggaggtggagaatgtgcagacagagttccctggagaagatgaaaatcctgagaaggccagcgagctgagccaggtggagctgcaggccgcccctggggccctgcctgtgagcagccctgagcccccaccagccctgcccccagctgctgatgcccctgtgacccagattggatttgaggccccacccctgcagggccaggccgccgccccagccagcggcagcggggctgacagcgagcccgcccggcacatcttctccttctcctggctgaacagcctgaatgaatag

SEQ ID NO: 19389 - DNA, 492 bp, Artificial Sequence
  Description of Artificial Sequence: Synthetic coding sequence
atgcccagcatcaagctgcagagcagtgatggagagatctttgaggtggatgtggagatcgccaagcagagcgtgaccatcaagaccatgctggaggacctgggcatggatgatgaaggagatgatgatcctgtgcccctgcccaacgtgaatgctgccatcctgaagaaggtgatccagtggtgcacccaccacaaggatgatcctcctcctccagaagatgatgagaacaaggagaagaggacagatgacatccctgtgtgggaccaggagttcctgaaggtggaccagggcaccctgtttgagctgatcctggccgccaactacctggacatcaagggcctgctggatgtgacctgcaagacagtggccaacatgatcaagggcaagaccccagaggagatcaggaagaccttcaacatcaagaatgacttcacagaggaggaggaggcccaggtgaggaaggagaaccagtggtgtgaggagaagtag

SEQ ID NO: 19390 - DNA, 1200 bp, Artificial Sequence
  Description of Artificial Sequence: Synthetic coding sequence
atggccgcccccagccccagcggcggcggcggcagcggcggcggcagcggcagcggcaccccaggccctgtgggcagccctgcccctggccaccctgctgtgtcctccatgcagggcaagaggaaggccctgaagctgaactttgccaacccccccttcaagagcacagcccgcttcaccctgaaccccaaccccaccggggtgcagaacccccacatcgagcggctgcggacccacagcattgagagcagcggcaagctgaagatcagccctgagcagcactgggacttcaccgctgaggacctgaaggacctgggggagatcggccgcggggcctacggctctgtgaacaagatggtgcacaagcccagcggccagatcatggctgtgaagaggatccgcagcacagtggatgagaaggagcagaagcagctgctgatggacctggatgtggtgatgaggagcagtgactgcccctacatcgtgcagttctatggagccctcttccgggagggggactgctggatctgcatggagctgatgagcaccagctttgacaagttctacaagtatgtgtacagcgtgctggatgatgtgattcctgaggagatcctgggcaagatcaccctggccaccgtgaaggccctgaaccacctgaaggagaacctgaagatcatccaccgggacatcaagcccagcaacatcctgctggacaggagcggcaacatcaagctgtgtgactttggcatcagcggccagctggtggacagcatcgccaagaccagagatgctggctgccggccctacatggcccctgagagaattgaccccagcgccagccggcagggctatgatgtgcggagtgatgtgtggagcctgggcatcaccctgtatgagctggccaccggccgcttcccctaccccaagtggaacagcgtgtttgaccagctgacccaggtggtgaagggggaccccccccagctgagcaacagcgaggagcgggagttcagccccagcttcatcaactttgtgaacctgtgcctgaccaaggatgagagcaagaggcccaagtacaaggagctgctgaagcaccccttcatcctgatgtatgaggagagagctgtggaggtggcctgctacgtgtgcaagatcctggaccagatgcctgccacccccagcagccccatgtatgtggactag

SEQ ID NO: 19391 - DNA, 1122 bp, Artificial Sequence
  Description of Artificial Sequence: Synthetic coding sequence
atggcccaggagagccccaagaacagcgctgctgagatccctgtgaccagcaatggagaggtggatgacagccgggagcacagcttcaacagagacctgaagcacagcctgcccagcggcctgggcctgtctgagacccagatcaccagccacggctttgacaacaccaaggagggcgtgattgaagctggggccttccagggcagccctgccccacccctgcccagcgtgatgagccccagccgggtggccgccagccggctggcccagcagggcagtgacctgattgtgcctgctgggggccagaggacccagaccaagagcggccctgtgatcctggctgatgagatcaagaacccagccatggagaagctggagctggtgaggaagtggagcctgaacacctacaagtgcacccggcagatcatcagcgagaagctgggccggggcagcaggacagtggacctggagctggaggcccagattgacatcctgcgggacaacaagaagaagtatgagaacatcctgaagctggcccagaccctgagcacccagctgttccagatggtgcacacccagaggcagctgggagatgcctttgctgacctgagcctgaagagcctggagctgcacgaggagtttggctacaatgctgacacccagaagctgctggccaagaatggagagaccctgctgggcgccatcaacttcttcatcgcctctgtgaacaccctggtgaacaagaccatcgaggacaccctgatgacagtgaagcagtatgagagcgccagaattgaatatgatgcctacagaacagacctggaggagctgaacctgggccccagagatgccaacaccctgcccaagattgagcagagccagcacctgttccaggcccacaaggagaagtatgacaagatgagaaatgatgtgtctgtgaagctgaagttcctggaggagaacaaggtgaaggtgctgcacaaccagctggtgctcttccacaatgccatcgccgcctactttgctggcaaccagaagcagctggagcagaccctgaagcagttccacatcaagctgaagaccccaggagtggatgcccccagctggctggaggagcagtag

SEQ ID NO: 19392 - DNA, 654 bp, Artificial Sequence
  Description of Artificial Sequence: Synthetic coding sequence
atgtacagcctgaaccaggagatcaaggccttcagcaggaacaacctgaggaagcagtgcaccagggtgaccaccctgaccgggaagaagatcatcgagacctggaaggatgcccgcatccacgtggtggaggaggtggagcccagcagcggcggcggctgcggctacgtgcaggacctgagcagtgacctgcaggtgggcgtcatcaagccctggctgctgctgggcagccaggatgctgcccatgacctggacaccctgaagaagaacaaggtgacccacatcctgaatgtggcctacggcgtggagaatgccttcctgagtgacttcacctacaagagcatcagcatcctggacctgcctgagaccaacatcctgagctacttcccagaatgttttgagttcatcgaggaggccaagaggaaggatggagtggtgctggtgcactgcaatgctggggtgtccagagctgctgccatcgtcatcggcttcctgatgaacagcgagcagaccagcttcaccagcgccttcagcctggtgaagaatgcccggcccagcatctgccccaacagcggcttcatggagcagctgcggacctaccaggagggcaaggagagcaacaagtgtgaccgcatccaggagaacagcagctag

SEQ ID NO: 19393 - DNA, 2679 bp, Artificial Sequence
  Description of Artificial Sequence: Synthetic coding sequence
atgctgaggacagctggaagagatggcctgtgccgcctgagcacctacctggaggagctggaggccgtggagctgaagaagttcaagctgtacctgggcacagccacagagctgggggagggcaagatcccctggggctccatggagaaggccggccccctggagatggcccagctgctgatcacccacttcggccctgaggaggcctggaggctggccctgagcacctttgagcgcatcaacaggaaggacctgtgggagcggggccagcgggaggacctggtgcgggacaccccacctgggggccccagcagcctgggcaaccagagcacctgcctgctggaggtgtccctggtgacccccaggaaggacccccaggagacctacagagattatgtgcggaggaagttccggctgatggaggacagaaatgcccggctgggagaatgtgtgaacctgagccaccgctacacccggctgctgctggtgaaggagcacagcaaccccatgcaggtgcagcagcagctgctggacaccggccggggccacgccaggacagtgggccaccaggccagccccatcaagattgagaccctgtttgagccagatgaggagaggcctgagccccccaggacagtggtgatgcagggcgctgctggcatcggcaagtccatgctggcccacaaggtgatgctggactgggcagatggcaagctgttccagggccgctttgactacctgttctacatcaactgccgggagatgaaccagagcgccacagaatgttccatgcaggacctgatcttcagctgctggccagagcccagcgcccccctgcaggagctgatccgggtgcctgagcggctgctcttcatcattgatggctttgatgagctgaagcccagcttccatgacccccagggcccctggtgcctgtgctgggaggagaagaggcccacagagctgctgctgaacagcctcatcaggaagaagctgctgcctgagctgagcctgctgatcaccacccggcccacagccctggagaagctgcaccggctgctggagcaccccaggcatgtggagatcctgggcttcagcgaggccgagaggaaggagtacttctacaagtacttccacaatgctgagcaggccggccaggtgttcaactacgtgcgggacaatgagcccctcttcaccatgtgctttgtgcccctggtgtgctgggtggtgtgcacctgcctgcagcagcagctggagggcggcggcctgctgcggcagaccagcaggaccaccacagctgtgtacatgctgtacctgctgagcctgatgcagcccaagccaggggccccccggctgcagcccccacccaaccagaggggcctgtgcagcctggccgcagatggcctgtggaaccagaagatcctgtttgaggagcaggacctgaggaagcacggcctggatggagaagatgtgtctgccttcctgaacatgaacatcttccagaaggacatcaactgtgagcgctactacagcttcatccacctgtccttccaggagttctttgctgccatgtactacatcctggatgaaggagagggcggggccggccctgaccaggatgtgacccggctgctgacagaatatgccttcagcgagaggagcttcctggccctgaccagccgcttcctgtttggcctgctgaatgaggagaccaggagccacctggagaagagcctgtgctggaaggtgagcccccacatcaagatggacctgctgcagtggatccagagcaaggcccagagtgatggcagcaccctgcagcagggcagcctggagttcttcagctgcctgtatgagatccaggaggaggagttcatccagcaggccctgagccacttccaggtgattgtggtgagcaacatcgccagcaagatggagcacatggtgtcctccttctgcctgaagcgctgccgcagcgcccaggtgctgcacctgtatggagccacctacagcgcagatggagaagatcgggcccgctgcagcgctggggcccacaccctgctggtgcagctgcctgagaggacagtgctgctggatgcctacagcgagcacctggccgccgccctgtgcaccaaccccaacctgattgagctgagcctgtacagaaatgccctgggcagcagaggagtgaagctgctgtgccagggcctgcggcaccccaactgcaagctgcagaacctgcggctgaagcgctgccgcatcagcagcagcgcctgtgaggacctgtctgctgccctgattgccaacaagaacctgaccaggatggacctgtctggaaatggagtgggcttccctggcatgatgctgctgtgtgagggcctgcggcacccccagtgccgcctgcagatgatccagctgaggaagtgccagctggagagcggggcctgccaggagatggcctctgtgctgggcaccaacccccacctggtggagctggacctgactggaaatgccctggaggacctgggcctgcggctgctgtgccagggcctgcggcaccctgtgtgccgcctgcggaccctgtgctggatgctgtttggcatggacctgaacaagatgacccacagccggctggccgccctgcgggtgaccaagccctacctggacatcggctgctag

SEQ ID NO: 19394 - DNA, 945 bp, Artificial Sequence
  Description of Artificial Sequence: Synthetic coding sequence
atgcagaccttcctgaagggcaagagggtgggctactggctgtctgagaagaagatcaagaagctgaacttccaggcctttgctgagctgtgcaggaagaggggcatggaggtggtgcagctgaacctgagccggcccatcgaggagcagggccccctggatgtgatcatccacaagctgacagatgtgatcctggaggccgaccagaatgacagccagagcctggagctggtgcaccgcttccaggagtacattgatgcccaccctgagaccatcgtgctggaccccctgcctgccatccgcaccctgctggacaggagcaagagctatgagctgatcaggaagattgaggcctacatggaggatgaccgcatctgcagcccccccttcatggagctgaccagcctgtgtggagatgacaccatgaggctgctggagaagaatggcctgaccttccccttcatctgcaagaccagggtggcccacggcaccaacagccatgagatggccatcgtgttcaaccaggagggcctgaatgccatccagcccccctgtgtggtgcagaacttcatcaaccacaatgctgtgctgtacaaggtgtttgtggtgggggagagctacacagtggtgcagaggcccagcctgaagaacttctctgctggcaccagtgaccgggagagcatcttcttcaacagccacaacgtgtccaagccagagagcagctctgtgctgacagagctggacaagattgagggcgtgtttgagcggcccagtgatgaagtcatccgggagctgagccgggccctgcggcaggccctgggcgtgtccctgtttggcatcgacatcatcatcaacaaccagacaggccagcacgccgtcatcgacatcaatgccttccctggggactgccaggtgtgcttcatcgagggctggaagacagactag

SEQ ID NO: 19395 - DNA, 630 bp, Artificial Sequence
  Description of Artificial Sequence: Synthetic coding sequence
atgcctgtggccgtgatggccgagagcgccttctccttcaagaagctgctggaccagtgtgagaaccaggagctggaggcccctgggggcatcgccaccccacctgtgtatggccagctgctggccctgtacctgctgcacaatgacatgaacaatgcccgctacctgtggaagagaattcctccagccatcaagagcgccaacagcgagctgggcggcatctggagcgtgggccagaggatctggcagagggacttccctggcatctacaccaccatcaatgcccaccagtggagcgagaccgtgcagcccatcatggaggccctgagagatgccaccaggagaagagcctttgccctggtgtcccaggcctacaccagcatcatcgcagatgactttgctgcctttgtgggcctgcctgtggaggaggccgtgaagggcatcctggagcagggctggcaggccgacagcaccaccaggatggtgctgcccaggaagcctgtggccggggccctggatgtgtccttcaacaagttcatccccctgtctgagcccgcccctgtgccccccatccccaatgagcagcagctggcccggctgacagattatgtggccttcctggagaactag

SEQ ID NO: 19396 - DNA, 4935 bp, Artificial Sequence
  Description of Artificial Sequence: Synthetic coding sequence
atgttctggtgtggcacctgctttgtgaccaacaacatgaagggcagcgaggtgtccctggagaagaagaagaagatcaagatgcctgtgaagaggctgcgggaggtggtgtcccagaaccacggggaccacctggtgctgctgaaggatgagctgccctgtgtgcccccagccctgagcgccaacaagaggctgcctgtgggcaccggcaccagcctgaatggcaccagccggggcagcagtgacctgaccagcgccaggaactgctaccagcccctgctggagaaccccatggtgtctgagagtgacttcagcaaggatgtggccgtgcaggtgctgcccctggacaagattgaggagaacaacaagcagaaggccaatgacatcttcatcagccagtacaccatgggccagaaggatgccctgaggacagtgctgaagcagaatgtgtccctgtgcctgaccggctggagcgaccacagcggggtcatcaccacccactgcagcctgtacctgctgcggctgatgaggagcagccacctgagcctgcccagctcctgggactaccgggcccagagcatgcctgtgttcaaggaggtgaaggtgcacctgctggaggatgctggcatcgagaaggatgctgtgacccaggagacccgcatcagccccagcggcatcgacagcgccaccaccgtggccgccgccacagctgctgccatcgccacagctgcccccctcatcaaggtgcagagcgacctggaggccaaggtgaacagcgtgacagagctgctgagcaagctgcaggagacagacaagcacctgcagagggtgacagagcagcagaccagcatccagaggaagcaggagaagctgcactgccacgaccacgagaagcagatgaatgtgttcatggagcagcacatccgccacctggagaagctgcagcagcagcagattgacatccagacccacttcatctctgctgccctgaagaccagcagcttccagcctgtgtccatgcccagcagcagagctgtggagaagtacagcgtgaagccagagcaccccaacctgggcagctgcaaccccagcctgtacaacacctttgccagcaagcaggcccccctgaaggaggtggaggacaccagctttgacaagcagaagagccccctggagaccccagcccccaggagatttgcccctgtgcctgtgtccagagatgatgagctgagcaagcgggagaacctgctggaggagaaggagaacatggaggtgtcctgccacagaggaaatgtgcggctgctggagcagatcctgaacaacaatgacagcctgaccaggaagtctgagagcagcaacaccaccagcctgaccaggagcaagattggctggaccccagagaagaccaaccgcttccccagctgtgaggagctggagaccaccaaggtgaccatgcagaagagtgatgatgtgctgcatgacctgggccagaaggagaaggagaccaacagcatggtgcagcccaaggagagcctgtccatgctgaagctgcctgacctgccccagaacagcgtgaagctgcagaccaccaacaccaccaggtctgtgctgaaggatgctgagaagatcctgcggggcgtgcagaacaacaagaaggtgctggaggagaacctggaggccatcatccgggccaaggatggagctgccatgtacagcctcatcaatgccctgagcaccaaccgggagatgtctgagaagatccgcatcaggaagacagtggatgagtggatcaagaccatctctgctgagatccaggatgagctgagcaggacagattatgagcagaagagatttgaccagaagaaccagaggaccaagaagggccagaacatgaccaaggacatccgcaccaacacccaggacaagacagtgaacaagagcgtcatccccaggaagcacagccagaagcagatcgaggagcacttcaggaacctgcccatgaggggcatgcctgccagcagcctgcagaaggagaggaaggagggcctgctgaaggccaccaccgtcatccaggatgaggactacatgctgcaggtgtatggcaagcctgtgtaccagggccacaggagcaccctgaagaagggcccctacctgcgcttcaacagccccagccccaagagccggccccagaggcccaaggtgattgagcgggtgaagggcaccaaggtgaagagcatccgcacccagacagacttctacgccaccaagcccaagaagatggacagcaagatgaagcacagcgtgcctgtgctgccccatggagaccagcagtacctgttcagccccagccgggagatgcccaccttcagcggcaccctggagggccacctgatccccatggccatcctgctgggccagacccagagcaacagcgacaccatgcctcctgctggggtcatcgtgtccaagccccaccctgtgacagtgaccaccagcatcccccccagcagcaggaaggtggagaccggggtgaagaagcccaacatcgccatcgtggagatgaagtctgagaagaaggaccccccccagctgactgtgcaggtgctgcccagcgtggacatcgacagcatcagcaacagcagcgcagatgtgctgagccccctgagcagccccaaggaggccagcctgccccctgtgcagacctggatcaagaccccagagatcatgaaggtggatgaggaggaggtgaagtttcctggcaccaactttgatgagatcattgatgtgatccaggaggaggagaagtgtgatgagatcccagacagcgagcccatcctggagttcaacagatctgtgaaggctgacagcaccaagtacaacggcccccccttcccccctgtggccagcaccttccagcccacagctgacatcctggacaaggtgattgaaaggaaggagaccctggagaacagcctcatccagtgggtggagcaggagatcatgagccgcatcatcagcggcctcttccctgtgcagcagcagatcgcccccagcatctctgtgtctgtgtctgagaccagcgagcccctgaccagtgacatcgtggagggcaccagcagcggggccctgcagctgtttgtggatgctggggtgcctgtgaacagcaatgtcatcaagcactttgtgaatgaggccctggccgagaccatcgctgtgatgctgggggaccgggaggccaagaagcagggccctgtggccactggagtgtctggagatgccagcaccaatgagacctacctgcctgcccgggtgtgcacccccctgcccaccccccagcccaccccaccctgcagccccagcagccctgccaaggaatgtgtgctggtgaagaccccagacagcagcccctgtgacagcgaccatgacatggccttccctgtgaaggagatctgtgccgagaagggagatgacatgcctgccatcatgctggtgaacacccccaccgtgacccccaccaccaccccacctcctgctgctgctgtgttcacccccaccctgagtgacatcagcattgacaagctgaaggtgagcagccctgagctgcccaagccctggggagatggagacctgcccctggaggaggagaaccccaacagcccccaggaggagctgcacccccgggccatcgtgatgtctgtggccaaggatgaggagcctgagagcatggacttccctgcccagcccccacctcctgagcctgtgcccttcatgcccttccctgctggcaccaaggcccccagccccagccagatgcctggcagtgacagcagcaccctggagagcaccctgtctgtgacagtgacagaaacagagaccctggacaagcccatcagcgagggggagatcctcttcagctgtggccagaagctggcccccaagatcctggaggacatcggcctgtacctgaccaacctgaatgacagcctgagcagcaccctgcatgatgctgtggagatggaggatgatcctccttctgagggccaggtgatccgcatgagccacaagaagttccacgcagatgccatcctgagctttgccaagcagaaccaggagagcgctgtgtcccagcaggccgtgtaccacagcgaggacctggagaacagcgtgggggagctgtctgagggccagaggccccagctgacagctgctgctgagaacatcctgatgggccacagcctgtacatgcagccccctgtgaccaacacccagagcctggaccagcagtgtgaccccaagcccctgagccggcagtttgacacagtgtctggcagcatctatgaggacagctgtgccagccacggccccatgagcctgggggagctggagctggagcccaacagcaagctggtgctgcccaccaccctgctgacagcccaggagaatgatgtgaacctgcctgtggccgctgaggacttcagccagtaccagctgaagcagaaccaggatgtgaagcaggtggagcacaagcccagccagagctacctgcgggtgaggaacaagagtgacatcgcccccagccagcagcaggtgtcccctggggacatggacaggacccagatcgagctgaacccctacctgacctgtgtgttttctggcctgggcgtgcacgtgaagaaggtgtcctgcatcggcaagctgggcctgtggaggtttgtgatccagatcatcagcagcccccgctgggagagcagcgccaccctgcgcttcacagatgccccctgccaggatgtgtctgatgctgctgtgtctgagccccggggcctgctgtctgtgtctgagagccagcacaatgctgggggccatggagtgtttggaggccgctacctgctgaatggcaagaggcagcctgcccagtgcctgtgccactggttctag

SEQ ID NO: 19397 - DNA, 3138 bp, Artificial Sequence
  Description of Artificial Sequence: Synthetic coding sequence
atgctgactgtgcaggtgaagaccagcagcgccatcgagctgcctgacagcctggccttcctgtggatcatccccatgtggtactgtgagggcaaggagctggagaacagcccagacatccacatcgtgcaggccggcaacctgcacagcctgaccatcgccgaggcctttgaggaggacaccggccgctacagctgctttgccagcaacatctacggcacagacagcaccagcgctgagatctacattgaaggagtgagcagcagtgacagcgagggggaccccaacaaggaggagatgaaccgcatccagaagcccaatgaggtgagcagcccccccaccaccagcgctgtgatccccccagctgtgccccaggcccagcacctggtggcccagccccgggtggccaccatccagcagtgccagagccccaccaactacctgcagggcctggatggcaagcccatcatcgccgcccctgtgttcaccaagatgctgcagaacctgagcgccagcgagggccagctggtggtgtttgagtgccgggtgaagggggcccccagccccaaggtggagtggtaccgggagggcaccctgattgaggacagcccagacttccgcatcctgcagaagaagcccaggtccatggccgagcctgaggagatctgcaccctggtgattgctgaggtgtttgctgaagattctggctgcttcacctgcacagccagcaacaagtatggcaccgtgagcagcatcgcccagctgcacgtgagaggaaatgaagacctgagcaacaacggcagcctgcacagcgccaacagcaccaccaacctggccgccatcgagccccagcccagccccccccacagcgagccccccagcgtggagcagccccccaagcccaagctggagggcgtgctggtgaaccacaatgagcccaggagcagcagcagaattggcctgcgggtgcacttcaacctgcctgaagatgacaagggcagcgaggccagcagcgaggccggcgtggtgaccacccggcagaccaggccagacagcttccaggagcgcttcaacggccaggccaccaagaccccagagcccagcagccctgtgaaggagcccccacctgtgctggccaagcccaagctggacagcacccagctgcagcagctgcacaaccaggtgctgctggagcagcaccagctgcagaaccccccacccagcagccccaaggagttccccttctccatgacagtgctgaacagcaatgcccctcctgctgtgaccaccagcagcaagcaggtgaaggcccccagcagccagaccttcagcctggcccggcccaagtacttcttccccagcaccaacaccacagctgccaccgtggcccccagcagcagccctgtgttcaccctgagcagcaccccccagaccatccagaggacagtgtccaaggagagcctgctggtgagccaccccagcgtgcagaccaagagccctgggggcctgagcatccagaatgagcccctgcccccaggccccacagagcccaccccaccacccttcaccttcagcatccccagcggcaaccagttccagccccgctgtgtgagccccatccctgtgagccccaccagccgcatccagaaccctgtggccttcctgagctctgtgctgcccagcctgcctgccatcccccccaccaatgccatgggcctgcccaggtctgcccccagcatgcccagccagggcctggccaagaagaacaccaagagcccccagcctgtgaatgatgacaacatccgggagaccaagaatgctgtgatccgggacctgggcaagaagatcaccttcagtgatgtgcggcccaaccagcaggagtacaagatcagcagctttgagcagaggctgatgaatgaaattgagttccggctggagaggacccctgtggatgaaagtgatgatgagatccagcatgatgagatccccaccgggaagtgcatcgcccccatctttgacaagaggctgaagcacttccgggtgacagagggcagccctgtgaccttcacctgcaagatcgtgggcatccctgtgcccaaggtgtactggttcaaggatggcaagcagatcagcaagagaaatgagcactgcaagatgaggcgggagggagatggcacctgcagcctgcacatcgagagcaccaccagtgatgatgatggcaactacaccatcatggccgccaacccccagggccgcatcagctgcagcggccacctgatggtgcagagcctgcccatccgcagccggctgaccagcgctggccagagccaccggggccgcagccgggtgcaggagcgggacaaggagcccctgcaggagcgcttcttccggccccacttcctgcaggcccctggggacatggtggcccacgagggccgcctgtgccgcctggactgcaaggtgtctggcctgcccccacctgagctgacctggctgctgaatggccagcctgtgctgcctgatgccagccacaagatgctggtgcgggagactggagtgcacagcctgctgattgaccccctgacccagagagatgctggcacctacaagtgcatcgccaccaacaagacaggccagaacagcttcagcctggagctgtctgtggtggccaaggaggtgaagaaggcccctgtgatcctggagaagctgcagaactgtggggtgcctgagggccaccctgtgcggctggagtgccgggtgattggcatgcctcctcctgtgttctactggaagaaggacaatgagaccatcccctgcacccgggagcgcatctccatgcaccaggacaccaccggctacgcctgcctgctgatccagcctgccaagaagagtgatgctggctggtacaccctgagcgccaagaatgaagctggcatcgtgtcctgcacagcccggctggacatctatgcccagtggcaccaccagatccccccacccatgtctgtgcggcccagcggcagccgctatggcagcctgaccagcaagggcctggacatcttcagcgccttcagctccatggagagcaccatggtgtacagctgcagcagccgctctgtggtggagagtgatgagctgtag

SEQ ID NO: 19398 - DNA, 951 bp, Artificial Sequence
  Description of Artificial Sequence: Synthetic coding sequence
atgacccccagcgagggcgcccgggccggcaccggccgggagctggagatgctggacagcctgctggccctgggcggcctggtgctgctgcgggacagcgtggagtgggagggccgcagcctgctgaaggccctggtgaagaagagcgccctgtgtggggagcaggtgcacatcctgggctgtgaggtgtctgaggaggagttccgggagggctttgacagcgacatcaacaaccggctggtgtaccatgacttcttccgggaccccctgaactggagcaagacagaggaggccttccctgggggccccctgggcgccctgcgggccatgtgcaagaggacagatcctgtgcctgtgaccatcgccctggacagcctgtcctggctgctgctgcggctgccctgcaccaccctgtgccaggtgctgcatgctgtgagccaccaggacagctgccctggggacagcagctctgtgggcaaggtgtctgtgctgggcctgctgcacgaggagctgcacggccctggccctgtgggcgccctgagcagcctggcccagacagaggtgaccctgggcggcaccatgggccaggccagcgcccacatcctgtgccggcggccccggcagaggcccacagaccagacccagtggttcagcatcctgcctgacttcagcctggacctgcaggagggccccagcgtggagagccagccctacagcgacccccacatcccccctgtggaccccaccacccacctgaccttcaacctgcacctgagcaagaaggagcgggaggcccgggacagcctcatcctgcccttccagttcagcagcgagaagcagcaggccctgctgcggccccggcccggccaggccaccagccacatcttctatgagccagatgcctatgatgacctggaccaggaggaccctgatgatgacctggacatctag

SEQ ID NO: 19399 - DNA, 1473 bp, Artificial Sequence; identical to SEQ ID NO: 18917
  Description of Artificial Sequence: Synthetic coding sequence

SEQ ID NO: 19400 - DNA, 1428 bp, Artificial Sequence
  Description of Artificial Sequence: Synthetic coding sequence
atggaggccctgctggagggcatccagaacagaggacatggaggcggcttcctgaccagctgtgaggccgagctgcaggagctgatgaagcagattgacatcatggtggcccacaagaagtctgagtgggagggccgcacccacgccctggagacctgcctgaagatccgggagcaggagctgaagagcctgcggagccagctggatgtgacccacaaggaggtgggcatgctgcaccagcaggtggaggagcacgagaagatcaagcaggagatgaccatggagtacaagcaggagctgaagaagctgcacgaggagctgtgcatcctgaagaggagctatgagaagctgcagaagaagcagatgagggagttccggggcaacaccaagaaccaccgggaggacagaagtgaaattgagcggctgacagccaagattgaggagttccggcagaagagcctggactgggagaagcagaggctcatctaccagcagcaggtgagcagcctggaggcccagaggaaggccctggccgagcagagcgagatcatccaggcccagctggtgaacaggaagcagaagctggagagcgtggagctgagcagccagagcgagatccagcacctgagcagcaagctggagcgggccaatgacaccatctgtgccaatgagctggagattgagcggctgaccatgagggtgaatgacctggtgggcacctccatgacagtgctgcaggagcagcagcagaaggaggagaagctgcgggagagcgagaagctgctggaggccctgcaggaggagaagcgggagctgaaggccgccctgcagagccaggagaacctgatccacgaggcccgcatccagaaggagaagctgcaggagaaggtgaaggccaccaacacccagcacgctgtggaggccatcagcctggagagcgtgtctgccacctgcaagcagctgagccaggagctgatggagaagtatgaggagctgaagaggatggaggcccacaacaatgagtacaaggccgagatcaagaagctgaaggagcagatcctgcagggcgagcagagctacagcagcgccctggagggcatgaagatggagatcagccacctgacccaggagctgcaccagagggacatcaccatcgccagcaccaagggcagcagcagtgacatggagaagaggctgcgggcagagatgcagaaggccgaggacaaggctgtggagcacaaggagatcctggaccagctggagagcctgaagctggagaacagacacctgtctgagatggtgatgaagctggagctgggcctgcacgagcgctggggcttcaccatgctgagcagcctggtgctgaactttggcatccaggccatccggcagccccagaggcccaaggtgctggagctgcaggtgtag

SEQ ID NO: 19401 - DNA, 2340 bp, Artificial Sequence
  Description of Artificial Sequence: Synthetic coding sequence
atgagaattgaggagaggaagagccagcacctgaccggcctgacagatgagaaggtgaaggcctacctgagcctgcacccccaggtgctggatgaatttgtgtctgagagcgtgtctgctgagaccgtggagaagtggctgaagaggaagaacaacaagtcagaagatgagagcgcccccaaggaggtgagccgctaccaggacaccaacatgcagggcgtggtgtatgagctgaacagctacatcgagcagaggctggacaccggcggggacaaccagctgctgctgtatgagctgagcagcatcatcaagatcgccaccaaggcagatggctttgccctgtacttcctgggggagtgcaacaacagcctgtgcatcttcaccccacctggcatcaaggagggcaagcccaggctcatcccagctggccccatcacccagggcaccaccgtgtctgcctacgtggccaagagcaggaagaccctgctggtggaggacatcctgggagatgagcgcttcccccggggcaccggcctggagagcggcacccgcatccagagcgtgctgtgcctgcccatcgtgacagccatcggggacctgattggcatcctggagctgtaccgccactggggcaaggaggccttctgcctgagccaccaggaggtggccacagccaacctggcctgggcctctgtggccatccaccaggtgcaggtgtgccggggcctggccaagcagacagagctgaatgacttcctgctggatgtgtccaagacctactttgacaacatcgtggccatcgacagcctgctggagcacatcatgatctatgccaagaacctggtgaatgctgacagatgtgccctcttccaggtggaccacaagaacaaggagctgtacagcgacctgtttgacatcggggaggagaaggagggcaagcctgtgttcaagaagaccaaggagatccgcttcagcattgagaagggcattgctggccaggtggccaggactggagaggtgctgaacatcccagatgcctatgctgacccccgcttcaaccgggaggtggacctgtacacaggctacaccaccaggaacatcctgtgcatgcccatcgtgtcccggggctctgtgattggagtggtgcagatggtgaacaagatcagcggcagcgccttcagcaagacagatgagaacaacttcaagatgtttgctgtgttctgtgccctggccctgcactgtgccaacatgtaccaccgcatccgccacagcgagtgcatctacagagtgaccatggagaagctgagctaccacagcatctgcaccagcgaggagtggcagggcctgatgcagttcaccctgcctgtgcggctgtgcaaggagattgagctgttccactttgatattggcccctttgagaacatgtggccaggcatctttgtgtacatggtgcacaggagctgtggcaccagctgctttgagctggagaagctgtgccgcttcatcatgtctgtgaagaagaactaccgccgggtgccctaccacaactggaagcatgctgtgacagtggcccactgcatgtatgccatcctgcagaacaaccacaccctcttcacagacctggagaggaagggcctgctgattgcctgcctgtgccacgacctggaccaccggggcttcagcaacagctacctgcagaagtttgaccaccccctggccgccctgtacagcaccagcaccatggagcagcaccacttcagccagacagtgtccatcctgcagctggagggccacaacatcttcagcaccctgagcagcagtgaatatgagcaggtgctggagatcatcaggaaggccatcatcgccacagacctggccctgtactttggaaacaggaagcagctggaggagatgtaccagacaggcagcctgaacctgaacaaccagagccaccgggacagagtcatcggcctgatgatgacagcctgtgacctgtgcagcgtgaccaagctgtggcctgtgaccaagctgacagccaatgacatctatgcagagttctgggccgagggagatgagatgaagaagctgggcatccagcccatccccatgatggaccgggacaagaaggatgaggtgccccagggccagctgggcttctacaatgctgtggccatcccctgctacaccaccctgacccagatcctgcccccaacagagcccctgctgaaggcctgccgggacaacctgagccagtgggagaaggtgatccggggggaggagacagccacctggatcagcagccccagcgtggcccagaaggctgctgccagcgaggactag

SEQ ID NO: 19402 - DNA, 2112 bp, Artificial Sequence
  Description of Artificial Sequence: Synthetic coding sequence
atggctgctgccactggagaccccggcctgagcaagctgcagtttgcccccttcagcagcgccctggatgtgggcttctggcatgagctgacccagaagaagctgaatgagtaccgcctggatgaggcccccaaggacatcaagggctactactacaatggagacagcgctggcctgcctgcccggctgaccctggagttcagcgcctttgacatgtctgcccccaccccagcccgctgctgcccagccatcggcaccctgtacaacaccaacaccctggagagcttcaagacagctgacaagaagctgctgctggagcaggccgccaatgagatctgggagagcatcaagagcggcacagccctggagaaccctgtgctgctgaacaagttcctgctgctgacctttgctgacctgaagaagtaccacttctactactggttctgctacccagccctgtgcctgcctgagagcctgcccctcatccagggccctgtgggcctggaccagcgcttcagcctgaagcagatcgaggccctggagtgtgcctatgacaacctgtgccagacagagggcgtgacagccctgccctacttcctgatcaagtatgatgagaacatggtgctggtgtccctgctgaagcactacagcgacttcttccagggccagaggaccaagatcaccatcggcgtgtatgacccctgcaacctggcccagtacccaggctggcccctgaggaacttcctggtgctggccgcccaccgctggagcagcagcttccagagcgtggaggtggtgtgcttccgggacaggaccatgcagggcgccagagatgtggcccacagcatcatctttgaggtgaagctgcctgagatggccttctccccagactgccccaaggctgtgggctgggagaagaaccagaagggcggcatgggccccaggatggtgaacctgtctgagtgcatggaccccaagaggctggccgagagctctgtggacctgaacctgaagctgatgtgctggaggctggtgcccaccctggacctggacaaggtggtgtctgtgaagtgcctgctgctgggcgccggcaccctgggctgcaatgtggcccggaccctgatgggctggggcgtgcgccacatcacctttgtggacaatgccaagatctcctacagcaaccctgtgcggcagcccctgtatgaatttgaggactgcctgggcggcggcaagcccaaggccctggccgctgctgaccggctgcagaagatcttccctggggtgaatgcccggggcttcaacatgagcatccccatgcctggccaccctgtgaacttcagctctgtgaccctggagcaggccaggagagatgtggagcagctggagcagctgattgagagccatgatgtggtgttcctgctgatggacacccgggagagccgctggctgcctgctgtgattgctgccagcaagaggaagctggtgatcaatgctgccctgggctttgacacctttgtggtgatgagacatggcctgaagaagcccaagcagcagggcgctggggacctgtgccccaaccaccctgtggccagcgctgacctgctgggcagcagcctgtttgccaacatccctggctacaagctgggctgctacttctgcaatgatgtggtggcccctggggacagcacccgggacaggaccctggaccagcagtgcaccgtgtccaggcctggcctggccgtgattgctggggccctggccgtggagctgatggtgtctgtgctgcagcaccctgagggcggctacgccatcgccagcagcagtgatgacaggatgaatgaaccacccaccagcctgggcctggtgccccaccagatccggggcttcctgagcagatttgacaacgtgctgcctgtgtccctggcctttgataaatgtacagcctgcagcagcaaggtgctggaccagtatgagcgggagggcttcaacttcctggccaaggtgttcaacagcagccacagcttcctggaggacctgaccggcctgaccctgctgcaccaggagacccaggccgctgagatctgggacatgtctgatgatgagaccatctag

SEQ ID NO: 19403 - DNA, 3246 bp, Artificial Sequence
  Description of Artificial Sequence: Synthetic coding sequence
atggagagcgctggcctggagcagctgctgcgggagctgctgctgcctgacacagagcgcatccggcgggccacagagcagctgcagatcgtgctgcgggccccagctgccctgcctgccctgtgtgacctgctggccagcgctgctgacccccagatccggcagtttgctgctgtgctgacccggcggcggctgaacacccgctggaggcggctggccgctgagcagcgggagagcctgaagagcctcatcctgacagccctgcagcgggagacagagcactgtgtgtccctgagcctggcccagctgagcgccaccatcttcaggaaggagggcctggaggcctggccccagctgctgcagctgctgcagcacagcacccacagcccccacagccctgagcgggagatgggcctgctgctgctgtctgtggtggtgaccagcaggcctgaggccttccagccccaccaccgggagctgctgcggctgctgaatgagaccctgggggaggtgggcagccctggcctgctcttctacagcctgcggaccctgaccaccatggccccctacctgagcacagaagatgtgcccctggccaggatgctggtgcccaagctgatcatggccatgcagaccctcatccccattgatgaggccaaggcctgtgaggccctggaggccctggatgagctgctggagagcgaggtgcctgtgatcaccccctacctgtctgaggtgctgaccttctgcctggaggtggccagaaatgtggccctgggcaatgccatccgcatccgcatcctgtgctgcctgaccttcctggtgaaggtgaagagcaaggccctgctgaagaaccggctgctgccccccctgctgcacaccctcttccccatcgtggccgctgagcccccacctggccagctggaccctgaggaccaggacagcgaggaggaggagctggagattgagctgatgggagagacccccaagcactttgctgtgcaggtggtggacatgctggccctgcacctgcccccagagaagctgtgcccccagctgatgcccatgctggaggaggccctgcggtctgagagcccctaccagaggaaggccggcctgctggtgctggccgtgctgagtgatggagctggggaccacatccggcagaggctgctgccccccctgctgcagatcgtgtgcaagggcctggaggaccccagccaggtggtgagaaatgctgccctgtttgccctgggccagttcagcgagaacctgcagccccacatcagcagctacagccgggaggtgatgcccctgctgctggcctacctgaagtctgtgcccctgggccacacccaccacctggccaaggcctgctacgccctggagaactttgtggagaacctgggccccaaggtgcagccctacctgcctgagctgatggagtgcatgctgcagctgctgaggaaccccagcagcccccgggccaaggagctggccgtgtctgccctgggcgccatcgccacagctgcccaggccagcctgctgccctacttccctgccatcatggagcacctgcgggagttcctgctgaccggccgggaggacctgcagcctgtgcagatccagagcctggagaccctgggcgtgctggcccgggctgtgggggagcccatgaggcccctggccgaggagtgctgccagctgggcctgggcctgtgtgaccaggtggatgatcctgacctgcggcgctgcacctacagcctgtttgctgccctgagcggcctgatgggagagggcctggccccccacctggagcagatcaccaccctgatgctgctgagcctgcggagcacagagggcatcgtgccccagtatgatggcagcagcagcttcctgctgtttgatgatgaaagtgatggagaggaggaggaggagctgatggatgaagatgtggaggaggaggatgacagcgagatcagcggctacagcgtggagaatgccttctttgatgagaaggaggacacctgtgccgctgtgggggagatctctgtgaacacctctgtggccttcctgccctacatggagagcgtgtttgaggaggtgttcaagctgctggagtgcccccacctgaatgtgaggaaggccgcccacgaggccctgggccagttctgctgtgccctgcacaaggcctgccagagctgccccagcgagcccaacacagctgccctgcaggccgccctggcccgggtggtgcccagctacatgcaggccgtgaaccgggagcgggagcggcaggtggtgatggctgtgctggaggccctgactggagtgctgcggagctgtggcaccctgaccctgaagcccccaggccgcctggccgagctgtgtggggtgctgaaggctgtgctgcagaggaagacagcctgccaggacacagatgaggaggaggaggaggaggatgatgaccaggccgagtatgatgccatgctgctggagcacgccggggaggccatcccagccctggccgctgctgctggaggagacagctttgcccccttctttgctggcttcctgcccctgctggtgtgcaagaccaagcagggctgcaccgtggccgagaagagctttgctgtgggcaccctggccgagaccatccagggcctgggcgccgccagcgcccagtttgtgtcccggctgctgcctgtgctgctgagcacagcccaggaggccgaccctgaggtgcgcagcaatgccatcttcggcatgggcgtgctggccgagcacggcggccacccagcccaggagcacttccccaagctgctgggcctgctcttccccctgctggcccgggagagacatgacagagtgcgggacaacatctgtggggccctggcccggctgctgatggccagccccaccaggaagccagagccccaggtgctggccgccctgctgcacgccctgcccctgaaggaggacctggaggagtgggtgaccatcggccgcctcttctccttcctgtaccagagcagcccagaccaggtgattgatgtggcccctgagctgctgcgcatctgcagcctcatcctggccgacaacaagatccccccagacaccaaggccgccctgctgctgctgctgaccttcctggccaagcagcacacagacagcttccaggccgccctgggcagcctgcctgtggacaaggcccaggagctgcaggccgtgctgggcctgtcctag

SEQ ID NO: 19404 - DNA, 7224 bp, Artificial Sequence
  Description of Artificial Sequence: Synthetic coding sequence
atggtgggggagagacatgctggggacctgatggtgcccctgggcccccggctgcaggcctacccagaggagctgatccggcagaggcctggccatgatggccaccctgagtacctgatccgctggagcgtgctgaagtgtggggaggtgggcaaggtgggcgtggaggagggcaaggccgagcacatcctgatgtggctgagcgcccctgaggtgtatgccaactgccccggcctgctgggggagcgggccctgagcaagggcctgcagcacgagcctgctggggtgtctggcagcttcccccgggaccccggcggcctggatgaggtggccatgggagagatggaggctgatgtgcaggccctggtgcggcgggccgcccggcagctggccgagagcggcacccccagcctgacagctgctgtgctgcacaccatccacgtgctgagcgcctatgccagcatcggccccctgactggagtcttccgggagactggagccctggacctgctgatgcacatgctgtgcaaccctgagccccagatcagaagatctgctgggaagatgctgcaggccctggccgcccatgatgctggcagccgggcccacgtgctgctgagcctgagccagcaggacggcatcgagcagcacatggactttgacagccgctacaccctgctggagctgtttgctgagaccaccagcagcgaggagcactgcatggcctttgagggcatccacctgccccagatccctgggaagctgctcttcagcctggtgaagcgctacctgtgtgtgaccagcctgctggaccagctgaacagcagccctgagctgggcgctggggaccagagcagcccctgtgccacccgggagaagagccggggccagcgggagctggagttctccatggctgtgggcaacctgatcagcgagctggtgcgctccatgggctgggccaggaacctgtctgagcagggcatgagccccccccggcccaccaggagcatcttccagccctacatcagcggccccagcctgctgctgcccaccatcgtgaccaccccccggcggcagggctgggtgttccggcagaggtctgagttcagcagccgcagcggctatggagaatatgtgcagcagaccctgcagcccggcatgagggtgaggatgctggatgattatgaggagatctctgctggagatgaaggagagttccggcagagcaacaacggcatcccccctgtgcagaccctgggggagaaggccctgggggagatctctgtgtctgtggagatggccgagagcctgctgcaggtgctgagcagcagatttgagggcagcaccctgaatgacctgctgaacagccagatctacaccaagtatggcctgctgagcaatgagcccagcagcagcagcaccagcaggaaccacagctgcaccccagaccctgaggaggagagcaagtctgaggccagcttcagcgaggaggagacagagagcctgaaggccaaggccgaggcccccaagacagaagctgagcccaccaagaccaggacagagacccccatggcccagagcgacagccagctgttcaaccagctgctggtgacagagggcatgaccctgcccacagagatgaaggaggccgccagcgagatggcccgggccctgcggggccctggccccaggagcagcctggaccagcacgtggccgctgtggtggccaccgtgcagatcagcagcctggacaccaacctgcagctgagcggcctgagcgccctgagccaggccgtggaggaggtgacagagcgggaccaccccctggtgcggccagacaggagcctgcgggagaagctggtgaagatgctggtggagctgctgaccaaccaggtgggggagaagatggtggtggtgcaggccctgcggctgctgtacctgctgatgaccaagcatgagtggaggcccctgtttgcccgggagggcggcatctatgctgtgctggtgtgcatgcaggagtacaagacctctgtgctggtgcagcaggccggcctggccgccctgaagatgctggccgtggccagcagcagcgagatccccacctttgtgacaggccgggacagcatccacagcctgtttgatgcccagatgacccgggagatctttgccagcattgattctgccaccaggcctggcagcgagagcctgctgctgactgtgcctgctgctgtgatcctgatgctgaacacagagggctgcagcagcgctgccagaaatggcctgctgctgctgaacctgctgctgtgcaaccaccacaccctgggggaccagatcatcacccaggagctgcgggacaccctcttccgccacagcggcatcgcccccaggacagagcccatgcccaccaccaggaccatcctgatgatgctgctgaaccgctacagcgagcccccaggcagccctgagcgggccgccctggagacccccatcatccagggccaggacggcagccctgagctgctgatccgcagcctggtgggcggccccagcgctgagctgctgctggacctggagcgggtgctgtgccgggagggcagccctggaggagctgtgcggcccctgctgaagaggctgcagcaggagacccagcccttcctgctgctgctgcggaccctggatgcccctggccccaacaagaccctgctgctgtctgtgctgcgggtcatcacccggctgctggacttccctgaggccatggtgctgccctggcatgaggtgctggagccctgcctgaactgcctgagcggccccagcagtgacagcgagatcgtgcaggagctgacctgcttcctgcaccggctggcctccatgcacaaggactatgctgtggtgctgtgctgcctgggcgccaaggagatcctgagcaaggtgctggacaagcacagcgcccagctgctgctgggctgtgagctgcgggacctggtgacagaatgtgagaagtatgcccagctgtacagcaacctgaccagcagcatcctggccggctgcatccagatggtgctgggccagatcgaggaccacaggaggacccaccagcccatcaacatccccttctttgatgtgttcctgcggcacctgtgccagggcagctctgtggaggtgaaggaggacaagtgctgggagaaggtggaggtgagcagcaacccccaccgggccagcaagctgacagaccacaaccccaagacctactgggagagcaatggcagcacaggcagccactacatcaccctgcacatgcaccggggcgtgctggtgcggcagctgaccctgctggtggccagcgaggacagcagctacatgcctgcccgggtggtggtgtttggaggagacagcaccagctgcattggaacagagctgaacacagtgaatgtgatgcccagcgccagcagggtcatcctgctggagaacctgaaccgcttctggcccatcatccagatccgcatcaagcgctgccagcagggcggcatcgacaccagggtgcggggcgtggaggtgctgggccccaagcccaccttctggcccctcttccgggagcagctgtgcaggaggacctgcctcttctacaccatccgggcccaggcctggagccgggacattgctgaggaccaccggcggctgctgcagctgtgcccccggctgaacagagtgctgcggcatgagcagaactttgctgaccgcttcctgcctgatgatgaagctgcccaggccctgggcaagacctgctgggaggccctggtgagccccctggtgcagaacatcaccagcccagatgctgagggcgtgtctgccctgggctggctgctggaccagtacctggagcagcgggagaccagcaggaaccccctgagcagagctgccagctttgccagccgggtgcggcggctgtgccacctgctggtgcacgtggagcccccacctggccccagccctgagcccagcacccggcccttcagcaagaacagcaagggccgggacaggagccctgcccccagccctgtgctgcccagcagcagcctgaggaacatcacccagtgctggctgtctgtggtgcaggagcaggtgagccgcttcctggccgccgcctggagggccccagactttgtgccccgctactgcaagctgtatgagcacctgcagagagctggcagcgagctgtttggcccccgggccgccttcatgctggccctgcggagcggcttcagcggggccctgctgcagcagagcttcctgacagctgcccacatgtctgagcagtttgcccgctacatcgaccagcagatccagggcggcctcatcggcggggcccctggggtggagatgctgggccagctgcagaggcacctggagcccatcatggtgctgagcggcctggagctggccaccacctttgagcacttctaccagcactacatggctgaccggctgctgagctttggcagctcctggctggagggcgctgtgctggagcagatcggcctgtgcttccccaaccggctgccccagctgatgctgcagagcctgagcaccagcgaggagctgcagaggcagttccacctgttccagctgcagaggctggacaagctgttcctggagcaggaggatgaggaggagaagaggctggaggaggaggaggaggaggaggaggaggaggaggccgagaaggagctgttcatcgaggaccccagccctgccatcagcatcctggtgctgagcccccgctgctggcctgtgagccccctgtgctacctgtaccaccccaggaagtgcctgcccacagagttctgtgatgccctggaccgcttcagcagcttctacagccagagccagaaccaccctgtgctggacatgggcccccaccggcggctgcagtggacctggctgggccgggcagagctgcagtttgggaagcagatcctgcacgtgtccacagtgcagatgtggctgctgctgaagttcaaccagacagaggaggtgtctgtggagaccctgctgaaggacagcgacctgagccctgagctgctgctgcaggccctggtgcccctgaccagcggaaatggccccctgaccctgcacgagggccaggacttcccccacggcggcgtgctgcggctgcacgagcccggcccccagaggtctggagaggccctgtggctgatccccccccaggcctacctgaatgtggagaaggatgagggccgcaccctggagcagaagaggaacctgctgagctgcctgctggtgcgcatcctgaaggcccatggagagaagggcctgcacatcgaccagctggtgtgcctggtgctggaggcctggcagaagggccccaaccccccaggcaccctgggccacacagtggccggcggcgtggcctgcaccagcacagatgtgctgagctgcatcctgcacctgctgggccagggctacgtgaagagaagagatgaccggccccagatcctgatgtatgctgcccctgagcccatgggcccctgccggggccaggctgatgtgcccttctgtggcagccagagcgagaccagcaagcccagccctgaggccgtggccaccctggccagcctgcagctgcctgctggccgcaccatgagcccccaggaggtggagggcctgatgaagcagacagtgcggcaggtgcaggagaccctgaacctggagccagatgtggcccagcacctgctggcccacagccactggggcgctgagcagctgctgcagagctacagcgaggaccctgagcccctgctgctggccgccggcctgtgtgtgcaccaggcccaggccgtgcctgtgcggccagaccactgccctgtgtgtgtgagccccctgggctgtgatgatgacctgcccagcctgtgctgcatgcactactgctgcaagagctgctggaatgagtacctgaccaccagaattgagcagaacctggtgctgaactgcacctgccccatcgctgactgcccagcccagcccactggagccttcatccgggccatcgtgagcagccctgaggtgatcagcaaatatgagaaggccctgctgcggggctacgtggagagctgcagcaacctgacctggtgcaccaacccccagggctgtgaccgcatcctgtgccggcagggcctgggctgcggcaccacctgcagcaaatgtggctgggccagctgcttcaactgcagcttccctgaggcccactacccagccagctgtggccacatgagccagtgggtggatgatggcggctactatgatggcatgtctgtggaggcccagagcaagcacctggccaagctgatcagcaagcgctgccccagctgccaggcccccatcgagaagaatgaaggctgcctgcacatgacctgtgccaagtgcaaccacggcttctgctggcgctgcctgaagtcctggaagcccaaccacaaggactactacaactgcagcgccatggtgtccaaggccgcccggcaggagaagcgcttccaggactacaatgaacgctgcaccttccaccaccaggcccgggagtttgctgtgaacctgaggaacagagtgtctgccatccacgaggtgcccccacccaggagcttcaccttcctgaatgatgcctgccagggcctggagcaggccaggaaggtgctggcctatgcctgtgtgtacagcttctacagccaggatgctgagtacatggatgtggtggagcagcagacagagaacctggagctgcacaccaatgccctgcagatcctgctggaggagaccctgctgcgctgccgggacctggccagcagcctgcggctgctgcgggctgactgcctgagcacaggcatggagctgctgcggcgcatccaggagcggctgctggccatcctgcagcacagcgcccaggacttccgggtgggcctgcagagccccagcgtggaggcctgggaggccaagggccccaacatgcctggcagccagccccaggccagcagcggccctgaggccgaggaggaggaggaggatgatgaagatgatgtgcctgagtggcagcaggatgaatttgatgaggagctggacaatgacagcttctcctatgatgaaagtgagaacctggaccaggagaccttcttctttggagatgaggaggaggatgaagatgaggcctatgactag

SEQ ID NO: 19405 - DNA, 672 bp, Artificial Sequence
  Description of Artificial Sequence: Synthetic coding sequence
atggaggatgtgaagctggagttccccagcctgccccagtgcaaggaggatgctgaggagtggacctaccccatgaggcgggagatgcaggagatcctgcccggcctcttcctgggcccctacagcagcgccatgaagagcaagctgcctgtgctgcagaagcacggcatcacccacatcatctgcatccggcagaacatcgaggccaacttcatcaagcccaacttccagcagctgttccgctacctggtgctggacattgctgacaaccctgtggagaacatcatccgcttcttccccatgaccaaggagttcattgatggcagcctgcagatgggcggcaaggtgctggtgcatggaaatgccggcatcagccgctctgctgccttcgtcatcgcctacatcatggagaccttcggcatgaagtacagagatgcctttgcctacgtgcaggagcggcgcttctgcatcaaccccaatgccggctttgtgcaccagctgcaggagtatgaggccatctacctggccaagctgaccatccagatgatgagccccctgcagatcgagaggagcctgtctgtgcacagcggcaccaccggcagcctgaagaggacccatgaggaggaggatgactttggcaccatgcaggtggccacagcccagaatggatag

SEQ ID NO: 19406 - DNA, 1689 bp, Artificial Sequence
  Description of Artificial Sequence: Synthetic coding sequence
atggatgacaagggggaccccagcaatgaggaggcccccaaggccatcaagcccaccagcaaggagttcaggaagacctggggcttccggaggaccaccatcgccaagcgggagggcgctggagatgctgaggccgaccccctggagcccccaccaccccagcagcagctgggcctgagcctgcggcgcagcggccggcagcccaagaggacagagcgggtggagcagttcctgaccatcgccaggagaagaggccgccgctccatgcctgtgtccctggaggacagcggggagcccaccagctgcccagccacagatgctgagacagccagcgagggctctgtggagagcgccagcgagaccaggagcggcccccagagcgccagcacagctgtgaaggagaggcctgccagcagcgagaaggtgaagggaggagatgaccatgatgacaccagtgacagcgacagtgatggcctgaccctgaaggagctgcagaaccggctgcggaggaagcgggagcaggagcccacagagcggcccctgaagggcatccagagccggctgaggaagaagaggcgggaggagggccctgctgagaccgtgggcagcgaggccagtgacacagtggagggcgtgctgcccagcaagcaggagccagaaaatgaccagggcgtggtgtcccaggccggcaaggatgaccgggagagcaagctggagggcaaggccgcccaggacatcaaggatgaggagcccggggacctgggccggcccaagccagaatgtgagggctatgaccccaatgccctgtactgcatctgccggcagccccacaacaaccgcttcatgatctgctgtgacagatgtgaggagtggttccatggagactgtgtgggcatcagcgaggcccggggccgcctgctggagagaaatggagaggactacatctgccccaactgcaccatcctgcaggtgcaggatgagacccacagcgagacagctgaccagcaggaggccaagtggaggcctggagatgctgatggaacagactgcaccagcatcggcaccatcgagcagaagagcagcgaggaccagggcatcaagggccgcatcgagaaggccgccaaccccagcggcaagaagaagctgaagatcttccagcctgtgattgaggcccctggggccagcaagtgcatcggccctggctgctgccacgtggcccagcctgacagcgtgtactgcagcaatgactgcatcctgaagcacgccgccgccaccatgaagttcctgagcagcggcaaggagcagaagcccaagcccaaggagaagatgaagatgaagccagagaagcccagcctgcccaagtgtggggcccaggccggcatcaagatcagctctgtgcacaagaggcctgcccctgagaagaaggagaccaccgtgaagaaggctgtggtggtgcctgcccggtctgaggccctgggcaaggaggccgcctgtgagagcagcacccccagctgggccagtgaccacaactacaatgctgtgaagccagagaagacagctgcccccagccccagcctgctgtacaagtgcatgtaccacctgggcgtgggcctgctggaccccagccgctccttctggatcgccatcccctgggcctgccccggcctgggcgtggccgccctgtgctag

SEQ ID NO: 19407 - DNA, 360 bp, Artificial Sequence
  Description of Artificial Sequence: Synthetic coding sequence
atgatcctgcagcagcccctgcagaggggcccccagggcggggcccagaggctgcccagggctgccctgggcgtgacctggggcctggatgcccgggagcccctgaggaagcagttcctgtctgaggagaacatggccacccacttcagccagctgagcctgcacaatgaccacccctactgcagcccccccatgaccttctccccagccctgccccccctgcggagcccctgcagcgagctgctgctgtggagatacccaggcagcctcatccctgaggccctgcggctgctgcggctgggggacacccccagccccccctacccagccaccccagctggggacatcatggagctgtag

SEQ ID NO: 19408 - DNA, 1794 bp, Artificial Sequence
  Description of Artificial Sequence: Synthetic coding sequence
atggtgcctgaggagcggcgggtgggcctgagcagtgatgagaccagcagtgacagcctgaagtcctggcacagcatctgtgtgctggacagcaaggagcagcccctggcctgccagcagaagcagaggcagtttgtgaagcctgtgacagagagcgagcagcccaccgtgctggagctgctgctggccgagctgcggaccctcttctctgctgtgctgcaggacagcagccctgctgcctggagatacctgcatgctgtgctgggcctgctgcccccctaccgggagctgctggtgggccacctggacctgctgcccttcctggagcagctgtactgctgggccccctgggtgcagacccacctgcacctggacctgctgggcgccatcgtgcaggccttccccccagacagcagcctgctggacagcgccagccatgctgactgctgcccccagaagaggcggctgcaccaccggcccccctgcccagcctgcccctttgtgcaggcccagtggagccggcagcaggtgaaggaggagctggccacctggctgcggcccctgaccctgcctgagctgcagcgctgcctgggcatcgtgggcgcccaggtggccctggaggaggccgtgtggctggatggcctgagcctgctgcccctggccctggccgctgacatccctgtgcgctatgagagcagtgacacagacaatgctgaggtggagcctgtgggcaggaaggagaccaggagccagctggactatgaggtgccccgggagaaggccttccagaagagcagcacaggcttcagccctgagaccagcttcctggacagccaggtgatgacagccctgaagatggagcgctacctgaagaagatccacttcctgtacctgaatgtggcccccagccgctacttccggccctacagcctgatggtggtgcccccagacaaggtgaaccctgagcactacatcttcagccccttcggcatcctgcacgtgcaccctgtggagggcagcgagaccatgaccctgggcacctggcaccaccactgtgtgctgtggcagcagctgcagttcatccccttcttcaagtactgcctgctgaggaagagcttcacctgctggaagaagaatgtgcggctgcagggcctgcaccggctgcagaagttcctggagaaccacctgctgctggccgtgccccactttggagctggcctgctgcacatcagccggctgctgcaggagctgcacagcgtgtcctggctgccccaggagctggaccgctgctatgagctgctggacctgcagacagccctggccgaggagaagcacaaggccctgcggctgctgcaccgctgcctgaacctgtgcaccagcatcctgcggctggtgcatgaggacacctaccacatgcagcagtgcctgcaggagcgggtgcagaactgtgaccgcatcagaacaggccagggcagcatctacctgcagagggtgcagcacaagcagctggagcagaagctgaagcaggccgaggcctggtggctgcagctgggcaagtttgcccggctggtggactacatgatctgccagagcctcatctctgtgctggaggagcagatcaccagctttgtggccaacatcctgcaggccccccggcagaagcccttcctgagcagccagctggtgtttgatgaccacggccagctgagccacgtgccctgtgtggagaacatgatccagaccctgactggaggcctgcagagcgtgaagaccagcgccctgcaggtgttctag

SEQ ID NO: 19409 - DNA, 591 bp, Artificial Sequence
  Description of Artificial Sequence: Synthetic coding sequence
atggaggacctgtttgagaccttccaggatgagatgggcttcagcaacatggaggatgatggccctgaggaggaggagcgggtggccgagccccaggccaacttcaacaccccccaggccctgcgctttgaggagctgctggccaacctgctgaatgagcagcaccagatcgccaaggagctgtttgagcagctgaagatgaagaagcccagcgccaagcagcagaaggaggtggagaaggtgaagccccagtgcaaggaggtgcaccagaccctcatcctggaccctgcccagaggaagaggctgcagcagcagatgcagcagcacgtgcagctgctgacccagatccacctgctggccacctgcaaccccaacctgaaccctgaggccagcagcacccgcatctgcctgaaggagctgggcacctttgcccagagcagcatcgccctgcaccaccagtacaaccccaagttccagaccctcttccagccctgcaacctgatgggcgccatgcagctgattgaggacttcagcacccacgtgtccattgactgcagcccccacaagacagtgaagaagacagtgtgctag

SEQ ID NO: 19410 - DNA, 888 bp, Artificial Sequence; identical to SEQ ID NO: 19226
  Description of Artificial Sequence: Synthetic coding sequence

SEQ ID NO: 19411 - DNA, 915 bp, Artificial Sequence
  Description of Artificial Sequence: Synthetic coding sequence
atgaagagggcccaccctgagtacagcagcagtgacagcgagctggatgagaccatcgaggtggagaaggagagcgcagatgaaaatggaaacctgagcagcgccctgggctccatgagccccaccaccagcagccagatcctggccaggaagagaagaagaggcatcatcgagaagagaagaagagaccgcatcaacaacagcctgtctgagctgcggcggctggtgcccagcgcctttgagaagcagggcagcgccaagctggagaaggccgagatcctgcagatgacagtggaccacctgaagatgctgcacacagctgggggcaagggctactttgatgcccacgccctggccatggactaccgcagcctgggcttcagagaatgtctggccgaggtggcccgctacctgagcatcatcgagggcctggatgccagtgaccccctgcgggtgcggctggtgagccacctgaacaactatgccagccagcgggaggccgccagcggggcccatgctggcctgggccacatcccctggggcaccgtgtttggccaccacccccacatcgcccaccccctgctgctgccccagaatggacatggaaatgccggcaccacagccagccccacagagccccaccaccagggccgcctgggcagcgcccaccctgaggccccagccctgcgggccccacccagcggcagcctgggccctgtgctgcctgtggtgaccagcgccagcaagctgagcccccccctgctgagctctgtggccagcctgagcgccttccccttctcctttggcagcttccacctgctgagccccaatgccctgagccccagcgcccccacccaggccgccaacctgggcaagccctaccggccctggggcacagaaattggagccttctag

SEQ ID NO: 19412 - DNA, 2529 bp, Artificial Sequence
  Description of Artificial Sequence: Synthetic coding sequence
atgtgtggcagcgagcgcatcctgcaggccggcaacatcctggagatccgggtgggccaggccggggcccggcgggtggccaccatgaccagccctgtgctggtggacatccgggaggaggtgacctgccccatctgcctggagctgctgacagagcccctgagcattgactgtggccacagcttctgccaggcctgcatcacccccaacggccgggagagcgtcatcggccaggagggggagaggagctgccctgtgtgccagaccagctaccagcccggcaacctgcggcccaacagacacctggccaacatcgtgcggcggctgcgggaggtggtgctgggccctgggaagcagctgaaggctgtgctgtgtgccgaccacggggagaagctgcagctgttctgccaggaggatggcaaggtgatctgctggctgtgtgagaggagccaggagcaccggggccaccacaccttcctggtggaggaggtggcccaggagtaccaggagaagttccaggagagcctgaagaagctgaagaatgaggagcaggaggccgagaagctgacagccttcatccgggagaagaagacctcctggaagaaccagatggagcctgagcgctgccgcatccagacagagttcaaccagctgaggaacatcctggacagagtggagcagcgggagctgaagaagctggagcaggaggagaagaagggcctgcgcatcatcgaggaggccgagaatgacctggtgcaccagacccagagcctgcgggagctgatcagtgacctggagcggcgctgccagggcagcaccatggagctgctgcaggatgtgtctgatgtgacagagaggtctgagttctggaccctgaggaagccagaggccctgcccaccaagctgcgctccatgttccgggccccagacctgaagaggatgctgcgggtgtgccgggagctgacagatgtgcagagctactgggccatccagggcagcctgacccggcgggagcggcgggccagcggcgtgaggaccaggaggagccagggcagcagcgccatggccagcaagatcctgctgaatgtgcaggaggaggtgacctgccccatctgcctggagctgctgacagagcccctgagcctggactgtggccacagcctgtgccgggcctgcatcaccgtgagcaacaaggaggccgtgacctccatgggcggcaagagcagctgccctgtgtgtggcatctcctacagctttgagcacctgcaggccaaccagcacctggccaacatcgtggagcggctgaaggaggtgaagctgagcccagacaacgggaagaagagggacctgtgtgaccaccacggggagaagctgctgctcttctgcaaggaggacaggaaggtgatctgctggctgtgtgagaggagccaggagcaccggggccaccacacagtgctgacagaggaggtgttcaaggagtgccaggagaagctgcaggccgtgctgaagaggctgaagaaggaggaggaggaggccgagaagctggaggccgacatccgggaggagaagacctcctggaagtaccaggtgcagacagagcggcagaggatccagacagaatttgaccagctgcggagcatcctgaacaatgaggagcagcgggagctgcagaggctggaggaggaggagaagaagaccctggacaagtttgctgaggccgaggatgagctggtgcagcagaagcagctggtgcgggagctgatcagtgatgtggagtgccgcagccagtggagcaccatggagctgctgcaggacatgagcggcatcatgaagtggagcgagatctggaggctgaagaagcccaagatggtgtccaagaagctgaagacagtgttccacgccccagacctgagcaggatgctgcagatgttccgggagctgacagctgtgcgctgctactgggtggatgtgaccctgaacagcgtgaacctgaacctgaacctggtgctgtctgaggaccagaggcaggtgatctctgtgcccatctggcccttccagtgctacaactacggcgtgctgggcagccagtacttcagcagcggcaagcactactgggaggtggatgtgtccaagaagacagcctggatcctgggcgtgtactgcaggacctacagccgccacatgaagtatgtggtgagaagatgtgccaaccggcagaacctgtacaccaagtaccggcccctgtttggctactgggtgattggcctgcagaacaagtgcaagtatggagtgtttgaggagagcctgagcagtgaccctgaggtgctgaccctgtccatggctgtgcccccctgccgggtgggcgtcttcctggactatgaagctggcatcgtgtccttcttcaacgtgaccagccacggcagcctcatctacaagttcagcaagtgctgcttcagccagcctgtgtacccctacttcaacccctggaactgcccagcccccatgaccctgtgcccccccagcagctag

SEQ ID NO: 19413 - DNA, 1497 bp, Artificial Sequence
  Description of Artificial Sequence: Synthetic coding sequence
atgaatggagccctggaccacagcgaccagcctgaccctgatgccatcaagatgtttgtgggccagatccccaggtcctggagcgagaaggagctgaaggagctgtttgagccctatggagctgtgtaccagatcaacgtgctgcgggacaggagccagaaccccccccagagcaagggctgctgctttgtgaccttctacaccaggaaggccgccctggaggcccagaatgccctgcacaacatcaagaccctgcccggcatgcaccaccccatccagatgaagccagctgacagcgagaagagcaatgctgtggaggacaggaagctgttcatcggcatggtgtccaagaagtgcaatgaaaatgacatccgggtgatgttcagccccttcggccagatcgaggagtgccgcatcctgcggggcccagatggcctgagccggggctgtgcctttgtgaccttcagcacccgggccatggcccagaatgccatcaaggccatgcaccagagccagaccatggagggctgcagcagccccatcgtggtgaagtttgctgacacccagaaggacaaggagcagaggcggctgcagcagcagctggcccagcagatgcagcagctgaacacagccacctggggcaacctgaccggcctgggcggcctgaccccccagtacctggccctgctgcagcaggccaccagcagcagcaacctgggcgccttcagcggcatccagcagatggccggcatgaatgccctgcagctgcagaacctggccaccctggccgctgctgctgctgctgcccagaccagcgccaccagcaccaatgccaaccccctgagcaccaccagcagcgccctgggcgccctgaccagccctgtggccgccagcacccccaacagcacagctggggccgccatgaacagcctgaccagcctgggcaccctgcagggcctggccggggccaccgtgggcctgaacaacatcaatgccctggccgcccccaggagcaagaggctgctgctgcccaaggacaacaacggcatggccgccctgaatggaggcctgggcgccaccggcctgaccaacggcacagctggcaccatggatgccctgacccaggcctacagcggcatccagcagtatgctgctgctgccctgcccaccctgtacagccagagcctgctgcagcagcagagcgctgctggcagccagaaggagggccctgagggcgccaacctcttcatctaccacctgccccaggagtttggagaccaggacatcctgcagatgttcatgccctttggaaatgtcatcagcgccaaggtgttcatcgacaagcagaccaacctgagcaagtgcttcggctttgtgtcctatgacaaccctgtgtctgcccaggccgccatccaggccatgaatggcttccagatcggcatgaagaggctgaaggtgcagctgaagaggagcaagaatgacagcaagccctactag

SEQ ID NO: 19414 - DNA, 2580 bp, Artificial Sequence
  Description of Artificial Sequence: Synthetic coding sequence
atgctggaggtgctggaggagatctggagcgtgcgggcccggcgggcccaccggccctgccccggccccagcctggctgatgacacagatgccaacagcaatggcagcagtggaaatgaaagcaatggccacgagagcagaggagccagccagaggagcagccacagcagcagcagtggaaatggcaaggacagcgccctgctggagaccacagagagcagcaagagcaccaacagccagagccccagcccccccagcagcagcatcgcctacagcctgctgagcgccagcagcgagcaggacaaccccagcaccagcggctgcagcagcgagcagagcgcccgggcccggacccagaaggagctgatgacagccctgcgggagctgaagctgcggctgcccccagagcggcggggcaagggccgcagcggcaccctggccaccctgcagtatgccctggcctgtgtgaagcaggtgcaggccaaccaggagtactaccagcagtggagcctggaggagggggagccctgcagcatggacatgagcacctacaccctggaggagctggagcacatcaccagcgagtacaccctgcagaaccaggacaccttctctgtggccgtgtccttcctgaccggcagaattgtgtacatcagcgagcaggccgctgtgctgctgcgctgcaagagagatgtgttccggggcacccgcttcagcgagctgctggccccccaggatgtgggcgtcttctacggcagcacagcccccagccggctgcccacctggggcaccggggccagcgctggcagcggcctgcgggacttcacccaggagaagagcgtcttctgccgcatccggggcggccctgaccgggaccccggcccccgctaccagcccttccggctgaccccctacgtgaccaagatccgggtgtctgatggagccccagcccagccctgctgcctgctgattgctgagcgcatccacagcggctatgaggccccccgcatccccccagacaagaggatcttcaccaccaggcacacccccagctgcctcttccaggatgtggatgaaagagctgcccccctgctgggctacctgccccaggacctgctgggcgcccctgtgctgctcttcctgcaccctgaggaccggcccctgatgctggccatccacaagaagatcctgcagctggccggccagccctttgaccacagccccatccgcttctgtgccagaaatggagaatatgtgaccatggacacctcctgggccggctttgtgcacccctggagcaggaaggtggcctttgtgctgggccgccacaaggtgaggacagcccccctgaatgaagatgtgttcaccccaccagcccccagccctgcccccagcctggacacagacatccaggagctgtctgagcagatccaccggctgctgctgcagcctgtgcacagccccagccccaccggcctgtgtggggtgggcgctgtgaccagccctggccccctgcacagccctggcagcagcagtgacagcaatggaggagatgctgagggccctggccccccagcccctgtgaccttccagcagatctgcaaggatgtgcacctggtgaagcaccagggccagcagctgttcatcgagagccgggcccggccccagagccggccccggctgcctgccaccggcaccttcaaggccaaggccctgccctgccagagcccagaccctgagctggaggccggcagcgcccctgtgcaggcccccctggccctggtgcctgaggaggccgagaggaaggaggccagcagctgcagctaccagcagatcaactgcctggacagcatcctgcgctacctggagagctgcaacctgcccagcaccaccaagaggaaatgtgccagcagcagcagctacaccaccagcagcgccagtgatgatgaccggcagaggacaggccctgtgtctgtgggcaccaagaaggaccccccatctgctgccctgtctggagagggcgccacccccaggaaggagcctgtggtgggcggcaccctgagccccctggccctggccaacaaggccgagagcgtggtgtctgtgaccagccagtgcagcttcagcagcaccatcgtgcacgtgggggacaagaagcccccagagagtgacatcatcatgatggaggacctgcccggcctggcccctggccctgcccccagccctgcccccagccccaccgtggccccagaccctgccccagatgcctacagacctgtgggcctgaccaaggctgtgctgagcctgcacacccagaaggaggagcaggccttcctgagccgcttccgggacctgggccgcctgcggggcctggacagcagcagcacagcccccagcgccctgggggagcggggcagccacctgggccccccaggggcctgccccctgcccagcctgggcctggactgctggggcgtgggcctgaagggcggcgtgtctgcccctggcacccaggccggcgtggccagcaccacccggccctgcctgggcaccggccccagcctggccagcccccactag

SEQ ID NO: 19415 - DNA, 1266 bp, Artificial Sequence
  Description of Artificial Sequence: Synthetic coding sequence
atggccagcagctctgtgcccccagccaccgtgtctgctgccacagctggccctggccctggcttcggctttgccagcaagaccaagaagaagcactttgtgcagcagaaggtgaaggtgttccgggctgctgaccccctggtgggcgtcttcctgtggggcgtggcccacagcatcaatgagctgagccaggtgcccccacctgtgatgctgctgcctgatgacttcaaggccagcagcaagatcaaggtgaacaaccacctgttccaccgggagaacctgcccagccacttcaagttcaaggagtactgcccccaggtgttcaggaacctgcgggacagatttggaattgatgaccaggactacctggtgtccctgaccaggaacccccccagcgagagcgagggcagtgatggccgcttcctgatctcctatgacaggaccctggtgatcaaggaggtgtccagtgaagatattgctgacatgcacagcaacctgagcaactaccaccagtacatcgtgaagtgccacggcaacaccctgctgccccagttcctgggcatgtacagagtgtctgtggacaatgaagacagctacatgctggtgatgaggaacatgttcagccaccggctgcctgtgcacaggaaatatgacctgaagggcagcctggtgtcccgggaggccagtgacaaggagaaggtgaaggagctgcccaccctgaaggacatggacttcctgaacaagaaccagaaggtgtacatcggggaggaggagaagaagatcttcctggagaagctgaagagagatgtggagttcctggtgcagctgaagatcatggactacagcctgctgctgggcatccatgacatcatccggggcagcgagcctgaggaggaggcccctgtgcgggaggatgaaagtgaggtggatggagactgcagcctgaccggccccccagccctggtgggcagctatggcaccagccctgagggcatcggcggctacatccacagccaccggcccctgggccctggagaatttgagagcttcattgatgtgtatgccatccgctctgctgagggcgccccccagaaggaggtgtacttcatgggcctgattgacatcctgacccagtatgatgccaagaagaaggccgcccacgccgccaagacagtgaagcacggggccggggctgagatcagcacagtgcaccctgagcagtatgccaagcgcttcctggacttcatcaccaacatctttgcctag

SEQ ID NO: 19416 - DNA, 2031 bp, Artificial Sequence
  Description of Artificial Sequence: Synthetic coding sequence
atggctgctgccactggagaccccggcctgagcaagctgcagtttgcccccttcagcagcgccctggatgtgggcttctggcatgagctgacccagaagaagctgaatgagtaccgcctggatgaggcccccaaggacatcaagggctactactacaatggagacagcgctggcctgcctgcccggctgaccctggagttcagcgcctttgacatgtctgcccccaccccagcccgctgctgcccagccatcggcaccctgtacaacaccaacaccctggagagcttcaagacagctgacaagaagctgctgctggagcaggccgccaatgagatctgggagagcatcaagagcggcacagccctggagaaccctgtgctgctgaacaagttcctgctgctgacctttgctgacctgaagaagtaccacttctactactggttctgctacccagccctgtgcctgcctgagagcctgcccctcatccagggccctgtgggcctggaccagcgcttcagcctgaagcagatcgaggccctggagtgtgcctatgacaacctgtgccagacagagggcgtgacagccctgccctacttcctgatcaagtatgatgagaacatggtgctggtgtccctgctgaagcactacagcgacttcttccagggccagaggaccaagatcaccatcggcgtgtatgacccctgcaacctggcccagtacccaggctggcccctgaggaacttcctggtgctggccgcccaccgctggagcagcagcttccagagcgtggaggtggtgtgcttccgggacaggaccatgcagggcgccagagatgtggcccacagcatcatctttgaggtgaagctgcctgagatggccttctccccagactgccccaaggctgtgggctgggagaagaaccagaagggcggcatgggccccaggatggtgaacctgtctgagtgcatggaccccaagaggctggccgagagctctgtggacctgaacctgaagctgatgtgctggaggctggtgcccaccctggacctggacaaggtggtgtctgtgaagtgcctgctgctgggcgccggcaccctgggctgcaatgtggcccggaccctgatgggctggggcgtgcgccacatcacctttgtggacaatgccaagatctcctacagcaaccctgtgcggcagcccctgtatgaatttgaggactgcctgggcggcggcaagcccaaggccctggccgctgctgaccggctgcagaagatcttccctggggtgaatgcccggggcttcaacatgagcatccccatgcctggccaccctgtgaacttcagctctgtgaccctggagcaggccaggagagatgtggagcagctggagcagctgattgagagccatgatgtggtgttcctgctgatggacacccgggagagccgctggctgcctgctgtgattgctgccagcaagaggaagctggtgatcaatgctgccctgggctttgacacctttgtggtgatgagacatggcctgaagaagcccaagcagcagggcgctggggacctgtgccccaaccaccctgtggccagcgctgacctgctgggcagcagcctgtttgccaacatccctggctacaagctgggctgctacttctgcaatgatgtggtggcccctggggacagcacccgggacaggaccctggaccagcagtgcaccgtgtccaggcctggcctggccgtgattgctggggccctggccgtggagctgatggtgtctgtgctgcagcaccctgagggcggctacgccatcgccagcagcagtgatgacaggatgaatgaaccacccaccagcctgggcctggtgccccaccaggtgctggaccagtatgaaagagagggcttcaacttcctggccaaggtgttcaacagcagccacagcttcctggaggacctgaccggcctgaccctgctgcaccaggagacccaggccgctgagatctgggacatgtctgatgatgagaccatctag

SEQ ID NO: 19417 - DNA, 1329 bp, Artificial Sequence
  Description of Artificial Sequence: Synthetic coding sequence
atggccagtgatggagccagcgccctgcccggccctgacatgtccatgaagcccagcgctgcccccagccccagccctgccctgcccttcctgccccccaccagtgaccccccagaccaccccccccgggagcccccaccccagcccatcatgcccagcgtcttctccccagacaaccccctgatgctgagcgccttccccagcagcctgctggtgactggagatggcggcccctgcctgtctggagctggagctgggaaggtgattgtgaaggtgaagacagagggcggcagcgctgagcccagccagacccagaacttcatcctgacccagacagccctgaacagcacagcccctggcaccccctgtggcggcctggagggccctgcccccccatttgtgacagccagcaatgtgaagaccatcctgcccagcaaggctgtgggcgtgtcccaggagggccccccaggcctgcccccccagcccccacctcctgtggcccagctggtgcccatcgtgcccctggagaaggcctggccaggcccccacggcaccaccggggagggcggccctgtggccaccctgagcaagcccagcctgggggacaggagcaagatcagcaaggatgtgtatgagaacttccggcagtggcagcgctacaaggccctggcccggcggcacctgagccagagcccagacacagaggccgtgaaggagtatgtggacatcatggagtggctggtgggcacccacctggccaccggggagagtgatggcaagcaggaggaggagggccagcagcaggaggaggagggcatgtacccagaccccggcctgctgagctacatcaatgagctgtgcagccagaaggtgtttgtgtccaaggtggaggccgtcatccacccccagttcctggccgacctgctgagccctgagaagcagagggaccccctggccctgattgaggagctggagcaggaggagggcctgaccctggcccagctggtgcagaagaggctgatggccctggaggaggaggaggatgctgaggccccacccagcttcagcggggcccagctggacagcagccccagcggctctgtggaggatgaagatggagatggccgcctgcggcccagccctggcctgcagggcgctgggggcgccgcctgcctgggcaaggtgagcagcagcggcaagagggcccgggaggtgcacggcggccaggagcaggccctggacagcccccggggcatgcacagagatggcaacaccctgcccagccccagctcctgggacctgcccaccaatggagagagccagtgctag

SEQ ID NO: 19418 - DNA, 666 bp, Artificial Sequence
  Description of Artificial Sequence: Synthetic coding sequence
atgcaggtgcaggatgatggagtgaacctgatcccctttgccaagtgcagccgggtggtgagccgcagccccccaccccggctgcccagccagagcctgcggcccatgccccagagatatggagatgtgttctggaagaacctgaaccagaggcccacccccacctggctggaggagcagcacatcccccccatgctgctgcccccacctgagatgctgtggaggaggaagaagagaagaccctgcctggagggcatgcagcagcagggcctgggcggcgtgcctgcccgggtgcgggctgtgacctaccacctggaggacctgcggcggcggcagagcatcatcaatgagctgaagaaggcccagtggggcagcagcggggccgccagcgagcctgtggtgctgggggaggagggctgcggcttccccagcaccaatgagtacccagacctggaggaggagcgggccacctacccccaggaggaggaccgcttcctgaccccaggccgggcccagctgctgtggagcccctggagccccctggaccaggaggaggcctgtgccagccggcagctgcacagcctggccagcttcagcacagtgacagcccggaggaaccccctgcacaacccctggggcatggagctggccgccagcgaggagtag

SEQ ID NO: 19419 - DNA, 480 bp, Artificial Sequence
  Description of Artificial Sequence: Synthetic coding sequence
atgcagagggtgggcaacaccttcagcaatgaaagccgggtggccagccgctgccccagcgtgggcctggccgagaggaacagagtggccaccatgcctgtgcggctgctgcgggacagccctgctgcccaggaggacaatgaccacgccagagatggcttccagatgaagctggatgcccacggctttgcccctgaggagctggtggtgcaggtggatggccagtggctgatggtgacaggccagcagcagctggatgtgcgggaccctgagcgggtgtcctacaggatgagccagaaggtgcacaggaagatgctgcccagcaacctgagccccacagccatgacctgctgcctgacccccagcggccagctgtgggtgcggggccagtgtgtggccctggccctgcctgaggcccagacaggccccagcccccggctgggcagcctgggcagcaaggccagcaacctgaccaggtag

SEQ ID NO: 19420 - DNA, 1782 bp, Artificial Sequence
  Description of Artificial Sequence: Synthetic coding sequence
atggagaagctgagcgccctgcaggagcagaagggggagctgaggaagaggctgagctacaccacccacaagctggagaagctggagacagaatttgacagcaccaggcactacctggagattgagctgcggcgggcccaggaggagctggagaaggtgacagagaagctgcggcgcatccagagcaactacatggccctgcagaggatcaaccaggagctggaggacaagctgtacaggatgggccagcactatgaggaggagaagagggccctgagccatgagatcgtggccctgaacagccacctgctggaggccaaggtgaccatcgacaagctgtctgaagataatgagctgtacaggaaggactgcaacctggccgcccagctgctgcagtgcagccagacctacggccgggtgcacaaggtgtctgagctgcccagcgacttccaggagcgggtgtccctgcacatggagaagcacggctgcagcctgcccagccccctgtgccacccagcctatgctgacagcgtgcccacctgtgtgattgccaaggtgctggagaagccagaccctgccagcctgagcagccggctgagtgatgccagcgcccgggacctggccttctgtgatggagtggagaagccaggcccccggcccccctacaagggggacatctactgcagcgacacagccctgtactgcccagaggagcggcggcgggacagaagacccagcgtggatgcccctgtgacagatgtgggcttcctgcgggcccagaacagcacagattctgctgctgaggaggaggaggaggccgaggccgccgccttccctgctggcttccagcacgaggccttccccagctatgccggcagcctgcccaccagcagcagctacagcagcttcagcgccaccagcgaggagaaggagcacgcccaggccagcaccctgacagccagccagcaggccatctacctgaacagcagagatgagctgtttgacaggaagcccccagccaccacctatgagggcagccccaggtttgccaaggccacagctgctgtggccgcccccctggaggccgaggtggcccctggcttcggccgcaccatgagcccctacccagctgagaccttccgcttccctgccagccctggcccccagcaggccctgatgccacccaacctgtggagcctgcgggccaagccaggcacagcccggctgcccggggaggacatgaggggccagtggaggcccctgtctgtggaggacatcggggcctacagctaccctgtgtctgctgctggccgggccagcccctgcagcttcagcgagcgctactatggaggagctgggggcagccctgggaagaaggcagatggccgggccagccccctgtatgccagctacaaggctgacagcttctctgaaggagatgacctgagccagggccacctggccgagccctgcttcctgcgggccggcggggacctgagcctgagccctggccgctctgctgaccccctgcccggctacgcccccagcgagggcggagatggagaccggctgggcgtgcagctgtgtggcacagccagcagccctgagcctgagcagggcagccgggacagcctggagcccagctccatggaggccagccctgagatgcaccctgctgcccggctgagcccccagcaggccttccccaggactggaggcagcggcctgagcaggaaggacagcctgaccaaggcccagctgtatggcaccctgctgaactag

SEQ ID NO: 19421 - DNA, 2610 bp, Artificial Sequence
  Description of Artificial Sequence: Synthetic coding sequence
atgggcaaccgggagatggaggagctgatccccctggtgaaccggctgcaggatgccttcagcgccctgggccagagctgcctgctggagctgccccagattgctgtggtgggcggccagagcgctgggaagagctctgtgctggagaactttgtgggccgggacttcctgccccggggcagcggcatcgtgacccggcggcccctggtgctgcagctggtgaccagcaaggccgagtatgcagagttcctgcactgcaagggcaagaagttcacagactttgatgaggtgcggctggagattgaagctgagacagacagagtgacaggcatgaacaagggcatcagcagcatccccatcaacctgcgggtgtacagcccccacgtgctgaacctgaccctgattgacctgcccggcatcaccaaggtgcctgtgggggaccagcccccagacatcgagtaccagatccgggagatgatcatgcagttcatcacccgggagaactgcctgatcctggccgtgaccccagccaacacagacctggccaacagtgatgccctgaagctggccaaggaggtggacccccagggcctgcggaccatcggggtcatcaccaagctggacctgatggatgagggcacagatgccagagatgtgctggagaacaagctgctgcccctgcggcggggctacgtgggcgtggtgaacagaagccagaaggacattgatggcaagaaggacatcaaggccgccatgctggccgagaggaagttcttcctgagccacccagcctaccgccacatcgctgacaggatgggcaccccccacctgcagaaggtgctgaaccagcagctgaccaaccacatccgggacaccctgcccaacttcaggaacaagctgcagggccagctgctgagcattgaacatgaggtggaggcctacaagaacttcaagccagaggaccccaccaggaagaccaaggccctgctgcagatggtgcagcagtttgctgtggactttgagaagagaattgagggcagcggggaccaggtggacaccctggagctgtctggaggagccaagatcaaccgcatcttccacgagcgcttcccctttgagatcgtgaagatggagttcaatgagaaggagctgcggcgggagatctcctatgccatcaagaacatccacggcatcagaacaggcctcttcaccccagacatggcctttgaggccatcgtgaagaagcagatcgtgaagctgaagggccccagcctgaagtctgtggacctggtgatccaggagctgatcaacacagtgaagaagtgcaccaagaagctggccaacttcccccggctgtgtgaggagacagaaagaattgtggccaaccacatccgggagcgggagggcaagaccaaggaccaggtgctgctgctgattgacatccaggtgtcctacatcaacaccaaccacgaggacttcatcggctttgccaatgcccagcagaggagcagccaggtgcacaagaagaccaccgtgggcaaccagggcaccaacctgccccccagccggcagatcgtcatcaggaagggctggctgaccatcagcaacatcggcatcatgaagggcggcagcaagggctactggtttgtgctgacagctgagagcctgtcctggtacaaggatgatgaggagaaggagaagaagtacatgctgcccctggacaacctgaaggtgagagatgtggagaagagcttcatgagcagcaagcacatctttgccctcttcaacacagagcagagaaatgtgtacaaggactaccgcttcctggagctggcctgtgacagccaggaggatgtggacagctggaaggccagcctgctgcgggccggcgtgtacccagacaagtctgtggctgaaaatgatgaaaatggccaggccgagaacttctccatggacccccagctggagcggcaggtggagaccatccggaacctggtggacagctacatgagcatcatcaacaagtgcatccgggacctgatccccaagaccatcatgcacctgatgatcaacaacgtgaaggacttcatcaacagcgagctgctggcccagctgtacagcagcgaggaccagaacaccctgatggaggagagcgctgagcaggcccagaggagagatgagatgctgaggatgtaccaggccctgaaggaggccctgggcatcatcggggacatcagcacagccaccgtgtccaccccagcccctcctcctgtggatgacagctggatccagcacagcagaagaagccccccacccagccccaccacccagaggcggcccaccctgagcgcccccctggcccggcccaccagcggccggggccctgccccagccatccccagccctggcccccacagcggggcccctcctgtgcccttccggcccggccccctgccccccttccccagcagcagtgacagctttggagccccaccccaggtgcccagccggcccacccgggccccacccagcgtgcccagccggcggcccccacccagccccacccggcccaccatcatccggcccctggagagcagcctgctggactag

SEQ ID NO: 19422 - DNA, 1896 bp, Artificial Sequence
  Description of Artificial Sequence: Synthetic coding sequence
atgaacagcagtgatgaggagaagcagctgcagctgatcaccagcctgaaggagcaggccatcggggagtatgaggacctgcgggcagagaaccagaagaccaaggagaagtgtgacaagatccggcaggagagagatgaggccgtgaagaagctggaggagttccagaagatcagccacatggtgattgaggaggtgaacttcatgcagaaccacctggagattgagaagacctgccgggagagcgctgaggccctggccaccaagctgaacaaggagaacaagaccctgaagaggatctccatgctgtacatggccaagctgggcccagatgtgatcacagaggagatcaacattgatgatgaggacagcaccacagacacagatggagctgctgagacctgtgtgtctgtgcagtgccagaagcagatcaaggagctgcgggaccagatcgtgtctgtgcaggaggagaagaagatcctggccatcgagctggagaacctgaagagcaagctggtggaggtgattgaggaggtgaacaaggtgaagcaggagaagacagtgctgaacagcgaggtgctggagcagaggaaggtgctggagaagtgcaacagagtgtccatgctggccgtggaggagtatgaggagatgcaggtgaacctggagctggagaaggacctgaggaagaaggccgagagctttgcccaggagatgttcatcgagcagaacaagctgaagaggcagagccacctgctgctgcagagcagcatcccagaccagcagctgctgaaggccctggatgaaaatgccaagctgacccagcagctggaggaggagcgcatccagcaccagcagaaggtgaaggagctggaggagcagctggagaatgagaccctgcacaaggagatccacaacctgaagcagcagctggagctgctggaggaggacaagaaggagctggagctgaagtaccagaacagcgaggagaaggccaggaacctgaagcacagcgtggatgagctgcagaagagggtgaaccagagtgaaaattctgtgcccccacctcctcctcctcctccacccctgcccccacctccacccaaccccatccgcagcctgatgtccatgatcaggaagaggagccaccccagcggcagcggggccaagaaggagaaggccacccagcctgagaccacagaggaggtgacagacctgaagaggcaggccgtggaggagatgatggaccgcatcaagaagggcgtgcacctgcggcctgtgaaccagacagcccggcccaagaccaagccagagagcagcaagggctgtgagagcgctgtggatgagctgaagggcatcctgggcaccctgaacaagagcaccagcagccgcagcctgaagagcctggaccctgaaaattctgaaacagagctggagcgcatcctgcggcggaggaaggtgacagctgaggccgacagcagcagccccaccggcatcctggccaccagcgagagcaagtccatgcctgtgctgggctctgtgtcctctgtgaccaagacagccctgaacaagaagaccctggaggccgagttcaacagccccagcccccccaccccagagcccggggagggccccaggaagctggagggctgcaccagcagcaaggtgaccttccagccccccagcagcatcggctgcaggaagaagtacattgatggagagaagcaggccgagcctgtggtggtgctggaccctgtgtccacccatgagccccagaccaaggaccaggtggccgagaaggaccccacccagcacaaggaggatgaaggagagatccagcctgagaacaaggaggacagcattgaaaatgtgcgggagacagacagcagcaactgctag

SEQ ID NO: 19423 - DNA, 1701 bp, Artificial Sequence
  Description of Artificial Sequence: Synthetic coding sequence
atggacctgcaccgggccgccttcaagatggagaacagcagctacctgcccaaccccctggccagccctgccctgatggtgctggccagcacagctgaggccagcagagatgccagcatcccctgccagcagccccggcccttcggcgtgcctgtgtctgtggacaaggatgtgcacatccccttcaccaacggcagctacacctttgcctccatgtaccaccggcagggcggcgtgcccggcacctttgccaacagagacttcccccccagcctgctgcacctgcacccccagtttgccccacccaacctggactgcacccccatctccatgctgaaccacagcggcgtgggcgccttccggccctttgccagcacagaagatcgggagagctaccagagcgccttcaccccagccaagaggctgaagaactgccacgacacagagagcccccacctgcgcttcagtgatgctgatggcaaggagtatgactttggcacccagctgcccagcagcagccctggcagcctgaaggtggatgacaccgggaagaagatctttgctgtgtctggcctcatcagtgaccgggaggccagcagcagcccagaagatagaaatgaccgctgcaagaagaaggccgccgccctgtttgacagccaggcccccatctgccccatctgccaggtgctgctgcggcccagcgagctgcaggagcacatggagcaggagctggagcagctggcccagctgcccagcagcaagaacagcctgctgaaggatgccatggcccctggcacccccaagagcctgctgctgagcgccagcatcaagcgggagggggagagccccacagccagcccccacagcagcgccacagatgacctgcaccacagcgaccgctaccagaccttcctgcgggtgcgggccaaccggcagacccggctgaatgccagaattggcaagatgaagaggaggaagcaggatgagggccagcgggagggcagctgcatggctgaagatgatgctgtggacattgaacatgagaacaacaacagatttgaggagtatgagtggtgtggccagaagaggatccgggccaccaccctgctggagggcggcttccggggcagcggcttcatcatgtgcagcggcaaggagaacccagacagtgatgctgacctggatgtggatggagatgacaccctggagtatggcaagccccagtacacagaagcagatgtgatcccctgcaccggggaggagcccggggaggccaaggagcgggaggccctgcggggagctgtgctgaatggaggcccccccagcacccgcatcaccccagagttcagcaagtgggccagtgatgagatgcccagcaccagcaatggagagagcagcaagcaggaggccatgcagaagacctgcaagaacagcgacatcgagaagatcacagaagattctgctgtgaccacctttgaggccctgaaggcccgggtgcgggagctggagcggcagctgagcagaggagaccgctacaagtgcctgatctgcatggacagctacagcatgcccctgaccagcatccagtgctggcacgtgcactgtgaggagtgctggctgcggaccctgggcgccaagaagctgtgcccccagtgcaacaccatcacagcccctggggacctgcggcgcatctacctgtag

SEQ ID NO: 19424 - DNA, 1071 bp, Artificial Sequence
  Description of Artificial Sequence: Synthetic coding sequence
atgctgagcgccatcaccaacgtggtgcagaacacaggcaagtctgtgctgaccggcggcctggatgccctggagttcatcggcaagaagaccatgaatgtgctggccgagagtgaccccggcttcaagaggaccaagaccctgatggagaggacagtgtccctgagccagatgctgcgggaggccaaggagaaggagaagcagaggctggcccagcagctgaccatggagaggacagcccactacggcatgctgtttgatgagtaccagggcctgagccacctggaggccctggagatcctgagcaatgaaagtgagagcaaggtgcagagcttcctggccagcctggatggagagaagctggagctgctgaagaatgacctgatcagcatcaaggacatctttgctgccaaggagctggagaatgaggagaaccaggaggagcagggcctggaggagaagggggaggagtttgccaggatgctgacagagctgctgtttgagctgcacgtggccgccaccccagacaagctgaacaaggccatgaagagggcccatgactgggtggaggaggaccagacagtggtgtctgtggatgtggccaaggtgtctgaggaggagaccaagaaggaggagaaggaggagaagagccaggacccccaggaggacaagaaggaggagaagaagaccaagaccatcgaggaggtgtacatgagcagcattgagagcctggccgaggtgacagcccgctgcatcgagcagctgcacaaggtggccgagctgatcctgcacggccaggaggaggagaagccagcccaggaccaggccaaggtgctgatcaagctgaccacagccatgtgcaatgaggtggccagcctgagcaagaagttcaccaacagcctgaccaccgtgggcagcaacaagaaggccgaggtgctgaaccccatgatcagctctgtgctgctggagggctgcaacagcaccacctacatccaggatgccttccagctgctgctgcctgtgctgcaggtgagccacatccagaccagctgcctgaaggcccagccctag

SEQ ID NO: 19425 - DNA, 519 bp, Artificial Sequence
  Description of Artificial Sequence: Synthetic coding sequence
atgagctacaactgctgcagcggcaacttcagcagccgcagctgtggcggctacctgcactacccagccagcagctgtggcttctcctaccccagcaaccaggtgtacagcacagacctgtgcagccccagcacctgccagctgggcagcagcctgtaccggggctgccagcagacctgctgggagcccaccagctgccagaccagctatgtggagagcagcccctgccagaccagctgctaccggcccaggaccagcctgctgtgcagcccctgccagaccacctacagcggcagcctgggcttcggcagcagcagctgccgcagcctgggctacggcagccgcagctgctacagcgtgggctgcggcagcagcggcttccgcagcctgggctacggcggctgcggcttccccagcctgggctacggcgtgggcttctgccggcccacctacctggccagccgcagctgccagagcagctgctaccggcccacctgtggcagcggcttctactactag

SEQ ID NO: 19426 - DNA, 2253 bp, Artificial Sequence; identical to SEQ ID NO: 19350
  Description of Artificial Sequence: Synthetic coding sequence

SEQ ID NO: 19427 - DNA, 888 bp, Artificial Sequence; identical to SEQ ID NO: 19226
  Description of Artificial Sequence: Synthetic coding sequence

SEQ ID NO: 19428 - DNA, 1476 bp, Artificial Sequence
  Description of Artificial Sequence: Synthetic coding sequence
atggacaccaagggctgcaccaccaccaacagccccagcaccccctgccagaactgcagccgcatcaccaacgtgtccaccatcagcagcaacaacggctgccaccctgggggcctgactgtgaacaactgccagcctgctggccacgtgctgcgcatcccctgggaccagggctgccagcccaccccccgcttctgcaggaagcccatctacctgatgaacaacttcaatgcccgcttcagcctggatgactgctcctggtacggggagggcatcaacagcaatgagaaggagaccatgcagatcctgaatgaaaggctggccaactacctgcagaaggtgaggatgctggagcgggagaatgctgagctggagagcaagatccaggaggagagcaacaaggagctgcctgtgctgtgcccagactacctgagctactacaccaccatcgaggagctgcagcagaagatcctgtgcaccaaggccgagaacagccggctggtgtcccagattgacaacaccaagctgacagcagatgacctgcgggccaagtatgaagctgaggtgtccctgcggcagctggtggagagtgatgccaacggcctgaagcagatcctgaatgtgctgaccctgggcaaggctgacctggaggcccaggtgcagagcctgaaggaggagctgctgtgcctgaagaacaaccacaaggaggagatcaacagcctgcagtgccagctgggggagcggctggacatcgaggtgacagctgcccccagcgctgacctgaaccaggtgctgcaggagatgcgctgccagtatgagcccatcatggagaccaacaggaaggatgtggagcagtggttcaacacccagatcgaggagctgaaccagcaggtggtgaccagcagccagcagcagcagtgctgccagaaggagatcatcgagctgcggcgctctgtgaacaccctggaggtggagctgcaggcccagcacaggatgagggacagccaggagtgcatcctgacagaaacagaggcccgctacacagccctgctgacccagatccagagcctgattgacaacctggaggcccagctggccgagatccgctgtgccctggagcggcagaaccaggagtatgagatcctgctggatgtgaagagccggctggagtgtgagatcaccacctaccgcagcctgctggagagcagtgatggcaagaggccctgctacccccgggccaccaagtgtgagcccagcccctggaccagctgcaagagcggggccatcgagagcacagccccagcctgcaccagcagcagcccctgcagcctgaaggagcactgcagcgcctgtggccccctgagccgcatcctggtgaagatctgcaccatcaccaaggagatcaaggatggcaaggtgatcagcagctatgaacatgtgcagccctgcttcatcatccggcctgccaaggtgtag

SEQ ID NO: 19429 - DNA, 1287 bp, Artificial Sequence
  Description of Artificial Sequence: Synthetic coding sequence
atgaagaggggcggccgggacagcgacaggaacagcagcgaggagggcacagctgagaagagcaagaagctgcggaccaccaatgagcacagccagacctgtgactggggcaacctgctgcaggacatcatcctgcaggtgttcaagtacctgcccctgctggaccgggcccacgccagccaggtgtgcaggaactggaaccaggtgttccacatgccagacctgtggcgctgctttgaatttgagctgaaccagcctgccaccagctacctgaaggccacccaccctgagctgatcaagcagatcatcaagaggcacagcaaccacctgcagtatgtgtccttcaaggtggacagcagcaaggagagcgctgaggccgcctgtgacatcctgagccagctggtgaactgcagcctgaagaccctgggcctcatcagcacagcccggcccagcttcatggacctgcccaagagccacttcatcagcgccctgactgtggtgtttgtgaacagcaagagcctgagcagcctgaagattgatgacacccctgtggatgaccccagcctgaaggtgctggtggccaacaacagcgacaccctgaagctgctgaagatgagcagctgcccccacgtgtccccagctggcatcctgtgtgtggccgaccagtgccacggcctgcgggagctggccctgaactaccacctgctgagtgatgagctgctgctggccctgagcagcgagaagcacgtgcggctggagcacctgagaattgatgtggtgtctgagaaccctggccagacccacttccacaccatccagaagagctcctgggatgccttcatccgccacagccccaaggtgaacctggtgatgtacttcttcctgtatgaggaggagtttgaccccttcttccgctatgagatcccagccacccacctgtacttcggccgctctgtgtccaaggatgtgctgggccgggtgggcatgacctgcccccggctggtggagctggtggtgtgtgccaacggcctgcggcccctggatgaggagctgatcagaattgctgagcgctgcaagaacctgagcgccatcggcctgggggagtgtgaggtgtcctgcagcgcctttgtggagtttgtgaagatgtgtggcggccgcctgagccagctgagcatcatggaggaggtgctgatcccagaccagaagtacagcctggagcagatccactgggaggtgtccaagcacctgggccgggtgtggttcccagacatgatgcccacctggtag

SEQ ID NO: 19430 - DNA, 3603 bp, Artificial Sequence
  Description of Artificial Sequence: Synthetic coding sequence
atgaacacagattctgggggctgtgccaggaagagagctgccatgtctgtgaccctgacctctgtgaagagggtgcagagcagccccaacctgctggccgccggccgggacagccagagcccagattctgcctggaggagctacaatgatggcaaccaggagaccctgaatggagatgccacctacagcagcctggccgccaagggcttccgctctgtgcggcccaacctgcaggacaagaggagccccacccagagccagatcaccgtgaatggaaacagcggcggcgctgtgagccccatgagctactaccagaggcccttcagccccagcgcctacagcctgcctgccagcctgaacagcagcatcgtgatgcagcacggcaccagcctggacagcacagacacctacccccagcacgcccagagcctggatggcaccaccagcagcagcatccccctgtaccgcagcagcgaggaggagaagagggtgaccgtcatcaaggccccccactacccaggcatcggccctgtggatgaaagtggcatccccacagccatccgcaccaccgtggaccggcccaaggactggtacaagaccatgttcaagcagatccacatggtgcacaagccagatgatgacacagacatgtacaacaccccctacacctacaatgccggcctgtacaaccccccctacagcgcccagagccaccctgctgccaagacccagacctaccggcccctgagcaagagccacagcgacaacagccccaatgccttcaaggatgccagcagccctgtgcccccaccccacgtgcccccacctgtgccccccctgcggccccgggacaggagcagcacagagaagcatgactgggaccccccagacaggaaggtggacaccaggaagttccgctctgagcccaggagcatctttgaatatgagcccgggaagagcagcatcctgcagcacgagaggcctgccagcctgtaccagagcagcattgacaggagcctggagcggcccatgagcagcgcctccatggccagtgacttcaggaagaggaggaagtctgagcctgctgtgggccccccccggggcctgggggaccagagcgccagcaggaccagccctggccgggtggacctgcccggcagcagcaccaccctgaccaagagcttcaccagcagcagccccagcagccccagccgggccaagggaggagatgacagcaagatctgccccagcctgtgcagctacagcggcctgaatggaaaccccagcagcgagctggactactgcagcacctaccggcagcacctggatgtgccccgggacagcccccgggccatctccttcaagaatggctggcagatggcccggcagaatgctgagatctggagcagcacagaggagaccgtgagccccaagatcaagagccgcagctgtgatgacctgctgaatgatgactgtgacagcttcccagaccccaaggtgaagtctgagagcatgggcagcctgctgtgtgaggaggacagcaaggagagctgccccatggcctggggcagcccctacgtgcctgaggtgcgcagcaatggccgcagccgcatccgccacaggtctgccagaaatgcccctggcttcctgaagatgtacaagaagatgcaccgcatcaacaggaaggacctgatgaacagcgaggtgatctgcagcgtgaagagccgcatcctgcagtatgagagcgagcagcagcacaaggacctgctgcgggcctggagccagtgcagcacagaggaggtgccccgggacatggtgcccacccgcatcagcgagtttgagaagctgatccagaagagcaagtccatgcccaacctgggagatgacatgctgagccctgtgaccctggagcccccccagaatggcctgtgccccaagaggcgcttcagcattgagtacctgctggaggaggagaaccagagcggccccccagcccggggccggcggggctgccagagcaatgccctggtgcccatccacatcgaggtgaccagtgatgagcagccccgggcccacgtggagttcagtgacagcgaccaggatggagtggtgtctgaccacagcgactacatccacctggagggcagcagcttctgcagcgagagtgactttgaccacttctccttcaccagcagcgagagcttctacggcagcagccaccaccaccaccaccaccaccaccaccaccaccgccacctgatcagcagctgcaagggccgctgcccagccagctacacccgcttcaccaccatgctgaagcatgagcgggcccggcatgagaacacagaggagccccggcggcaggagatggaccccggcctgagcaagctggccttcctggtgtcccctgtgcccttccggaggaagaagaacagcgcccccaagaagcagacagagaaggccaagtgcaaggcctctgtgtttgaggccctggacagcgccctgaaggacatctgtgaccagatcaaggccgagaagaagaggggcagcctgcctgacaacagcatcctgcacaggctcatcagcgagctgctgcctgatgtgcctgagaggaacagcagcctgcgggccctgcggcgcagccccctgcaccagcccctgcaccccctgcccccagatggagccatccactgccccccctaccagaatgactgtggccgcatgcccaggtctgccagcttccaggatgtggacacagccaacagcagctgccaccaccaggaccggggcggggccctgcaggaccgggagagccccaggagctacagcagcaccctgacagacatgggccgcagcgccccccgggagcggcggggcaccccagagaaggagaagctgcctgccaaggctgtgtatgacttcaaggcccagaccagcaaggagctgtccttcaagaagggggacacagtgtacatcctgaggaagattgaccagaactggtatgaaggagagcaccacggccgggtgggcatcttccccatctcctatgtggagaagctgaccccacctgagaaggcccagcctgcccggcccccacctccagcccagcctggagagatcggggaggccatcgccaagtacaacttcaatgctgacaccaacgtggagctgagcctgaggaaaggagacagagtcatcctgctgaagagggtggaccagaactggtatgagggcaagatccctggcaccaaccggcagggcatcttccctgtgtcctatgtggaggtggtgaagaagaacaccaagggagctgaggactacccagacccccccatcccccacagctacagcagtgaccgcatccacagcctgagcagcaacaagccccagaggcctgtgttcacccatgagaacatccagggcggcggggagcccttccaggccctgtacaactacaccccaagaaatgaagatgagctggagctgcgggagagtgatgtgattgatgtgatggagaagtgtgatgatggctggtttgtgggcaccagcaggaggaccaagttcttcggcaccttccctggcaactacgtgaagaggctgtag

SEQ ID NO: 19431 - DNA, 1470 bp, Artificial Sequence
  Description of Artificial Sequence: Synthetic coding sequence
atggaggacagcgccagcgccagcctgagcagcgctgctgccaccggcaccagcaccagcaccccagctgcccccacagccaggaagcagctggacaaggagcaggtgaggaaggctgtggatgccctgctgacccactgcaagagcaggaagaacaactacggcctgctgctgaatgaaaatgaaagcctcttcctgatggtggtgctgtggaagatccccagcaaggagctgcgggtgcggctgaccctgccccacagcatccgcagtgacagcgaggacatctgcctcttcaccaaggatgagcccaacagcaccccagagaagacagagcagttctacaggaagctgctgaacaagcacggcatcaagacagtgtcccagatcatcagcctgcagaccctgaagaaggagtacaagagctatgaggccaagctgcggctgctgagcagctttgacttcttcctgacagatgcccgcatccggcggctgctgcccagcctgattggccgccacttctaccagaggaagaaggtgcctgtgtctgtgaacctgctgagcaagaacctgagccgggagatcaatgactgcatcggcggcaccgtgctgaacatcagcaagagcggcagctgcagcgccatccgcatcggccacgtgggcatgcagatcgagcacatcatcgagaacatcgtggccgtgaccaagggcctgtctgagaagctgcctgagtgggagagcgtgaagctgctgtttgtgaagacagagaagtctgctgccctgcccatcttcagcagctttgtgagcaactgggatgaggccaccaagaggagcctgctgaacaagaagaagaaggaggcccggaggaagaggcgggagaggaactttgagaagcagaaggagaggaagaagaagaggcagcaggccaggaagacagcctctgtgctgagcaaggatgatgtggcccctgagagcggggacaccaccgtgaagaagccagagagcaagaaggagcagaccccagagcacggcaagaagaagaggggccggggcaaggcccaggtgaaggccaccaatgaaagtgaagatgagatcccccagctggtgcccatcggcaagaagaccccagccaatgagaaggtggagatccagaagcacgccaccgggaagaagagccctgccaagagccccaaccccagcaccccccggggcaagaagaggaaggccctgcctgccagcgagacccccaaggctgctgagagcgagaccccaggcaagagccctgagaagaagcccaagatcaaggaggaggccgtgaaggagaagagccccagcctgggcaagaaggatgcccggcagacccccaagaagccagaggccaagttcttcaccacccccagcaagtctgtgaggaaggccagccacacccccaagaagtggcccaagaagcccaaggtgccccagagcacctag

SEQ ID NO: 19432 - DNA, 3171 bp, Artificial Sequence
  Description of Artificial Sequence: Synthetic coding sequence
atggccggggccctgcggcggggccgggccctgggcagccggcccagcggccccaccgtgagcagcagaagaagcccccagtgccctgtggcccaggagggcctgggcgcccggagccggccccgggtggcccccaggagcctggcccgctgtggccccagcagccggctgatgggctggaagcccagcgaggcccggggccagagccagagcttccaggccagcggcctgcagcccaggagcctgaaggccgcccggcgggccaccggccgcccagacaggagcagagctgccccacccaacatggaccctgacccccaggccggcgtgcaggtgggcatgagggtggtgcggggcgtggactggaagtggggccagcaggacggcggggagggcggcgtgggcaccgtggtggagctgggcagacatggcagccccagcaccccagacagaacagtggtggtgcagtgggaccagggcaccaggaccaactacagagctggctaccagggcgcccatgacctgctgctgtatgacaatgcccagattggagtgcgccaccccaacatcatctgtgactgctgcaagaagcacggcctgcggggcatgcgctggaagtgccgggtgtgcctggactatgacctgtgcacccagtgctacatgcacaacaagcatgagctggcccacgcctttgacagatatgaaacagcccacagcaggcctgtgaccctgagcccccggcagggcctgccccgcatccccctgcggggcatcttccagggcgccaaggtggtgcggggccctgactgggagtggggcagccaggacggcggggagggcaagccaggccgggtggtggacatccggggctgggatgtggagaccggccgctctgtggcctctgtgacctgggcagatggcaccaccaacgtgtacagagtgggccacaagggcaaggtggacctgaagtgtgtgggggaggccgccggcggcttctactacaaggaccacctgccccggctgggcaagccagctgagctgcagaggagagtgtctgctgacagccagcccttccagcacggggacaaggtgaagtgcctgctggacacagatgtgctgcgggagatgcaggagggccacggcggctggaaccccaggatggccgagttcatcggccagacaggcaccgtgcaccgcatcacagacagaggagatgtgcgggtgcagttcaaccacgagacccgctggaccttccaccctggggccctgaccaagcaccacagcttctgggtgggagatgtggtgcgggtcatcggggacctggacacagtgaagaggctgcaggccggccatggagagtggacagatgacatggccccagccctgggccgggtgggcaaggtggtgaaggtgtttggagatggcaacctgcgggtggccgtggccggccagcgctggaccttcagccccagctgcctggtggcctacagacctgaggaggatgccaacctggatgtggccgagcgggcccgggagaacaagagcagcctgtctgtggccctggacaagctgcgggcccagaagagtgaccctgagcaccctggccgcctggtggtggaggtggccctgggcaatgctgcccgggccctggacctgctgcggcggcggcctgagcaggtggacaccaagaaccagggccgcacagccctgcaggtggccgcctacctgggccaggtggagctgatccggctgctgctgcaggcccgggccggcgtggacctgcctgatgatgagggcaacacagccctgcactacgccgccctgggcaaccagcctgaggccaccagggtgctgctgtctgctggctgcagagcagatgccatcaacagcacccagagcacagccctgcacgtggccgtgcagaggggcttcctggaggtggtgcgggccctgtgtgagcggggctgtgatgtgaacctgcctgatgcccacagcgacacccccctgcacagcgccatctctgctggcactggagccagcggcatcgtggaggtgctgacagaggtgcccaacattgatgtgacagccaccaacagccagggcttcaccctgctgcaccacgccagcctgaagggccacgccctggccgtgaggaagatcctggcccgggcccggcagctggtggatgccaagaaggaggatggcttcaccgccctgcacctggccgccctgaacaaccaccgggaggtggcccagatcctgatccgggagggccgctgtgatgtgaatgtgaggaacaggaagctgcagagccccctgcacctggccgtgcagcaggcccacgtgggcctggtgcccctgctggtggatgctggctgcagcgtgaatgcagaagatgaggagggggacacagccctgcacgtggccctgcagaggcaccagctgctgcccctggtggctgatggagctggaggagaccccggccccctgcagctgctgagccggctgcaggccagcggcctgcccggcagcgctgagctgactgtgggcgctgctgtggcctgcttcctggccctggagggcgcagatgtgtcctacaccaaccaccggggccgcagccccctggacctggccgctgagggccgggtgctgaaggccctgcagggctgtgcccagcgcttccgggagcggcaggccggcggcggggccgcccctggcccccggcagaccctgggcacccccaacacagtgaccaacctgcacgtgggcgccgcccctggccctgaggccgctgagtgcctggtgtgcagcgagctggccctgctggtgctcttcagcccctgccagcacaggacagtgtgtgaggagtgtgcccggaggatgaagaagtgcatccgctgccaggtggtggtgtccaagaagctgcggccagatggcagcgaggtggccagcgctgccccagcccctggccccccccggcagctggtggaggagctgcagagccgctaccggcagatggaggagcgcatcacctgccccatctgcatcgacagccacatccggctggtgttccagtgtggccacggggcctgtgccccctgtggcagcgccctgagcgcctgccccatctgccggcagcccatccgggaccgcatccagatctttgtgtag

SEQ ID NO: 19433 - DNA, 858 bp, Artificial Sequence
  Description of Artificial Sequence: Synthetic coding sequence
atgtctgaggccggggaggagcagcccatggagaccactggagccacagaaaatggccacgaggccgtgcctgagggggagagccctgctggggccggcaccggggctgctgctggggccggcggggccacagctgcccctccttctggcaaccagaatggagctgagggggaccagatcaatgccagcaagaatgaagaagatgctgggaagatgtttgtgggcggcctgtcctgggacaccagcaagaaggacctgaaggactacttcaccaagtttggagaggtggtggactgcaccatcaagatggaccccaacacaggccgcagccggggcttcggcttcatcctcttcaaggatgctgcctctgtggagaaggtgctggaccagaaggagcaccggctggatggccgggtcatcgaccccaagaaggccatggccatgaagaaggaccctgtgaagaagatctttgtgggcggcctgaaccctgaggccacagaggagaagatccgggagtactttggagaatttggagaaattgaggccatcgagctgcccatggaccccaagctgaacaagaggcggggctttgtgttcatcaccttcaaggaggaggagcctgtgaagaaggtgctggagaagaagttccacacagtgtctggcagcaaatgtgagatcaaggtggcccagcccaaggaggtgtaccagcagcagcagtatggcagcggcggccggggcaacagaaacagaggcaacagaggcagcggcggcggcggcggcggcggcggccagggcagcaccaactacggcaagagccagaggcggggcggccaccagaacaactacaagccctactag

SEQ ID NO: 19434 - DNA, 1212 bp, Artificial Sequence; identical to SEQ ID NO: 18994
  Description of Artificial Sequence: Synthetic coding sequence

SEQ ID NO: 19435 - DNA, 1347 bp, Artificial Sequence
  Description of Artificial Sequence: Synthetic coding sequence
atggccacagacagctgggccctggccgtggatgagcaggaggccgctgctgagagcctgagcaacctgcacctgaaggaggagaagatcaagccagacaccaatggagctgtggtgaagaccaatgccaatgctgagaagacagatgaggaggagaaggaggacagagctgcccagagcctgctgaacaagctgatccgcagcaacctggtggacaacaccaaccaggtggaggtgctgcagagggaccccaacagccccctgtacagcgtgaagagctttgaggagctgcggctgccccagaacctgattgcccagagccagagcggcaccgggaagacagctgcctttgtgctggccatgctgagccaggtggagcccgccaacaagtacccccagtgcctgtgcctgagccccacctatgagctggccctgcagacaggcaaggtgattgagcagatgggcaagttctacccagagctgaagctggcctatgctgtgcggggcaacaagctggagcggggccagaagatcagcgagcagatcgtcatcggcaccccaggcaccgtgctggactggtgcagcaagctgaagttcatcgaccccaagaagatcaaggtgtttgtgctggatgaagcagatgtgatgattgccacccagggccaccaggaccagagcatccgcatccagaggatgctgcccaggaactgccagatgctgctcttcagcgccacctttgaagattctgtgtggaagtttgcccagaaggtggtgcctgaccccaacgtcatcaagctgaagcgggaggaggagaccctggacaccatcaagcagtactacgtgctgtgcagcagcagagatgagaagttccaggccctgtgcaacctgtatggagccatcaccatcgcccaggccatgatcttctgccacaccaggaagacagcctcctggctggccgctgagctgagcaaggagggccaccaggtggccctgctgtctggagagatgatggtggagcagagagctgctgtgattgagcgcttccgggagggcaaggagaaggtgctggtgaccaccaacgtgtgtgcccggggcattgatgtggagcaggtgtctgtggtgatcaactttgacctgcctgtggacaaggatggcaacccagacaatgagacctacctgcaccgcatcggccgcacaggccgctttgggaagaggggcctggccgtgaacatggtggacagcaagcacagcatgaacatcctgaaccgcatccaggagcacttcaacaagaagattgaaaggctggacacagatgacctggatgaaattgagaagatcgccaactag

SEQ ID NO: 19436 - DNA, 1248 bp, Artificial Sequence; identical to SEQ ID NO: 19216
  Description of Artificial Sequence: Synthetic coding sequence

SEQ ID NO: 19437 - DNA, 1026 bp, Artificial Sequence
  Description of Artificial Sequence: Synthetic coding sequence
atggcccaggagagccccaagaacagcgctgctgagatccctgtgaccagcaatggagaggtggatgacagccgggagcacagcttcaacagagacctgaagcacagcctgcccagcggcctgggcctgtctgagacccagatcaccagccacggctttgacaacaccaaggagggcgtgattgaagctggggccttccagggcggccagaggacccagaccaagagcggccctgtgatcctggctgatgagatcaagaacccagccatggagaagctggagctggtgaggaagtggagcctgaacacctacaagtgcacccggcagatcatcagcgagaagctgggccggggcagcaggacagtggacctggagctggaggcccagattgacatcctgcgggacaacaagaagaagtatgagaacatcctgaagctggcccagaccctgagcacccagctgttccagatggtgcacacccagaggcagctgggagatgcctttgctgacctgagcctgaagagcctggagctgcacgaggagtttggctacaatgctgacacccagaagctgctggccaagaatggagagaccctgctgggcgccatcaacttcttcatcgcctctgtgaacaccctggtgaacaagaccatcgaggacaccctgatgacagtgaagcagtatgagagcgccagaattgaatatgatgcctacagaacagacctggaggagctgaacctgggccccagagatgccaacaccctgcccaagattgagcagagccagcacctgttccaggcccacaaggagaagtatgacaagatgagaaatgatgtgtctgtgaagctgaagttcctggaggagaacaaggtgaaggtgctgcacaaccagctggtgctcttccacaatgccatcgccgcctactttgctggcaaccagaagcagctggagcagaccctgaagcagttccacatcaagctgaagaccccaggagtggatgcccccagctggctggaggagcagtag

SEQ ID NO: 19438 - DNA, 1572 bp, Artificial Sequence
  Description of Artificial Sequence: Synthetic coding sequence
atggccaacgtgggcctgcagttccaggccagcgctggggacagcgacccccagagccggcccctgctgctgctgggccagctgcaccacctgcaccgggtgccctggagccacgtgcggggcaagctgcagccccgggtgacagaggagctgtggcaggccgccctgagcaccctgaaccccaaccccacagacagctgccccctgtacctgaactatgccaccgtggccgccctgccctgccgggtgagccgccacaacagccccagcgctgcccacttcatcacccggctggtgaggacctgcctgcccccaggggcccaccgctgcatcgtgatggtgtgtgagcagcctgaggtgtttgccagcgcctgtgccctggcccgggccttccccctcttcacccacaggtctggggccagccggcggctggagaagaagacagtgacagtggagttcttcctggtgggccaggacaatggacctgtggaggtgtccaccctgcagtgcctggccaatgccacagatggagtgcggctggccgcccgcatcgtggacaccccctgcaatgagatgaacacagacaccttcctggaggagatcaacaaggtgggcaaggagctgggcatcatccccaccatcatcagagatgaggagctgaagacccggggctttggaggcatctatggagtgggcaaggccgccctgcaccccccagccctggccgtgctgagccacaccccagatggagccacccagaccatcgcctgggtgggcaagggcatcgtgtatgacaccggcggcctgagcatcaagggcaagaccaccatgcctggcatgaagagggactgtggcggcgctgctgctgtgctgggcgccttccgggccgccatcaagcagggcttcaaggacaacctgcatgctgtgttctgcctggccgagaacagcgtgggccccaatgccaccaggccagatgacatccacctgctgtacagcggcaagacagtggagatcaacaacacagatgctgagggccgcctggtgctggctgatggagtgtcctatgcctgcaaggacctgggcgctgacatcatcctggacatggccaccctgaccggggcccagggcatcgccaccgggaagtaccacgccgctgtgctgaccaacagcgctgagtgggaggccgcctgtgtgaaggccggcaggaaatgtggggacctggtgcaccccctggtgtactgcccagagctgcacttcagcgagttcaccagcgctgtggccgacatgaagaacagcgtggccgaccgggacaacagccccagcagctgtgccggcctcttcatcgccagccacatcggctttgactggccaggagtgtgggtgcacctggacattgctgcccctgtgcatgctggggagcgggccaccggcttcggcgtggccctgctgctggccctgtttggccgggccagcgaggaccccctgctgaacctggtgagccccctgggctgtgaggtggatgtggaggagggggacctgggccgggacagcaagagaagaaggctggtgtag

SEQ ID NO: 19439 - DNA, 1371 bp, Artificial Sequence
  Description of Artificial Sequence: Synthetic coding sequence
atggctgatggcggcagcgagcgggcagatggaagaattgtgaagatggaggtggactacagcgccaccgtggaccagaggctgcctgaatgtgccaagctggccaaggagggccgcctgcaggaggtgattgagaccctgctgagcctggagaagcagaccaggacagccagtgacatggtgtccaccagccgcatcctggtggccgtggtgaagatgtgctatgaggccaaggagtgggacctgctgaatgaaaacatcatgctgctgagcaagagaagaagccagctgaagcaggccgtggccaagatggtgcagcagtgctgcacctacgtggaggagatcacagacctgcccatcaagctgcggctgattgacaccctgaggatggtgacagagggcaagatctacgtggagattgaaagagcccggctgaccaagaccctggccaccatcaaggagcagaatggagatgtgaaggaggccgccagcatcctgcaggagctgcaggtggagacctacggctccatggagaagaaggagcgggtggagttcatcctggagcagatgaggctgtgcctggccgtgaaggactacatccgcacccagatcatcagcaagaagatcaacaccaagttcttccaggaggagaacacagagaagctgaagctgaagtactacaacctgatgatccagctggaccagcacgagggcagctacctgagcatctgcaagcactaccgggccatctatgacaccccctgcatccaggccgagagcgagaagtggcagcaggccctgaagtctgtggtgctgtatgtgatcctggccccctttgacaatgagcagagcgacctggtgcaccgcatcagcggggacaagaagctggaggagatccccaagtacaaggacctgctgaagctgttcaccaccatggagctgatgcgctggagcaccctggtggaggactatggcatggagctgaggaagggcagcctggagagccctgccacagatgtgtttggcagcacagaggagggggagaagcgctggaaggacctgaagaacagagtggtggagcacaacatccgcatcatggccaagtactacacccgcatcaccatgaagaggatggcccagctgctggacctgtctgtggatgaaagtgaggccttcctgagcaacctggtggtgaacaagaccatctttgccaaggtggaccggctggccggcatcatcaacttccagaggcccaaggaccccaacaacctgctgaatgactggagccagaagctgaacagcctgatgagcctggtgaacaagaccacccacctgattgccaaggaggagatgatccacaacctgcagtag

SEQ ID NO: 19440 - DNA, 1011 bp, Artificial Sequence
  Description of Artificial Sequence: Synthetic coding sequence
atgaagattgacatccacagccacatcctgcccaaggagtggccagacctgaagaagagatttggctatggaggctgggtgcagctgcagcaccacagcaagggggaggccaagctgctgaaggatggcaaggtgttccgggtggtgcgggagaactgctgggaccctgaggtgcgcatccgggagatggaccagaagggcgtgacagtgcaggccctgagcacagtgcctgtgatgttctcctactgggccaagccagaggacaccctgaacctgtgccagctgctgaacaatgacctggccagcacagtggtgtcctaccccaggagatttgtgggcctgggcaccctgcccatgcaggcccctgagctggccgtgaaggagatggagcgctgtgtgaaggagctgggcttccctggggtgcagatcggcacccacgtgaatgagtgggacctgaatgcccaggagctgtttcctgtgtatgctgctgctgagcggctgaagtgcagcctgtttgtgcacccctgggacatgcagatggatggccgcatggccaagtactggctgccctggctggtgggcatgcctgctgagaccaccatcgccatctgcagcatgatcatgggcggcgtgtttgagaagttccccaagctgaaggtgtgctttgcccacggcggcggggccttccccttcaccgtgggccgcatcagccacggcttctccatgaggccagacctgtgtgcccaggacaaccccatgaaccccaagaagtacctgggcagcttctacacagatgccctggtgcatgaccccctgagcctgaagctgctgacagatgtgattggcaaggacaaggtgatcctgggcacagactaccccttccccctgggggagctggagcccgggaagctgattgaatccatggaggagtttgatgaggagaccaagaacaagctgaaggctggaaatgccctggccttcctgggcctggagaggaagcagtttgaatag

SEQ ID NO: 19441 - DNA, 1617 bp, Artificial Sequence
  Description of Artificial Sequence: Synthetic coding sequence
atggagctgagctaccagaccctgaagttcacccaccaggcccgggaggcctgtgagatgaggacagaggcccggaggaagaacctgctgatcctgatcagccactacctgacccaggagggctacatcgacacagccaatgccctggagcaggagaccaagctgggcctgcggagatttgaggtgtgtgacaacatcgacctggagaccatcctgatggagtatgagagctactactttgtgaagttccagaagtaccccaagatcgtgaagaagagcagtgacacagctgagaacaacctgccccagaggagccggggcaagaccaggaggatgatgaatgacagctgccagaacctgcccaagatcaaccagcagaggcccaggagcaagaccacagctgggaagacaggagacaccaagagcctgaacaaggagcaccccaaccaggaggtggtggacaacacccggctggagagcgccaactttggcctgcacatcagccgcatcaggaaggacagcggggaggagaatgcccacccccggcggggccagatcatcgacttccagggcctgctgacagatgccatcaagggggccaccagcgagctggccctgaacacctttgaccacaacccagaccccagcgagcggctgctgaagcccctgagcgccttcatcggcatgaacagcgagatgagggagctggccgctgtggtgtcccgggacatctacctgcacaaccccaacatcaagtggaatgacatcatcggcctggatgctgccaagcagctggtgaaggaggccgtggtgtaccccatccgctacccccagctgttcaccggcatcctgagcccctggaagggcctgctgctgtatggccccccaggcaccgggaagaccctgctggccaaggctgtggccacagagtgcaagaccaccttcttcaacatcagcgccagcaccatcgtgtccaagtggaggggggacagcgagaagctggtgcgggtgctgtttgagctggcccgctaccacgcccccagcaccatcttcctggatgagctggagagcgtgatgagccagaggggcacagccagcggcggggagcacgagggcagcctgaggatgaagacagagctgctggtgcagatggatggcctggcccggtctgaggacctggtgtttgtgctggccgccagcaacctgccctgggagctggactgtgccatgctgcggcggctggagaagaggatcctggtggacctgcccagccgggaggcccggcaggccatgatctaccactggctgccccctgtgtccaagagccgggccctggagctgcacacagagctggagtacagcgtgctgagccaggagacagagggctacagcggcagtgacatcaagctggtgtgccgggaggccgccatgaggcctgtgaggaagatctttgatgccctggagaaccaccagagcgagagcagtgacctgccccgcatccagctggacatcgtgaccacagctgacttcctggatgtgctgacccacaccaagcccagcgccaagaacctggcccagcgctacagcgactggcagcgggagtttgaatctgtgtag

SEQ ID NO: 19442 - DNA, 507 bp, Artificial Sequence; identical to SEQ ID NO: 18866
  Description of Artificial Sequence: Synthetic coding sequence

SEQ ID NO: 19443 - DNA, 1764 bp, Artificial Sequence
  Description of Artificial Sequence: Synthetic coding sequence
atggccagcgaggacatcgccaagctggccgagaccctggccaagacccaggtggccggcggccagctgtccttcaagggcaagagcctgaagctgaacacagcagaagatgccaaggatgtgatcaaggagattgaggactttgacagcctggaggccctgcggctggagggcaacacagtgggcgtggaggccgcccgggtgattgccaaggccctggagaagaagtctgagctgaagcgctgccactggagcgacatgttcaccggccgcctgaggacagagatccccccagccctgatcagcctgggggagggcctcatcacagctggggcccagctggtggagctggacctgagtgacaatgccttcggcccagatggagtgcagggctttgaggccctgctgaagagcagcgcctgcttcaccctgcaggagctgaagctgaacaactgtggcatgggcatcggcggcggcaagatcctggccgccgccctgacagagtgccacaggaagagcagcgcccagggcaagcccctggccctgaaggtgtttgtggccggcaggaaccggctggagaatgatggagccacagccctggccgaggccttccgggtgattggcaccctggaggaggtgcacatgccccagaatggcatcaaccaccctggcatcacagccctggcccaggcctttgctgtgaaccccctgctgcgggtcatcaacctgaatgacaacaccttcacagagaagggagctgtggccatggccgagaccctgaagaccctgcggcaggtggaggtgatcaactttggagactgcctggtgcgcagcaaaggagctgtggccatcgcagatgccatccggggcggcctgcccaagctgaaggagctgaacctgtccttctgtgagatcaagagagatgctgccctggccgtggccgaggccatggctgacaaggccgagctggagaagctggacctgaatggaaacaccctgggggaggagggctgtgagcagctgcaggaggtgctggagggcttcaacatggccaaggtgctggccagcctgagtgatgatgaagatgaggaggaggaggaggagggggaggaggaggaggaggaggccgaggaggaggaggaggaggatgaggaggaggaggaggaggaggaggaggaggaggaggaggagccccagcagaggggccagggcgagaagagcgccacccccagcaggaagatcctggaccccaacacaggagagcccgcccctgtgctgagcagccccccaccagcagatgtgtccaccttcctggccttccccagccctgagaagctgctgcggctgggccccaagagctctgtgctgattgcccagcagacagacaccagtgaccctgagaaggtggtgtctgccttcctgaaggtgagcagcgtcttcaaggatgaggccaccgtgaggatggctgtgcaggatgctgtggatgccctgatgcagaaggccttcaacagcagcagcttcaacagcaacaccttcctgacccggctgctggtgcacatgggcctgctgaagtctgaggacaaggtgaaggccatcgccaacctgtatggccccctgatggccctgaaccacatggtgcagcaggactacttccccaaggccctggcccccctgctgctggcctttgtgaccaagcccaacagcgccctggagagctgcagctttgcccggcacagcctgctgcagaccctgtacaaggtgtag

SEQ ID NO: 19444 - DNA, 2529 bp, Artificial Sequence
  Description of Artificial Sequence: Synthetic coding sequence
atggacatcagcaagggcctgcccggcatgcagggcggcctgcacatctggatcagcgagaacaggaagatggtgcctgtgcctgagggcgcctacggcaacttctttgaggagcactgctacgtgatcctgcacgtgccccagagccccaaggccacccagggcgccagcagtgacctgcactactgggtgggcaagcaggccggggctgaggcccagggcgctgctgaggccttccagcagaggctgcaggatgagctgggcggccagacagtgctgcaccgggaggcccagggccacgagagtgactgcttctgcagctacttccggcccggcatcatctacagaaaaggaggcctggccagtgacctgaagcacgtggagaccaacctcttcaacatccagaggctgctgcacatcaagggcaggaagcacgtgtctgccacagaggtggagctgtcctggaacagcttcaacaagggggacatcttcctgctggacctgggcaagatgatgatccagtggaatggccccaagaccagcatcagcgagaaggcccggggcctggccctgacctacagcctgcgggaccgggagcggggcggcggccgggcccagattggagtggtggatgatgaggccaaggccccagacctgatgcagatcatggaggccgtgctgggcagaagagtgggcagcctgcgggccgccacccccagcaaggacatcaaccagctgcagaaggccaacgtgcggctgtaccacgtgtatgagaagggcaaggacctgctgcaggaggaggacttctacatcctggaccagggcggcttcaagatctacgtgtggcagggccgcatgagcagcctgcaggagaggaaggccgccttcagcagagctgtgggcttcatccaggccaagggctaccccacctacaccaacgtggaggtggtgaatgatggagctgagagcgctgccttcaagcagctgttccgcacctggagcgagaagagaagaagaaaccagaagctgggcggccgggacaagagcatccacgtgaagctggatgtgggcaagctgcacacccagcccaagctggccgcccagctgaggatggtggatgatggcagcggcaaggtggaggtgtggtgcatccaggacctgcaccggcagcctgtggaccccaagagacatggccagctgtgtgccggcaactgctacctggtgctgtacacctaccagaggctgggccgggtgcagtacatcctgtacctgtggcagggccaccaggccacagcagatgaaattgaggccctgaacagcaatgctgaggagctggatgtgatgtatggaggagtgctggtgcaggagcacgtgaccatgggcagcgagcccccccacttcctggccatcttccagggccagctggtgatcttccaggagcgggccggccaccacggcaagggccagagcgccagcaccaccaggctcttccaggtgcagggcacagacagccacaacaccaggaccatggaggtgcctgcccgggccagcagcctgaacagcagtgacatcttcctgctggtgacagcctctgtgtgctacctgtggtttgggaagggctgcaatggagaccagcgggagatggcccgggtggtggtgaccgtcatcagcaggaagaatgaggagaccgtgctggagggccaggagcccccccacttctgggaggccctgggcggccgggccccctaccccagcaacaagaggctgcctgaggaggtgcccagcttccagccccggctgtttgagtgcagcagccacatgggctgcctggtgctggccgaggtgggcttcttcagccaggaggacctggacaagtatgacatcatgctgctggacacctggcaggagatcttcctgtggctgggggaggccgccagcgagtggaaggaggccgtggcctggggccaggagtacctgaagacccaccctgctggccgcagccctgccacccccatcgtgctggtgaagcagggccacgagccccccaccttcatcggctggttcttcacctgggacccctacaagtggaccagccaccccagccacaaggaggtggtggatggcagccctgctgctgccagcaccatcagcgagatcacagctgaggtgaacaacctgcggctgagccgctggccaggaaatggccgggccggggctgtggccctgcaggccctgaagggcagccaggacagcagtgaaaatgacctggtgcgcagccccaagtctgctggcagcaggaccagcagctctgtgagcagcaccagcgccaccatcaatggaggcctgcggcgggagcagctgatgcaccaggccgtggaggacctgcctgagggcgtggaccctgcccggcgggagttctacctgagtgacagcgacttccaggacatctttgggaagagcaaggaggagttctacagcatggccacctggaggcagaggcaggagaagaagcagctgggcttcttctag

SEQ ID NO: 19445 - DNA, 1620 bp, Artificial Sequence
  Description of Artificial Sequence: Synthetic coding sequence
atggatgccatggccagccctgggaaggacaactacaggatgaagagctacaagaacaaggccctgaacccccaggagatgagaagaagaagagaggaggagggcatccagctgaggaagcagaagcgggaggagcagctgttcaagagaagaaatgtgtacctgcccagaaatgatgagagcatgctggagagccccatccaggaccctgacatcagcagcacagtgcccatccctgaggaggaggtggtgaccacagacatggtgcagatgatcttcagcaacaatgctgaccagcagctgacagccacccagaagttcaggaagctgctgagcaaggagcccaacccccccatcgaccaggtgatccagaagccaggagtggtgcagagatttgtgaagttcctggagagaaatgaaaactgcaccctgcagtttgaggccgcctgggccctgaccaacatcgccagcggcaccttcctgcacaccaaggtggtgattgaaacaggagctgtgcccatcttcatcaagctgctgaacagcgagcatgaagatgtgcaggagcaggccgtgtgggccctgggcaacattgctggggacaatgcagaatgtcgggactttgtgctgaactgtgagatcctgccccccctgctggagctgctgaccaacagcaaccggctgaccaccaccagaaatgctgtgtgggccctgagcaacctgtgccggggcaagaaccccccacccaacttcagcaaggtgagcccctgcctgaatgtgctgagccggctgctcttcagcagtgaccctgatgtgctggctgatgtgtgctgggccctgagctacctgagtgatggccccaatgacaagatccaggccgtcatcgacagcggcgtgtgccggcggctggtggagctgctgatgcacaatgactacaaggtggtgtccccagccctgcgggctgtgggcaacatcgtgactggagatgacatccagacccaggtgatcctgaactgcagcgccctgccctgcctgctgcacctgctgagcagccccaaggagagcatcaggaaggaggcctgctggacagtgagcaacatcacagctggcaacagagcccagatccaggccgtgattgatgccaacatcttccctgtgctgattgagatcctgcagaaggccgagttccgcaccaggaaggaggccgcctgggccatcaccaatgccaccagcggcggcaccccagagcagatccgctacctggtggccctgggctgcatcaagcccctgtgtgacctgctgactgtgatggacagcaagatcgtgcaggtggccctgaatggcctggagaacatcctgcggctgggggagcaggagagcaagcagaatggcatcggcatcaacccctactgtgccctgattgaggaggcctacggcctggacaagattgagttcctgcagagccatgagaaccaggagatctaccagaaggcctttgacctgattgagcactactttggagtggaggaggatgaccccagcatcgtgccccaggtggatgagaaccagcagcagttcatcttccagcagcaggaggcccccatggatggcttccagctgtag

SEQ ID NO: 19446 - DNA, 3735 bp, Artificial Sequence
  Description of Artificial Sequence: Synthetic coding sequence
atgctgatcaaggagtaccacatcctgctgcccatgagcctggatgagtaccaggtggcccagctgtacatgatccagaagaagagccgggaggagagcagcggggagggcagcggcgtggagatcctggccaaccggccctacacagatggccctgggggcagcggccagtacacccacaaggtgtaccacgtgggcagccacatccctggctggttccgggccctgctgcccaaggccgccctgcaggtggaggaggagagctggaatgcctacccctacaccaggacccgctacacctgcccctttgtggagaagttcagcattgaaattgagacctactacctgcctgatggcggccagcagcccaacgtgttcaacctgtctggagctgagcggcggcagaggatcctggacaccattgatattgtgagagatgctgtggcccctggagagtacaaggccgaggaggacccccggctgtaccacagcgtgaagacaggccggggccccctgagtgatgactgggccaggacagctgcccagacaggccccctgatgtgtgcctacaagctgtgcaaggtggagttccgctactggggcatgcaggccaagattgagcagttcatccatgatgtgggcctgcggcgggtgatgctgcgggcccaccggcaggcctggtgctggcaggatgagtggacagagctgtccatggctgacatccgggccctggaggaggagacagccaggatgctggcccagaggatggccaagtgcaacacaggcagcgagggcagcgaggcccagcccccaggcaagcccagcacagaggcccggtctgctgccagcaacacaggcaccccagatggccctgaggcccctcctggcccagatgccagcccagatgccagctttgggaagcagtggagcagcagcagccgcagcagctacagcagccagcacggcggcgctgtgagcccccagagcctgtctgagtggaggatgcagaacatcgcccgggacagcgagaacagcagcgaggaggagttctttgatgcccacgagggcttcagtgacagcgaggaggtgttccccaaggagatgaccaagtggaacagcaatgacttcattgatgcctttgccagccctgtggaggccgagggcaccccagagcccggggctgaggccgccaagggcattgaagatggagcccaggccccccgggacagcgagggcctggatggagctggggagctgggcgctgaggcctgtgctgtgcacgccctcttcctgatcctgcacagcggcaacatcctggacagcggccctggagatgccaacagcaagcaggctgatgtgcagaccctgagcagcgcctttgaggccgtgacccgcatccacttccctgaggccctgggccacgtggccctgcggctggtgccctgcccccccatctgtgccgccgcctatgccctggtgagcaacctgagcccctacagccatgatggagacagcctgagccgcagccaggaccacatccccctggccgccctgcccctgctggccaccagcagcagccgctaccagggcgctgtggccaccgtcatcgcccggaccaaccaggcctacagcgccttcctgcggagccctgagggcgccggcttctgtggccaggtggccctgattggagatggagtgggcggcatcctgggctttgatgccctgtgccacagcgccaatgccggcaccggcagccggggcagcagccggcggggctccatgaacaatgagctgctgagccctgagtttggacctgtgcgggaccccctggctgatggagtggagggcctgggccggggcagccctgagcccagcgccctgcccccccagaggatccccagcgacatggccagccctgagcctgagggcagccagaacagcctgcaggccgccccagccaccaccagctcctgggagccccggcgggccagcacagccttctgccccccagctgccagcagcgaggccccagatggccccagcagcacagcccggctggacttcaaggtgtctggcttcttcctgtttggcagccccctgggcctggtgctggccctgaggaagacagtgatgcctgccctggaggccgcccagatgaggcctgcctgtgagcagatctacaacctcttccacgccgctgacccctgtgccagccggctggagcccctgctggcccccaagttccaggccatcgcccccctgactgtgccccgctaccagaagttccccctgggagatggcagcagcctgctgctggccgacaccctgcagacccacagcagcctcttcctggaggagctggagatgctggtgcccagcacccccaccagcaccagcggggccttctggaagggcagcgagctggccacagaccccccagcccagcctgctgcccccagcaccaccagcgaggtggtgaagatcctggagcgctggtggggcaccaagagaattgactacagcctgtactgcccagaggccctgacagccttccccaccgtgaccctgccccacctgttccacgccagctactgggagagcgcagatgtggtggccttcatcctgcggcaggtgattgagaaggagcggccccagctggccgagtgtgaggagcccagcatctacagccctgccttcccccgggagaagtggcagaggaagaggacccaggtgaagatcagaaatgtgaccagcaaccaccgggccagtgacacagtggtgtgtgagggccggccccaggtgctgagcggccgcttcatgtatggccccctggatgtggtgaccctgaccggggagaaggtggatgtgtacatcatgacccagcccctgagcggcaagtggatccacttcggcacagaggtgaccaacagcagcggccgcctgaccttccctgtgcccccagagcgggccctgggcattggagtgtaccctgtgaggatggtggtgcggggggaccacacctatgcagagtgctgcctgactgtggtggcccggggcacagaggccgtggtgttcagcattgatggcagcttcaccgcctctgtgtccatcatgggcagtgaccccaaggtgcgggccggggctgtggatgtggtgcgccactggcaggacagcggctacctgattgtgtatgtgacaggccgcccagacatgcagaagcaccgggtggtggcctggctgagccagcacaacttcccccatggagtggtgtccttctgtgatggcctgacccatgaccccctgcggcagaaggccatgttcctgcagagcctggtgcaggaggtggagctgaacatcgtggccggctacggcagccccaaggatgtggccgtgtatgctgccctgggcctgagccccagccagacctacatcgtgggccgggctgtgaggaagctgcaggcccagtgccagttcctgagtgatggctacgtggcccacctgggccagctggaggccggcagccacagccacgccagcagcggcccccccagggctgccctgggcaagagcagctatggagtggccgcccctgtggacttcctgaggaagcagagccagctgctgcggagccggggccccagccaggccgagcgggagggccctggcaccccacccaccaccctggcccggggcaaggcccggagcatcagcctgaagctggacagcgaggagtag

SEQ ID NO: 19447 - DNA, 882 bp, Artificial Sequence
  Description of Artificial Sequence: Synthetic coding sequence
atgacagaggacagccagaggaacttccgctctgtgtactatgagaaggtgggcttccggggcgtggaggagaagaagagcctggagatcctgctgaaggatgaccggctggacacagagaagctgtgcaccttcagccagcgcttccccctgcccagcatgtaccgggccctggtgtggaaggtgctgctgggcatcctgcccccccaccacgagagccacgccaaggtgatgatgtacaggaaggagcagtacctggatgtgctgcacgccctgaaggtggtgcgctttgtgtctgatgccaccccccaggccgaggtgtacctgaggatgtaccagctggagagcggcaagctgcccaggagccccagcttccccctggagccagatgatgaggtgttcctggccatcgccaaggccatggaggagatggtggaggacagcgtggactgctactggatcaccaggagatttgtgaaccagctgaacaccaagtacagagacagcctgccccagctgcccaaggcctttgagcagtacctgaacctggaggatggccgcctgctgacccacctgaggatgtgcagcgctgcccccaagctgccctatgacctgtggttcaagcgctgctttgctggctgcctgcctgagagcagcctgcagagggtgtgggacaaggtggtgtctggcagctgcaagatcctggtgtttgtggccgtggagatcctgctgaccttcaagatcaaggtgatggccctgaacagcgctgagaagatcaccaagttcctggagaacatcccccaggacagcagtgatgccatcgtgtccaaggccatcgacctgtggcacaagcactgcggcacccctgtgcacagcagctag

SEQ ID NO: 19448 - DNA, 249 bp, Artificial Sequence
  Description of Artificial Sequence: Synthetic coding sequence
atgtctgagggggagagccagacagtgctgagcagcggcagtgaccccaaggtggagagcagcagcagcgcccctggcctgacctctgtgagcccccctgtgaccagcaccaccagcgctgccagccctgaggaggaggaggagagtgaagatgaaagtgagatcctggaggagagcccctgtggccgctggcagaagagaagagaggaggtgaaccagagaaatgtgcccggcattgattctgcctag

SEQ ID NO: 19449 - DNA, 5058 bp, Artificial Sequence
  Description of Artificial Sequence: Synthetic coding sequence
atgagcctgcccttctaccagcgctgccaccagcactatgacctgagctacagaaacaaggatgtgcgcagcacagtgagccactaccagcgggagaagaagaggtctgctgtgtacacccagggcagcacagcctacagcagccgcagcagcgctgcccacagaagagagagcgaggccttccggcgggccagcgccagcagcagccagcagcaggccagccagcacgccctgagcagcgaggtgtccaggaaggccgccagcgcctatgactatggcagcagccacggcctgacagacagcagcctgctgctggatgactacagcagcaagctgagccccaagcccaagagggccaagcacagcctgctgtctggagaggagaaggagaacctgcccagcgactacatggtgcccatcttcagcggccggcagaagcacgtgtctggcatcacagacacagaggaggagcgcatcaaggaggccgccgcctacatcgcccagaggaacctgctggccagcgaggagggcatcaccaccagcaagcagagcacagccagcaagcagaccacagccagcaagcagagcacagccagcaagcagagcacagccagcaagcagagcacagccagccggcagagcacagccagccggcagagcgtggtgtccaagcaggccaccagcgccctgcagcaggaggagaccagcgagaagaagagcaggaaggtggtgatccgggagaaggccgagcggctgagcctgaggaagaccctggaggagacagagacctaccacgccaagctgaatgaagaccacctgctgcacgcccctgagttcatcatcaagcccaggagccacacagtgtgggagaaggaaaatgtgaagctgcactgcagcattgctggctggccagagccccgggtgacctggtacaagaaccaggtgcccatcaacgtgcacgccaaccctgggaagtacatcatcgagagccgctatggcatgcacaccctggagatcaatggctgtgactttgaggacacagcccagtaccgggccagcgccatgaatgtgaagggggagctgagcgcctatgcctctgtggtggtgaagcgctacaagggggagtttgatgagacccgcttccacgccggggccagcaccatgcccctgagctttggagtgaccccctacggctacgccagcagatttgagatccactttgatgacaagtttgatgtgtcctttggccgggagggggagaccatgagcctgggctgccgggtggtgatcaccccagagatcaagcacttccagcctgagatccagtggtacagaaatggagtgcccctgagccccagcaagtgggtgcagaccctgtggagcggggagcgggccaccctgaccttcagccacctgaacaaggaggatgagggcctgtacaccatccgggtgaggatgggagagtactatgagcagtacagcgcctacgtgtttgtgagagatgctgatgctgagattgagggcgccccagctgcccccctggatgtgaagtgcctggaggccaacaaggactacatcatcatctcctggaagcagcctgctgtggatggcggcagccccatcctgggctacttcatcgacaagtgtgaggtgggcacagacagctggagccagtgcaatgacacccctgtgaagtttgcccgcttccctgtgacaggcctgattgagggccgcagctacatcttccgggtgcgggctgtgaacaagatgggcatcggcttccccagccgggtgtctgagcctgtggccgccctggaccctgctgagaaggcccggctgaagagccggcccagcgccccctggacaggccagatcatcgtgacagaggaggagcccagcgagggcatcgtgcccggccccccaacagacctgtctgtgacagaggccaccaggagctatgtggtgctgtcctggaagcccccaggccagaggggccacgagggcatcatgtactttgtggagaagtgtgaggccggcacagagaactggcagagggtgaacacagagctgcctgtgaagagccccaggtttgccctgtttgacctggccgagggcaagagctactgcttccgggtgcgctgcagcaacagcgctggggtgggggagcccagcgaggccacagaggtgacagtggtgggggacaagctggacatccccaaggcccctgggaagatcatccccagcaggaacacagacacctctgtggtggtgtcctgggaggagagcaaggatgccaaggagctggtgggctactacatcgaggcctctgtggccggcagcggcaagtgggagccctgcaacaacaaccctgtgaagggcagccgcttcacctgccacggcctggtgacaggccagagctacatcttccgggtgcgggctgtgaatgctgctggcctgtctgagtacagccaggacagcgaggccatcgaggtgaaggccgccatcggcggcggcgtgtccccagatgtgtgcccagccctgagtgatgagcccggcggcctgacagccagccggggccgggtgcatgaggccagcccccccaccttccagaaggatgccctgctgggcagcaagcccaacaagcccagcctgcccagcagcagccagaacctgggccagacagaggtgtccaaggtgtctgagaccgtgcaggaggagctgaccccaccaccccagaaggccgccccccagggcaagagcaagagtgaccccctgaagaagaagacagaccgggccccacccagccccccctgtgacatcacctgcctggagagcttccgggacagcatggtgctgggctggaagcagcctgacaagattggaggagctgagatcaccggctactacgtgaactaccgggaggtgattgatggagtgcctgggaagtggagggaggccaacgtgaaggctgtgtctgaggaggcctacaagatcagcaacctgaaggagaacatggtgtaccagttccaggtggccgccatgaacatggccggcctgggcgcccccagcgctgtgtctgagtgcttcaagtgtgaggagtggaccatcgctgtgcccggccccccccacagcctgaagtgcagcgaggtgaggaaggacagcctggtgctgcagtggaagccccctgtgcacagcggccgcacccctgtgacaggctactttgtggacctgaaggaggccaaggccaaggaggaccagtggaggggcctgaatgaagctgccatcaagaatgtgtacctgaaggtgcggggcctgaaggagggcgtgtcctatgtgttccgggtgcgggccatcaaccaggccggcgtgggcaagcccagcgacctggccggccctgtggtggccgagaccaggcctggcaccaaggaggtggtggtgaatgtggatgatgatggagtcatcagcctgaactttgaatgtgacaagatgacccccaagtctgagttctcctggagcaaggactatgtgtccacagaggacagcccccggctggaggtggagagcaaaggaaacaagaccaagatgaccttcaaggacctgggcatggatgacctgggcatctacagctgtgatgtgacagacacagatggcatcgccagcagctacctgattgatgaggaggagctgaagaggctgctggccctgagccatgagcacaagttccccaccgtgcctgtgaagtctgagctggccgtggagatcctggagaagggccaggtgcgcttctggatgcaggccgagaagctgtctggaaatgccaaggtgaactacatcttcaatgagaaggagatctttgagggccccaagtacaagatgcacatcgacaggaacacaggcatcatcgagatgttcatggagaagctgcaggatgaagatgagggcacctacaccttccagctgcaggacggcaaggccaccaaccacagcacagtggtgctggtgggagatgtgttcaagaagctgcagaaggaggccgagttccagaggcaggagtggatcaggaagcagggcccccactttgtggagtacctgtcctgggaggtgactggagaatgtaatgtgctgctgaagtgcaaggtggccaacatcaagaaggagacccacatcgtgtggtacaaggatgagcgggagatctctgtggatgagaagcatgacttcaaggatggcatctgcaccctgctgatcacagagttcagcaagaaggatgctggcatctatgaggtgatcctgaaggatgaccggggcaaggacaagagccggctgaagctggtggatgaggccttcaaggagctgatgatggaggtgtgcaagaagatcgccctgagcgccacagacctgaagatccagagcacagctgagggcatccagctgtacagctttgtgacctactacgtggaggacctgaaggtgaactggagccacaatggaagtgccatccgctacagcgacagagtgaagacaggagtgactggagagcagatctggctgcagatcaatgagcccaccccaaatgacaagggcaagtatgtgatggagctgtttgatggcaagacaggccaccagaagacagtggacctgagcggccaggcctatgatgaggcctatgcagagttccagaggctgaagcaggccgccatcgccgagaagaacagagcccgggtgctgggcggcctgcctgatgtggtgaccatccaggagggcaaggccctgaacctgacctgcaatgtgtggggagaccccccacctgaggtgtcctggctgaagaatgagaaggccctggccagtgatgaccactgcaacctgaagtttgaagctggccgcacagcctacttcaccatcaacggggtgtccacagctgacagcggcaagtatggcctggtggtgaagaacaagtatggcagcgagaccagtgacttcaccgtgtctgtgttcatccctgaggaggaggccaggatggccgccctggagagcctgaagggcggcaagaaggccaagtag

SEQ ID NO: 19450 - DNA, 5877 bp, Artificial Sequence
  Description of Artificial Sequence: Synthetic coding sequence
atggctgacagaacagccccccgctgccagctgcggctggagtgggtgtatggctaccggggccaccagtgcaggaacaacctgtactacacagctgggaaggaggtggtgtactttgtggccggcgtgggcgtggtgtacaacacccgggagcacagccagaagttcttcctgggccacaatgatgacatcatcagcctggccctgcacccagacaagaccctggtggccaccggccaggtgggcaaggagccctacatctgcatctgggacagctacaacgtgcagacagtgtccctgctgaaggatgtgcacacccatggagtggcctgcctggcctttgacagtgatggccagaggctggcctctgtgggcctggatgccaagaacacagtgtgcatctgggactggaggaagggcaagctgctggccagcgccaccggccacagcgaccgcatctttgacatctcctgggacccctaccagcccaacagagtggtgtcctgtggggtgaagcacatcaagttctggaccctgtgtggaaatgccctgacagccaagaggggcatctttgggaagacaggagacctgcagaccatcctgtgcctggcctgtgccaaggaggacatcacctacagcggggccctgaatggagacatctacgtgtggaagggcctgaacctggtgaggaccatccagggcgcccacagcgctggcatcttctccatgtatgcctgtgaggagggctttgccaccggcggcagagatggctgcatccggctgtgggacacagacttcaagcccatcaccaagattgacctgcgggagacagagcagggctacaagggcctgagcatccgctctgtgtgctggaaggctgaccggctgctggccggcacccaggacagcgagatctttgaggtgattgtgcgggagcgggacaagcccatgctgatcctgcagggccactgtgagggggagctgtgggccctggccctgcaccccaagaagcccctggccgtgacaggcagtgatgacagatctgtgcggctgtggagcctggccgaccacgccctgattgcccgctgcaacatggaggaggccgtgcgctctgtggccttctccccagatggcagccagctggccctgggcatgaaggatggcagcttcatcgtgctgcgggtgcgggacatgacagaggtggtgcacatcaaggacaggaaggaggtgatccacgagatgaagttctccccagatggcagctacctggccgtgggcagcaatgatggccctgtggatgtgtatgctgtggcccagcgctacaagaagatcggggagtgcagcaagagcctgtccttcatcacccacatcgactggagcctggacagcaagtacctgcagaccaatgatggagctggggagcggctcttctacaggatgcccagcggcaagcccctgaccagcaaggaggagatcaagggcatcccctgggcctcctggacctgtgtgaagggccctgaggtgtctggcatctggcccaagtacacagaggtgacagacatcaacagcgtggatgccaactacaacagctctgtgctggtgtctggagatgactttggcctggtgaagctgttcaagttcccctgcctgaagagaggagccaagttcagaaaatatgtgggccacagcgcccacgtgaccaacgtgcgctggagccatgacttccagtgggtgctgagcactggaggagctgaccacagcgtcttccagtggaggttcatccctgagggcgtgtccaatggcatgctggagacagccccccaggagggcggcgctgacagctacagcgaggagagtgacagcgacctgagtgatgtgcctgagctggacagcgacatcgagcaggaggcccagatcaactatgaccggcaggtgtacaaggaggacctgccccagctgaagcagcagagcaaggagaagaaccacgctgtgcccttcctgaagcgggagaaggcccctgaggacagcctgaagctgcagttcatccacggctaccggggctatgactgcaggaacaacctcttctacacccaggccggggaggtggtgtaccacatcgctgctgtggccgtggtgtacaaccggcagcagcacagccagaggctgtacctgggccatgatgatgacatcctgagcctgaccatccaccctgtgaaggactatgtggccaccggccaggtgggcagagatgctgccatccacgtgtgggacacccagaccctgaagtgcctgagcctgctgaagggccagcaccagaggggcgtgtgtgccctggacttcagcgcagatggcaagtgcctggtgtctgtgggcctggatgacttccacagcatcgtgttctgggactggaagaagggggagaagatcgccaccacccggggccacaaggacaagatctttgtggtgaagtgcaacccccaccacgtggacaagctggtgacagtgggcatcaagcacatcaagttctggcagcaggccggcggcggcttcaccagcaagaggggcacctttggatctgtgggcaagctggagaccatgatgtgtgtgtcctatggccgcatggaggacctggtgttcagcggggccgccaccggggacatcttcatctggaaggacatcctgctgctgaagacagtgaaggcccatgatggccctgtgtttgccatgtatgccctggacaagggctttgtgactggaggcaaggatggcatcgtggagctgtgggatgacatgtttgagcgctgcctgaagacctacgccatcaagaggtctgccctgagcaccagcagcaagggcctgctgctggaggacaaccccagcatccgggccatcaccctgggccacggccacatcctggtgggcaccaagaatggagagatcctggagattgacaagagcggccccatgaccctgctggtgcagggccacatggagggggaggtgtggggcctggccgcccaccccctgctgcccatctgtgccaccgtgtctgatgacaagaccctgcgcatctgggagctgagcgcccagcacaggatgctggccgtgaggaagctgaagaagggcggccgctgctgtgccttctccccagatggcaaggccctggccgtgggcctgaatgatggcagcttcctggtggtgaatgctgacacagtggaggacatggtgtccttccaccacaggaaggagatgatcagtgacatcaagttcagcaaggacaccgggaagtacctggccgtggccagccatgacaactttgtggacatctacaacgtgctgaccagcaagagggtgggcatctgcaagggggccagcagctacatcacccacatcgactgggacagccggggcaagctgctgcaggtgaacagcggggcccgggagcagctgttctttgaggccccccggggcaagaggcacatcatccggcccagcgagattgagaagattgagtgggacacctggacctgtgtgctgggccccacctgtgagggcatctggccagcccacagcgacatcacagatgtgaatgctgccagcctgaccaaggactgcagcctgctggccactggagatgactttggatttgtgaagctgttctcctaccctgtgaagggccagcacgcccgcttcaagaagtatgtgggccacagcgcccacgtgaccaacgtgcgctggctgcacaatgattctgtgctgctgactgtgggcggcgctgacacagccctgatgatctggacccgggagtttgtgggcacccaggagagcaagctggtggacagcgaggagagtgacacagatgtggaggaggatggcggctatgacagtgatgtggcccgggagaaggccatcgactacaccaccaagatctatgctgtgtccatccgggagatggagggcaccaagccccaccagcagctgaaggaggtgtctgtggaggagcggccccctgtgtccagagctgccccccagcctgagaagctgcagaagaacaacatcaccaagaagaagaagctggtggaggagctggccctggaccacgtgtttggctaccggggctttgactgcaggaacaacctgcactacctgaatgatggagctgacatcatcttccacacagctgctgctggcatcgtgcagaacctgagcacaggcagccagagcttctacctggagcacacagatgacatcctgtgcctgactgtgaaccagcaccccaagtacagaaatgtggtggccaccagccagatcggcaccacccccagcatccacatctgggatgccatgaccaagcacaccctgtccatgctgcgctgcttccacagcaaaggagtgaactacatcaacttcagcgccaccgggaagctgctggtgtctgtgggcgtggaccctgagcacaccatcaccgtgtggcgctggcaggagggcgccaaggtggccagcagaggaggccacctggagcgcatctttgtggtggagttccggccagacagcgacacccagtttgtgtctgtgggcgtgaagcacatgaagttctggaccctggccggcagcgccctgctgtacaagaagggcgtgattggcagcctgggcgccgccaagatgcagaccatgctgtctgtggcctttggagccaacaacctgaccttcaccggggccatcaatggagatgtgtatgtgtggaaggaccacttcctgatccggctggtggccaaggcccacactggacctgtgttcaccatgtacaccaccctgagagatggcctcatcgtgactggaggcaaggagcggcccaccaaggagggcggcgctgtgaagctgtgggaccaggagatgaagcgctgccgggccttccagctggagaccggccagctggtggagtgtgtgcgctctgtgtgccggggcaagggcaagatcctggtgggcaccaaggatggagagatcatcgaggtgggggagaagaatgctgccagcaacatcctgattgatggccacatggagggggagatctggggcctggccacccaccccagcaaggacctcttcatcagcgccagcaatgatggaacagcccgcatctgggacctggccgacaagaagctgctgaacaaggtgtccctgggccacgccgcccgctgtgccgcctacagcccagatggagagatggtggccatcggcatgaagaatggagaatttgtgatcctgctggtgaacagcctgaaggtgtggggcaagaagagggacaggaagagcgccatccaggacatccgcatcagcccagacaaccgcttcctggccgtgggcagcagcgagcacacagtggacttctatgacctgacccagggcaccaacctgaaccgcatcggctactgcaaggacatccccagctttgtgatccagatggacttcagcgcagatggcaagtacatccaggtgtccactggagcctacaagaggcaggtgcatgaggtgcccctgggcaagcaggtgacagaagctgtggtgattgagaagatcacctgggcctcctggacctctgtgctgggagatgaggtgattggcatctggcccagaaatgctgacaaggcagatgtgaactgtgcctgtgtgacccatgctggcctgaacatcgtgactggagatgactttggcctggtgaagctgtttgacttcccctgcacagagaagtttgccaagcacaagcgctacttcggccacagcgcccacgtgaccaacatccgcttctcctatgatgacaagtatgtggtgtccactggaggagatgactgcagcgtgtttgtgtggcgctgcctgtag

SEQ ID NO: 19451 - DNA, 630 bp, Artificial Sequence
  Description of Artificial Sequence: Synthetic coding sequence
atgaaccccagcatgaagcagaagcaggaggagatcaaggagaacatcaagaacagctctgtgcccaggaggaccctgaagatgatccagcccagcgccagcggcagcctggtgggcagagaaaatgagctgtctgctggcctgagcaagaggaagcacagaaatgaccacctgaccagcaccaccagcagccctggggtcatcgtgcctgagagcagcgagaacaagaacctgggcggcgtgacccaggagagctttgacctgatgatcaaggagaaccccagcagccagtactggaaggaggtggccgagaagaggaggaaggccctgtatgaggccctgaaggaaaatgagaagctgcacaaggagattgagcagaaggacaatgaaattgcccggctgaagaaggagaacaaggagctggccgaggtggccgagcacgtgcagtacatggccgagctgattgagcggctgaatggagagcccctggacaactttgagagcctggacaaccaggagtttgacagcgaggaggagaccgtggaggacagcctggtggaggacagcgagatcggcacctgtgccgagggcaccgtgagcagcagcacagatgccaagccctgcatctag

SEQ ID NO: 19452 - DNA, 1635 bp, Artificial Sequence
  Description of Artificial Sequence: Synthetic coding sequence
atgaacaccagcatcccctaccagcagaacccctacaacccccggggcagcagcaatgtcatccagtgctaccgctgtggggacacctgcaagggggaggtggtgcgggtgcacaacaaccacttccacatccgctgcttcacctgccaggtgtgtggctgcggcctggcccagagcggcttcttcttcaagaaccaggagtacatctgcacccaggactaccagcagctgtatggcacccgctgtgacagctgccgggacttcatcaccggggaggtgatcagcgccctgggccgcacctaccaccccaagtgctttgtgtgcagcctgtgcaggaagcccttccccatcggggacaaggtgaccttcagcggcaaggaatgtgtgtgccagacctgcagccagagcatggccagcagcaagcccatcaagatccggggccccagccactgtgccggctgcaaggaggagatcaagcacggccagagcctgctggccctggacaagcagtggcacgtgtcctgcttcaagtgccagacctgcagcgtcatcctgaccggggagtacatcagcaaggatggagtgccctactgtgagagtgactaccacgcccagtttggcatcaagtgtgagacctgtgaccgctacatcagcggccgggtgctggaggccggcggcaagcactaccaccccacctgtgcccgctgtgtgcgctgccaccagatgttcacagaaggagaggagatgtacctgaccggcagcgaggtgtggcaccccatctgcaagcaggccgcccgggcagagaagaagctgaagcacaggaggaccagcgagaccagcatcagccccccaggcagcagcatcggcagccccaacagagtcatctgtgacatctatgagaacctggacctgcggcagaggcgggccagcagccctggctacatcgacagccccacctacagccggcagggcatgagccccaccttcagccgcagcccccaccactactacagaagtggggacctgagcacagccaccaagagcaagaccagcgaggacatcagccagaccagcaagtacagccccatctacagcccagacccctactatgccagcgagagcgagtactggacctaccacggcagccccaaggtgccccgggcccggcgcttcagcagtggaggagaagaagatgactttgaccgctccatgcacaagctgcagagcggcatcggccgcctcatcctgaaggaggagatgaaggcccggagcagcagctatgctgacccctggaccccacccaggagcagcaccagcagccgggaggccctgcacacagctggctatgagatgagcctgaatggcagccccaggagccactacctggccgacagcgaccccctcatcagcaagagcgccagcctgcctgcctacagaagaaatggcctgcacaggacccccagcgctgacctcttccactatgacagcatgaatgctgtgaactggggcatgagggagtacaagatctacccctatgagctgctgctggtgaccacccggggcaggaaccggctgcccaaggatgtggacaggacccggctggagggcaacttctggaagagcggctgcctgtag

SEQ ID NO: 19453 - DNA, 840 bp, Artificial Sequence
  Description of Artificial Sequence: Synthetic coding sequence
atgacccccagcgagggcgcccgggccggcaccggccgggagctggagatgctggacagcctgctggccctgggcggcctggtgctgctgcgggacagcgtggagtgggagggccgcagcctgctgaaggccctggtgaagaagagcgccctgtgtggggagcaggtgcacatcctgggctgtgaggtgtctgaggaggagttccgggagggctttgacagcgacatcaacaaccggctggtgtaccatgacttcttccgggaccccctgaactggagcaagacagaggaggccttccctgggggccccctgggcgccctgcgggccatgtgcaagaggacagatcctgtgcctgtgaccatcgccctggacagcctgtcctggctgctgctgcggctgccctgcaccaccctgtgccaggtgctgcatgctgtgagccaccaggacagctgccctggggacagcagctctgtgggcaaggtgtctgtgctgggcctgctgcacgaggagctgcacggccctggccctgtgggcgccctgagcagcctggcccagacagaggtgaccctgggcggcaccatgggccaggccagcgcccacatcctgtgccggcggccccggcagaggcccacagaccagacccagtggttcagcatcctgcctgacttcagcctggacctgcaggagggccccagcgtggagagccagccctacagcgacccccacatcccccctgtgtccaagaatgccaaggcccggaccaggaagtgcagcctggtgtctggccacggccgggagaacaagagctgccggggctggggctggggccagggcttctag

SEQ ID NO: 19454 - DNA, 405 bp, Artificial Sequence
  Description of Artificial Sequence: Synthetic coding sequence
atgtctgaaaatgctgcccctggcctgtgtggggagctgctgctgcagaggggcaccaccaaggtggccaccggcctggtgctgaacagagaccagaggctggcctgggccgagaacagcattgacttcatcagccgggagctgtgtgcccacagcatcaggaagctgcaggcccacgtgctgctgatcaaggctgtgcacggctactttgacagccggcagaactacagcgagaaggagagcctgtccttcatgattgacaccatgaagagcaccctgaaggagcagttccagtttgtggaggtgcccggcaaccactgtgtgcacatgtctgagccccagcacgtggccagcatcatcagcagcttcctgcagtgcacccacatgctgcctgcccagctgtag

SEQ ID NO: 19455 - DNA, 1350 bp, Artificial Sequence
  Description of Artificial Sequence: Synthetic coding sequence
atgatgctgggcacagaaggaggagagggctttgtggtgaaggtgcggggcctgccctggagctgcagcgcagatgaggtgcagcgcttcttcagtgactgcaagatccagaatggagcccagggcatccgcttcatctacacccgggagggccggcccagcggggaggcctttgtggagctggagagtgaagatgaggtgaagctggccctgaagaaggaccgggagaccatgggccaccgctacgtggaggtgttcaagagcaacaacgtggagatggactgggtgctgaagcacacaggccccaacagcccagacacagccaatgatggctttgtgcggctgcggggcctgcccttcggctgcagcaaggaggagatcgtgcagttcttcagcggcctggagatcgtgcccaacggcatcaccctgcctgtggacttccagggccgcagcactggagaggcctttgtgcagtttgccagccaggagattgctgagaaggccctgaagaagcacaaggagcgcatcggccaccgctacatcgagatcttcaagagcagcagagctgaggtgaggacccactatgacccccccaggaagctgatggccatgcagaggcctggcccctatgacaggcctggagctggccggggctacaacagcatcggccgcggggccggctttgagaggatgagaagaggagcctacggcggcggctacggcggctatgatgactacaacggctacaatgatggctacggctttggaagtgaccgcttcggccgggacctgaactactgcttcagcggcatgtctgaccacagatatggagatggcggcagcaccttccagagcaccaccggccactgtgtgcacatgaggggcctgccctaccgggccacagaaaatgacatctacaacttcttcagccccctgaaccctgtgcgggtgcacattgaaattggaccagatggccgggtgactggagaggctgatgtggagtttgccacccatgaagatgctgtggccgccatgagcaaggacaaggccaacatgcagcaccgctacgtggagctgttcctgaacagcacagctggggccagcggcggggcctatgagcaccgctacgtggagctgttcctgaacagcacagctggggccagcggcggggcctacggcagccagatgatgggcggcatgggcctgagcaaccagagcagctatggaggccctgccagccagcagctgagcggcggctacggcggcggctacggcggccagagctccatgagcggctatgaccaggtgctgcaggagaacagcagtgacttccagagcaacatcgcctag

SEQ ID NO: 19456 - DNA, 4077 bp, Artificial Sequence
  Description of Artificial Sequence: Synthetic coding sequence
atgggcaaccagctggccggcatcgcccccagccagatcctgtctgtggagagctacttcagtgacatccatgactttgaatatgacaagagcctgggcagcacccgcttcttcaaggtggcccgggccaagcaccgggagggcctggtggtggtgaaggtgtttgccatccaggaccccaccctgcccctgaccagctacaagcaggagctggaggagctgaagatccggctgaacagcgcccagaactgcctgcccttccagaaggccagcgagaaggccagcgagaaggccgccatgctgttccggcagtatgtgcgggacaacctgtatgaccgcatcagcacccggcccttcctgaacaacatcgagaagcgctggatcgccttccagatcctgacagctgtggaccaggcccacaagagcggcgtgcgccacggggacatcaagacagaaaatgtgatggtgacctcctggaactgggtgctgctgacagactttgccagcttcaagcccacctacctgcctgaggacaacccagctgacttcaactacttctttgacaccagcagaagaaggacctgctacatcgcccctgagagatttgtggatggcggcatgtttgccacagagctggagtacatgagggaccccagcacccccctggtggacctgaacagcaaccagaggaccagaggagagctgaagagggccatggacatcttctctgctggctgtgtgattgctgagctgttcacagaaggagtgcccctgtttgacctgagccagctgctggcctacagaaatggccacttcttccctgagcaggtgctgaacaagattgaggaccacagcatccgggagctggtgacccagatgatccaccgggagccagacaagaggctggaggccgaggactacctgaagcagcagagaggaaatgccttccctgagatcttctacaccttcctgcagccctacatggcccagtttgccaaggagaccttcctgtctgcagatgagcgcatcctggtgatcaggaaggacctgggcaacatcatccacaacctgtgtggccatgacctgcctgagaaggccgagggggagcccaaggaaaatggcctggtgatcctggtgtctgtcatcaccagctgcctgcagaccctgaagtactgtgacagcaagctggccgccctggagctgatcctgcacctggccccccggctgtctgtggagatcctgctggaccgcatcaccccctacctgctgcacttcagcaatgattctgtgccccgggtgcgggcagaggccctgcggaccctgaccaaggtgctggccctggtgaaggaggtgcccagaaatgacatcaacatctacccagagtacatcctgcccggcatcgcccacctggcccaggatgatgccaccatcgtgcggctggcctatgcagagaacatcgccctgctggccgagacagccctgcgcttcctggagctggtgcagctgaagaacctgaacatggagaatgaccccaacaatgaggagattgatgaggtgacccaccccaatggaaattatgacacagagctgcaggccctgcacgagatggtgcagcagaaggtggtgaccctgctgagtgaccctgaaaatattgtgaagcagaccctgatggagaatggcatcacccggctgtgtgtgttcttcggccggcagaaggccaatgatgtgctgctgagccacatgatcaccttcctgaatgacaagaatgactggcacctgcggggggccttctttgacagcatcgtgggcgtggccgcctacgtgggctggcagagcagcagcatcctgaagcccctgctgcagcagggcctgagtgatgctgaggagtttgtgattgtgaaggccctgtatgccctgacctgcatgtgccagctgggcctgctgcagaagccccacgtgtatgaatttgccagtgacatcgcccccttcctgtgccaccccaacctgtggatccgctatggagctgtgggcttcatcaccgtggtggcccggcagatcagcacagcagatgtgtactgcaagctgatgccctacctggacccctacatcacccagcccatcatccagatcgagaggaagctggtgctgctgtctgtgctgaaggagcctgtgagccgcagcatctttgattatgccctgcggagcaaggacatcaccagcctcttccgccacctgcacatgaggcagaagaagagaaatggcagcctgcctgactgccccccaccagaagatcctgccatcgcccagctgctgaagaagctgctgagccagggcatgacagaggaggaggaggacaagctgctggccctgaaggacttcatgatgaagagcaacaaggccaaggccaacatcgtggaccagagccacctgcatgacagcagccagaagggcgtgattgacctggccgccctgggcatcaccggccggcaggtggacctggtgaagaccaagcaggagccagatgacaagagggccaggaagcacgtgaagcaggacagcaatgtgaatgaggagtggaagtccatgtttggcagcctggacccccccaacatgccccaggccctgcccaagggcagtgaccaggaggtgatccagacaggcaagcccccaagaagtgagagcagcgctggcatctgtgtgcccctgagcaccagcagccaggtgcctgaggtgaccaccgtgcagaacaagaagcctgtgattcctgtgctgagcagcaccatcctgcccagcacctaccagatccgcatcaccacctgcaagacagagctgcagcagctgatccagcagaagcgggagcagtgcaatgctgagcgcatcgccaagcagatgatggagaatgctgagtgggagagcaagcccccacctcctggctggaggcccaagggcctgctggtggcccacctgcacgagcacaagtctgctgtgaaccgcatccgggtgtctgatgagcacagcctgtttgccacctgcagcaatgatggcaccgtgaagatctggaacagccagaagatggagggcaagaccaccaccaccaggagcatcctgacctacagcagaattggaggccgggtgaagaccctgaccttctgccagggcagccactacctggccatcgccagtgacaatggagctgtgcagctgctgggcatcgaggccagcaagctgcccaagagccccaagatccaccccctgcagagccgcatcctggaccagaaggaggatggctgtgtggtggacatgcaccacttcaacagcggggcccagagcgtgctggcctatgccaccgtgaatggcagcctggtgggctgggacctgcggagcagcagcaatgcctggaccctgaagcatgacctgaagagcggcctcatcaccagctttgctgtggacatccaccagtgctggctgtgcatcggcaccagcagcggcaccatggcctgctgggacatgaggttccagctgcccatcagcagccactgccaccccagccgggcccgcatccggcggctgtccatgcaccccctgtaccagagctgggtgattgctgctgtgcagggcaacaatgaggtgtccatgtgggacatggagactggagaccggcgcttcaccctgtgggccagcagcgccccacccctgtctgagctgcagcccagcccccacagcgtgcacggcatctactgcagccctgcagatggcaaccccatcctgctgacagctggcagtgacatgaagatccgcttctgggacctggcctacccagagaggagctatgtggtggccggcagcaccagcagccccagcgtgtcctactacaggaagatcatcgagggcacagaggtggtgcaggagatccagaacaagcagaaggtgggccccagtgatgacaccccccggcggggccctgagagcctgcctgtgggccaccacgacatcatcacagatgtggccaccttccagaccacccagggcttcatcgtgacagccagcagagatggcatcgtgaaggtgtggaagtag

SEQ ID NO: 19457 - DNA, 993 bp, Artificial Sequence
  Description of Artificial Sequence: Synthetic coding sequence
atgcctgtggtgaccacagatgctgagagcgagaccggcatccccaagagcctgagcaatgagccccccagcgagaccatggaggagattgagcacacctgcccccagccccggctgaccctgacagccccagccccctttgctgatgagaccaactgccagtgccaggcccctcatgagaagctgaccatcgcccaggcccggctgggcaccccagctgacaggcctgtgcgggtgtatgcagatggcatctttgacctcttccacagcggccacgcccgggccctgatgcaggccaagaccctcttccccaacagctacctgctggtgggcgtgtgcagtgatgacctgacccacaagttcaagggcttcaccgtgatgaatgaggccgagagatatgaggccctgcggcactgccgctacgtggatgaagtcatcagagatgccccctggaccctgaccccagagttcctggagaagcacaagattgactttgtggcccatgatgacatcccctacagcagcgctggcagtgatgatgtgtacaagcacatcaaggaggccggcatgtttgtgcccacccagaggacagagggcatcagcaccagtgacatcatcaccagaattgtgcgggactatgatgtgtatgcccggaggaacctgcagaggggctacacagccaaggagctgaatgtgtccttcatcaatgagaagcgctaccgcttccagaaccaggtggacaagatgaaggagaaggtgaagaatgtggaggagaggagcaaggagtttgtgaacagagtggaggagaagagccatgacctgatccagaagtgggaggagaagagccgggagttcatcggcaacttcctggagctgtttggaccagatggagcctggaagcagatgttccaggagaggagcagcaggatgctgcaggccctgagccccaagcagagccccctgaagtcctgggcccgctgccgggacttctag

SEQ ID NO: 19458 - DNA, 2025 bp, Artificial Sequence
  Description of Artificial Sequence: Synthetic coding sequence
atgcagaccagcagcagccgctctgtgcacctgtctgagtggcagaagaactactttgccatcaccagcggcatctgcaccggccccaaggcagatgcctaccgggcccagatcctgcgcatccagtatgcctgggccaacagcgagatcagccaggtgtgtgccaccaagctgttcaagaagtatgcagagaagtacagcgccatcatcgacagcgacaacgtggagagcggcctgaacaactatgcagagaacatcctgaccctggccggcagccagcagacagacagcgacaagtggcagagcggcctgagcatcaacaacgtgttcaagatgagctctgtgcagaagatgatgcaggccggcaagaagttcaaggacagcctgctggagcccgccctggcctctgtggtgatccacaaggaggccaccgtgtttgacctgcccaagttctctgtgtgtggcagcagccaggagagtgacagcctgcccaacagcgcccatgaccgggacaggacccaggacttccctgagagcaaccggctgaagctgctgcagaatgcccagccccccatggtgaccaacacagcccggacctgccccaccttcagcgcccctgtgggggagagcgccacagccaagttccacgtgacccccctgtttggaaatgtgaagaaggagaaccacagcagcgccaaggagaacatcggcctgaatgtgttcctgagcaaccagagctgcttccctgctgcctgtgagaacccccagaggaagagcttctacggcagcggcaccattgatgccctgagcaaccccatcctgaacaaggcctgcagcaagacagaggacaatggccccaaggaggacagcagcctgcccaccttcaagacagccaaggagcagctgtgggtggaccagcagaagaagtaccaccagccccagagggccagcggcagcagctatggaggagtgaagaagagcctgggcgccagccgcagccggggcatcctgggcaagtttgtgccccccatccccaagcaggacggcggggagcagaatggaggcatgcagtgcaagccctatggagctggccccacagagcccgcccaccctgtggatgagcggctgaagaacctggagcccaagatgattgagctgatcatgaatgagatcatggaccacggcccccctgtgaactgggaggacattgctggggtggagtttgccaaggccaccatcaaggagatcgtggtgtggcccatgctgcggccagacatcttcaccggcctgcggggcccccccaagggcatcctgctgtttggccccccaggcaccgggaagaccctcatcggcaagtgcatcgccagccagagcggggccaccttcttcagcatcagcgccagcagcctgaccagcaagtgggtgggggagggggagaagatggtgcgggccctgtttgctgtggcccgctgccagcagcctgctgtgatcttcattgatgaaattgacagcctgctgagccagagaggagatggagagcacgagagcagccgccgcatcaagacagagttcctggtgcagctggatggagccaccaccagcagcgaggaccgcatcctggtggtgggcgccaccaaccggccccaggagattgatgaggccgcccggcggcggctggtgaagaggctgtacatccccctgcctgaggccagcgccaggaagcagatcgtcatcaacctgatgagcaaggagcagtgctgcctgtctgaggaggagattgagcagatcgtgcagcagagtgatgccttcagcggggctgacatgacccagctgtgccgggaggccagcctgggccccatccgcagcctgcagacagctgacatcgccaccatcaccccagaccaggtgcggcccatcgcctacatcgactttgaaaatgccttcagaacagtgcggcccagcgtgagccccaaggacctggagctgtatgagaactggaacaagaccttcggctgtgggaagtag

SEQ ID NO: 19459 - DNA, 1143 bp, Artificial Sequence
  Description of Artificial Sequence: Synthetic coding sequence
atgctgcggaggaagcccagcaatgccagcgagaaggagcccacccagaagaagaagctgagcctgcagaggagcagcagcttcaaggactttgccaagagcaagcccagcagccctgtggtgtctgagaaggagttcaacctggatgacaacatcccagaagatgattctggagtgcccaccccagaagatgctgggaagagcggcaagaagctgggcaagaagtggagggctgtgatcagcaggaccatgaacaggaagatgggcaagatgatggtgaaggccctgtctgaggagatggctgacaccctggaggagggcagcgccagccccaccagcccagactacagcctggacagccctggccctgagaagatggccctggccttcagcgagcaggaggagcacgagctgcctgtgctgagccggcaggccagcactggaagtgagctgtgcagccccagccctggcagcggcagctttggagaggagcccccagccccccagtacacaggccccttctgtggccgggcccgggtgcacacagacttcacccccagcccctatgaccatgacagcctgaagctgcagaagggagatgtgatccagatcatcgagaagccccctgtgggcacctggctgggcctgctgaatggcaaggtgggcagcttcaagttcatctacgtggatgtgctgcctgaggaggccgtgggccacgcccggcccagccggcggcagagcaagggcaagaggcccaagcccaagaccctgcacgagctgctggagcgcatcggcctggaggagcacaccagcaccctgctgctgaatggctaccagaccctggaggacttcaaggagctgcgggagacccacctgaatgagctgaacatcatggacccccagcaccgggccaagctgctgacagctgctgagctgctgctggactatgacaccggcagcgaggaggccgaggagggcgctgagagcagccaggagcctgtggcccacacagtgtctgagcccaaggtggacatcccccgggacagcggctgctttgagggcagcgagagcggcagagatgatgctgagctggccggcacagaggagcagctgcagggcctgagcctggccggggccccctag

SEQ ID NO: 19460 - DNA, 1692 bp, Artificial Sequence
  Description of Artificial Sequence: Synthetic coding sequence
atgaaccccctgtttggccccaacctcttcctgctgcagcaggagcagcagggcctggccggccccctgggggacagcctgggcggggaccactttgctgggggcggggacctgcccccagcccccctgagccctgctggccctgctgcctacagccccccaggccctggccctgcccccccagctgccatggccctgagaaatgacctgggcagcaacatcaacgtgctgaagaccctgaacctgcgcttccgctgcttcctggccaaggtgcatgagctggagaggaggaaccggctgctggagaagcagctgcagcaggccctggaggagggcaagcagggccggcggggcctgggcagaagagaccaggccgtgcagacaggctttgtgagccccatccggcccctgggcctgcagctgggcgcccggcctgctgctgtgtgcagccccagcgcccgggtgctgggcagccctgcccggagccctgctggccccctggcccccagcgctgccagcctgagcagcagcagcaccagcaccagcaccacctacagcagcagcgcccgcttcatgcctggcaccatctggagcttcagccacgcccggcggctgggccctggcctggagcccaccctggtgcagggccctggcctgtcctgggtgcacccagatggagtgggcgtgcagattgacaccatcaccccagagatccgggccctgtacaacgtgctggccaaggtgaagcgggagagagatgagtacaagaggcgctgggaggaggagtacacagtgcgcatccagctgcaggacagagtgaatgagctgcaggaggaggcccaggaggctgatgcctgccaggaggagctggccctgaaggtggagcagctgaaggccgagctggtggtgttcaagggcctgatgagcaacaacctgtctgagctggacaccaagatccaggagaaggccatgaaggtggacatggacatctgcagaagaattgacatcacagccaagctgtgtgatgtggcccagcagaggaactgtgaggacatgatccagatgttccagaagaagctggtgcccagcatgggcggcaggaagcgggagaggaaggctgctgtggaggaggacaccagcctgtctgagagcgagggcccccggcagccagatggagatgaggaggagagcacagccctgagcatcaatgaggagatgcagaggatgctgaaccagctgcgggagtatgactttgaagatgactgtgacagcctgacctgggaggagacagaggagaccctgctgctgtgggaggacttcagcggctacgccatggctgctgctgaggcccagggcgagcagcaggaggacagcctggagaaggtgatcaaggacacagagagcctcttcaagacccgggagaaggagtaccaggagaccatcgaccagatcgagctggagctggccacagccaagaatgacatgaacagacacctgcacgagtacatggagatgtgcagcatgaagaggggcctggatgtgcagatggagacctgccggcggctcatcacccagagcggggacaggaagagccctgccttcaccgctgtgcccctgagtgaccccccacctcctccttctgaggccgaggacagcgacagagatgtgtccagtgacagctccatgaggtag

SEQ ID NO: 19461 - DNA, 1893 bp, Artificial Sequence
  Description of Artificial Sequence: Synthetic coding sequence
atgctgttcctggccatcccccagagcattgatgaggagacagaggtgtggagcgaccacatcatcttcccccgcatcccccggggccctgtgcagcagcccctggaggaccgcatcttcaccccagctgtgtctgctgtgtacagcacagtgacccaggtggcccggcagcccggcacccccacccccagcccctacagcgcccacgagatcaacaagggccaccccaacctggccgccaccccacctggccacgccagcagccctggcctgagccagaccccctaccccagcggccagaatgccggccccaccaccctggtgtacccccagaccccccagaccatgaacagccagccccagaccaggagcccctttgctgctggcccccggcccccccaccaccagttcttccagaggccccagatccagcccccccgggccaccatccccaacagcagccccagcatccggcctggggcccagacccccacagctgtgtaccaggccaaccagcacatcatgatggtgaaccacctgcccatgccctaccctgtgccccagggcccccagtactgcatcccccagtaccgccacagcggccccccctacgtgggccccccccagcagtaccctgtgcagcccccaggccctggccccttctacccaggccctggccctggggacttccccaatgcctacggcacccccttctaccccagccagcctgtgtaccagagcgcccccatcatcgtgcccacccagcagcagcccccaccagccaagcgggagaagaagaccatccgcatccgggaccccaaccagggcggcaaggacatcacagaggagatcatgtctgggggcggcagcaggaaccccaccccacccatcggccggcccaccagcacccccaccccaccccagcagctgcccagccaggtgcctgagcacagccctgtggtgtatggcaccgtggagagcgcccacctggccgccagcacccctgtgacagctgccagtgaccagaagcaggaggagaagcccaagccagaccctgtgctgaagagccccagccctgtgctgcggctggtgctgagcggggagaagaaggagcaggagggccagaccagcgagaccacagccatcgtgtccattgctgagctgcccctgccccccagccccaccaccgtgtcctctgtggcccggagcaccatcgccgcccccaccagcagcgccctgagcagccagcccatcttcaccacagccattgatgacagatgtgagctgagcagcccccgggaggacaccatccccatccccagcctgaccagctgcacagagaccagtgaccccctgcccaccaatgaaaatgatgatgacatctgcaagaagccctgcagcgtggccccaaatgacatccccctggtgagcagcaccaacctgatcaatgagatcaacggggtgtctgagaagctgagcgccacagagagcatcgtggagatcgtgaagcaggaggtgctgcccctgaccctggagctggagatcctggagaaccccccagaggagatgaagctggagtgcatcccagcccccatcacccccagcacagtgcccagcttcccccccaccccacccaccccaccagccagccccccccacacccctgtgattgtgcctgctgctgccaccaccgtgagcagccccagcgctgccatcaccgtgcagagggtgctggaggaggatgagagcatccgcacctgcctgtctgaagatgccaaggagatccagaacaagattgaggtggaggctgatggccagacagaggagatcctggacagccagaacctgaacagcagaagaagccctgtgcctgagaccagcaatgaatgttag

SEQ ID NO: 19462 - DNA, 414 bp, Artificial Sequence
  Description of Artificial Sequence: Synthetic coding sequence
atgatcctgcccaccaaggccatggccacccaggagctgactgtgaagaggaagctgagcggcaacaccctgcaggtgcaggccagcagccctgtggccctgggcgtgcgcatccccaccgtggccctgcacatgatggagctgtttgacaccaccgtggagcagctgtacagcatcttcaccgtgaaggagctgaccaacaagaagatcatcatgaagtggaggtgtggcaactggccagaggagcactacgccatggtggccctgaactttgtgcccaccctgggccagacagagctgcagctgaaggagttcctgagcatctgcaaggaggagaacatgaagttctgctggcagaagcagcactttgaggagatcaagggcagcctgcagctgacccccctgaatggatag

SEQ ID NO: 19463 - DNA, 1248 bp, Artificial Sequence; identical to SEQ ID NO: 19216
  Description of Artificial Sequence: Synthetic coding sequence

SEQ ID NO: 19464 - DNA, 1464 bp, Artificial Sequence
  Description of Artificial Sequence: Synthetic coding sequence
atgagcagccccctggccagcctgagcaagaccaggaaggtgcccctgcccagcgagcccatgaaccctggaagaagaggcatccgcatctatggagatgtgcctgccagccatgacagcgagctgatggccttcatgaccaggaagctgtgggacctggagcagcaggtgaaggcccagacagatgagatcctgagcaaggaccagaagattgctgccctggaggacctggtgcagaccctgcggccccaccctgctgaggccaccctgcagaggcaggaggagctggagaccatgtgtgtgcagctgcagaggcaggtgcgggagatggagcgcttcctgagtgactatggcctgcagtgggtgggggagcccatggaccaggaggacagcgagagcaagacagtgtctgaacatggagagcgggactggatgacagccaagaagttctggaagccaggggacagcctggcccctcctgaggtggactttgaccggctgctggccagcctgcaggacctgtctgagctggtggtggagggggacacccaggtgacccctgtgcctggaggagcccggctgcggaccctggagcccatccccctgaagctgtacagaaatggcatcatgatgtttgatggccccttccagcccttctatgaccccagcacccagcgctgcctgcgggacatcctggatggcttcttccccagcgagctgcagaggctgtaccccaacggggtgcccttcaaggtgtctgacctgaggaaccaggtgtacctggaggatggcctggaccccttccctggagagggccgggtggtgggccggcagctgatgcacaaggccctggacagagtggaggagcaccctggcagcaggatgacagctgagaagttcctgaaccggctgcccaagtttgtgatccggcagggcgaggtgattgacatccggggccccatccgggacaccctgcagaactgctgccccctgcctgcccgcatccaggagatcgtggtggagacccccaccctggccgctgagcgggagaggagccaggagagccccaacaccccagccccacccctgtccatgctgcgcatcaagtcagaaaatggagagcaggccttcctgctgatgatgcagcctgacaacaccatcggagatgtgcgggccctgctggcccaggcccgggtgatggatgccagcgcctttgagatcttcagcaccttcccccccaccctgtaccaggatgacaccctgaccctgcaggccgccggcctggtgcccaaggccgccctgctgctgcgggcccggcgggcccccaagagcagcctgaagttcagccctggcccctgccccggccctggccctggccccagccctggccctggccctggccccagccctggccctggccctggccccagcccctgccccggccccagccccagcccccagtag

SEQ ID NO: 19465 - DNA, 1467 bp, Artificial Sequence
  Description of Artificial Sequence: Synthetic coding sequence
atgtctgccttctgcctgggcctggtgggccgggccagcgccccagctgagccagacagcgcctgctgcatggagctgcctgctgctgctggagatgctgtgcgcagccctgctgctgctgctgccctgatcttccctgggggcagcggggagctggagctggccctggaggaggagctggccctgctggccgccggggagcggcccagcgaccccggggagcacccccaggccgagctgctgagcgtcatccggcagaaggagaaggacctggtgctggccgcccggctgggcaaggccctgctggagaggaaccaggacatgagccggcagtatgagcagatgcacaaggagctgacagacaagctggagcacctggagcaggagaagcatgagctgcggaggagatttgagaaccgggagggggagtgggagggccgggtgtctgagctggagagtgatgtgaagcagctgcaggatgagctggagcggcagcagatccacctgcgggaggccgaccgggagaagagcagagctgtgcaggagctgtctgagcagaaccagaggctgctggaccagctgagccgggccagcgaggtggagcggcagctgtccatgcaggtgcacgccctgcgggaggacttccgggagaagaacagcagcaccaaccagcacatcatccggctggagagcctgcaggccgagatcaagatgctgagtgacaggaagcgggagctggagcaccggctgagcgccaccctggaggagaatgacctgctgcagggcaccgtggaggagctgcaggacagagtgctgatcctggagcggcagggccatgacaaggacctgcagctgcaccagagccagctggagctgcaggaggtgcggctgagctgccggcagctgcaggtgaaggtggaggagctgacagaggagaggagcctgcagagcagcgctgccaccagcaccagcctgctgtctgaaattgagcagagcatggaggccgaggagctggagcaggagcgggagcagctgcggctgcagctgtgggaggcctactgccaggtgcgctacctgtgcagccacctgcggggaaatgacagcgctgacagcgctgtgtccacagacagctccatggatgagagcagcgagaccagcagcgccaaggatgtgcctgctggcagcctgaggacagccctgaatgagctgaagaggctcatccagagcatcgtggatggcatggagcccaccggcagccggcggctggatgatgacagcctggaggagcagatccggcagaccagcgaggacagccgggccctgcgggagctgatggagggggagcggggccgcctgcctgaggccagccgctgctgcctgcctgcctgcagccagcccatccagagccccagcctgccccacgtgggcaaggcccagcagggctgtgccgccaggatgtacctgtag

SEQ ID NO: 19466 - DNA, 1428 bp, Artificial Sequence
  Description of Artificial Sequence: Synthetic coding sequence
atgacccggggcactggaggaacagcccagaggggccgcagcggccctgacagccagggcctgctggacagcagcctgatggccagcggcacagccagccgctcagaagatgaggagagcctggccggccagaagagggccagcagccaggccctgggcaccatccccaagaggaggagcagcagccgcttcatcaagaggaagaagtttgatgatgagctggtggagagcagcctggccaagagcagcacccgggccaagggggccagcggcgtggagcccggccgctgcagcggcagcgagcccagcagcagcgagaagaagaaggtgtccaaggcccccagcacccctgtgccccccagccctgccccagcccctggcctgaccaagagggtgaagaagagcaagcagcccctgcaggtgaccaaggacctgggccgctggaagccagcagatgacctgctgctgatcaatgctgtgctgcagaccaatgacctgacctctgtgcacctgggcgtgaagttcagctgccgcttcaccctgcgggaggtgcaggagcgctggtacgccctgctgtatgaccctgtgatcagcaagctggcctgccaggccatgaggcagctgcaccctgaggccatcgccgccatccagagcaaggccctcttcagcaaggccgaggagcagctgctgagcaaggtgggcagcaccagccagcccaccctggagaccttccaggacctgctgcaccgccacccagatgccttctacctggccaggacagccaaggccctgcaggcccactggcagctgatgaagcagtactacctgctggaggaccagacagtgcagcccctgcccaagggggaccaggtgctgaacttcagtgatgctgaggacctgattgatgacagcaagctgaaggacatgagagatgaggtgctggagcacgagctgatggtggccgaccggcggcagaagcgggagatccggcagctggagcaggagctgcacaagtggcaggtgctggtggacagcatcaccggcatgagcagcccagactttgacaaccagaccctggccgtgctgcggggccgcatggtgcgctacctgatgaggagccgggagatcaccctgggccgggccaccaaggacaaccagattgatgtggacctgagcctggagggccctgcctggaagatcagcaggaagcagggcgtcatcaagctgaagaacaacggggacttcttcatcgccaatgaaggccggcggcccatctacattgatggccggcctgtgctgtgtggcagcaagtggaggctgagcaacaacagcgtggtggagatcgccagcctgcgctttgtgttcctgatcaaccaggacctgattgccctgatccgggcagaggccgccaagatcaccccccagtag

SEQ ID NO: 19467 - DNA, 1311 bp, Artificial Sequence
  Description of Artificial Sequence: Synthetic coding sequence
atggctgatggcggcagcgagcgggcagatggaagaattgtgaagatggaggtggactacagcgccaccgtggaccagaggctgcctgaatgtgccaagctggccaaggccagtgacatggtgtccaccagccgcatcctggtggccgtggtgaagatgtgctatgaggccaaggagtgggacctgctgaatgaaaacatcatgctgctgagcaagagaagaagccagctgaagcaggccgtggccaagatggtgcagcagtgctgcacctacgtggaggagatcacagacctgcccatcaagctgcggctgattgacaccctgaggatggtgacagagggcaagatctacgtggagattgaaagagcccggctgaccaagaccctggccaccatcaaggagcagaatggagatgtgaaggaggccgccagcatcctgcaggagctgcaggtggagacctacggctccatggagaagaaggagcgggtggagttcatcctggagcagatgaggctgtgcctggccgtgaaggactacatccgcacccagatcatcagcaagaagatcaacaccaagttcttccaggaggagaacacagagaagctgaagctgaagtactacaacctgatgatccagctggaccagcacgagggcagctacctgagcatctgcaagcactaccgggccatctatgacaccccctgcatccaggccgagagcgagaagtggcagcaggccctgaagtctgtggtgctgtatgtgatcctggccccctttgacaatgagcagagcgacctggtgcaccgcatcagcggggacaagaagctggaggagatccccaagtacaaggacctgctgaagctgttcaccaccatggagctgatgcgctggagcaccctggtggaggactatggcatggagctgaggaagggcagcctggagagccctgccacagatgtgtttggcagcacagaggagggggagaagcgctggaaggacctgaagaacagagtggtggagcacaacatccgcatcatggccaagtactacacccgcatcaccatgaagaggatggcccagctgctggacctgtctgtggatgaaagtgaggccttcctgagcaacctggtggtgaacaagaccatctttgccaaggtggaccggctggccggcatcatcaacttccagaggcccaaggaccccaacaacctgctgaatgactggagccagaagctgaacagcctgatgagcctggtgaacaagaccacccacctgattgccaaggaggagatgatccacaacctgcagtag

SEQ ID NO: 19468 - DNA, 1974 bp, Artificial Sequence
  Description of Artificial Sequence: Synthetic coding sequence
atggatgatcctgactgtgacagcacctgggaggaggatgaagaagatgctgaagatgctgaagatgaggactgtgaagatggagaggccgccggggccagagatgctgatgctggagatgaagatgaggagagcgaggagccccgggccgcccggcccagcagcttccagagcaggatgacaggcagcaggaactggagggccacccgggacatgtgccgctaccgccacaactacccagacctggtggagcgggactgcaatggagacacccccaacctgtccttctacagaaatgagatccgcttcctgcccaacggctgcttcatcgaggacatcctgcagaactggacagacaactatgacctgctggaggacaaccacagctacatccagtggctgttccccctgcgggagcccggggtgaactggcacgccaagcccctgaccctgcgggaggtggaggtgttcaagagcagccaggagatccaggagcggctggtgcgggcctatgagctgatgctgggcttctacggcatccggctggaggaccggggcactggaacagtgggccgggcccagaactaccagaagcgcttccagaacctgaactggaggagccacaacaacctgcgcatcacccgcatcctgaagagcctgggggagctgggcctggagcacttccaggcccccctggtgcgcttcttcctggaggagaccctggtgagaagagagctgcccggggtgcggcagagcgccctggactacttcatgtttgctgtgcgctgccgccaccagaggcggcagctggtgcactttgcctgggagcacttccggccccgctgcaagtttgtgtggggcccccaggacaagctgcggcgcttcaagcccagcagcctgccccaccccctggagggcagcaggaaggtggaggaggagggcagccctggggaccctgaccacgaggccagcacccagggccgcacctgtggccctgagcacagcaagggcggcggccgggtggatgagggcccccagcccaggtctgtggagccccaggatgctggccccctggagaggagccagggagatgaggccggcggccatggagaagatagacctgagcccctgagccccaaggagagcaagaagaggaagctggagctgagcagaagagagcagcccccaacagagcccggcccccagagcgccagcgaggtggagaagatcgccctgaacctggagggctgtgccctgagccagggcagcctgaggacaggcacccaggaggtgggcggccaggaccccggggaggccgtgcagccctgccggcagcccctgggcgcccgggtggccgacaaggtgaggaagaggaggaaggtggatgagggcgctggggacagcgctgctgtggccagcggcggggcccagaccctggccctggccggcagccctgcccccagcggccaccccaaggccggccacagtgaaaatggagtggaggaggacacagagggccgcacaggccccaaggagggcaccccaggcagccccagcgagaccccaggccccagccctgctggccctgctggagatgagcctgctgagagccccagcgagaccccaggccccaggcctgctggccctgctggagatgagcctgctgagagccccagcgagaccccaggccccagccctgctggccccaccagagatgagcctgctgagagccccagcgagaccccaggccccaggcctgctggccctgctggagatgagcctgctgagagccccagcgagaccccaggccccaggcctgctggccctgctggagatgagcctgctgagagccccagcgagaccccaggccccagccctgctggccccaccagagatgagcccgccaaggccggggaggccgctgagctgcaggatgctgaggtggagagcagcgccaagagcggcaagccctag

SEQ ID NO: 19469 - DNA, 615 bp, Artificial Sequence; identical to SEQ ID NO: 18379
  Description of Artificial Sequence: Synthetic coding sequence

SEQ ID NO: 19470 - DNA, 3042 bp, Artificial Sequence
  Description of Artificial Sequence: Synthetic coding sequence
atgggctggaagcccagcgaggcccggggccagagccagagcttccaggccagcggcctgcagcccaggagcctgaaggccgcccggcgggccaccggccgcccagacaggagccgggccgcccggcccaccatggaccccagcgcccacaggagccgggccgccccacccaacatggaccctgacccccaggccggcgtgcaggtgggcatgagggtggtgcggggcgtggactggaagtggggccagcaggatggaggagagggcggcgtgggcaccgtggtggagctgggccgccacggcagccccagcaccccagacagaacagtggtggtgcagtgggaccagggcaccaggaccaactaccgggccggctaccagggcgcccatgacctgctgctgtatgacaatgcccagatcggcgtgcgccaccccaacatcatctgtgactgctgcaagaagcacggcctgcggggcatgcgctggaagtgccgggtgtgcctggactatgacctgtgcacccagtgctacatgcacaacaagcatgagctggcccacgcctttgacagatatgaaacagcccacagcaggcctgtgaccctgagcccccggcagggcctgccccgcatccccctgcggggcatcttccagggcgccaaggtggtgcggggccctgactgggagtggggcagccaggatggaggagagggcaagccaggccgggtggtggacatccggggctgggatgtggagaccggccgctctgtggcctctgtgacctgggcagatggcaccaccaacgtgtacagagtgggccacaagggcaaggtggacctgaagtgtgtgggggaggccgccggcggcttctactacaaggaccacctgccccggctgggcaagccagctgagctgcagaggagagtgtctgctgacagccagcccttccagcacggggacaaggtgaagtgcctgctggacacagatgtgctgcgggagatgcaggagggccatggaggctggaaccccaggatggccgagttcatcggccagacaggaacagtgcaccgcatcacagacagaggagatgtgcgggtgcagttcaaccacgagacccgctggaccttccaccctggggccctgaccaagcaccacagcttctgggtgggagatgtggtgcgggtgattggagacctggacacagtgaagaggctgcaggccggccacggggagtggacagatgacatggccccagccctgggccgggtgggcaaggtggtgaaggtgtttggagatggcaacctgcgggtggccgtggccggccagcgctggaccttcagccccagctgcctggtggcctacagaccagaagaagatgccaacctggatgtggccgagcgggcccgggagaacaagagcagcctgtctgtggccctggacaagctgcgggcccagaagagtgaccctgagcaccctggccgcctggtggtggaggtggccctgggcaatgctgcccgggccctggacctgctgcggcggcggcctgagcaggtggacaccaagaaccagggccgcacagccctgcaggtggccgcctacctgggccaggtggagctgatccggctgctgctgcaggcccgggccggcgtggacctgcctgatgatgagggcaacacagccctgcactatgctgccctgggcaaccagcctgaggccaccagggtgctgctgtctgctggctgcagagcagatgccatcaacagcacccagagcacagccctgcacgtggccgtgcagaggggcttcctggaggtggtgcgggccctgtgtgagcggggctgtgatgtgaacctgcctgatgcccacagcgacacccccctgcacagcgccatctctgctggcaccggggccagcggcatcgtggaggtgctgacagaggtgcccaacattgatgtgacagccaccaacagccagggcttcaccctgctgcaccacgccagcctgaagggccacgccctggccgtgaggaagatcctggcccgggcccggcagctggtggatgccaagaaggaggatggcttcaccgccctgcacctggccgccctgaacaaccaccgggaggtggcccagatcctgatccgggagggccgctgtgatgtgaatgtgaggaacaggaagctgcagagccccctgcacctggccgtgcagcaggcccacgtgggcctggtgcccctgctggtggatgctggctgcagcgtgaatgcagaagatgaggagggggacacagccctgcacgtggccctgcagaggcaccagctgctgcccctggtggctgatggagctggaggagaccccggccccctgcagctgctgagccggctgcaggccagcggcctgcccggcagcgctgagctgactgtgggcgctgctgtggcctgcttcctggccctggagggcgcagatgtgtcctacaccaaccaccggggccgcagccccctggacctggccgctgagggccgggtgctgaaggccctgcagggctgtgcccagcgcttccgggagcggcaggccggcggcggggccgcccctggcccccggcagaccctgggcacccccaacacagtgaccaacctgcacgtgggcgccgcccctggccctgaggccgcagaatgtctggtgtgcagcgagctggccctgctggtgctcttcagcccctgccagcacaggacagtgtgtgaagaatgtgcccggaggatgaagaagtgcatccgctgccaggtggtggtgtccaagaagctgcggccagatggcagcgaggtggccagcgctgccccagcccctggccccccccggcagctggtggaggagctgcagagccgctaccggcagatggaggagcgcatcacctgccccatctgcatcgacagccacatccggctggtgttccagtgtggccatggagcctgtgccccctgtggcagcgccctgagcgcctgccccatctgccggcagcccatccgggaccgcatccagatctttgtgtag

SEQ ID NO: 19471 - DNA, 2055 bp, Artificial Sequence
  Description of Artificial Sequence: Synthetic coding sequence
atgatccccccccaggaggccagcgccaggagaagagaaattgaggacaagctgaagcaggaggaggagaccctgtccttcatccgggacagcctggagaagagtgaccagctgaccaagaacatggtgtccatcctgagcagctttgagagccggctgatgaagctggagaacagcatcatccctgtgcacaagcagacagagaacctgcagaggctgcaggagaatgtggagaagaccctgagctgcctggaccacgtgatctcctactaccacgtggccagtgacacagagaagatcatccgggagggccccaccggccgcctggaggagtacctgggctccatggccaagatccagaaggctgtggagtacttccaggacaacagcccagacagccctgagctgaacaaggtgaagctgctgtttgagcggggcaaggaggccctggagagcgagttccgcagcctgatgaccaggcacagcaaggtggtgtcccctgtgctgatcctggacctgatctctggagatgatgacctggaggcccaggaggatgtgaccctggagcacctgcctgagagcgtgctgcaggacgtcatccgcatcagccgctggctggtggagtatggaagaaaccaggacttcatgaatgtgtactaccagatccgcagcagccagctggacaggagcatcaagggcctgaaggagcacttccacaagagcagcagcagcagtggagtgccctacagccctgccatccccaacaagaggaaggacacccccaccaagaagcctgtgaagaggcctggcaccatcaggaaggcccagaacctgctgaagcagtacagccagcacggcctggatggcaagaagggcggcagcaacctgatccccctggagggcagagatgacatgctggatgtggagacagatgcctacatccactgtgtgtctgcctttgtgaagctggcccagagcgagtaccagctgctggccgacatcatccctgagcaccaccagaagaagacctttgacagcctcatccaggatgccctggatggcctgatgctggagggggagaacatcgtgtctgctgccaggaaggccatcgtgagacatgacttcagcacagtgctgaccgtcttccccatcctgcggcacctgaagcagaccaagccagagtttgaccaggtgctgcagggcacagctgccagcaccaagaacaagctgcccggcctcatcacctccatggagaccatcggggccaaggccctggaggactttgctgacaacatcaagaatgaccctgacaaggagtacaacatgcccaaggatggcaccgtgcatgagctgaccagcaatgccatcctcttcctgcagcagctgctggacttccaggagacagctggggccatgctggccagccaggagaccagcagcagcgccaccagctacagcagcgagttcagcaagaggctgctgagcacctacatctgcaaggtgctgggcaacctgcagctgaacctgctgagcaagagcaaggtgtatgaagatcctgccctgagcgccatcttcctgcacaacaactacaactacatcctgaagagcctggagaagtctgagctgatccagctggtggccgtgacccagaagacagctgagaggagctaccgggagcacatcgagcagcagatccagacctaccagaggtcctggctgaaggtgacagactacatcgccgagaagaacctgcctgtgttccagcccggggtgaagctgcgggacaaggagcggcagatcatcaaggagcgcttcaagggcttcaatgatggcctggaggagctgtgcaagatccagaaggcctgggccatcccagacacagagcagagggaccgcatccggcaggcccagaagaccatcgtgaaggagacctatggagccttcctgcagaagtttggatctgtgcccttcaccaagaaccctgagaagtacatcaagtatggagtggagcaggtgggggacatgattgaccggctgtttgacaccagcgcctag

SEQ ID NO: 19472 - DNA, 3576 bp, Artificial Sequence
  Description of Artificial Sequence: Synthetic coding sequence
atgcctgtgcaggccgcccagtggacagagttcctgagctgccccatctgctacaatgaatttgatgaaaatgtgcacaagcccatcagcctgggctgcagccacacagtgtgcaagacctgcctgaacaagctgcacaggaaggcctgcccctttgaccagacagccatcaacacagacattgatgtgctgcctgtgaactttgccctgctgcagctggtgggcgcccaggtgcctgaccaccagagcatcaagctgagcaacctgggggagaacaagcactatgaggtggccaagaagtgtgtggaggacctggccctgtacctgaagcccctgagcggcggcaagggcgtggccagcctgaaccagagcgccctgagccggcccatgcagaggaagctggtgaccctggtgaactgccagctggtggaggaggagggccgggtgcgggccatgagagctgcccggagcctgggggagaggacagtgacagagctgatcctgcagcaccagaacccccagcagctgagcgccaacctgtgggccgctgtgcgggcccggggctgccagttcctgggccctgccatgcaggaggaggccctgaagctggtgctgctggccctggaggatggcagcgccctgagcaggaaggtgctggtgctgtttgtggtgcagaggctggagccccgcttcccccaggccagcaagaccagcattggacatgtggtgcagctgctgtaccgggccagctgcttcaaggtgaccaagagagatgaggacagcagcctgatgcagctgaaggaggagttccgctcctatgaggccctgcggcgggagcatgatgcccagatcgtgcacatcgccatggaggccggcctgcgcatcagccctgagcagtggagcagcctgctgtatggagacctggcccacaagagccacatgcagagcatcatcgacaagctgcagagccctgagagctttgccaagtctgtgcaggagctgaccatcgtgctgcagaggactggagaccctgccaacctgaaccggctgcggccccacctggagctgctggccaacatcgaccccaacccagatgctgtgagccccacctgggagcagctggagaatgccatggtggccgtgaagacagtggtgcacggcctggtggacttcatccagaactacagcaggaagggccacgagaccccccagccccagcccaacagcaagtacaagacctccatgtgccgggacctgcggcagcagggcggctgcccccggggcaccaactgcacctttgcccacagccaggaggagctggagaagtaccgcctgaggaacaagaagatcaatgccaccgtgaggaccttccccctgctgaacaaggtgggcgtgaacaacacagtgaccaccacagctggaaatgtcatcagcgtcatcggcagcacagagaccaccgggaagatcgtgcccagcaccaacggcatcagcaatgctgagaacagcgtgtcccagctgatcagccgcagcacagacagcaccctgcgggccctggagaccgtgaagaaggtgggcaaggtgggcgccaacggccagaatgctgctggccccagcgctgacagcgtgacagagaacaagattggcagcccccccaagacccctgtgtccaatgtggccgccaccagcgctggccccagcaatgtgggcacagagctgaacagcgtgccccagaagagcagccccttcctgaccagggtgcctgtgtacccaccccacagcgagaacatccagtacttccaggaccccaggacccagatcccctttgaggtgccccagtacccccagacaggctactacccacctccacccaccgtgcctgctggggtggccccctgtgtgcccaggtttgtgcgcagcaacaacgtgcctgagagcagcctgcccccagcctccatgccctatgctgaccactacagcaccttcagcccccgggacaggatgaacagcagcccctaccagcccccaccaccccagccctacggccctgtgccccctgtgcccagcggcatgtatgcccctgtgtatgacagccgccgcatctggaggcctcccatgtaccagagagatgacatcatccgcagcaacagcctgccccccatggatgtgatgcacagctctgtgtaccagaccagcctgcgggagcgctacaacagcctggatggctactacagcgtggcctgccagcccccatctgagcccaggaccaccgtgcccctgccccgggagccctgtggccacctgaagaccagctgtgaggagcagatccggaggaagccagaccagtgggcccagtaccacacccagaaggcccccctggtgagcagcaccctgcctgtggccacccagagccccaccccacccagccccctcttctctgtggacttccgggctgacttcagcgagagcgtgtctggcaccaagtttgaggaggaccacctgagccactacagcccctggagctgtggcaccatcggcagctgcatcaatgccattgattctgagcccaaggatgtgattgccaacagcaatgctgtgctgatggacctggacagcggagatgtgaagagaagagtgcacctgtttgagacccagaggaggaccaaggaggaggaccccatcatccccttcagtgatggccccatcatcagcaagtggggcgccatcagccgcagcagcaggacaggctaccacaccacagatcctgtgcaggccacagccagccagggcagcgccaccaagcccatctctgtgtctgactatgtgccctacgtgaatgctgtggacagccgctggagcagctatggaaatgaggccaccagcagcgcccactacgtggagcgggaccgcttcatcgtgacagacctgagcggccacaggaagcacagcagcactggagacctgctgagcctggagctgcagcaggccaagagcaacagcctgctgctgcagcgggaggccaatgccctggccatgcagcagaagtggaacagcctggatgagggccgccacctgaccctgaacctgctgagcaaggagattgagctgagaaatggagagctgcagagcgactacacagaagatgccacagacaccaagccagaccgggacatcgagctggagctgagcgccctggacacagatgagccagatggccagagcgagcccatcgaggagatcctggacatccagctgggcatcagcagccagaatgaccagctgctgaatggcatggctgtggagaatggccaccctgtgcagcagcaccagaaggagccccccaagcagaagaagcagagcctgggggaggaccacgtgatcctggaggagcagaagaccatcctgcctgtgaccagctgcttcagccagcccctgcctgtgtccatcagcaatgccagctgcctgcccatcaccacctctgtgtctgctggcaacctgatcctgaagacccacgtgatgtctgaggacaagaatgacttcctgaagcctgtggccaacgggaagatggtgaacagctag

SEQ ID NO: 19473 - DNA, 2100 bp, Artificial Sequence
  Description of Artificial Sequence: Synthetic coding sequence
atgtgtggcatctttgcctacctgaactaccacgtgcccaggacccggcgggagatcctggagaccctcatcaagggcctgcagaggctggagtaccggggctatgattctgctggggtgggctttgatggcggcaatgacaaggactgggaggccaatgcctgcaagatccagctgatcaagaagaagggcaaggtgaaggccctggatgaggaggtgcacaagcagcaggacatggacctggacattgaatttgatgtgcacctgggcatcgcccacacccgctgggccacccatggagagcccagccctgtgaacagccacccccagaggagtgacaagaacaatgagttcatcgtcatccacaacggcatcatcaccaactacaaggacctgaagaagttcctggagagcaagggctatgactttgaaagtgaaacagacacagagaccatcgccaagctggtgaagtacatgtatgacaaccgggagagccaggacaccagcttcaccaccctggtggagagggtcatccagcagctggagggcgcctttgccctggtgttcaagtctgtgcacttccctggccaggccgtgggcacccggcggggcagccccctgctgattggagtgcgctctgagcacaagctgagcacagaccacatccccatcctgtacagaacagcccggacccagatcggcagcaagttcacccgctggggcagccagggcgagcggggcaaggacaagaagggcagctgcaacctgagccgggtggacagcaccacctgcctcttccctgtggaggagaaggctgtggagtactactttgccagtgatgccagcgctgtgattgagcacaccaacagagtcatcttcctggaggatgatgatgtggccgctgtggtggatggccgcctgagcatccaccgcatcaagaggacagctggggaccaccctggccgggctgtgcagaccctgcagatggagctgcagcagatcatgaagggcaacttcagcagcttcatgcagaaggagatctttgagcagcctgagagcgtggtgaacaccatgaggggccgggtgaactttgatgactacacagtgaacctgggcggcctgaaggaccacatcaaggagatccagcgctgcagaagactcatcctgattgcctgtggcaccagctaccacgccggcgtggccacccggcaggtgctggaggagctgacagagctgcctgtgatggtggagctggccagtgacttcctggacaggaacacccctgtgttcagagatgatgtgtgcttcttcctgagccagagcggggagacagctgacaccctgatgggcctgcgctactgcaaggagcggggggccctgactgtgggcatcaccaacacagtgggcagcagcatcagccgggagacagactgtggggtgcacatcaatgccggccctgagattggagtggccagcaccaaggcctacaccagccagtttgtgtccctggtgatgtttgccctgatgatgtgtgatgaccgcatctccatgcaggagaggaggaaggagatcatgctgggcctgaagaggctgcctgacctgatcaaggaggtgctgtccatggatgatgagatccagaagctggccacagagctgtaccaccagaagtctgtgctgatcatgggccggggctaccactacgccacctgcctggagggcgccctgaagatcaaggagatcacctacatgcacagcgagggcatcctggccggggagctgaagcacggccccctggccctggtggacaagctgatgcctgtgatcatgatcatcatgagggaccacacctacgccaagtgccagaatgccctgcagcaggtggtggcccggcagggccggcctgtggtgatctgtgacaaggaggacacagagaccatcaagaacaccaagaggaccatcaaggtgccccacagcgtggactgcctgcagggcatcctgagcgtcatccccctgcagctgctggccttccacctggccgtgctgcggggctatgatgtggacttccccaggaacctggccaagtctgtgacagtggagtag

SEQ ID NO: 19474 - DNA, 2067 bp, Artificial Sequence
  Description of Artificial Sequence: Synthetic coding sequence
atgtctgtgaacagcgagaagagcagcagcagcgagaggcctgagccccagcagaaggcccccctggtgcccccacctcctcctcctcctcctcctcctcctccacccctgcctgaccccaccccacctgagcctgaggaggagatcctgggcagtgatgatgaggagcaggaggaccctgctgactactgcaagggcggctaccaccctgtgaagattggagacctcttcaacggccgctaccacgtgatcaggaagctgggctggggccacttcagcacagtgtggctgtgctgggacatgcagggcaagagatttgtggccatgaaggtggtgaagagcgcccagcactacacagaaacagccctggatgagatcaagctgctgaagtgtgtgcgggagagtgaccccagcgaccccaacaaggacatggtggtgcagctgattgatgacttcaagatcagcggcatgaatggcatccacgtgtgcatggtgtttgaggtgctgggccaccacctgctgaagtggatcatcaagagcaactaccagggcctgcctgtgcgctgtgtgaagagcatcatccggcaggtgctgcagggcctggactacctgcacagcaagtgcaagatcatccacacagacatcaagccagagaacatcctgatgtgtgtggatgatgcctacgtgcggaggatggctgctgaggccacagagtggcagaaggccggggcccccccacccagcggcagcgctgtgtccacagccccccagcagaagcccatcggcaagatcagcaagaacaagaagaagaagctgaagaagaagcagaagaggcaggccgagctgctggagaagaggctgcaggagattgaggagctggagcgggaggccgagaggaagatcatcgaggagaacatcaccagcgctgcccccagcaatgaccaggatggagagtactgcccagaggtgaagctgaagaccaccggcctggaggaggccgctgaggccgagacagccaaggacaacggggaggccgaggaccaggaggagaaggaggatgctgagaaggaaaatattgagaaggatgaagatgatgtggaccaggagctggccaacatcgaccccacctggattgagagccccaagaccaacggccacattgaaaatggccccttcagcctggagcagcagctggatgatgaagatgatgatgaggaggactgccccaaccctgaggagtacaacctggatgagcccaatgctgagagtgactacacctacagcagcagctatgagcagttcaatggagagctgcccaacggccgccacaagatccctgagagccagtttcctgagttcagcaccagcctcttcagcggcagcctggagcctgtggcctgtggctctgtgctgtctgagggcagccccctgacagagcaggaggagagcagccccagccatgacaggagcaggacagtgtctgccagcagcactggagacctgcccaaggccaagaccagggctgctgacctgctggtgaaccccctggaccccagaaatgctgacaagatccgggtgaagattgctgacctgggcaatgcctgctgggtgcacaagcacttcacagaggacatccagacccggcagtaccgcagcattgaggtgctgattggagctggctacagcaccccagctgacatctggagcacagcctgcatggcctttgagctggccactggagactacctgtttgagccccacagcggggaggactacagcagagatgaggaccacatcgcccacatcatcgagctgctgggcagcatccccaggcactttgccctgagcggcaagtacagccgggagttcttcaacagaagaggagagctgcggcacatcaccaagctgaagccctggagcctgtttgatgtgctggtggagaagtatggctggccccatgaagatgctgcccagttcacagacttcctgatccccatgctggagatggtgcctgagaagagggccagcgctggagaatgtctgcggcacccctggctgaacagctag

SEQ ID NO: 19475 - DNA, 1308 bp, Artificial Sequence
  Description of Artificial Sequence: Synthetic coding sequence
atgagcggctaccagaggaggcctggggccacccccctgagccgggcccggagcctggccatcccagatgccccagccttctatgaaagaagaagctgcctgccccagctgaactgtgagcggccccacggccgggacctggacagccccttcttcggcatccggcctgccttcatgtgctacgtgcccagccctgtgctggcctctgtgggggacacagactttggctacggcaagggcaagtgcagcaagcagagccccagcggggcccacggcacccactttggagatgacagatttgaggacctggaggaggccaaccccttctccttccgggagttcctgaagaccaagaacctgggcctgagcaaagaagatcctgccagccgcatctatgccaaggaggccagccgccacagcctgggcctggaccacaacagcccccccagccagacaggaggctacggcctggagtaccagcagcccttctttgaggaccccaccggggccggggacctgctggatgaggaggaggatgaggacaccggctggagcggggcctacctgcccagcgccatcgagcagacccaccctgagcgggtgcctgctggcaccagcccctgcagcacctacctgtccttcttcagcaccccatctgagctggccggccctgagagcctgcccagctgggccctgagtgacacagacagccgggtgtccccagccagccctgctggcagccccagcgctgactttgctgtgcatggagagagcctgggggacagacacctgcggaccctgcagatctcctatgatgccctgaaggatgagaacagcaagctgcggaggaagctgaatgaggtgcagagcttcagcgaggcccagacagagatggtgaggaccctggagaggaagctggaggccaagatgatcaaggaggagagtgactaccatgacctggagagcgtggtgcagcaggtggagcagaacctggagctgatgaccaagagagctgtgaaggccgagaaccacgtggtgaagctgaagcaggagatcagcctgctgcaggcccaggtgagcaacttccagagagaaaatgaggccctgcgctgtggccagggcgccagcctgactgtggtgaagcagaatgctgatgtggccctgcagaacctgcgggtggtgatgaacagcgcccaggccagcatcaagcagctggtgtctggagctgagaccctgaacctggtggccgagatcctgaagagcattgaccgcatcagcgaggtgaaggatgaggaggaggacagctag

SEQ ID NO: 19476 - DNA, 591 bp, Artificial Sequence
  Description of Artificial Sequence: Synthetic coding sequence
atgaaggtgaagatcaagtgctggaatggagtggccacctggctgtgggtggccaatgatgagaactgtggcatctgcaggatggccttcaacggctgctgcccagactgccccctgcacggggagagcatcagccgctgcctgggctggtgcccccagcctgtgcctgtgctgggcggccgggcccacccccaggtgcccatcaacacagccagccccaccccaggccagcacacaggcagcctgatgagccgggaggagagcagccgcagcccagaccccaccccaccagccctggaccaggagaccagcagcctgctgcgctgcaccagcccctggtgcctggaccacagctgtgacctgtttggcatcacagaccaggtgtctgcagatggcccccgggcctgccggcagggcgcccggcggcggctgcctgctggggtgggccctgtgctgcccctgctgccccacgccctgcacccccaggtggccgccaggacagctggagctgctgccctgccccacgtgcccccaggcatggaggtgcagggcgtgcggccagacctggccctggccggcggggccagctag

SEQ ID NO: 19477 - DNA, 5127 bp, Artificial Sequence
  Description of Artificial Sequence: Synthetic coding sequence
atggccgccatcggccggggccgcagcctgaagaacctgcgggtgcggggcagaaatgattctggagaggagaatgtgcccctggacctgacccgggagcccagcgacaacctgcgggagatcctgcagaatgtggcccggctgcagggcgtgagcaacatgaggaagctgggccacctgaacaacttcaccaagctgctgtgtgacatcggccacagcgaggagaagctgggcttccactatgaggacatcatcatctgcctgcggctggccctgctgaatgaggccaaggaggtgcgggccgccggcctgcgggccctgcgctacctgatccaggacagcagcatcctgcagaaggtgctgaagctgaaggtggactacctgattgcccgctgcatcgacatccagcagagcaatgaggtggagaggacccaggccctgcggctggtgaggaagatgatcaccgtgaatgccagcctcttccccagctctgtgaccaacagcctgattgctgtgggcaatgatggcctgcaggagcgggacaggatggtgcgggcctgcatcgccatcatctgtgagctggccctgcagaaccctgaggtggtggccctgcggggcggcctgaacaccatcctgaagaatgtcatcgactgccagctgagccgcatcaatgaggccctgatcaccaccatcctgcacctgctgaaccaccccaagacccggcagtatgtgcgggcagatgtggagctggagcgcatcctggccccctacacagacttccactaccgccacagcccagacacagctgagggccagctgaaggaggaccgggaggcccgcttcctggccagcaagatgggcatcatcgccaccttccgctcctgggccggcatcatcaacctgtgcaagccaggcaacagcggcatccagagcctgattggagtgctgtgcatccccaacatggagatccggcggggcctgctggaggtgctgtatgacatcttccggctgcccctgcctgtggtgacagaggagttcatcgaggccctgctgtctgtggaccccggccgcttccaggacagctggaggctgagtgatggctttgtggccgctgaggccaagaccatcctgccccaccgggcccggagcaggccagacctgatggacaactacctggccctgatcctgagcgccttcatcagaaatggcctgctggagggcctggtggaggtgatcaccaacagtgatgaccacatctctgtgcgggccaccatcctgctgggggagctgctgcacatggccaacaccatcctgccccacagccacagccaccacctgcactgcctgcccaccctgatgaacatggccgccagctttgacatccccaaggagaagaggctgcgggccagcgctgccctgaactgcctgaagcgcttccacgagatgaagaagaggggccccaagccctacagcctgcacctggaccacatcatccagaaggccatcgccacccaccagaagagggaccagtacctgcgggtgcagaaggacatcttcatcctgaaggacacagaggaggccctgctgatcaacctgcgggacagccaggtgctgcagcacaaggagaacctggagtggaactggaacctgattggcaccatcctgaagtggcccaacgtgaacctgaggaactacaaggatgagcagctgcacagatttgtgcggcggctgctgtacttctacaagcccagcagcaagctgtatgccaacctggacctggactttgccaaggccaagcagctgactgtggtgggctgccagttcacagagttcctgctggagagtgaagaagatggccagggctacctggaggacctggtgaaggacatcgtgcagtggctgaatgccagcagcggcatgaagccagagaggagcctgcagaacaacggcctgctgaccaccctgagccagcactacttcctgttcatcggcaccctgagctgccacccccatggagtgaagatgctggagaagtgcagcgtcttccagtgcctgctgaacctgtgcagcctgaagaaccaggaccacctgctgaagctgactgtgagcagcctggactacagcagagatggcctggcccgggtcatcctgagcaagatcctgacagctgccacagatgcctgccgcctgtatgccaccaagcacctgcgggtgctgctgcgggccaacgtggagttcttcaacaactggggcatcgagctgctggtgacccagctgcatgacaagaacaagaccatcagcagcgaggccctggacatcctggatgaggcctgtgaggacaaggccaacctgcacgccctgatccagatgaagccagccctgagccacctgggggacaagggcctgctgctgctgctgcgcttcctgagcatccccaagggcttctcctacctgaatgaaagaggctacgtggccaagcagctggagaagtggcaccgggagtacaacagcaaatatgtggacctgattgaggagcagctgaatgaggccctgaccacctacaggaagcctgtggatggagacaactacgtgagaagaagcaaccagaggctgcagaggcctcatgtgtacctgcccatccacctgtatggccagctggtgcaccacaagacaggctgccacctgctggaggtgcagaacatcatcacagagctgtgcagaaatgtgaggaccccagacctggacaagtgggaggagatcaagaagctgaaggccagcctgtgggccctgggcaacatcggcagcagcaactggggcctgaacctgctgcaggaggagaatgtcatcccagacatcctgaagctggccaagcagtgtgaggtgctgagcatccggggcacctgtgtgtatgtgctgggcctgattgccaagaccaagcagggctgtgacatcctgaagtgccacaactgggatgctgtgcgccacagcaggaagcacctgtggcctgtggtgcctgatgatgtggagcagctgtgcaatgagctgagcagcatccccagcaccctgagcctgaacagcgagagcaccagcagccgccacaacagcgagagcgagagcgtgcccagctccatgttcatcctggaggatgaccgcttcggcagcagcagcaccagcaccttcttcctggacatcaatgaagacacagagcccaccttctatgacaggagcggccccatcaaggacaagaacagcttccccttctttgccagcagcaagctggtgaagaaccgcatcctgaacagcctgaccctgcccaacaagaagcacaggagcagcagtgaccccaagggcggcaagctgagcagcgagagcaagaccagcaacagacgcatccgcaccctgacagagcccagcgtggacttcaaccacagtgatgacttcacccccatcagcacagtgcagaagaccctgcagctggagaccagcttcatgggcaacaagcacatcgaggacaccggcagcacccccagcatcggggagaatgacctgaagttcaccaagaactttggaacagagaaccaccgggagaacaccagccgggagcggctggtggtggagagcagcaccagcagccacatgaagatccgcagccagagcttcaacacagacaccaccaccagcggcatcagctccatgagcagcagccccagccgggagaccgtgggcgtggatgccaccaccatggacacagactgtggctccatgagcacagtggtgtccaccaagaccatcaagaccagccactacctgaccccccagagcaaccacctgagcctgagcaagagcaacagcgtgtccctggtgcccccaggcagcagccacaccctgccccggcgggcccagagcctgaaggcccccagcatcgccaccatcaagagcctggccgactgcaacttctcctacaccagcagcagagatgccttcggctacgccaccctgaagaggctgcagcagcagaggatgcaccccagcctgagccacagcgaggccctggccagccctgccaaggatgtgctcttcacagacaccatcaccatgaaggccaacagctttgagagccggctgacccccagccgcttcatgaaggccctgtcctatgccagcctggacaaggaggacctgctgagccccatcaaccagaacaccctgcagaggagcagctctgtgcgctccatggtgtcctctgccacctacggcggcagtgatgactacatcggcctggccctgcctgtggacatcaatgacatcttccaggtgaaggacatcccctacttccagaccaagaacatcccccctcatgatgacagaggagcccgggcctttgcccatgatgctgggggcctgcccagcggcaccggcggcctggtgaagaacagcttccacctgctgcggcagcagatgagcctgacagagatcatgaacagcatccacagtgatgccagcctcttcctggagagcacagaggacaccggcctgcaggagcacacagatgacaactgcctgtactgtgtgtgcatcgagatcctgggcttccagcccagcaaccagctgagcgccatctgcagccacagcgacttccaggacatcccctacagcgactggtgtgagcagaccatccacaaccccctggaggtggtgcccagcaagttcagcggcatcagcggctgcagtgatggagtgtcccaggagggcagcgccagcagcaccaagagcacagagctgctgctgggcgtgaagaccatcccagatgacacccccatgtgccgcatcctgctgaggaaggaggtgctgcggctggtgatcaacctgagcagctctgtgtccaccaagtgccacgagaccggcctgctgaccatcaaggagaagtacccccagacctttgatgacatctgcctgtacagcgaggtgagccacctgctgagccactgcaccttccggctgccctgccgccgcttcatccaggagctgttccaggatgtgcagttcctgcagatgcatgaggaggccgaggccgtgctggccaccccacccaagcagcccatcgtggacaccagcgctgagagctag

SEQ ID NO: 19478 - DNA, 3867 bp, Artificial Sequence; identical to SEQ ID NO: 19323
  Description of Artificial Sequence: Synthetic coding sequence

SEQ ID NO: 19479 - DNA, 2829 bp, Artificial Sequence
  Description of Artificial Sequence: Synthetic coding sequence
atgacaggcagcaacagccacatcaccatcctgaccctgaaggtgctgccccactttgagagcctgggcaagcaggagaagatccccaacaagatgtctgccttcaggaaccactgcccccacctggacagcgtgggggagatcaccaaggaggacctgatccagaagagcctgggcacctgccaggactgcaaggtgcagggccccaacctgtgggcctgcctggagaaccgctgcagctatgtgggctgtggggagagccaggtggaccacagcaccatccacagccaggagaccaagcactacctgactgtgaacctgaccaccctgcgggtgtggtgctacgcctgcagcaaggaggtgttcctggacaggaagctgggcacccagcccagcctgccccacgtgcggcagccccaccagatccaggagaacagcgtgcaggacttcaagatccccagcaacaccaccctgaagacccccctggtggccgtgtttgatgacctggacattgaagcagatgaggaggatgagctgcgggcccggggcctgaccggcctgaagaacatcggcaacacctgctacatgaatgctgccctgcaggccctgagcaactgcccccccctgacccagttcttcctggactgtggcggcctggccaggacagacaagaagccagccatctgcaagagctacctgaagctgatgacagagctgtggcacaagagcaggcctggctctgtggtgcccaccaccctcttccagggcatcaagacagtgaaccccaccttccggggctacagccagcaggatgcccaggagttcctgcgctgcctgatggacctgctgcacgaggagctgaaggagcaggtgatggaggtggaggaggacccccagaccatcaccacagaggagaccatggaggaggacaagagccagagtgatgtggacttccagagctgtgagagctgcagcaacagcgacagagcagaaaatgaaaatggcagccgctgcttcagcgaggacaacaatgagaccaccatgctgatccaggatgatgagaacaacagcgagatgagcaaggactggcagaaggagaagatgtgcaacaagatcaacaaggtgaacagcgagggggagtttgacaaggaccgggacagcatcagcgagaccgtggacctgaacaaccaggagaccgtgaaggtgcagatccacagccgggccagcgagtacatcacagatgtgcacagcaatgacctgagcaccccccagatcctgcccagcaatgaaggagtgaacccccggctgagcgccagcccccccaagagcggcaacctgtggccaggcctggccccaccccacaagaaggcccagagcgccagccccaagaggaagaagcagcacaagaagtacagaagtgtcatcagtgacatctttgatggcaccatcatcagctctgtgcagtgcctgacctgtgacagagtgtctgtgaccctggagaccttccaggacctgagcctgcccatccctgggaaggaggacctggccaagctgcacagcagcagccaccccaccagcatcgtgaaggccggcagctgtggggaggcctatgccccccagggctggatcgccttcttcatggagtatgtgaagagatttgtggtgtcctgtgtgcccagctggttctggggccctgtggtgaccctgcaggactgcctggccgccttctttgccagagatgagctgaagggggacaacatgtacagctgtgagaagtgcaagaagctgagaaatggagtgaagttctgcaaggtgcagaacttccctgagatcctgtgcatccacctgaagcgcttcagacatgagctgatgttcagcaccaagatcagcacccacgtgtccttccccctggagggcctggacctgcagcccttcctggccaaggacagccctgcccagatcgtgacctatgacctgctgagcgtcatctgccaccacggcacagccagcagcggccactacatcgcctactgcaggaacaacctgaacaacctgtggtatgaatttgatgaccagagcgtgacagaggtgtctgagagcacagtgcagaatgctgaggcctacgtgctcttctacaggaagagcagcgaggaggcccagaaggagcggcggcgcatcagcaacctgctgaacatcatggagcccagcctgctgcagttctacatcagccggcagtggctgaacaagttcaagacctttgctgagcccggccccatcagcaacaatgacttcctgtgcatccacggcggcgtgccccccaggaaggccggctacatcgaggacctggtgctgatgctgccccagaacatctgggacaacctgtacagccgctatggaggcggccctgctgtgaaccacctgtacatctgccacacctgccagattgaagctgagaagattgagaagaggaggaagacagagctggagatcttcatccggctgaacagagccttccagaaggaggacagccctgccaccttctactgcatctccatgcagtggttccgggagtgggagagctttgtgaagggcaaggatggagaccccccaggccccatcgacaacaccaagattgctgtgaccaagtgtggaaatgtgatgctgcggcagggcgctgacagcggccagatcagcgaggagacctggaacttcctgcagagcatctatggaggcggccctgaggtgatcctgcggccccctgtggtgcacgtggaccctgacatcctgcaggccgaggagaagattgaggtggagaccaggagcctgtag

SEQ ID NO: 19480 - DNA, 2106 bp, Artificial Sequence
  Description of Artificial Sequence: Synthetic coding sequence
atgatgaagaggcagctgcacaggatgaggcagctggcccagacaggcagcctgggccgcaccccagagacagctgagttcctgggggaggacctgctgcaggtggagcagaggctggagcccgccaagagagctgcccacaacatccacaagaggctgcaggcctgcctgcagggccagagcggggctgacatggacaagagggtgaagaagctgcccctgatggccctgagcaccaccatggccgagagcttcaaggagctggaccctgacagctccatgggcaaggccctggagatgagctgtgccatccagaaccagctggcccgcatcctggccgagtttgagatgaccctggagagagatgtgctgcagcccctgagccggctgtctgaggaggagctgcctgccatcctgaagcacaagaagagcctgcagaagctggtgtctgactggaacaccctgaagagccggctgagccaggccaccaagaacagcggcagcagccagggcctgggcggcagccctggcagccacagccacaccaccatggccaacaaggtggagaccctgaaggaggaggaggaggagctgaagaggaaggtggagcagtgcagagatgagtacctggccgacctgtaccactttgtgaccaaggaggacagctatgccaactacttcatccggctgctggagatccaggccgactaccacagaagaagcctgagcagcctggacacagccctggccgagctgcgggagaaccacggccaggccgaccacagccccagcatgacagccacccacttcccccgggtgtatggagtgtccctggccacccacctgcaggagctgggccgggagatcgccctgcccatcgaggcctgtgtgatgatgctgctgtctgagggcatgaaggaggagggcctcttccggctggccgccggggcctctgtgctgaagaggctgaagcagaccatggccagtgacccccacagcctggaggagttctgcagcgacccccatgctgtggccggggccctgaagagctacctgcgggagctgcctgagcccctgatgacctttgacctgtatgatgactggatgagagctgccagcctgaaggagcccggggcccggctgcaggccctgcaggaggtgtgcagccggctgcccccagagaacctgagcaacctgcgctacctgatgaagttcctggcccggctggccgaggagcaggaggtgaacaagatgacccccagcaacatcgccatcgtgctgggccccaacctgctgtggcccccagagaaggagggggaccaggcccagctggatgctgcctctgtgagcagcatccaggtggtgggcgtggtggaggccctgatccagagcgctgacaccctcttccctggggacatcaacttcaacgtgtctggcctcttctctgctgtgaccctgcaggacacagtgtctgaccggctggccagcgaggagctgcccagcacagctgtgcccaccccagccaccaccccagccccagccccagccccagccccagccccagccccagccctggccagcgctgccaccaaggagaggacagagagcgaggtgccccccaggcctgccagccccaaggtgaccaggagccccccagagacagctgcccctgtggaggacatggcccggaggaccaagaggcctgccccagcccggcccaccatgcccccaccccaggtgtctggcagccgcagcagccccccagccccacccctgcccccaggcagcggcagccctggcaccccccaggccctgccccggcggctggtgggcagcagcctgcgggcccccaccgtgcccccacccctgccccccaccccaccccagcctgcccggcggcagagccgccgcagccctgccagccccagccctgccagccctggccctgccagccccagccctgtgtccctgagcaacccagcccaggtggacctgggcgccgccacagctgagggcggggcccctgaggccatctctggagtgcccaccccaccagccatccccccccagccccggcccaggagcctggccagcgagaccaactag

SEQ ID NO: 19481 - DNA, 1818 bp, Artificial Sequence
  Description of Artificial Sequence: Synthetic coding sequence
atggaggtgcgggccagcctgcagaagatcgtgtccaatggagatgagcagctggagaaggccatggaggagatcctgcgggacagcgagaagaggcccagcagcctgctggtggactgccagagcagcagcgagatcagtgaccacagctttggagacatcccagccagccagaccaacaagcccagcctgcagctgatcctggaccccagcaacacagagatcagcaccccccggcccagcagccctgggggcctgcctgaagaagattctgtgctcttcaacaagctgacctacctgggctgcatgaaggtgagcagccccagaaatgaggtggaggccctgcgggccatggccaccatgaagagcagcagccagtaccccttccctgtgaccctgtatgtgcccaacgtgcctgagggctctgtgcgcatcatcgaccagagcagcaatgtggagatcgccagcttccccatctacaaggtgctcttctgtgcccggggccatgatggcaccacagagagcaactgctttgccttcacagagagcagccacggcagcgaggagttccagatccacgtgttcagctgtgagatcaaggaggccgtgagccgcatcctgtacagcttctgcacagccttcaagaggagcagccggcaggtgtctgatgtgaaggacagcgtcatccccaccccagacagtgatgtgttcaccttctctgtgtccctggaggtgaaggaggatgatggaaaaggaaacttcagccctgtgcccaaggaccgggacaagttctacttcaagctgaagcagggcatcgagaagaaggtggtgatcaccgtgcagcagctgagcaacaaggagctggccatcgagcgctgcttcggcatgctgctgagccctggaagaaatgtgaagaacagcgacatgcacctgctggacatggagagcatgggcaagagctatgatggccgggcctacgtgatcaccggcatgtggaaccccaatgcccctgtgttcctggccctgaatgaggagacccccaaggacaagcaggtgtacatgacagtggccgtggacatggtggtgacagaggtggtggagcctgtgcgcttcctgctggagaccgtggtgcgggtgtacccagccaatgaacgcttctggtacttcagcaggaagaccttcacagagaccttcttcatgaggctgaagcagagcgagggcaagggccacaccaatgctggagatgccatctatgaggtggtgtccctgcagcgggagagtgacaaggaggagcctgtgacccccaccagcggcggcggccccatgagcccccaggatgatgaagctgaggaggagagtgacaatgagctgagcagcggcactggagatgtgtccaaggactgcccagagaagatcctgtacagctggggcgagctgctgggcaagtggcacagcaacctgggcgcccggcccaagggcctgagcaccctggtgaagagcggcgtgcctgaggccctgcgggcagaggtgtggcagctgctggccggctgccacgacaaccaggccatgctggaccgctaccgcatcctgatcaccaagcagcagatgaagttcagcctgaccccccggcagaccatccacctggtgaagtatgagggctccatgaaggtgtccatgaccccctgcaaccagctgcagtttgacatccggctggatgtgctgatcacctacaccttctgcttcagcagcttccctgagcctgagctgtacaagtatgtgctgaagcaccagctgatcaagaggctgaatgcctgctag

SEQ ID NO: 19482 - DNA, 3120 bp, Artificial Sequence
  Description of Artificial Sequence: Synthetic coding sequence
atggctgtgcagctggtgcctgattctgccctgggcctgctgatgatgacagagggccgccgctgccaggtgcacctgctggatgacaggaagctggagctgctggtgcagcccaagctgctggccaaggagctgctggacctggtggccagccacttcaacctgaaggagaaggagtactttggaattgccttcacagatgaaacaggccacctgaactggctgcagctggacagaagagtgctggagcatgacttccccaagaagagcggccctgtggtgctgtacttctgtgtgcgcttctacatcgagagcatctcctacctgaaggacaatgccaccatcgagctgttcttcctgaatgccaagagctgcatctacaaggagctgattgatgtggacagcgaggtggtgtttgagctggccagctacatcctgcaggaggccaagggggacttcagcagcaatgaggtggtgcggagtgacctgaagaagctgcctgccctgcccacccaggccctgaaggagcaccccagcctggcctactgtgaggacagagtcatcgagcactacaagaagctgaatggccagacccggggccaggccatcgtgaactacatgagcatcgtggagagcctgcccacctacggcgtgcactactatgctgtgaaggacaagcagggcatcccctggtggctgggcctgagctacaagggcatcttccagtatgactaccatgacaaggtgaagcccaggaagatcttccagtggaggcagctggagaacctgtacttccgggagaagaagttctctgtggaggtgcatgacccccggcgggcctctgtgaccaggaggaccttcggccacagcggcattgctgtgcacacctggtacgcctgcccagccctgatcaagagcatctgggccatggccatcagccagcaccagttctacctggacaggaagcagagcaagagcaagatccacgccgcccggagcctgtctgaaattgccatcgacctgacagagaccggcaccctgaagaccagcaagctggccaacatgggcagcaagggcaagatcatcagcggcagcagcggcagcctgctgagcagcggcagccaggagagtgacagcagccagagcgccaagaaggacatgctggccgccctgaagagccggcaggaggccctggaggagaccctgcggcagaggctggaggagctgaagaagctgtgcctgcgggaggccgagctgaccgggaagctgcctgtggagtaccccctggaccctggagaggagccccccatcgtgagaagacgcatcggcacagccttcaagctggatgagcagaagatcctgcccaagggggaggaggccgagctggagcggctggagcgggagtttgccatccagagccagatcacagaggccgcccggcggctggccagtgaccccaacgtgtccaagaagctgaagaagcagaggaagaccagctacctgaatgccctgaagaagctgcaggagattgaaaatgccatcaatgaaaatcgcatcaagagcggcaagaagcccacccagagggccagcctcatcattgatgatggcaacatcgccagcgaggacagcagcctgagtgatgccctggtgctggaggatgaggacagccaggtgaccagcaccatcagccccctgcacagcccccacaagggcctgcccccccggccccccagccacaaccggcccccaccaccccagagcctggagggcctgcggcagatgcactaccacagaaatgactatgacaagagccccatcaagcccaagatgtggagcgagagcagcctggatgagccctatgagaaggtgaagaagaggagcagccacagccacagcagcagccacaagcgcttccccagcacaggcagctgtgccgaggccggcggcggcagcaacagcctgcagaacagccccatccggggcctgccccactggaacagccagagctccatgcccagcaccccagacctgcgggtgcgcagcccccactacgtgcacagcaccaggtctgtggacatcagccccacccggctgcacagcctggccctgcacttccgccacaggagcagcagcctggagagccagggcaagctgctgggctctgaaaatgacaccggcagcccagacttctacacccccaggaccaggagcagcaatggaagtgaccccatggatgactgcagcagctgcaccagccacagcagcagcgagcactactacccagcccagatgaatgccaactacagcaccctggccgaggacagccccagcaaggcccggcagaggcagaggcagaggcagagagctgctggggccctgggcagcgccagcagcggctccatgcccaacctggccgcccggggcggggccggcggggccggcggggccggcggcggcgtgtacctgcacagccagagccagcccagcagccagtaccgcatcaaggagtaccccctgtacattgaaggaggagccacccctgtggtggtgcgcagcctggagagtgaccaggagggccactacagcgtgaaggcccagttcaagaccagcaacagctacacagctgggggcctcttcaaggagagctggaggggcggcggcggagatgaaggagacaccggccgcctgacccccagccgcagccagatcctgcggacccccagcctgggccgggagggcgcccatgacaagggagctggccgggctgctgtgtctgatgagctgcggcagtggtaccagaggagcacagccagccacaaggagcacagccggctgagccacaccagcagcaccagcagtgacagcggcagccagtacagcaccagcagccagagcacctttgtggcccacagccgggtgaccaggatgccccagatgtgcaaggccaccagcgctgccctgccccagagccagaggagcagcacccccagcagcgagatcggggccaccccacccagcagcccccaccacatcctgacctggcagacaggagaggccacagagaacagccccatcctggatggcagcgagagccccccccaccagagcacagatgaatag

SEQ ID NO: 19483 - DNA, 3228 bp, Artificial Sequence
  Description of Artificial Sequence: Synthetic coding sequence
atggtggtggaggtggacagcatgcctgctgccagctctgtgaagaagcccttcggcctgcggagcaagatgggcaagtggtgctgccgctgcttcccctgctgccgggagagcggcaagagcaatgtgggcaccagcggggaccatgatgacagcgccatgaagaccctgcggagcaagatgggcaagtggtgccgccactgcttcccctgctgccggggcagcggcaagagcaatgtgggcgccagcggggaccatgatgattctgccatgaagaccctgaggaacaagatgggcaagtggtgctgccactgcttcccctgctgccggggcagcagcaagagcaaggtgggcgcctggggagactatgatgacagcgccttcatggagccccgctaccacgtgcggggggaggacctggacaagctgcaccgggccgcctggtggggcaaggtgcccaggaaggacctgattgtgatgctgcgggacacagatgtgaacaagcaggacaagcagaagaggacagccctgcacctggccagcgccaatggaaacagcgaggtggtgaagctgctgctggaccggcgctgccagctgaatgtgctggacaacaagaagaggacagccctgatcaaggctgtgcagtgccaggaggatgaatgtgccctgatgctgctggagcacggcacagaccccaacatcccagatgaatatggcaacaccaccctgcactacgccatctacaatgaagacaagctgatggccaaggccctgctgctgtatggagctgacatcgagagcaagaacaagcacggcctgacccccctgctgctgggcgtgcatgagcagaagcagcaggtggtgaagttcctgatcaagaagaaggccaacctgaatgccctggacagatatggccgcacagccctgatcctggccgtgtgctgcggcagcgccagcatcgtgtccctgctgctggagcagaacattgatgtgagcagccaggacctgagcggccagacagcccgggagtatgctgtgagcagccaccaccacgtgatctgccagctgctgagtgactacaaggagaagcagatgctgaagatcagcagcgagaacagcaaccctgagcaggacctgaagctgaccagcgaggaggagagccagcgcttcaagggcagcgagaacagccagcctgagaagatgagccaggagcctgagatcaacaaggatggagaccgggaggtggaggaggagatgaagaagcatgagagcaacaacgtgggcctgctggagaacctgaccaatggagtgacagctggaaatggagacaatggcctcatcccccagaggaagagcaggaccccagagaaccagcagttcccagacaatgaaagtgaggagtaccaccgcatctgtgagctgctgagtgactacaaggagaagcagatgcccaagtacagcagcgagaacagcaaccctgagcaggacctgaagctgaccagcgaggaggagagccagaggctgaagggctctgaaaatggccagcctgagaagaggagccaggagcctgagatcaacaaggatggagaccgggagctggagaacttcatggccatcgaggagatgaagaagcacaggagcacccacgtgggcttccctgagaacctgaccaacggggccacagctggaaatggagatgatggcctcatcccccccaggaagagcaggaccccagagagccagcagttcccagacacagaaaatgaggagtaccacagtgatgagcagaatgacacccagaagcagttctgtgaggagcagaacacaggcatcctgcatgatgagatcctgattcatgaggagaagcagatcgaggtggtggagaagatgaacagcgagctgagcctgagctgcaagaaggagaaggacatcctgcacgagaacagcaccctgcgggaggagatcgccatgctgcggctggagctggacaccatgaagcaccagagccagctgcgggagaagaagtacctggaggacatcgagagcgtgaagaagagaaatgacaacctgctgaaggccctgcagctgaatgagctgaccatggatgatgacacagctgtgctggtgattgacaatggcagcggcatgtgcaaggccggctttgctggagatgatgcccccagggctgtgttccccagcatcgtgggccggccccggcagcagggcatgatgggcggcatgcaccagaaggagagctatgtgggcaaggaggcccagagcaagaggggcatcctgaccctgaagtaccccatggagcacggcatcatcaccaactgggatgacatggagaagatctggcaccacaccttctacaatgagctgcgggtggcccctgaggagcaccctgtgctgctgacagaggccaccctgaaccccaaggccaaccgggagaagatgacccagatcatgtttgagaccttcaacaccccagccatgtatgtggccatccaggccgtgctgagcctgtacaccagcggccgcaccactggaattgtgatggattctggagatggagtgacccacacagtgcccatctatgagggcaatgccctgccccacgccaccctgcggctggacctggccggccgggagctgcctgactacctgatgaagatcctgacagagcacggctaccgcttcaccaccatggccgagcgggagatcgtgcgggacatcaaggagaagctgtgctacgtggccctggactttgagcaggagatggccaccgtggccagcagcagcagcctggagaagagctatgagctgcctgatggccaggtgatcaccatcggaaatgaacgcttccgctgcccagaggccctcttccagccctgcttcctgggcatggagagctgtggcatccacgagaccaccttcaacagcatcatgaagagtgatgtggacatcaggaaggacctgtacaccaacacagtgctgagcggcggcaccaccatgtacccaggcatggcccacaggatgcagaaggagattgctgccctggcccccagcatgatgaagatccgcatcatcgccccacccaagaggaagtacagcgtgtgggtgggcggcagcatcctggccagcctgagcaccttccagcagatgtggatcagcaagcaggagtatgatgaaagtggccccagcatcgtgcacaggaagtgcctgtag

SEQ ID NO: 19484 - DNA, 1752 bp, Artificial Sequence
  Description of Artificial Sequence: Synthetic coding sequence
atgctgtctgagagcaaggagggggaggagaaggaggaggtgaccatggacaccagcgagaacagaccagaaaatgatgtgcctgagccccccatgcccatcgctgaccaggtgtccaatgatgacaggcctgagggctctgtggaggatgaggagaagaaggagagcagcctgcccaagagcttcaagaggaagatctctgtggtgtctgccaccaagggcgtgcctgctggcaacagcgacacagagggcggccagcccggcaggaagaggcgctggggcgccagcacagccaccacccagaagaagcccagcatcagcatcaccacagagagcctgaagagcctcatcccagacatcaagcccctggccggccaggaggccgtggtggacctgcacgcagatgacagccgcatcagtgaagatgaaacagaaagaaatggagatgatggcacccatgacaagggcctgaagatctgcaggacagtgacccaggtggtgcctgctgagggccaggagaatggccagcgggaggaggaggaggaggagaaggagcctgaggccgagccccctgtgcccccccaggtgtctgtggaggtggccctgcccccacctgctgagcacgaggtgaagaaggtgaccctgggggacaccctgaccaggaggagcatcagccagcagaagtctggagtgtccatcaccattgatgatcctgtgaggacagcccaggtgcccagccccccccggggcaagatcagcaacatcgtgcacatcagcaacctggtgcggcccttcaccctgggccagctgaaggagctgctgggccgcacaggcaccctggtggaggaggccttctggattgacaagatcaagagccactgctttgtgacctacagcacagtggaggaggccgtggccaccaggacagccctgcacggcgtgaagtggccccagagcaaccccaagttcctgtgtgccgactatgcagagcaggatgagctggactaccaccggggcctgctggtggaccggcccagcgagaccaagacagaggagcagggcatcccccggcccctgcaccccccacctcctcctcctgtgcagcccccccagcaccccagggctgagcagcgggagcaggagagagctgtgcgggagcagtgggccgagcgggagcgggagatggagcggcgggagaggaccaggtctgagcgggagtgggaccgggacaaggtgcgggagggccccaggagccgcagccgcagccgggacagaagaaggaaggagcgggccaagagcaaggagaagaagtctgagaagaaggagaaggcccaggaggagcccccagccaagctgctggatgacctcttcaggaagaccaaggccgccccctgcatctactggctgcccctgacagacagccagatcgtgcagaaggaggccgagcgggcagagcgggccaaggagcgggagaagaggaggaaggagcaggaggaggaggagcagaaggagcgggagaaggaggccgagcgggagaggaaccggcagctggagcgggagaagaggcgggagcacagccgggagcgggaccgggagcgggagcgggagcgggagcgggacagaggagaccgggaccgggaccgggagcgggaccgggagcggggccgggagcgggaccggcgggacaccaagaggcacagccgcagccgcagccgcagcacccctgtgcgggaccggggcggcagaagatag

SEQ ID NO: 19485 - DNA, 963 bp, Artificial Sequence; identical to SEQ ID NO: 19292
  Description of Artificial Sequence: Synthetic coding sequence

SEQ ID NO: 19486 - DNA, 3294 bp, Artificial Sequence
  Description of Artificial Sequence: Synthetic coding sequence
atggctgctgctgctgctgagcagcagcagttctacctgctgctgggcaacctgctgagcccagacaacgtggtgaggaagcaggccgaggagacctatgagaacatccctggccagagcaagatcaccttcctgctgcaggccatccggaacaccacagctgctgaggaggcccggcagatggctgctgtgctgctgcggcggctgctgagcagcgcctttgatgaggtgtacccagccctgcccagtgatgtgcagacagccatcaagtctgagctgctgatgatcatccagatggagacccagagctccatgaggaagaaggtgtgtgacattgctgctgagctggccaggaacctgattgatgaagatggcaacaaccagtggccagagggcctgaagttcctgtttgattctgtgagcagccagaatgtgggcctgcgggaggccgccctgcacatcttctggaacttccctggcatcttcggcaaccagcagcagcactacctggatgtgatcaagaggatgctggtgcagtgcatgcaggaccaggagcaccccagcatccgcaccctgagcgcccgggccacagctgccttcatcctggccaatgagcacaacgtggccctcttcaagcactttgctgacctgctgcccggcttcctgcaggccgtgaatgacagctgctaccagaatgatgattctgtgctgaagagcctggtggagattgctgacacagtgcccaagtacctgcggccccacctggaggccaccctgcagctgagcctgaagctgtgtggggacaccagcctgaacaacatgcagaggcagctggccctggaggtgattgtgaccctgtctgaaacagctgctgccatgctgaggaagcacaccaacatcgtggcccagaccatcccccagatgctggccatgatggtggacctggaggaggatgaggactgggccaatgctgatgagctggaggatgatgactttgacagcaatgctgtggccggggagagcgccctggacaggatggcctgtggcctgggcggcaagctggtgctgcccatgatcaaggagcacatcatgcagatgctgcagaacccagactggaagtacagacatgctggcctgatggccctgagcgccatcggggagggctgccaccagcagatggagggcatcctgaatgagatcgtgaactttgtgctgctcttcctgcaggacccccacccccgggtgcgctatgctgcctgcaatgctgtgggccagatggccacagactttgcccctggcttccagaagaagttccacgagaaggtgattgctgccctgctgcagaccatggaggaccagggcaaccagagggtgcaggcccacgccgccgccgccctgatcaacttcacagaggactgccccaagagcctgctgatcccctacctggacaacctggtgaagcacctgcacagcatcatggtgctgaagctgcaggagctgatccagaagggcaccaagctggtgctggagcaggtggtgaccagcatcgcctctgtggccgacacagctgaggagaagtttgtgccctactatgacctcttcatgcccagcctgaagcacatcgtggagaatgctgtgcagaaggagctgcggctgctgcggggcaagaccatcgagtgcatcagcctcatcggcctggccgtgggcaaggagaagttcatgcaggatgccagtgatgtgatgcagctgctgctgaagacccagacagacttcaatgacatggaggatgatgacccccagatctcctacatgatcagcgcctgggccaggatgtgcaagatcctgggcaaggagttccagcagtacctgcctgtggtgatgggccccctgatgaagacagccagcatcaagccagaggtggccctgctggacacccaggacatggagaacatgtctgatgatgatggctgggagtttgtgaacctgggggaccagcagagctttggcatcaagacagctggcctggaggagaagagcacagcctgccagatgctggtgtgctacgccaaggagctgaaggagggctttgtggagtacacagagcaggtggtgaagctgatggtgcccctgctgaagttctacttccatgatggagtgcgggtggccgctgctgagagcatgcccctgctgctggagtgtgcccgggtgcggggccctgagtacctgacccagatgtggcacttcatgtgtgatgccctgatcaaggccatcggcacagagccagacagtgatgtgctgtctgagatcatgcacagctttgccaagtgcatcgaggtgatgggagatggctgcctgaacaatgagcactttgaggagctgggcggcatcctgaaggccaagctggaggagcacttcaagaaccaggagctgcggcaggtgaagaggcaggatgaggactatgatgagcaggtggaggagagcctgcaggatgaagatgacaatgatgtgtacatcctgaccaaggtgtctgacatcctgcacagcatcttcagcagctacaaggagaaggtgctgccctggtttgagcagctgctgcccctcatcgtgaacctgatctgcccccaccggccctggccagaccggcagtggggcctgtgcatctttgatgatgtgattgagcactgcagccctgccagcttcaagtatgcagagtacttcctgcggcccatgctgcagtatgtgtgtgacaacagccctgaggtgcggcaggccgccgcctacggcctgggcgtgatggcccagtatggaggagacaactaccggcccttctgcacagaggccctgcccctgctggtgcgggtcatccagagcgctgacagcaagaccaaggaaaatgtgaatgccacagagaactgcatctctgctgtgggcaagatcatgaagttcaagccagactgtgtgaatgtggaggaggtgctgccccactggctgtcctggctgcccctgcacgaggacaaggaggaggccgtgcagaccttcaactacctgtgtgacctgattgagagcaaccaccccatcgtgctgggccccaacaacaccaacctgcccaagatcttcagcatcatcgccgagggggagatgcatgaggccatcaagcatgaggacccctgtgccaagaggctggccaacgtggtgcggcaggtgcagaccagcggcggcctgtggacagaatgtattgcccagctgagccctgagcagcaggccgccatccaggagctgctgaacagcgcctag

SEQ ID NO: 19487 - DNA, 2715 bp, Artificial Sequence
  Description of Artificial Sequence: Synthetic coding sequence
atgtttcctgccctggagacccacctgaagcagaccatcccagacccctatgaggacttcatgtaccgccacctgcagtactacggctacttcaaggcccagaggggcagcctgcccaacagcgccacccaccagcacgtgaggaagaacaacccccagtgcctgctgaatggcagcctgggggagaaggatgacctgatcccagacaccctgcagaaggagaagctgctgtggcccatcagcctgagcagcgctgtgcaccggcagatcgaggccatcaacagagacttccacagctgcctgggctggatgcagtggaggggcctgagcagcctgcagcccccaccaccccgcttcaaggacagccctgccagcgccttccgggtggccggcatcacagacagccacatgctgagcctgccccacctgcggagccggcagctgctgtatgatgagctggatgaggtgaacccccggctgcgggagccccaggagctgttcagcatcctgagcaccaagaggcccctgcaggccccccgctggcccattgaatgtgaggtgatcaaggagaacatccaccacatcgagtgggccccaccccagcctgagtacttctaccagcccaagggaaatgagaaggtgcctgagatcgtgggggagaagaagggcaccgtggtgtaccagctggacagcgtgcccatcgagggcagctacttcaccagcagccgggtgggcggcaagaggggcatcgtgaaggagctggccgtgaccctgcagggccctgaggacaacaccctgctgtttgagagcagatttgagagcggcaacctgcagaaggctgtgcgggtggacacctatgaatatgagctgaccctgaggacagacctgtacaccaacaagcacacccagtggttctacttccgggtgcagaacaccaggaaggatgccacctaccgcttcaccatcgtgaacctgctgaagcccaagagcctgtacacagtgggcatgaagcccctgctgtacagccagctggatgccaacaccagaaatattggctggaggcgggagggcaatgagatcaagtactacaagaacaacacagatgatggccagcagcccttctactgcctgacctggaccatccagttcccctatgaccaggacacctgcttctttgcccacttctacccctacacctacacagacctgcagtgctacctgctgtctgtggccaacaaccccatccagagccagttctgcaagctgcagaccctgtgccgcagcctggccggcaacacagtgtacctgctgaccatcaccaaccccagccagaccccccaggaggccgccgccaagaaggctgtggtgctgagcgcccgggtgcaccctggagagagcaatggctcctgggtgatgaagggcttcctggacttcatcctgagcaacagcccagatgcccagctgctgcgggacatctttgtgttcaaggtgctgcccatgctgaacccagatggagtgattgtgggcaactaccgctgcagcctggccggccgggacctgaacagacactacaagaccatcctgaaggagagcttcccctgcatctggtacaccaggaacatgatcaagaggctgctggaggagcgggaggtgctgctgtactgtgacttccacggccacagcaggaagaacaacatcttcctgtatggctgcaacaacaacaacaggaagtactggctgcacgagagggtcttccccctgatgctgtgcaagaatgccccagacaagttctccttccacagctgcaacttcaaggtgcagaagtgcaaggagggcaccggccgggtggtgatgtggaggatgggcatcctgaacagctacaccatggagagcacctttggaggcagcaccctgggcaacaagagggacacccacttcaccatcgaggacctgaagagcctgggctaccacgtgtgtgacaccctgctggacttctgtgaccctgaccagatgaagttcacccagtgcctggccgagctgaaggagctgctgcggcaggagatccacaagaagttccacgagctgggccaggatgtggacctggagggctcctggagcgacatcagcctgagtgacatcgagagcaggaacagcaccagcggcagtgacagcagcctgagtgatggcctgcctgtgcacctggccaacattgctgatgagctgacccagaagaagaagatgttcaagaagaagaagaagaagagcctgcagaccaggaagcagagaaatgagcagtaccagaagaagaacctgatgcagaagctgaagctgacagaggacaccagcgagaaggccggctttgccagcaccctgcagaagcagcccaccttcttcaagaacagcgagaacagcagcttcctgcccatgaagaatgaaaacccccggctgaatgagaccaacctgaacagaagagacaaggacacccccctggaccccagcatggccaccctcatcctgcccaagaacaagggccgcatgcagaacaagaagccaggcttcaccgtgtcctgcagccccaagaggaccatcaacagcagccaggagcccgcccctggcatgaagcccaactggcccaggagccgctacccagccaccaagaggggctgtgccgccatggccgcctaccccagcctgcacatctacacctacccctag

SEQ ID NO: 19488 - DNA, 789 bp, Artificial Sequence
  Description of Artificial Sequence: Synthetic coding sequence
atggccctgagcctgggctggaaggcccacaggaaccactgcggcctgctgctgcaggccctgcggagcagcggcctgctgctcttcccctgtggccagtgcccctggagaggagctggcagcttcctggaccctgagatcaaggccttcctggaggagaacacagaggtgaccagcagcggcagcctgaccccagagatccagctgcggctgctgaccccccgctgcaagttctggtgggagagagctgacctgtggccccacagcgacccctactgggccatctactggccaggcggccaggccctgagccgctacctgctggacaacccagatgtggtgcggggcaagtctgtgctggacctgggcagcggctgtggggccacagccatcgccgccaagatgtctggggccagccgcatcctggccaatgacatcgaccccatcgccggcatggccatcaccctgaactgtgagctgaaccggctgaaccccttccccatcctgatccagaacatcctgaacctggagcaggacaagtgggacctggtggtgctgggggacatgttttatgatgaggacctggccgacagcctgcaccagtggctgaagaagtgcttctggacctaccgcaccagggtgctgattggagaccccggccggccccagttcagcggccacagcatccagcaccacctgcacaaggtggtggagtacagcctgctggagagcacccggcaggagaacagcggcctgaccaccagcacagtgtggggcttccagccctag

SEQ ID NO: 19489 - DNA, 2619 bp, Artificial Sequence
  Description of Artificial Sequence: Synthetic coding sequence
atgaactacccaggccggggcagccccaggagccctgagcacaacggccggggcggcggcggcggggcctgggagctgggcagtgatgcccggcctgccttcggcggcggcgtgtgctgctttgagcacctgcctggaggagaccctgatgatggagatgtgcccctggccctgctgcggggggagcccggcctgcacctggcccctggaacagatgaccacaaccaccacctggccctggacccctgcctgagtgatgaaaattatgacttcagcagcgctgagagcggcagcagcctgcgctactacagcgagggggagagcggcggcggcggcagcagcctgagcctgcaccccccccagcagccccccctggtgcccaccaacagcggcggcggcggggccaccggcggcagccctggagagaggaagaggacccggctgggcggccctgctgcccggcacagatatgaggtggtgacagagctgggccctgaggaggtgcgctggttctacaaggaggacaagaagacctggaagcccttcatcggctatgacagcctgcgcatcgagctggccttccgcaccctgctgcagaccactggagcccggccccagggcggggacagagatggagaccacgtgtgcagccccactggacctgccagcagcagtggagaagatgatgatgaagatcgggcctgtggcttctgccagagcaccaccggccacgagcctgagatggtggagctggtgaacatcgagcctgtgtgtgtgcggggcggcctgtatgaggtggatgtgacccagggcgagtgctaccctgtgtactggaaccaggccgacaagatccctgtgatgaggggccagtggttcattgatggcacctggcagcccctggaggaggaggagagcaacctgattgagcaggagcacctgaactgcttccggggccagcagatgcaggagaactttgatattgaggtgtccaagagcattgatggcaaggatgctgtgcacagcttcaagctgagcaggaaccacgtggactggcacagcgtggatgaggtgtacctgtacagtgatgccaccaccagcaagatcgccaggacagtgacccagaagctgggcttcagcaaggccagcagcagcggcacccggctgcaccggggctacgtggaggaggccaccctggaggacaagcccagccagaccacccacatcgtgtttgtggtgcatggaattggccagaagatggaccagggccgcatcatcaagaacacagccatgatgagggaggccgccaggaagattgaggagcggcacttcagcaaccacgccacccacgtggagttcctgcctgtggagtggaggagcaagctgaccctggatggagacacagtggacagcatcaccccagacaaggtgcggggcctgcgggacatgctgaacagcagcgccatggacatcatgtactacaccagccccctgtacagagatgagctggtgaagggcctgcagcaggagctgaacagactctacagcctcttctgcagcaggaacccagactttgaggagaagggcggcaaggtgtccatcgtgagccacagcctgggctgcgtcatcacctatgacatcatgacaggctggaaccctgtgcggctgtatgagcagctgctgcagaaggaggaggagctgcctgatgagcgctggatgtcctatgaggagcggcacctgctggatgagctgtacatcaccaagaggcggctgaaggagattgaggagcggctgcacggcctgaaggccagctccatgacccagaccccagccctgaagttcaaggtggagaacttcttctgcatgggcagccccctggccgtgttcctggccctgcggggcatccggcccggcaacacaggcagccaggaccacatcctgccccgggagatctgcaaccggctgctgaacatcttccaccccacagatcctgtggcctaccgcctggagcccctcatcctgaagcactacagcaacatcagccctgtgcagatccactggtacaacaccagcaaccccctgccctatgagcacatgaagcccagcttcctgaacccagccaaggagcccacctctgtgtctgaaaatgaaggcatcagcaccatccccagccctgtgaccagccctgtgctgagccgccgccactatggagagagcatcaccaacatcggcaaggccagcatcctgggcgccgccagcatcggcaagggcctgggcggcatgctgttcagcagatttggccgcagcagcaccacccagagcagcgagaccagcaaggacagcatggaggatgagaagaagcctgtggccagccccagcgccaccaccgtgggcacccagaccctgccccacagcagcagcggcttcctggacagcgccctggagctggaccacagaattgactttgagctgcgggagggcctggtggagagccgctactggagcgctgtgaccagccacacagcctactggagcagcctggatgtggccctcttcctgctgaccttcatgtacaagcatgaacatgatgatgatgccaagcccaacctggaccccatctag

SEQ ID NO: 19490 - DNA, 1461 bp, Artificial Sequence
  Description of Artificial Sequence: Synthetic coding sequence
atggtgagccacaccttccacatgaggacagaggagagtgatgccagccaggagggagatgacctgcccaagagcagcgccaacaccagccaccccaagcaggatgacagccccaagagcagcgaggagaccatccagcccaaggagggggacatccccaaggcccctgaggagaccatccagagcaagaaggaggacctgcccaagagcagcgagaaggccatccagcccaaggagagcaacatccccaagagcagcgccaagcccatccagcccaagctgggcaacatccccaaggcctctgtgaagcccagccagcccaaggagggggacatccccaaggcccctgaggagaccatccagagcaagaaggaggacctgcccaagagcagcgaggaggccatccagcccaaggagggggacatccccaagagcagcgccaagcccatccagcccaagctgggcaacatcgccaagacctctgtgaagcccagccagcccaaggagagtgacatccccaagagccctgaggagaccatccagcccaaggagggggacatccccaagagcagcgccaagcccatccagcccaagctgggcaacatccccaaggcctctgtgaagcccagccagcccaaggagggggacatcagcaagagccctgaggaggccatccagcccaaggagggggacctgcccaagagcctggaggaggccatccagcccaaggagggggacatccccaagagccctgaggaggccatccagcccaaggagggggacatccccaagagcctggaggaggccatccagcccaaggagggggacatccccaagagccctgaggagaccatccagcccaagaagggggacatccccaagagccctgaggaggccatccagcccaaggagggggacatccccaagagccccaagcaggccatccagcccaaggagggggacatccccaagagcctggaggaggccatcccccccaaggagattgacatccccaagagccctgaggagaccatccagcccaaggaggatgacagccccaagagcctggaggaggccacccccagcaaggagggggacatcctgaagccagaggaggagaccatggagttccctgagggggacaaggtgaaggtgatcctgagcaaggaggactttgaggccagcctgaaggaggccggggagcggctggtggccgtggacttcagcgccacctggtgtggcccctgcaggaccatccggcccttcttccacgccctgtctgtgaagcatgaagatgtggtgttcctggaggtggatgctgacaactgtgaggaggtggtgagagaatgtgccatcatgtgtgtgcccaccttccagttctacaagaaggaggagaaggtggatgagctgtgtggggccctgaaggagaagctggaggccgtgattgctgagctgaagtag

SEQ ID NO: 19491 - DNA, 1005 bp, Artificial Sequence
  Description of Artificial Sequence: Synthetic coding sequence
atggccgccagcggcagcggcatggcccagaagacctgggagctggccaacaacatgcaggaggcccagagcattgatgagatctacaagtatgacaagaagcagcagcaggagatcctggccgccaagccctggaccaaggaccaccactacttcaagtactgcaagatcagcgccctggccctgctgaagatggtgatgcacgcccggagcggcggcaacctggaggtgatgggcctgatgctgggcaaggtggatggagagaccatgatcatcatggacagctttgccctgcctgtggagggcacagagaccagggtgaatgcccaggccgccgcctatgagtacatggccgcctacattgaaaatgccaagcaggtgggccgcctggagaatgccatcggctggtaccacagccaccctggctacggctgctggctgagcggcattgatgtgtccacccagatgctgaaccagcagttccaggagccctttgtggccgtggtgattgaccccaccaggaccatctctgctgggaaggtgaacctgggcgccttccgcacctaccccaagggctacaagcccccagatgagggccccagcgagtaccagaccatccccctgaacaagattgaggactttggagtgcactgcaagcagtactatgccctggaggtgtcctacttcaagagcagcctggacaggaagctgctggagctgctgtggaacaagtactgggtgaacaccctgagcagcagcagcctgctgaccaatgctgactacaccaccggccaggtgtttgacctgtctgagaagctggagcagagcgaggcccagctgggccggggcagcttcatgctgggcctggagacccatgacaggaagtctgaggacaagctggccaaggccacccgggacagctgcaagaccaccatcgaggccatccacggcctgatgagccaggtgatcaaggacaagctgttcaaccagatcaacatctcctag

SEQ ID NO: 19492 - DNA, 1350 bp, Artificial Sequence
  Description of Artificial Sequence: Synthetic coding sequence
atggtgatggagaagcccagccccctgctggtgggccgggagtttgtgcggcagtactacaccctgctgaacaaggcccctgagtacctgcaccgcttctacggcaggaacagcagctatgtgcacggcggcgtggatgccagcggcaagccccaggaggccgtgtatggccagaatgacatccaccacaaggtgctgagcctgaacttcagcgagtgccacaccaagatcagacatgtggatgcccacgccaccctgagtgatggagtggtggtgcaggtgatgggcctgctgagcaacagcggccagcctgagaggaagttcatgcagacctttgtgctggcccctgagggctctgtgcccaacaagttctacgtgcacaatgacatgttccgctatgaagatgaggtgtttggagacagcgagcctgagctggatgaggagagtgaagatgaggtggaggaggagcaggaggagcggcagcccagccctgagcctgtgcaggagaatgccaacagcggctactatgaggcccaccctgtgaccaatggaattgaggagcccctggaggagagcagccatgagcctgagcctgagcctgagagcgagaccaagacagaggagctgaagccccaggtggaggagaagaacctggaggagctggaggagaagagcaccaccccacctcctgctgagcctgtgtccctgccccaggagccccccaagccccgggtggaggccaagccagaggtgcagagccagcccccccgggtgcgggagcagaggccccgggagaggcctggcttccccccccggggcccccggcccggccgcggggacatggagcagaatgacagcgacaacagacgcatcatccgctacccagacagccaccagctgtttgtgggcaacctgccccatgacattgatgaaaatgagctgaaggagttcttcatgagctttggaaatgtggtggagctgcgcatcaacaccaagggcgtgggcggcaagctgcccaactttggatttgtggtgtttgatgattctgagcctgtgcagaggatcctgattgccaagcccatcatgttccggggggaggtgcggctgaatgtggaggagaagaagacccgggccgcccgggagcgggagacccggggcggcggagatgacagaagagacatcagaagaaatgaccggggccctgggggcccccggggcatcgtgggcggcggcatgatgagggacagagatggccggggccccccaccccggggcggcatggcccagaagctgggcagcggccggggcaccggccagatggagggccgcttcaccggccagaggaggtag

SEQ ID NO: 19493 - DNA, 333 bp, Artificial Sequence
  Description of Artificial Sequence: Synthetic coding sequence
atggaggagatcccagcccaggaggccgccggcagcccccgggtgcagttccagagcctggagacccagagtgaatgtctgagccctgagccccagtttgtgcaggacacagacatggagcagggcctgaccggcggcatcctgctgcggctgcccaccacccgcatccacagcgtgaacagctgcccagccctgagccacacccaggccagcgccttcagcggggagaccctggccgtgctgacagctggcatcagcaagcgctggcccaagtaccgcctgcccatcgacatcgcccggccctgcagcgagacccccttcccccggctgtag

SEQ ID NO: 19494 - DNA, 822 bp, Artificial Sequence; identical to SEQ ID NO: 19062
  Description of Artificial Sequence: Synthetic coding sequence

SEQ ID NO: 19495 - DNA, 2916 bp, Artificial Sequence
  Description of Artificial Sequence: Synthetic coding sequence
ctgagcagaagagtgccctgtgtgagaagaggctgccggccccccctgccccccctgcccggcagccagagccgggcctggagccgggaccgggaggcccccctggaccccggccggcctgcccagagcggcagaagacccaccagccgctctgtgagccacgcctgctcctggaatggaggcagcctggaccccctggagggcaccccagccctgctgcggtctgctgagcggctgatgaggaaggtgaagaagctgcggctggacaaggaaaatacaggctcctggaggagcttcagcctgaacagcgagggcgctgagaggatggccaccaccggcacccccacagctgacagaggagatgctgctgccacagatgatcctgctgcccgcttccaggtgcagaagcacagctgggatggcctgcggagcatcatccacggcagcaggaagtacagcggcctcatcgtgaacaaggcccctcatgacttccagtttgtgcagaagacagatgaaagtggcccccacagccaccggctgtactacctgggcatgccctacggcagccgggagaacagcctgctgtacagcgagatccccaagaaggtgaggaaggaggccctgctgctgctgtcctggaagcagatgctggaccacttccaggccaccccccaccacggcgtgtacagccgggaggaggagctgctgcgggagaggaagaggctgggcgtgtttggcatcaccagctatgacttccacagcgagagcggcctcttcctgttccaggccagcaacagcctcttccactgcagagatggcggcaagaatggcttcatggtgagccccatgaagcccctggagatcaagacccagtgcagcggccccaggatggaccccaagatctgcccagctgaccctgccttcttctccttcatcaacaacagcgacctgtgggtggccaacatcgagaccggggaggagcggcggctgaccttctgccaccagggcctgagcaatgtgctggatgaccccaagtctgctggggtggccaccttcgtcatccaggaggagtttgaccgcttcaccggctactggtggtgccccacagcctcctgggagggcagcgagggcctgaagaccctgcgcatcctgtatgaggaggtggatgaaagtgaggtggaggtgattcatgtgcccagccctgccctggaggagaggaagacagacagctaccgctaccccaggacaggcagcaagaaccccaagatcgccctgaagctggccgagttccagacagacagccagggcaagatcgtgtccacccaggagaaggagctggtgcagcccttcagcagcctcttccccaaggtggagtacatcgcccgggccggctggaccagagatggcaagtatgcctgggccatgttcctggaccggccccagcagtggctgcagctggtgctgctgcccccagccctcttcatccccagcacagaaaatgaggagcagaggctggccagcgcccgggctgtgcccagaaatgtgcagccctacgtggtgtatgaggaggtgaccaacgtgtggatcaacgtgcatgacatcttctaccccttcccccagagcgagggggaggatgagctgtgcttcctgcgggccaatgaatgcaagacaggcttctgccacctgtacaaggtgacagctgtgctgaagagccagggctatgactggagcgagcccttcagccctggagaagatgagttcaagtgccccatcaaggaggagatcgccctgaccagcggggagtgggaggtgctggcccggcacggcagcaagatctgggtgaatgaggagaccaagctggtgtacttccagggcaccaaggacacccccctggagcaccacctgtatgtggtgtcctatgaggccgccggggagatcgtgcggctgaccaccccaggcttcagccacagctgcagcatgagccagaactttgacatgtttgtgagccactacagctctgtgtccaccccaccctgtgtgcacgtgtacaagctgagcggcccagatgatgaccccctgcacaagcagccccgcttctgggcctccatgatggaggccgccagctgccccccagactatgtgcccccagagatcttccacttccacaccaggagtgatgtgcggctgtatggcatgatctacaagccccacgccctgcagcccgggaagaagcaccccaccgtgctgtttgtgtatggaggcccccaggtgcagctggtgaacaacagcttcaagggcatcaagtacctgcggctgaacaccctggccagcctgggctatgctgtggtggtgattgatggccggggcagctgccagaggggcctgcgctttgaaggagccctgaagaaccagatgggccaggtggagattgaggaccaggtggagggcctgcagtttgtggccgagaagtatggcttcatcgacctgagccgggtggccatccacggctggagctatggaggcttcctgagcctgatgggcctcatccacaagccccaggtgttcaaggtggccatcgccggggcccctgtgacagtgtggatggcctatgacaccggctacacagagcgctacatggatgtgcctgagaacaaccagcacggctatgaagctggctctgtggccctgcacgtggagaagctgcccaatgagcccaaccggctgctgatcctgcacggcttcctggatgaaaatgtgcacttcttccacaccaacttcctggtgtcccagctgatccgggccggcaagccctaccagctgcagatctacccaaatgaaagacacagcatccgctgcccagagagcggggagcactatgaggtgaccctgctgcacttcctgcaggagtacctgtag

SEQ ID NO: 19496 - DNA, 2592 bp, Artificial Sequence
  Description of Artificial Sequence: Synthetic coding sequence
atgggcaaccgggagatggaggagctgatccccctggtgaaccggctgcaggatgccttcagcgccctgggccagagctgcctgctggagctgccccagattgctgtggtgggcggccagagcgctgggaagagctctgtgctggagaactttgtgggccgggacttcctgccccggggcagcggcatcgtgacccggcggcccctggtgctgcagctggtgaccagcaaggccgagtatgcagagttcctgcactgcaagggcaagaagttcacagactttgatgaggtgcggctggagattgaagctgagacagacagagtgacaggcatgaacaagggcatcagcagcatccccatcaacctgcgggtgtacagcccccacgtgctgaacctgaccctgattgacctgcccggcatcaccaaggtgcctgtgggggaccagcccccagacatcgagtaccagatccgggagatgatcatgcagttcatcacccgggagaactgcctgatcctggccgtgaccccagccaacacagacctggccaacagtgatgccctgaagctggccaaggaggtggacccccagggcctgcggaccatcggggtcatcaccaagctggacctgatggatgagggcacagatgccagagatgtgctggagaacaagctgctgcccctgcggcggggctacgtgggcgtggtgaacagaagccagaaggacattgatggcaagaaggacatcaaggccgccatgctggccgagaggaagttcttcctgagccacccagcctaccgccacatcgctgacaggatgggcaccccccacctgcagaaggtgctgaaccagcagctgaccaaccacatccgggacaccctgcccaacttcaggaacaagctgcagggccagctgctgagcattgaacatgaggtggaggcctacaagaacttcaagccagaggaccccaccaggaagaccaaggccctgctgcagatggtgcagcagtttgctgtggactttgagaagagaattgagggcagcggggaccaggtggacaccctggagctgtctggaggagccaagatcaaccgcatcttccacgagcgcttcccctttgagatcgtgaagatggagttcaatgagaaggagctgcggcgggagatctcctatgccatcaagaacatccacggcatcagaacaggcctcttcaccccagacatggcctttgaggccatcgtgaagaagcagatcgtgaagctgaagggccccagcctgaagtctgtggacctggtgatccaggagctgatcaacacagtgaagaagtgcaccaagaagctggccaacttcccccggctgtgtgaggagacagaaagaattgtggccaaccacatccgggagcgggagggcaagaccaaggaccaggtgctgctgctgattgacatccaggtgtcctacatcaacaccaaccacgaggacttcatcggctttgccaatgcccagcagaggagcagccaggtgcacaagaagaccaccgtgggcaaccaggtgatcaggaagggctggctgaccatcagcaacatcggcatcatgaagggcggcagcaagggctactggtttgtgctgacagctgagagcctgtcctggtacaaggatgatgaggagaaggagaagaagtacatgctgcccctggacaacctgaaggtgagagatgtggagaagagcttcatgagcagcaagcacatctttgccctcttcaacacagagcagagaaatgtgtacaaggactaccgcttcctggagctggcctgtgacagccaggaggatgtggacagctggaaggccagcctgctgcgggccggcgtgtacccagacaagtctgtgggcaacaacaaggcagaaaatgatgaaaatggccaggccgagaacttctccatggacccccagctggagcggcaggtggagaccatccggaacctggtggacagctacatgagcatcatcaacaagtgcatccgggacctgatccccaagaccatcatgcacctgatgatcaacaacgtgaaggacttcatcaacagcgagctgctggcccagctgtacagcagcgaggaccagaacaccctgatggaggagagcgctgagcaggcccagaggagagatgagatgctgaggatgtaccaggccctgaaggaggccctgggcatcatcggggacatcagcacagccaccgtgtccaccccagcccctcctcctgtggatgacagctggatccagcacagcagaagaagccccccacccagccccaccacccagaggcggcccaccctgagcgcccccctggcccggcccaccagcggccggggccctgccccagccatccccagccctggcccccacagcggggcccctcctgtgcccttccggcccggccccctgccccccttccccagcagcagtgacagctttggagccccaccccaggtgcccagccggcccacccgggccccacccagcgtgcccagccggcggcccccacccagccccacccggcccaccatcatccggcccctggagagcagcctgctggactag

SEQ ID NO: 19497 - DNA, 1263 bp, Artificial Sequence; identical to SEQ ID NO: 18898
  Description of Artificial Sequence: Synthetic coding sequence

SEQ ID NO: 19498 - DNA, 2481 bp, Artificial Sequence
  Description of Artificial Sequence: Synthetic coding sequence
atggtggcccctgtgctggagaccagccacgtgttctgctgccccaacagagtgcggggcgtgctgaactggagcagcggcccccggggcctgctggccttcggcaccagctgcagcgtggtgctgtatgaccccctgaagagggtggtggtgaccaacctgaatggccacacagcccgggtgaactgcatccagtggatctgcaagcaggacggcagccccagcacagagctggtgtctgggggcagtgacaaccaggtgatccactgggagattgaggacaaccagctgctgaaggctgtgcacctgcagggccacgagggccctgtgtatgctgtgcatgctgtgtaccagaggaggaccagtgaccctgccctgtgcaccctcatcgtgtctgctgctgctgacagcgctgtgcggctgtggagcaagaagggccctgaggtgatgtgcctgcagaccctgaactttggaaatggatttgccctggccctgtgcctgtccttcctgcccaacacagatgtgcccatcctggcctgtggaaatgatgactgccgcatccacatctttgcccagcagaatgaccagttccagaaggtgctgagcctgtgtggccacgaggactggatccggggcgtggagtgggccgccttcggccgggacctcttcctggccagctgcagccaggactgcctgatccgcatctggaagctgtacatcaagagcaccagcctggagacccaggatgatgacaacatccggctgaaggagaacaccttcaccattgaaaatgaatctgtgaagatcgcctttgctgtgaccctggagaccgtgctggccggccacgagaactgggtgaatgctgtgcactggcagcctgtgttctacaaggatggagtgctgcagcagcctgtgcggctgctgagcgcctccatggacaagaccatgatcctgtgggccccagatgaggagagcggcgtgtggctggagcaggtgcgggtgggggaggtgggcggcaacaccctgggcttctatgactgccagttcaatgaagatggctccatgatcatcgcccacgccttccacggggccctgcacctgtggaagcagaacacagtgaacccccgggagtggaccccagagatcgtcatcagcggccactttgatggagtgcaggacctggtgtgggaccctgagggggagttcatcatcaccgtgggcacagaccagaccacccggctgtttgccccctggaagaggaaggaccagagccaggtgacctggcatgaaattgcccggccccagatccacggctatgacctgaagtgcctggccatgatcaaccgcttccagtttgtgtctggagcagatgagaaggtgctgcgggtcttcagcgcccccaggaactttgtggagaacttctgtgccatcaccggccagagcctgaaccacgtgctgtgcaaccaggacagcgacctgcctgagggcgccaccgtgcctgccctgggcctgagcaacaaggctgtgttccagggcgacatcgccagccagcccagtgatgaggaggagctgctgaccagcacaggctttgagtaccagcaggtggccttccagcccagcatcctgacagagcccccaacagaggaccacctgctgcagaacaccctgtggccagaggtgcagaagctgtatggccacggctatgagatcttctgtgtgacctgcaacagcagcaagaccctgctggccagcgcctgcaaggccgccaagaaggagcacgccgccatcatcctgtggaacaccacctcctggaagcaggtgcagaacctggtgttccacagcctgactgtgacccagatggccttcagccccaatgagaagttcctgctggccgtgtcccgggacaggacctggagcctgtggaagaagcaggacaccatcagccctgagtttgagcctgtgttcagcctgtttgccttcaccaacaagatcacctctgtgcacagccgcatcatctggagctgtgactggagcccagacagcaagtacttcttcaccggcagccgggacaagaaggtggtggtgtggggagaatgtgacagcacagatgactgcatcgagcacaacatcggcccctgcagctctgtgctggatgtgggcggcgctgtgacagctgtgtctgtgtgccctgtgctgcaccccagccagcgctacgtggtggccgtgggcctggagtgtgggaagatctgcctgtacacctggaagaagacagaccaggtgcctgagatcaatgactggacccactgtgtggagaccagccagagccagagccacaccctggccatcaggaagctgtgctggaagaactgcagcggcaagacagagcagaaggaggccgagggcgctgagtggctgcactttgccagctgtggggaggaccacacagtgaagatccaccgggtgaacaagtgtgccctgtag

SEQ ID NO: 19499 - DNA, 1152 bp, Artificial Sequence
  Description of Artificial Sequence: Synthetic coding sequence
atggacaggacctgtgaggagaggcctgcagaagatggcagtgatgaagaagatcctgacagcatggaggcccccacccgcatccgggacaccccagaagatattgtgctggaggccccagccagcggcctggccttccacccagcccgggacctgctggccgctggagatgtggatggagatgtgtttgtgttctcctacagctgccaggagggggagaccaaggagctgtggagcagcggccaccacctgaaggcctgcagagctgtggccttctctgaagatggccagaagctgatcaccgtgtccaaggacaaggccatccacgtgctggatgtggagcagggccagctggagcggcgggtgtccaaggcccacggggcccccatcaacagcctgctgctggtggatgaaaatgtgctggccactggagatgacacaggaggcatctgcctgtgggaccagaggaaggagggccccctgatggacatgaggcagcacgaggagtacatcgctgacatggccctggaccctgccaagaagctgctgctgacagccagcggagatggctgcctgggcatcttcaacatcaagagaagaagatttgagctgctgtctgagccccagagcggggacctgacctctgtgaccctgatgaagtggggcaagaaggtggcctgtggcagcagcgagggcaccatctacctgttcaactggaatggatttggagccaccagtgacagatttgccctgcgggcagagagcattgactgcatggtgcctgtgacagagagcctgctgtgcaccggcagcacagatggagtcatccgggctgtgaacatcctgcccaacagagtggtgggctctgtgggccagcacactggagagcctgtggaggagctggccctgagccactgcggccgcttcctggccagcagcggccatgaccagaggctgaagttctgggacatggcccagctgcgggctgtggtggtggatgactacagaagaaggaagaagaagggcggccccctgcgggccctgagcagcaagacctggagcacagatgacttctttgctggcctgcgggaggagggagaagattccatggcccaggaggagaaggaggagactggagatgacagcgactag

SEQ ID NO: 19500 - DNA, 999 bp, Artificial Sequence
  Description of Artificial Sequence: Synthetic coding sequence
atgtctgaggccggggaggagcagcccatggagaccactggagccacagaaaatggccacgaggccgtgcctgagggggagagccctgctggggccggcaccggggctgctgctggggccggcggggccacagctgcccctccttctggcaaccagaatggagctgagggggaccagatcaatgccagcaagaatgaagaagatgctgggaagatgtttgtgggcggcctgtcctgggacaccagcaagaaggacctgaaggactacttcaccaagtttggagaggtggtggactgcaccatcaagatggaccccaacacaggccgcagccggggcttcggcttcatcctcttcaaggatgctgcctctgtggagaaggtgctggaccagaaggagcaccggctggatggccgggtcatcgaccccaagaaggccatggccatgaagaaggaccctgtgaagaagatctttgtgggcggcctgaaccctgaggccacagaggagaagatccgggagtactttggagaatttggagaaattgaggccatcgagctgcccatggaccccaagctgaacaagaggcggggctttgtgttcatcaccttcaaggaggaggagcctgtgaagaaggtgctggagaagaagttccacacagtgtctggcagcaaatgtgagatcaaggtggcccagcccaaggaggtgtaccagcagcagcagtatggcagcggcggccggggcaacagaaacagaggcaacagaggcagcggcggcggcggcggcggcggcggccagagccagagctggaaccagggctacggcaactactggaaccagggctacggctaccagcagggctacggccctggctacggcggctatgactacagcccctacggctactacggctacggccctggctatgactacagccagggcagcaccaactacggcaagagccagaggagaggaggccaccagaacaactacaagccctactag

SEQ ID NO: 19501 - DNA, 2745 bp, Artificial Sequence; identical to SEQ ID NO: 18914
  Description of Artificial Sequence: Synthetic coding sequence

SEQ ID NO: 19502 - DNA, 2772 bp, Artificial Sequence
  Description of Artificial Sequence: Synthetic coding sequence
atggccgccagcacaggctacgtgcggctgtggggcgccgcccgctgctgggtgctgcggcggcccatgctggccgctgctgggggccgggtgcccacagctgctggggcctggctgctgcggggccagaggacctgtgatgccagccccccctgggccctgtggggccggggccctgccatcggcggcagcgctggagctggggagggccctgtgatcacagccctgacccccatgaccatcccagatgtgttcccccacctgcccctgattgccatcaccagaaatcctgtgttcccccgcttcatcaagatcatcgaggtgaagaacaagaagctggtggagctgctgcggaggaaggtgcggctggcccagccctacgtgggcgtcttcctgaagagagatgacagcaatgaaagtgatgtggtggagagcctggatgagatctaccacacaggcacctttgcccagatccacgagatgcaggacctgggggacaagctgaggatgattgtgatgggccaccggcgggtgcacatcagccggcagctggaggtggagcctgaggagcctgaggccgagaacaagcacaagcccaggaggaagagcaagaggggcaagaaggaggctgaagatgagctgagcgcccggcaccctgctgagctggccatggagcccaccccagagctgcctgctgaggtgctgatggtggaggtggagaatgtggtgcatgaggacttccaggtgacagaggaggtgaaggccctgacagctgagatcgtgaagaccatccgggacatcatcgccctgaaccccctgtaccgggagagcgtgctgcagatgatgcaggccggccagagggtggtggacaaccccatctacctgagtgacatgggcgccgccctgactggagctgagagccatgagctgcaggatgtgctggaggagaccaacatccccaagaggctgtacaaggccctgagcctgctgaagaaggagtttgagctgagcaagctgcagcagaggctgggccgggaggtggaggagaagatcaagcagacccacaggaagtacctgctgcaggagcagctgaagatcatcaagaaggagctgggcctggagaaggatgacaaggatgccatcgaggagaagttccgggagcggctgaaggagctggtggtgcccaagcacgtgatggatgtggtggatgaggagctgagcaagctgggcctgctggacaaccacagcagcgagttcaacgtgaccaggaactacctggactggctgaccagcatcccctggggcaagtacagcaatgaaaacctggacctggcccgggcccaggccgtgctggaggaggaccactacggcatggaggatgtgaagaagaggatcctggagttcatcgctgtgtcccagctgcggggcagcacccagggcaagatcctgtgcttctacggccccccaggagtgggcaagaccagcatcgcccggagcatcgcccgggccctgaaccgggagtacttccgcttctctgtgggcggcatgacagatgtggccgagatcaagggccacaggaggacctacgtgggcgccatgcctgggaagatcatccagtgcctgaagaagaccaagacagagaaccccctcatcctgattgatgaggtggacaagattggccggggctaccagggcgaccccagcagcgccctgctggagctgctggaccctgagcagaatgccaacttcctggaccactacctggatgtgcctgtggacctgagcaaggtgctcttcatctgcacagccaacgtgacagacaccatccctgagcccctgcgggacaggatggagatgatcaacgtgtctggctacgtggcccaggagaagctggccatcgccgagcgctacctggtgccccaggcccgggccctgtgtggcctggatgagagcaaggccaagctgagcagtgatgtgctgaccctgctgatcaagcagtactgccgggagagcggcgtgaggaacctgcagaagcaggtggagaaggtgctgaggaagagcgcctacaagatcgtgtctggagaggccgagagcgtggaggtgaccccagagaacctgcaggactttgtgggcaagcctgtgttcaccgtggagaggatgtatgatgtgaccccacctggggtggtgatgggcctggcctggacagccatgggcggcagcaccctgtttgtggagaccagcctgcggcggccccaggacaaggatgccaagggggacaaggatggcagcctggaggtgacaggccagctgggggaggtgatgaaggagagcgcccgcatcgcctacacctttgcccgggccttcctgatgcagcacgccccagccaatgactacctggtgaccagccacatccacctgcacgtgcctgagggcgccacccccaaggatggccccagcgctggctgcaccatcgtgacagccctgctgagcctggccatgggccggcctgtgcggcagaacctggccatgaccggggaggtgtccctgaccgggaagatcctgcctgtgggcggcatcaaggagaagaccatcgccgccaagagagctggggtgacctgcatcgtgctgcctgctgagaacaagaaggacttctatgacctggccgccttcatcacagagggcctggaggtgcactttgtggagcactaccgggagatctttgatattgccttcccagatgagcaggccgaggccctggccgtggagaggtag

SEQ ID NO: 19503 - DNA, 681 bp, Artificial Sequence
  Description of Artificial Sequence: Synthetic coding sequence
atgggccccctgcccaggacagtggagctgttctatgatgtgctgagcccctacagctggctgggctttgagatcctgtgccgctaccagaacatctggaacatcaacctgcagctgcggcccagcctcatcaccggcatcatgaaggacagcggcaacaagcccccaggcctgctgcccaggaagggcctgtacatggccaatgacctgaagctgctgcggcaccacctgcagatccccatccacttccccaaggacttcctgtctgtgatgctggagaagggcagcctgagcgccatgaggttcctgacagctgtgaacctggagcaccctgagatgctggagaaggccagccgggagctgtggatgagggtgtggagcagaaatgaagacatcacagagccccagagcatcctggccgctgctgagaaggccggcatgtctgctgagcaggcccagggcctgctggagaagatcgccacccccaaggtgaagaaccagctgaaggagaccacagaggccgcctgccgctacggggccttcggcctgcccatcaccgtggcccacgtggatggccagacccacatgctgtttggaagtgacaggatggagctgctggcccacctgctgggggagaagtggatgggccccatccccccagctgtgaatgcccggctgtag

SEQ ID NO: 19504 - DNA, 2055 bp, Artificial Sequence
  Description of Artificial Sequence: Synthetic coding sequence
atggaggccaaccacagcgagcagctgtctgctgagcggcagagcaccccacctggggacagcagcagcctgcccagccacaacggcctggagaaggaggatggccaggacagccccacccctgtgcagcccccagagaaggaggcctctgtgcacccagacatcagcgaggagctgaaccggcagctggaggacatcatcaacacctacggcagcgctgccagcacagctgggaaggagggcagcgcccgggccagcgagcagccagaaaatgctgagagcccagacaatgaagatggagactgtgaggagaccacagaggaggccggccgggagcctgtggccagcggggagcccccaacagtgaaggagcctgtgagcaacaaggagcagaagctggagaagaagatcctgaagggcctgggcaaggaggccaacctgctgatgcagaacctgaacaagctgcagaccccagaggagaagtttgacttcctgttcaagaagtatgcagagctgctggatgagcacaggacagagcagaagaagctgaagctgctgcagaagaagcaggtgcagatccagaaggagaaggaccagctgcagggcgagcacagccgggccatcctggcccggagcaagctggagagcctgtgccgggagctgcagaggcacaacaagaccctgaaggaggaggccctgcagagggcccgggaggaggaggagaagaggaaggagatcaccagccacttccagagcaccctgacagacatccagggccagatcgagcagcagagcgagaggaacatgaagctgtgccaggagaacacagagctggccgagaagctgaagagcatcatcgaccagtatgagctgcgggaggagcacctggacaagatcttcaagcaccgggagctgcagcagaagctggtggatgccaagctggagcaggcccaggagatgatgaaggaggccgaggagcggcacaagcgggagaaggagtacctgctgaaccaggccgctgagtggaagctgcaggccaaggtgctgaaggagcaggagaccgtgctgcaggcccagctgaccctgtacagcggccgctttgaggagttccagagcaccctgaccaagagcaatgaggtgtttgccaccttcaagcaggagatggacaagaccaccaagaagatgaagaagctggagaaggacacagccacctggaaggccaggtttgagaactgcaacaaggccctgctggacatgattgaggagaaggccctgcgggccaaggagtatgaatgttttgtgatgaagattggccgcctggagaacctgtgccgggccctgcaggaggagagaaatgagctgcacaagaagatcagagatgctgagatcagcgagaaggatgaccagagccagcacaacagtgatgaggagcctgagagcaatgtgtctgtggaccaggagattgatgctgaggaggtgaacagcgtgcagacagctgtgaagaacctggccacagccttcatgatcatccaccaccctgagagcaccccccaccagagcaaggagacccagcctgagatcggcagcagccaggagagcgcagatgctgccctgaaggagcctgagcagcccccactcatccccagccgggacagcgagagccccctgccccccctgaccccccaggccgaggccgagggcggcagtgatgctgagccccccagcaaggccagcaacagccctgctggcctgggcgctgagacccagtgtgagggcctgcctgtgggcgcccaggccgaccaggcctcctggaagccagaggccgaggccagcggccaggccccccaggcccccacagaggccagcctgcagaagatggaggctgatgtgcctgccccagcctgtgccgctgaggagcacgtggccgccatggtgcctgcctgtgagcccagccggcagccccccagggctgctgctgaggagctgcctgtgggcgccagcgctggcccccagcccagaaatgtggccgacaccaacctggagggcgtggactag

SEQ ID NO: 19505 - DNA, 1461 bp, Artificial Sequence
  Description of Artificial Sequence: Synthetic coding sequence
atgaatggcaccctggaccacccagaccagcctgacctggatgccatcaagatgtttgtgggccaggtgcccaggacctggagcgagaaggacctgcgggagctgtttgagcagtatggagctgtgtatgagatcaacgtgctgcgggacaggagccagaaccccccccagagcaagggctgctgctttgtgaccttctacaccaggaaggccgccctggaggcccagaatgccctgcacaacatgaaggtgctgcccggcatgcaccaccccatccagatgaagccagctgacagcgagaagaacaatgctgtggaggacaggaagctgttcatcggcatgatcagcaagaagtgcacagaaaatgacatccgggtgatgttcagcagctttggccagatcgaggagtgccgcatcctgcggggcccagatggcctgagccggggctgtgcctttgtgaccttcaccacccgggccatggcccagacagccatcaaggccatgcaccaggcccagaccatggagggctgcagcagccccatggtggtgaagtttgctgacacccagaaggacaaggagcagaagaggatggcccagcagctgcagcagcagatgcagcagatctctgctgcctctgtgtggggcaacctggccggcctgaacaccctgggcccccagtacctggccctgtacctgcagctgctgcagcagacagccagcagcggcaacctgaacaccctgagcagcctgcaccccatgggcggcctgaatgccatgcagctgcagaacctggccgccctggccgccgccgccagcgctgcccagaacaccccatctggcaccaatgccctgaccaccagcagcagccccctgtctgtgctgaccagcagcggcagcagccccagcagcagcagcagcaacagcgtgaaccccatcgccagcctgggcgccctgcagaccctggccggggccacagctggcctgaatgtgggcagcctggccggcatggccgccctgaatggaggcctgggcagcagcggcctgagcaatggcaccggcagcaccatggaggccctgacccaggcctacagcggcatccagcagtatgctgctgctgccctgcccaccctgtacaaccagaacctgctgacccagcagagcatcggggctgctggcagccagaaggagggccctgagggcgccaacctcttcatctaccacctgccccaggagtttggagaccaggacctgctgcagatgttcatgccctttggaaatgtggtgtctgccaaggtgttcatcgacaagcagaccaacctgagcaagtgcttcggctttgtgtcctatgacaaccctgtgtctgcccaggccgccatccagagcatgaatggcttccagatcggcatgaagaggctgaaggtgcagctgaagaggagcaagaatgacagcaagccctactag

SEQ ID NO: 19506 - DNA, 7812 bp, Artificial Sequence
  Description of Artificial Sequence: Synthetic coding sequence
atggagaaggccaccgtgcctgtggccgccgccacagctgctgagggggagggcagccccccagctgtggccgctgtggccggccccccagctgctgctgaggtgggcggcggcgtgggcggcagcagccgggcccggagcgccagcagcccccggggcatggtgcgggtgtgtgacctgctgctgaagaagaagccaccccagcagcagcaccacaaggccaagaggaacagaacctgccggccccccagcagcagcgagagcagcagtgacagcgacaacagcggcggcggcggcggcggcggcggcggcggcggcggcggcggcggcaccagcagcaacaacagcgaggaggaggaggatgatgatgatgaggaggaggaggtgtctgaggtggagagcttcatcctggaccaggatgacctggagaaccccatgctggagacagccagcaagctgctgctgagcggcacagcagatggagctgacctgaggacagtggaccctgagacccaggcccggctggaggccctgctggaggccgccggcatcggcaagctgagcacagcagatggcaaggcctttgctgaccctgaggtgctgcggcggctgaccagctctgtgtcctgtgccctggatgaagctgctgctgccctgaccaggatgagagctgagagcacagccaatgccggccagagcgacaacagaagcctggccgaggcctgcagtgaaggagatgtgaatgctgtgaggaagctgctgattgagggccgctctgtgaatgagcacacagaggagggggagagcctgctgtgcctggcctgcagcgctggctactatgagctggcccaggtgctgctggccatgcacgccaacgtggaggaccggggcatcaagggggacatcacccccctgatggccgccgccaacggcggccacgtgaagatcgtgaagctgctgctggcccacaaggcagatgtgaatgcccagagcagcactggaaacacagccctgacctacgcctgtgccggcggctacgtggatgtggtgaaggtgctgctggagagcggggccagcattgaggaccacaatgaaaatggccacacccccctgatggaggccggcagcgctggccacgtggaggtggcccggctgctgctggagaatggagctggcatcaacacccacagcaatgagttcaaggagagcgccctgaccctggcctgctacaagggccacctggagatggtgcgcttcctgctggaggccggggctgaccaggagcacaagacagatgagatgcacacagccctgatggaggcctgcatggatggccacgtggaggtggcccggctgctgctggacagcggggcccaggtgaacatgcctgctgacagctttgagagccccctgaccctggccgcctgtggcggccacgtggagctggccgccctgctgattgagcggggggccagcctggaggaggtgaatgatgagggctacacccccctgatggaggccgcccgggagggccacgaggagatggtggccctgctgctgggccagggcgccaacatcaatgcccagacagaggagacccaggagacagccctgaccctggcctgctgcggcggcttcctggaggtggccgacttcctgatcaaggccggggctgacatcgagctgggctgcagcacccccctgatggaggccgcccaggagggccacctggagctggtgaagtacctgctggccgccggggccaacgtgcacgccaccacagccaccggggacacagccctgacctacgcctgtgaaaatggccacacagatgtggctgatgtgctgctgcaggccggggctgacctggagcatgaaagtgaaggaggccgcacccccctgatgaaggccgcccgggccggccacgtgtgcaccgtgcagttcctgatcagcaagggggccaacgtgaacagaaccacagccaacaatgaccacacagtgctgagcctggcctgtgccggcggccacctggccgtggtggagctgctgctggcccacggggctgaccccacccaccggctgaaggatggcagcaccatgctgattgaggccgccaagggcggccacacctctgtggtgtgctacctgctggactaccccaacaacctgctgagcgcccctcctccagatgtgacccagctgaccccacccagccatgacctgaacagagccccccgggtgcctgtgcaggccctgcccatggtggtgcccccccaggagccagacaagcccccagccaacgtggccaccaccctgcccatccggaacaaggccgccagcaagcagaagagcagcagccacctgcctgccaacagccaggatgtgcagggctacatcaccaaccagagccctgagagcatcgtggaggaggcccagggcaagctgacagagctggagcagaggatcaaggaggccatcgagaagaatgcccagctgcagagcctggagctggcccacgccgaccagctgaccaaggagaagattgaggagctgaacaagacccgggaggagcagatccagaagaagcagaagatcctggaggagctgcagaaggtggagcgggagctgcagctgaagacccagcagcagctgaagaagcagtacctggaggtgaaggcccagaggatccagctgcagcagcagcagcagcagagctgccagcacctgggcctgctgacccctgtgggcgtgggggagcagctgtctgagggggactatgcccggctgcagcaggtggaccctgtgctgctgaaggatgagccccagcagacagctgcccagatgggctttgcccccatccagcccctggccatgccccaggccctgcccctggccgccggccccctgcccccaggcagcatcgccaacctgacagagctgcagggcgtcatcgtgggccagcctgtgctgggccaggcccagctggccggcctgggccagggcatcctgacagagacccagcagggcctgatggtggccagccctgcccagaccctgaatgacaccctggatgacatcatggctgctgtgtctggccgggccagcgccatgagcaacacccccacccacagcattgctgccagcatcagccagccccagacccccacccccagccccatcatcagccccagcgccatgctgcccatctacccagccattgatattgatgcccagacagagagcaaccacgacacagccctgaccctggcctgtgccggcggccacgaggagctggtgcagaccctgctggagcggggggccagcattgagcaccgggacaagaagggcttcacccccctcatcctggccgccacagctggccacgtgggcgtggtggagatcctgctggacaacggggctgacatcgaggcccagagcgagaggaccaaggacacccccctgagcctggcctgcagcggcggccggcaggaggtggtggagctgctgctggcccggggggccaacaaggagcacagaaatgtgtctgactacacccccctgagcctggccgccagcggcggctacgtgaacatcatcaagatcctgctgaatgctggagctgagatcaacagcaggacaggcagcaagctgggcatcagccccctgatgctggccgccatgaatggccacacagctgctgtgaagctgctgctggacatgggcagtgacatcaatgcccagatcgagaccaacagaaacacagccctgaccctggcctgcttccagggccgcacagaggtggtgtccctgctgctggacaggaaggccaacgtggagcaccgggccaagacaggcctgacccccctgatggaggccgccagcggcggctacgccgaggtgggccgggtgctgctggacaagggagcagatgtgaatgcccctcctgtgcccagcagccgggacacagccctgaccatcgctgctgacaagggccactacaagttctgtgagctgctgattggccgcggggcccacattgatgtgaggaacaagaagggcaacacccccctgtggctggccgccaacggcggccacctggatgtggtgcagctgctggtgcaggccggggctgatgtggatgctgctgacaacaggaagatcacccccctgatggccgccttcaggaagggccacgtgaaggtggtgcgctacctggtgaaggaggtgaaccagttccccagcgacagcgagtgcatgagatacatcgccaccatcacagacaaggagatgctgaagaagtgccacctgtgcatggagagcatcgtgcaggccaaggaccggcaggccgctgaggccaacaagaatgccagcatcctgctggaggagctggacctggagaagctgcgggaggagagccggcggctggccctggccgccaagcgggagaagaggaaggagaagaggaggaagaagaaggaggagcagaggaggaagctggaggagattgaggccaagaacaaggagaactttgagctgcaggccgcccaggagaaggagaagctgaaggtggaggatgagcctgaggtgctgacagagcccccatctgccaccaccaccaccaccatcggcatcagcgccacctggaccaccctggccggcagccacggcaagaggaacaacaccatcaccaccaccagcagcaagaggaagaacaggaagaacaagatcaccccagaaaatgtgcagatcatctttgatgaccccctgcccatctcctacagccagcctgagaaggtgaatggagagagcaagagcagcagcaccagcgagagcggggacagcgacaacatgaggatcagcagctgcagtgatgagagcagcaacagcaacagcagcaggaagagtgacaaccacagccctgctgtggtgaccaccaccgtgagcagcaagaagcagcccagcgtgctggtgaccttccccaaggaggagaggaagtctgtgtctgggaaggccagcatcaagctgtctgagaccatcagcgagggcaccagcaacagcctgagcacctgcaccaagagcggccccagccccctgagcagccccaacgggaagctgactgtggccagccccaagaggggccagaagcgggaggagggctggaaggaggtggtgagaagaagcaagaaggtgtctgtgcccagcaccgtcatcagccgggtgattggccggggcggctgcaacatcaatgccatccgggagttcaccggggcccacattgatattgacaagcagaaggacaagacaggagaccgcatcatcaccatccggggcggcacagagagcacccggcaggccacccagctgatcaatgccctgatcaaggaccctgacaaggagattgatgagctgatccccaagaaccggctgaagagcagcagcgccaacagcaagattggcagcagcgcccccaccaccacagctgccaacaccagcctgatgggcatcaagatgaccaccgtggccctgagcagcaccagccagacagccacagccctgactgtgcctgccatcagcagcgccagcacccacaagaccatcaagaaccctgtgaacaacgtgcggcccggcttccctgtgtccctgcccctggcctaccccccaccccagtttgcccacgccctgctggccgcccagaccttccagcagatccggcccccccggctgcccatgacccactttggaggcaccttccccccagcccagagcacctggggccccttccctgtgcggcccctgagccctgcccgggccaccaacagccccaagccccacatggtgcccaggcacagcaaccagaacagcagcggcagccaggtgaacagcgctggcagcctgaccagcagccccaccaccaccaccagcagcagcgccagcacagtgcccggcaccagcaccaacggcagccccagcagccccagcgtgcggcggcagctgtttgtgacagtggtgaagaccagcaatgccaccaccaccaccgtgaccaccacagccagcaacaacaacacagcccccaccaatgccacctaccccatgcccacagccaaggagcactaccctgtgagcagccccagcagccccagccccccagcccagcccggcggcgtgtccaggaacagccccctggactgtggcagcgccagccccaacaaggtggccagcagcagcgagcaggaggccggcagcccccctgtggtggagaccaccaacacccggccccccaacagcagcagcagcagcggcagcagcagcgcccacagcaaccagcagcagcccccaggctctgtgtcccaggagcccaggcctcccctgcagcagagccaggtgcccccacctgaggtgaggatgacagtgccccccctggccaccagcagcgcccctgtggccgtgcccagcacagcccctgtgacctaccccatgccccagacccccatgggctgcccccagcccacccccaagatggagaccccagccatccggcccccacctcatggcaccacagccccccacaagaacagcgcctctgtgcagaacagctctgtggccgtgctgtctgtgaaccacatcaagaggccccacagcgtgcccagctctgtgcagctgcccagcaccctgagcacccagagcgcctgccagaacagcgtgcacccagccaacaagcccatcgcccccaacttcagcgcccccctgcccttcggccccttcagcaccctgtttgagaacagccccaccagcgcccacgccttctggggcggctctgtggtgagcagccagagcaccccagagagcatgctgagcggcaagagcagctacctgcccaacagcgaccccctgcaccagagcgacaccagcaaggcccctggcttccggccccccctgcagaggcctgcccccagccccagcggcatcgtgaacatggacagcccctacggctctgtgacccccagcagcacccacctgggcaactttgccagcaacatcagcggcggccagatgtatggccctggggcccccctgggcggggccccagctgctgccaacttcaaccggcagcacttcagccccctgagcctgctgaccccctgcagcagcgccagcaatgacagcagcgcccagagcgtgtcctctggagtgcgggcccccagccctgcccccagctctgtgcccctgggcagcgagaagcccagcaatgtgtcccaggacaggaaggtgcctgtgcccatcggcacagagaggtctgcccgcatccggcagacaggcaccagcgcccccagcgtcatcggcagcaacctgagcacctctgtgggccacagcggcatctggagctttgagggcattggaggcaaccaggacaaggtggactggtgcaaccctggcatgggcaaccccatgatccaccggcccatgtctgaccccggggtcttcagccagcaccaggccatggagcgggacagcactggaattgtgaccccatctggcaccttccaccagcacgtgcctgctggctacatggacttccccaaggtgggcggcatgcccttctctgtgtatggaaatgccatgatcccccctgtggcccccatcccagatggagctgggggccccatcttcaacggcccccatgctgctgaccccagctggaacagcctcatcaagatggtgagcagcagcacagagaacaacggcccccagacagtgtggacaggcccctgggccccccacatgaacagcgtgcacatgaaccagctgggctag

SEQ ID NO: 19507 - DNA, 3075 bp, Artificial Sequence
  Description of Artificial Sequence: Synthetic coding sequence
atgacagagggccgccgctgccaggtgcacctgctggatgacaggaagctggagctgctggtgcagcccaagctgctggccaaggagctgctggacctggtggccagccacttcaacctgaaggagaaggagtacttcggcatcgccttcacagatgagaccggccacctgaactggctgcagctggaccggcgggtgctggagcatgacttccccaagaagagcggccctgtggtgctgtacttctgtgtgcgcttctacatcgagagcatctcctacctgaaggacaatgccaccatcgagctgttcttcctgaatgccaagagctgcatctacaaggagctgattgatgtggacagcgaggtggtgtttgagctggccagctacatcctgcaggaggccaagggggacttcagcagcaatgaggtggtgcggagtgacctgaagaagctgcctgccctgcccacccaggccctgaaggagcaccccagcctggcctactgtgaagatagagtgattgagcactacaagaagctgaatggccagacccggggccaggccatcgtgaactacatgagcatcgtggagagcctgcccacctatggagtgcactactatgctgtgaaggacaagcagggcatcccctggtggctgggcctgagctacaagggcatcttccagtatgactaccatgacaaggtgaagcccaggaagatcttccagtggaggcagctggagaacctgtacttccgggagaagaagttctctgtggaggtgcatgacccccggcgggcctctgtgaccaggaggaccttcggccacagcggcattgctgtgcacacctggtacgcctgcccagccctgatcaagagcatctgggccatggccatcagccagcaccagttctacctggacaggaagcagagcaagagcaagatccatgctgcccggagcctgtctgagatcgccatcgacctgacagaaacaggcaccctgaagaccagcaagctggccaacatgggcagcaagggcaagatcatcagcggcagcagcggcagcctgctgagcagcggcagccaggagagtgacagcagccagagcgccaagaaggacatgctggccgccctgaagagccggcaggaggccctggaggagaccctgcggcagaggctggaggagctgaagaagctgtgcctgcgggaggccgagctgaccgggaagctgcctgtggagtaccccctggaccccggggaggagccccccatcgtgagaagaagaattggaacagccttcaagctggatgagcagaagatcctgcccaagggggaggaggccgagctggagcggctggagcgggagtttgccatccagagccagatcacagaagctgcccggcggctggccagtgaccccaacgtgtccaagaagctgaagaagcagaggaagaccagctacctgaatgccctgaagaagctgcaggagattgaaaatgccatcaatgaaaatcgcatcaagagcggcaagaagcccacccagagggccagcctcatcattgatgatggcaacatcgccagcgaggacagcagcctgagtgatgccctggtgctggaggatgaggacagccaggtgaccagcaccatcagccccctgcacagcccccacaagggcctgccccccaggcctcccagccacaacagacctcctccaccccagagcctggagggcctgcggcagatgcactaccacagaaatgactatgacaagagccccatcaagcccaagatgtggagcgagagcagcctggatgagccctatgagaaggtgaagaagaggagcagccacagccacagcagcagccacaagcgcttccccagcacaggcagctgtgccgaggccggcggcggcagcaacagcctgcagaacagccccatccggggcctgccccactggaacagccagagctccatgcccagcaccccagacctgcgggtgcgcagcccccactacgtgcacagcaccaggtctgtggacatcagccccacccggctgcacagcctggccctgcacttccgccacaggagcagcagcctggagagccagggcaagctgctgggctctgaaaatgacaccggcagcccagacttctacacccccaggaccaggagcagcaatggaagtgaccccatggatgactgcagcagctgcaccagccacagcagcagcgagcactactacccagcccagatgaatgccaactacagcaccctggccgaggacagccccagcaaggcccggcagaggcagaggcagaggcagagagctgctggggccctgggcagcgccagcagcggctccatgcccaacctggccgcccggggcggggccggcggggccggcggggccggcggcggcgtgtacctgcacagccagagccagcccagcagccagtaccgcatcaaggagtaccccctgtacatcgagggcggggccacccctgtggtggtgcgcagcctggagagtgaccaggagggccactacagcgtgaaggcccagttcaagaccagcaacagctacacagctgggggcctcttcaaggagagctggaggggcggcggcggagatgaaggagacaccggccgcctgacccccagccgcagccagatcctgcggacccccagcctgggccgggagggcgcccatgacaagggggccggccgggctgctgtgtctgatgagctgcggcagtggtaccagaggagcacagccagccacaaggagcacagccggctgagccacaccagcagcaccagcagtgacagcggcagccagtacagcaccagcagccagagcacctttgtggcccacagccgggtgaccaggatgccccagatgtgcaaggccaccagcgctgccctgccccagagccagaggagcagcacccccagcagcgagattggagccaccccacccagcagcccccaccacatcctgacctggcagacaggagaggccacagagaacagccccatcctggatggcagcgagagccccccccaccagagcacagatgaatag

SEQ ID NO: 19508 - DNA, 864 bp, Artificial Sequence
  Description of Artificial Sequence: Synthetic coding sequence
atgagccaggcctggtggcacacctctgtgtccccagccacccaggaggccaaggccggcggcctgctgcagccccggcggcagaggctgtggctgaagcgctgccgcatcagcagcagcgcctgtgaggacctgtctgctgccctgattgccaacaagaacctgaccaggatggacctgtctggaaatggagtgggcttccctggcatgatgctgctgtgtgagggcctgcggcacccccagtgccgcctgcagatgatccagctgaggaagtgccagctggagagcggggcctgccaggagatggcctctgtgctgggcaccaacccccacctggtggagctggacctgactggaaatgccctggaggacctgggcctgcggctgctgtgccagggcctgcggcaccctgtgtgccgcctgcggaccctgtggctgaagatctgccgcctgacagctgctgcctgtgatgagctggccagcaccctgtctgtgaaccagagcctgcgggagctggacctgagcctgaatgagctgggggacctgggcgtgctgctgctgtgtgagggcctgcggcaccccacctgcaagctgcagaccctgcggctggacagctgtggcctgacagccaaggcctgtgagaacctgtacttcaccctgggcatcaaccagaccctgacagacctgtacctgaccaacaatgccctgggggacacaggagtgcggctgctgtgcaagaggctgagccaccctggctgcaagctgcgggtgctgtggctgtttggcatggacctgaacaagatgacccacagccggctggccgccctgcgggtgaccaagccctacctggacatcggctgctag

SEQ ID NO: 19509 - DNA, 615 bp, Artificial Sequence
  Description of Artificial Sequence: Synthetic coding sequence
atggccggctacctgtctgagagtgactttgtgatggtggaggagggcttcagcacccgggacctgctgaaggagctgaccctgggcgccagccaggccaccacagatgaggtggccgccttctttgtggccgacctgggcgccatcgtgaggaagcacttctgcttcctgaagtgcctgccccgggtgcggcccttctatgctgtgaagtgcaacagcagccctggggtgctgaaggtgctggcccagctgggcctgggcttcagctgtgccaacaagatcgccagcgtcatcaacagcgccctggacctgtacttccctgagggctgcggcgtggacatctttgctgagctgggccgctactacgtgaccagcgccttcaccgtggccgtgtccatcatcgccaagaaggaggtgctgctggaccagcccggccgggaggaggagaatggcagcaccagcaagaccatcgtgtaccacctggatgagggcgtgtatggcatcttcaacagcgtgctgtttgacaacatctgccccacccccatcctgcagaagagcaagaaccacagcccctgctacatgagcctggagagcatccacttcatcgctgtgtag

SEQ ID NO: 19510 - DNA, 519 bp, Artificial Sequence
  Description of Artificial Sequence: Synthetic coding sequence
atgatgaagctgaagagcaaccagaccaggacctatgatggagatggctacaagaagagagctgcctgcctgtgcttccgctctgagagcgaggaggaggtgctgctggtgagcagcagccgccacccagaccgctggatcgtgcctgggggcggcatggagcctgaggaggagcccagcgtggccgctgtgcgggaggtgtgtgaggaggccggcgtgaagggcaccctgggccgcctggtgggcatctttgagaaccaggagaggaagcacaggacctacgtgtatgtgctgattgtgacagaggtgctggaggactgggaggacagcgtgaacattggaaggaagcgggagtggttcaagattgaagatgccatcaaggtgctgcagtaccacaagcctgtgcaggccagctactttgagaccctgcggcagggctacagcgccaacaacggcacccctgtggtggccaccacctacagcgtgtctgcccagagctccatgagcggcatcagatag

SEQ ID NO: 19511 - DNA, 4284 bp, Artificial Sequence; identical to SEQ ID NO: 18772
  Description of Artificial Sequence: Synthetic coding sequence

SEQ ID NO: 19512 - DNA, 1179 bp, Artificial Sequence
  Description of Artificial Sequence: Synthetic coding sequence
atgggagacagctgcccagctgtgaccttccgcagccagaaggaaaatagagctggcctgcaggagaagctgcgctacctgcagcagcagctgcaggatgagaccccccggcggcaggaggccgagctgcaggagcctgaggagaagcaggagcctgaggagaagcaggagcctgaggagaagcagaagccagaggccggcctgtcctggaacagcctgggccctgctgccaccagccagggctgccccggccccccaggcagcccagacaagcccagccggccccacggcctggtgcctgctggctggggcatgggccccagggctggggagggcccctacgtgtctgagcaggagctgcagaagctgttcaccggcatcgaggagctgcggcgggaggtgagcagcctgacagcccgctggcaccaggaggagggcgctgtgcaggaggccctgcggctgctgggcggcctgggcggccgggtggatggcttcctgggccagtgggagcgggcccagcgggagcaggcccagacagcccgggacctgcaggagctgcggggccgggcagatgagctgtgcaccatggtggagaggtctgctgtgtctgtggccagcctgcggtctgagctggagggcctgggccccctgaagcccatcctggaggagtttggccggcagttccagaacagccggcggggccctgacctgtccatgaacctggacaggagccaccagggcaactgtgcccgctgtgccagccagggcagccagctgagcacagagagcctgcagcagctgctggaccgggccctgaccagcctggtggatgaggtgaagcagaggggcctgaccccagcctgccccagctgccagaggctgcacaagaagatcctggagctggagcggcaggccctggccaagcacgtgcgggcagaggccctgagcagcaccctgcggctggcccaggatgaggccctgcgggccaagaacctgctgctgacagacaagatgaagccagaggagaagatggccaccctggaccacctgcacctgaagatgtgcagcctgcatgaccacctgagcaacctgcccctggagggcagcacaggcaccatgggcggcggcagcagcgctggcaccccacccaagcagggcggcagcgcccctgagcagtag

SEQ ID NO: 19513 - DNA, 1692 bp, Artificial Sequence
  Description of Artificial Sequence: Synthetic coding sequence
atgtctgatgatgctggggacaccctggccactggagacaaggccgaggtgacagagatgcccaacagcgacagcctgcctgaagatgctgaggtgcactgtgacagcgctgctgtgtcccatgagcccaccccagctgaccccagaggagagggccatgaaaatgctgctgtgcagggcgctggggccgccgccatcggcccccctgtgcagccccaggatgccaatgccctggagccccccctgaatggagatgtgacagaggacaccctggctgaatgtattgattctgtgtccctggaggccgagcccaggtctgagatccccctgcaggagcagaactacctggccgtggacagccccccatctgggggcggctgggccggctggggctcctggggcaagagcctgctgagcagcgccagcgccaccgtgggccacggcctgacagctgtgaaggagaaggccggggccaccctgcgcatccatggagtgaacagcggcagcagcgagggcgcccagcccaacacagaaaatggagtgcctgagatcacagatgctgccacagaccagggccctgctgagagcccccccaccagccccagcagcgccagccggggcatgctgagcgccatcaccaacgtggtgcagaacacaggcaagtctgtgctgactggaggcctggatgccctggagttcatcggcaagaagaccatgaatgtgctggccgagagtgaccccggcttcaagaggaccaagaccctgatggagaggacagtgtccctgagccagatgctgcgggaggccaaggagaaggagaagcagaggctggcccagcagctgaccatggagaggacagcccactacggcatgctgtttgatgagtaccagggcctgagccacctggaggccctggagatcctgagcaatgaaagtgagagcaaggtgcagagcttcctggccagcctggatggagagaagctggagctgctgaagaatgacctgatcagcatcaaggacatctttgctgccaaggagctggagaatgaggagaaccaggaggagcagggcctggaggagaagggggaggagtttgccaggatgctgacagagctgctgtttgagctgcacgtggccgccaccccagacaagctgaacaaggccatgaagagggcccatgactgggtggaggaggaccagacagtggtgtctgtggatgtggccaaggtgtctgaggaggagaccaagaaggaggagaaggaggagaagagccaggacccccaggaggacaagaaggaggagaagaagaccaagaccatcgaggaggtgtacatgagcagcattgagagcctggccgaggtgacagcccgctgcatcgagcagctgcacaaggtggccgagctgatcctgcacggccaggaggaggagaagccagcccaggaccaggccaaggtgctgatcaagctgaccacagccatgtgcaatgaggtggccagcctgagcaagaagttcaccaacagcctgaccaccgtgggcagcaacaagaaggccgaggtgctgaaccccatgatcagctctgtgctgctggagggctgcaacagcaccacctacatccaggatgccttccagctgctgctgcctgtgctgcaggtgagccacatccagaccagctgcctgaaggcccagccctag

SEQ ID NO: 19514 - DNA, 1257 bp, Artificial Sequence
  Description of Artificial Sequence: Synthetic coding sequence
atgttctccccagaccaggagaaccaccccagcaaggcccctgtgaagtatggagagctgattgtgctgggctacaacggcagcctgcccaatggagaccggggccgcaggaagagcagatttgccctcttcaagaggcccaaggccaacggggtgaagcccagcacagtgcacatcgcctgcaccccccaggccgccaaggccatcagcaacaaggaccagcacagcatctcctacaccctgagccgggcccagacagtggtggtggagtacacccatgacagcaacacagacatgttccagatcggccgcagcacagagagccccatcgactttgtggtgacagacacagtgcccggcagccagagcaacagcgacacccagagcgtgcagagcaccatcagcagatttgcctgccgcatcatctgtgaaagaaatccacccttcaccgcccgcatctatgctgctggctttgacagcagcaagaacatcttcctgggggagaaggccgccaagtggaagaccagtgatggccagatggatggcctgaccaccaacggggtgctggtgatgcaccccagaaatggcttcacagaggacagcaagccaggcatctggagggagatctctgtgtgtggaaatgtgttcagcctgcgggagaccaggtctgcccagcagaggggcaagatggtggagattgagaccaaccagctgcaggacggcagcctgattgacctgtgtggggccaccctgctgtggaggacagctgagggcctgagccacacccccaccgtgaagcacctggaggccctgcggcaggagatcaatgctgcccggccccagtgccctgtgggcttcaacaccctggccttccccagcatgaagaggaaggatgtggtggatgagaagcagccctgggtgtacctgaactgtggccacgtgcacggctaccacaactggggcaacaaggaggagagagatggcaaggaccgggagtgccccatgtgccgctctgtgggcccctacgtgcccctgtggctgggctgtgaggccggcttctacgtggatgctggcccccccacccacgccttcagcccctgtggccacgtgtgcagcgagaagaccacagcctactggagccagatccccctgccccacggcacccacaccttccacgccgcctgccccttctgtgcccaccagctggccggggagcagggctacatccgcctcatcttccagggccccctggactag

SEQ ID NO: 19515 - DNA, 3963 bp, Artificial Sequence
  Description of Artificial Sequence: Synthetic coding sequence
atgcaggatgacagcattgaggccagcaccagcatcagccagctgctgcgggagagctacctggccgagaccaggcaccggggcaacaatgaaagaagcagagctgagcccagcagcaacccctgccacttcggcagccccagcggggctgctgagggcggcggcggccaggatgacctgcctgacctgagcgccttcctgagccaggaggagctggatgaatctgtgaacctggcccggctggccatcaactatgaccccctggagaaggcagatgagacccaggccaggaagaggctgagcccagaccagatgaagcacagccccaacctgagctttgagcccaacttctgccaggacaaccccaggagccccaccagcagcaaggagagcccccaggaggccaagaggccccagtactgcagcgagacccagagcaagaaggtgttcctgaacaaggctgctgacttcatcgaggagctgagcagcctcttcaagagccacagcagcaagaggatccggccccgggcctgcaagaaccacaagagcaagctggagagccagaacaaggtgatgcaggagaacagcagcagcttcagtgacctgtctgaaagaagagagaggagctctgtgcccatccccatcccagctgacacccgggacaatgaggtgaaccacgccctggagcagcaggaggccaagagaagagaggccgagcaggccgccagcgaggccgccggcggggacaccaccccaggcagcagccccagcagcctgtactatgaggagcccctgggccagcccccacgcttcacccagaagctgcggagccgggaggtgcctgagggcaccagggtgcagctggactgcatcgtggtgggcatccccccaccccaggtgcgctggtactgtgagggcaaggagctggagaacagcccagacatccacatcgtgcaggccggcaacctgcacagcctgaccatcgccgaggcctttgaggaggacaccggccgctacagctgctttgccagcaacatctatggaacagacagcaccagcgctgagatctacatcgagggcgtgagcagcagtgacagcgagggggaccccaacaaggaggagatgaaccgcatccagaagcccaatgaggtgagcagcccccccaccaccagcgctgtgattcctcctgctgtgccccaggcccagcacctggtggcccagccccgggtggccaccatccagcagtgccagagccccaccaactacctgcagggcctggatggcaagcccatcatcgccgcccctgtgttcaccaagatgctgcagaacctgagcgccagcgagggccagctggtggtgtttgaatgtcgggtgaagggggcccccagccccaaggtggagtggtaccgggagggcaccctgattgaggacagcccagacttccgcatcctgcagaagaagcccaggtccatggccgagcctgaggagatctgcaccctggtgattgctgaggtgtttgctgaggacagcggctgcttcacctgcacagccagcaacaagtatggaacagtgagcagcatcgcccagctgcacgtgagaggaaatgaagacctgagcaacaacggcagcctgcacagcgccaacagcaccaccaacctggccgccatcgagccccagcccagccccccccacagcgagcccccatctgtggagcagccccccaagcccaagctggagggcgtgctggtgaaccacaatgagcccaggagcagcagccgcatcggcctgcgggtgcacttcaacctgcctgaagatgacaagggcagcgaggccagcagcgaggccggcgtggtgaccacccggcagaccaggccagacagcttccaggagcgcttcaacggccaggccaccaagaccccagagcccagcagccctgtgaaggagcccccacctgtgctggccaagcccaagctggacagcacccagctgcagcagctgcacaaccaggtgctgctggagcagcaccagctgcagaaccccccacccagcagccccaaggagttccccttctccatgacagtgctgaacagcaatgcccccccagctgtgaccaccagcagcaagcaggtgaaggcccccagcagccagaccttcagcctggcccggcccaagtacttcttccccagcaccaacaccacagctgccaccgtggcccccagcagcagccctgtgttcaccctgagcagcaccccccagaccatccagaggacagtgtccaaggagagcctgctggtgagccaccccagcgtgcagaccaagagccctgggggcctgagcatccagaatgagcccctgcccccaggccccacagagcccaccccaccacccttcaccttcagcatccccagcggcaaccagttccagccccgctgtgtgagccccatccctgtgagccccaccagccgcatccagaaccctgtggccttcctgagctctgtgctgcccagcctgcctgccatcccccccaccaatgccatgggcctgcccaggtctgcccccagcatgcccagccagggcctggccaagaagaacaccaagagcccccagcctgtgaatgatgacaacatccgggagaccaagaatgctgtgatccgggacctgggcaagaagatcaccttcagtgatgtgcggcccaaccagcaggagtacaagatcagcagctttgagcagaggctgatgaatgaaattgagttccggctggagaggacccctgtggatgaaagtgatgatgagatccagcatgatgagatccccactggaaaatgtattgcccccatctttgacaagaggctgaagcacttccgggtgacagagggcagccctgtgaccttcacctgcaagatcgtgggcatccctgtgcccaaggtgtactggttcaaggatggcaagcagatcagcaagagaaatgagcactgcaagatgagaagagaaggagatggcacctgcagcctgcacatcgagagcaccaccagtgatgatgatggcaactacaccatcatggccgccaacccccagggccgcatcagctgcagcggccacctgatggtgcagagcctgcccatccgcagccggctgaccagcgctggccagagccaccggggccgcagccgggtgcaggagcgggacaaggagcccctgcaggagcgcttcttccggccccacttcctgcaggcccctggggacatggtggcccacgagggccgcctgtgccgcctggactgcaaggtgtctggcctgcccccacctgagctgacctggctgctgaatggccagcctgtgctgcctgatgccagccacaagatgctggtgcgggagaccggggtgcacagcctgctgattgaccccctgacccagagagatgctggcacctacaagtgcatcgccaccaacaagacaggccagaacagcttcagcctggagctgtctgtggtggccaaggaggtgaagaaggcccctgtgatcctggagaagctgcagaactgtggggtgcctgagggccaccctgtgcggctggagtgcagggtcatcggcatgcctcctcctgtgttctactggaagaaggacaatgagaccatcccctgcacccgggagcgcatctccatgcaccaggacaccaccggctacgcctgcctgctgatccagcctgccaagaagagtgatgctggctggtacaccctgagcgccaagaatgaggccggcatcgtgtcctgcacagcccggctggacatctatgcccagtggcaccaccagatccccccacccatgtctgtgcggcccagcggcagccgctatggcagcctgaccagcaagggcctggacatcttcagcgccttcagctccatggagagcaccatggtgtacagctgcagcagccgctctgtggtggagagtgatgagctgtag

SEQ ID NO: 19516 - DNA, 4206 bp, Artificial Sequence
  Description of Artificial Sequence: Synthetic coding sequence
atggccagctgtgccagcattgatattgaagatgccacccagcacctgcgggacatcctgaagctggacaggcctgctgggggccccagcgctgagagcccccggcccagcagcgcctacaatggagacctgaatggcctgctggtgcctgaccccctgtgcagcggggacagcaccagcgccaacaagacaggcctgcggaccatgccacccatcaacctgcaggagaagcaggtgatctgcctgtctggagatgacagcagcacctgcatcggcatcctggccaaggaggtggagatcgtggccagcagtgacagcagcatcagcagcaaggcccggggcagcaacaaggtgaagatccagcctgtggccaagtatgactgggagcagaagtactactacggcaacctgattgctgtgagcaacagcttcctggcctatgccatccgggccgccaacaacggcagcgccatggtgcgggtcatctctgtgtccaccagcgagaggaccctgctgaagggcttcaccggctctgtggccgacctggcctttgcccacctgaacagcccccagctggcctgcctggatgaggccggcaacctgtttgtgtggaggctggccctggtgaatggcaagatccaggaggagatcctggtgcacatccggcagcctgagggcacccccctgaaccacttccgccgcatcatctggtgccccttcatccctgaggagagcgaggactgctgtgaggagagcagccccaccgtggccctgctgcatgaagatagagctgaggtgtgggacctggacatgctgcggagcagccacagcacctggcctgtggatgtgtcccagatcaagcagggcttcatcgtggtgaagggccacagcacctgcctgtctgagggcgccctgagcccagatggcaccgtgctggccacagccagccatgatggctacgtgaagttctggcagatctacatcgagggccaggatgagccccgctgcctgcacgagtggaagccccatgatggccggcccctgagctgcctgctcttctgtgacaaccacaagaagcaggaccctgatgtgcccttctggaggttcctgatcaccggggctgaccagaaccgggagctgaagatgtggtgcaccgtgtcctggacctgcctgcagaccatccgcttctccccagacatcttcagctctgtgtctgtgccccccagcctgaaggtgtgcctggacctgtctgctgagtacctgatcctgagtgatgtgcagaggaaggtgctgtatgtgatggagctgctgcagaaccaggaggagggccacgcctgcttcagcagcatcagcgagttcctgctgacccaccctgtgctgagctttggcatccaggtggtgagccgctgccgcctgcggcacacagaggtgctgcctgctgaggaggagaatgacagcctgggcgcagatggcacccatggagctggggccatggagagcgctgctggggtgctgatcaagctgttctgtgtgcacaccaaggccctgcaggatgtgcagatccgcttccagccccagctgaacccagatgtggtggcccccctgcccacccacacagcccacgaggacttcaccttcggggagagcaggcctgagctgggcagcgagggcctgggcagcgctgcccacggcagccagcctgacctgcggcgcatcgtggagctgcctgccccagctgacttcctgagcctgagcagcgagaccaagcccaagctgatgaccccagatgccttcatgacccccagcgccagcctgcagcagatcacagccagccccagcagcagcagcagcggcagcagcagcagcagcagcagcagcagcagcagcctgacagctgtgtctgccatgagcagcaccagcgctgtggaccccagcctgaccaggcctcctgaggagctgaccctgagccccaagctgcagctggatggcagcctgaccatgagcagcagcggcagcctgcaggccagcccccggggcctgctgcccggcctgctgcctgccccagctgacaagctgacccccaagggccctggccaggtgcccacagccaccagcgccctgagcctggagctgcaggaggtggagcccctgggcctgccccaggccagccccagcaggaccaggagcccagatgtgatcagcagcgccagcacagccctgagccaggacatccctgagatcgccagcgaggccctgagccggggcttcggcagcagcgcccctgagggcctggagccagacagcatggccagcgctgccagcgccctgcacctgctgagcccccggcccaggcctggccctgagctgggcccccagctgggcctggatggcggccctggagatggagacagacacaacacccccagcctgctggaggccgccctgacccaggaggccagcaccccagacagccaggtgtggcccacagccccagacatcacccgggagacctgcagcaccctggccgagagccccagaaatggcctgcaggagaagcacaagagcctggccttccacaggcctccctaccacctgctgcagcagagggacagccaggatgccagcgctgagcagagcgaccatgatgatgaggtggccagcctggccagcgccagcggcggcttcggcaccaaggtgcctgccccccggctgcctgccaaggactggaagaccaagggcagccccaggaccagccccaagctgaagaggaagagcaagaaggatgatggagatgctgccatgggcagccggctgacagagcaccaggtggccgagcccccagaggactggccagccctgatctggcagcagcagcgggagctggccgagctgcggcacagccaggaggagctgctgcagaggctgtgcacccagctggagggcctgcagagcacagtgactggacatgtggagcgggccctggagaccaggcatgagcaggagcagaggcggctggagcgggccctggccgagggccagcagaggggcggccagctgcaggagcagctgacccagcagctgagccaggccctgagcagcgctgtggccggccgcctggagaggagcatcagagatgagatcaagaagacagtgcccccctgtgtgagccgcagcctggagcccatggccggccagctgagcaacagcgtggccaccaagctgacagctgtggagggctccatgaaggagaacatcagcaagctgctgaagagcaagaacctgacagatgccatcgcccgggctgctgctgacaccctgcagggccccatgcaggccgcctaccgggaggccttccagagcgtggtgctgcctgcctttgagaagagctgccaggccatgttccagcagatcaatgacagcttccggctgggcacccaggagtacctgcagcagctggagagccacatgaagagcaggaaggcccgggagcaggaggcccgggagcctgtgctggcccagctgcggggcctggtgtccaccctgcagagcgccacagagcagatggccgccaccgtggccggctctgtgcgggcagaggtgcagcaccagctgcacgtggccgtgggcagcctgcaggagagcatcctggcccaggtgcagagaattgtgaagggggaggtgtctgtggccctgaaggagcagcaggccgctgtgaccagcagcatcatgcaggccatgaggtctgctgctggcacccctgtgcccagcgcccacctggactgccaggcccagcaggcccacatcctgcagctgctgcagcagggccacctgaaccaggccttccagcaggccctgacagctgctgacctgaacctggtgctgtatgtgtgtgaaacagtggaccctgcccaggtgtttggccagcccccctgccccctgagccagcctgtgctgctgagcctcatccagcagctggccagtgacctgggcaccaggacagacctgaagctgagctacctggaggaggccgtgatgcacctggaccacagcgaccccatcacccgggaccacatgggctctgtgatggcccaggtgcggcagaagctgttccagttcctgcaggccgagccccacaacagcctgggcaaggccgcccggcggctgagcctgatgctgcacggcctggtgacccccagcctgccctag

SEQ ID NO: 19517 - DNA, 576 bp, Artificial Sequence
  Description of Artificial Sequence: Synthetic coding sequence
atgagcagtggagcagatggcggcggcggcgctgctgtggccgcccggagtgacaagggcagccctggagaagatggctttgtgcccagcgccctgggcacccgggagcactgggatgctgtgtatgaaagagagctgcagaccttccgggagtatggagacacaggagagatctggtttggagaggagagcatgaacagactcatccgctggatgcagaagcacaagatccccctggatgcctctgtgctggacatcggcactggaaatggagtcttcctggtggagctggccaagtttggcttcagcaacatcaccggcatcgactacagccccagcgccatccagctgagcggcagcatcatcgagaaggagggcctgagcaacatcaagctgaaggtggaggacttcctgaacctgagcacccagctgagcggcttccacatctgcatcgacaagggcacctttgatgccatcagcctgaacccagacaatgccatcgagaagaggaagcagtatgtgaagagcctgagccgggtgctgaaggtgaagggcttcttcaacaacgtgatgtag

SEQ ID NO: 19518 - DNA, 2622 bp, Artificial Sequence
  Description of Artificial Sequence: Synthetic coding sequence
atgggcaaccgggagatggaggagctgatccccctggtgaaccggctgcaggatgccttcagcgccctgggccagagctgcctgctggagctgccccagattgctgtggtgggcggccagagcgctgggaagagctctgtgctggagaactttgtgggccgggacttcctgccccggggcagcggcatcgtgacccggcggcccctggtgctgcagctggtgaccagcaaggccgagtatgcagagttcctgcactgcaagggcaagaagttcacagactttgatgaggtgcggctggagattgaagctgagacagacagagtgacaggcatgaacaagggcatcagcagcatccccatcaacctgcgggtgtacagcccccacgtgctgaacctgaccctgattgacctgcccggcatcaccaaggtgcctgtgggggaccagcccccagacatcgagtaccagatccgggagatgatcatgcagttcatcacccgggagaactgcctgatcctggccgtgaccccagccaacacagacctggccaacagtgatgccctgaagctggccaaggaggtggacccccagggcctgcggaccatcggggtcatcaccaagctggacctgatggatgagggcacagatgccagagatgtgctggagaacaagctgctgcccctgcggcggggctacgtgggcgtggtgaacagaagccagaaggacattgatggcaagaaggacatcaaggccgccatgctggccgagaggaagttcttcctgagccacccagcctaccgccacatcgctgacaggatgggcaccccccacctgcagaaggtgctgaaccagcagctgaccaaccacatccgggacaccctgcccaacttcaggaacaagctgcagggccagctgctgagcattgaacatgaggtggaggcctacaagaacttcaagccagaggaccccaccaggaagaccaaggccctgctgcagatggtgcagcagtttgctgtggactttgagaagagaattgagggcagcggggaccaggtggacaccctggagctgtctggaggagccaagatcaaccgcatcttccacgagcgcttcccctttgagatcgtgaagatggagttcaatgagaaggagctgcggcgggagatctcctatgccatcaagaacatccacggcatcagaacaggcctcttcaccccagacatggcctttgaggccatcgtgaagaagcagatcgtgaagctgaagggccccagcctgaagtctgtggacctggtgatccaggagctgatcaacacagtgaagaagtgcaccaagaagctggccaacttcccccggctgtgtgaggagacagaaagaattgtggccaaccacatccgggagcgggagggcaagaccaaggaccaggtgctgctgctgattgacatccaggtgtcctacatcaacaccaaccacgaggacttcatcggctttgccaatgcccagcagaggagcagccaggtgcacaagaagaccaccgtgggcaaccagggcaccaacctgccccccagccggcagatcgtcatcaggaagggctggctgaccatcagcaacatcggcatcatgaagggcggcagcaagggctactggtttgtgctgacagctgagagcctgtcctggtacaaggatgatgaggagaaggagaagaagtacatgctgcccctggacaacctgaaggtgagagatgtggagaagagcttcatgagcagcaagcacatctttgccctcttcaacacagagcagagaaatgtgtacaaggactaccgcttcctggagctggcctgtgacagccaggaggatgtggacagctggaaggccagcctgctgcgggccggcgtgtacccagacaagtctgtgatgaacaagaaggcagaaaatgatgaaaatggccaggccgagaacttctccatggacccccagctggagcggcaggtggagaccatccggaacctggtggacagctacatgagcatcatcaacaagtgcatccgggacctgatccccaagaccatcatgcacctgatgatcaacaacgtgaaggacttcatcaacagcgagctgctggcccagctgtacagcagcgaggaccagaacaccctgatggaggagagcgctgagcaggcccagaggagagatgagatgctgaggatgtaccaggccctgaaggaggccctgggcatcatcggggacatcagcacagccaccgtgtccaccccagcccctcctcctgtggatgacagctggatccagcacagcagaagaagccccccacccagccccaccacccagaggcggcccaccctgagcgcccccctggcccggcccaccagcggccggggccctgccccagccatccccagccctggcccccacagcggggcccctcctgtgcccttccggcccggccccctgccccccttccccagcagcagtgacagctttggagccccaccccaggtgcccagccggcccacccgggccccacccagcgtgcccagccggcggcccccacccagccccacccggcccaccatcatccggcccctggagagcagcctgctggactag

SEQ ID NO: 19519 - DNA, 3111 bp, Artificial Sequence
  Description of Artificial Sequence: Synthetic coding sequence
atgaggaagcaggaggtgaggacaggccgggaggccggccagggccacggcaccggcagccctgctgagcaggtgaaggccctgatggacctgctggccggcaagggcagccagggcagccaggccccccaggccctggacaggaccccagatgcccccctgggcccctgcagcaatgacagccgcatccagaggcacaggaaggccctgctgagcaaggtgggcggcggccctgagctgggcggcccctggcaccggctggccagcctgctgctggtggagggcctgacagacctgcagctgcgggagcatgacttcacccaggtggaggccacccggggcggcggccacccagccaggacagtggccctggacaggctcttcctgcccctgagccgggtgtctgtgcccccccgggtgtccatcaccatcggcgtggccggcatgggcaagaccaccctggtgcgccactttgtgcggctgtgggcccacggccaggtgggcaaggacttcagcctggtgctgcccctgaccttccgggacctgaacacccatgagaagctgtgtgccgacaggctcatctgcagcgtcttcccccacgtgggggagcccagcctggccgtggccgtgcctgcccgggccctgctgatcctggatggcctggatgaatgtaggacccccctggacttcagcaacacagtggcctgcacagaccccaagaaggagatccctgtggaccacctgatcaccaacatcatccggggcaacctcttccctgaggtgtccatctggatcaccagccggcccagcgccagcggccagatccctgggggcctggtggacaggatgacagagatccggggcttcaatgaggaggagatcaaggtgtgcctggagcagatgtttcctgaggaccaggccctgctgggctggatgctgagccaggtgcaggccgaccgggccctgtacctgatgtgcaccgtgcctgccttctgccgcctgaccggcatggccctgggccacctgtggaggagcaggacaggcccccaggatgctgagctgtggccacccaggaccctgtgtgagctgtacagctggtacttcaggatggccctgtctggagagggccaggagaagggcaaggccagcccccgcatcgagcaggtggcccatggaggcaggaagatggtgggcaccctgggccgcctggccttccacggcctgctgaagaagaagtatgtgttctatgagcaggacatgaaggcctttggagtggacctggccctgctgcagggcgccccctgcagctgcttcctgcagcgggaggagaccctggccagctctgtggcctactgcttcacccacctgagcctgcaggagtttgtggccgccgcctactactacggggccagccggcgggccatctttgacctcttcacagagagcggcgtgtcctggccccggctgggcttcctgacccacttccgctctgctgcccagagggccatgcaggccgaggatggccgcctggatgtgttcctgcgcttcctgagcggcctgctgagcccccgggtgaatgccctgctggccggcagcctgctggcccagggcgagcaccaggcctaccgcacccaggtggccgagctgctgcagggctgcctgcggccagatgctgctgtgtgtgcccgggccatcaacgtgctgcactgcctgcacgagctgcagcacacagagctggcccggtctgtggaggaggccatggagagcggggccctggcccggctgaccggccctgcccaccgggccgccctggcctacctgctgcaggtgtctgatgcctgtgcccaggaggccaacctgagcctgagcctgagccagggcgtgctgcagagcctgctgccccagctgctgtactgcaggaagctgcggctggacaccaaccagttccaggaccctgtgatggagctgctgggctctgtgctgagcggcaaggactgccgcatccagaagatcagcctggccgagaaccagatcagcaacaagggggccaaggccctggcccggagcctgctggtgaacagaagcctgaccagcctggacctgcggggcaacagcatcggcccccagggcgccaaggccctggctgatgccctgaagatcaacagaaccctgaccagcctgagcctgcagggcaacacagtgagagatgatggagcccgctccatggccgaggccctggccagcaacagaaccctgtccatgctgcacctgcagaagaacagcatcggccccatgggcgcccagaggatggctgacctgaagcagaacagaagcctgaaggagctgatgttcagcagcaacagcattggagatggaggagccaaggccctggccgaggccctgaaggtgaaccagggcctggagagcctggacctgcagagcaacagcatcagtgatgctggggtggccgccctgatgggcgccctgtgcaccaaccagaccctgctgagcctgagcctgcgggagaacagcatcagccctgagggcgcccaggccatcgcccacgccctgtgtgccaacagcaccctgaagaacctggacctgcagtggaacttcatccaggccggggccgcccaggccctgggccaggccctgcagctgaacagaagcctgaccagcctggacctgcaggagaatgccatcggagatgatggagcctgtgctgtggcccgggccctgaaggtgaacacagccctgacagccctgtacctgcaggtggccagcattggagccagcggggcccaggtgctgggggaggccctggccgtgaacagaaccctggagatcctggacctgcggggaaatgccatcggcgtggccggggccaaggccctggccaatgccctgaaggtgaacagcagcctgcggcggctgaacctgcaggagaacagcctgggcatggatggagccatctgcatcgccacagccctgagcggcaaccaccggctgcagcacatcaacctgcagggcaaccacatcggggacagcggggccaggatgatcagcgaggccatcaagaccaatgcccccacctgcaccgtggagatgtag

SEQ ID NO: 19520 - DNA, 2784 bp, Artificial Sequence
  Description of Artificial Sequence: Synthetic coding sequence
atgttctggaagtttgacctgaacaccaccagccacgtggacaagctgctggacaaggagcacgtgaccctgcaggagctgatggatgaagatgacatcctgcaggagtgcaaggcccagaaccagaagctgctggacttcctgtgccggcagcagtgcatggaggagctggtgtccctcatcacccaggacccccccctggacatggaggagaaggtgcgcttcaagtaccccaacacagcctgtgagctgctgacctgtgatgtgccccagatcagtgaccggctgggcggagatgagagcctgctgagcctgctgtatgacttcctggaccacgagccccccctgaaccccctgctggccagcttcttcagcaagaccatcggcaacctgattgccaggaagacagagcaggtgatcaccttcctgaagaagaaggacaagttcatcagcctggtgctgaagcacatcggcaccagcgccctgatggacctgctgctgcggctggtgtcctgtgtggagcccgccggcctgcggcaggatgtgctgcactggctgaatgaggagaaggtgatccagaggctggtggagctgatccaccccagccaggatgaagatcggcagagcaatgccagccagaccctgtgtgacatcgtgcggctgggccgggaccagggcagccagctgcaggaggccctggagccagaccccctgctgacagccctggagagccaggactgtgtggagcagctgctgaagaacatgtttgatggagacagaacagagagctgcctggtgtctggcacccaggtgctgctgaccctgctggagaccaggagagtgggcacagagggcctggtggacagcttcagccagggcctggagaggagctatgctgtgagcagctctgtgctgcacggcatcgagccccggctgaaggacttccaccagctgctgctgaacccccccaagaagaaggccatcctgaccaccatcggcgtgctggaggagcccctgggcaatgcccggctgcatggagcccggctgatggccgccctgctgcacaccaacacccccagcatcaaccaggagctgtgccgcctgaacaccatggacctgctgctggacctcttcttcaagtacacctggaacaacttcctgcacttccaggtggagctgtgcatcgccgccatcctgagccacgccgcccgggaggagaggacagaggccagcggcagcgagagccgggtggagccccctcatgaaaatggaaacagaagcctggagaccccccagcctgctgccagcctgcctgacaacaccatggtgacccacctgttccagaagtgctgcctggtgcagaggatcctggaggcctgggaggccaatgaccacacccaggccgccggcggcatgagaagaggcaacatgggccacctgaccagaattgccaatgctgtggtgcagaacctggagcggggccctgtgcagacccacatcagcgaggtgatccggggcctgcctgctgactgccggggccgctgggagagctttgtggaggagaccctgacagagaccaacagaagaaacacagtggacctggccttcagtgactaccagatccagcagatgacagccaactttgtggaccagtttggcttcaatgatgaggagtttgctgaccaggatgacaacatcaatgccccctttgacagaattgctgagatcaacttcaacattgatgctgatgaggacagccccagcgctgccctgtttgaggcctgctgcagcgaccgcatccagccctttgatgatgatgaagatgaggacatctgggaggacagcgacacccgctgtgccgcccgggtgatggcccggcccaggtttggagcccctcatgccagcgagagctgcagcaagaatggacctgagcggggcggccaggacggcaaggccagcctggaggcccacagagatgcccctggagctggggcccccccagcccctgggaagaaggaggcccctcctgtggagggggacagcgaggccggggccatgtggacagctgtgtttgatgagcccgccaacagcacccccacagcccctggggtggtgagagatgtgggcagctctgtgtgggccgccggcaccagcgcccctgaggagaagggctgggccaagttcacagacttccagcccttctgctgcagcgagagcggcccccgctgcagcagccctgtggacacagagtgcagccacgccgagggcagccgcagccagggccctgagaaggccttcagccctgccagcccctgtgcctggaatgtgtgtgtgaccaggaaggcccccctgctggccagtgacagcagcagcagcggcggcagccacagtgaagatggagaccagaaggccgccagcgccatggatgctgtgtcccggggccctggccgggaggccccacccctgcccaccgtggccaggacagaggaggccgtgggccgggtgggctgtgccgacagccggctgctgagccctgcctgcccagcccccaaggaggtgacagctgccccagctgtggccgtgcccccagaggccaccgtggccatcaccacagccctgagcaaggccggccctgccatccccaccccagctgtgtcctctgccctggccgtggccgtgcccctgggccccatcatggctgtgacagctgccccagccatggtggccaccctgggcaccgtgaccaaggatggccagatgccccggcagaaggagctgccctag

SEQ ID NO: 19521 - DNA, 2220 bp, Artificial Sequence
  Description of Artificial Sequence: Synthetic coding sequence
atgggcttcagcaacatggaggatgatggccctgaggaggaggagcgggtggccgagccccaggccaacttcaacaccccccaggccctgcgctttgaggagctgctggccaacctgctgaatgagcagcaccagatcgccaaggagctgtttgagcagctgaagatgaagaagcccagcgccaagcagcagaaggaggtggagaaggtgaagccccagtgcaaggaggtgcaccagaccctcatcctggaccctgcccagaggaagaggctgcagcagcagatgcagcagcacgtgcagctgctgacccagatccacctgctggccacctgcaaccccaacctgaaccctgaggccagcagcacccgcatctgcctgaaggagctgggcacctttgcccagagcagcatcgccctgcaccaccagtacaaccccaagttccagaccctcttccagccctgcaacctgatgggcgccatgcagctgattgaggacttcagcacccacgtgtccattgactgcagcccccacaagacagtgaagaagacagccaatgagttcccctgcctgcccaagcaggtggcctggatcctggccaccagcaaggtgttcatgtacccagagctgctgcctgtgtgcagcctgaaggccaagaacccccaggacaagatcctcttcaccaaggccgaggacaacctgctggccctgggcctgaagcactttgagggcacagagttcctgaaccccctcatcagcaagtacctgctgacctgcaagacagcccggcagctgactgtgcgcatcaagaacctgaacatgaacagagccccagacaacatcatcaagttctacaagaagaccaagcagctgcctgtgctgggcaagtgctgtgaggagatccagccccaccagtggaagccacccatcgagcgggaggagcaccggctgcccttctggctgaaggccagcctgcccagcatccaggaggagctgcggcacatggctgatggagcccgggaggtgggcaacatgacaggcaccacagagatcaacagcgaccagggcctggagaaggacaacagcgagctgggcagcgagacccgctaccccctgctgctgcccaagggcgtggtgctgaagctgaagcctgtggccgaccgcttccccaagaaggcctggaggcagaagaggagctctgtgctgaagcccctgctgatccagcccagccccagcctgcagcccagcttcaaccctgggaagaccccagcccagagcacccacagcgaggccccacccagcaagatggtgctgcgcatcccccaccccatccagcctgccaccgtgctgcagacagtgcctggggtgccccccctgggcgtgtctggaggagagagctttgagagccctgctgccctgcctgccatgcctcctgaggcccggaccagcttccccctgtctgagagccagaccctgctgagcagcgcccctgtgcccaaggtgatgatgcccagccctgccagctccatgttcaggaagccctacgtgagaagaagacccagcaagagaagaggagcccgggccttccgctgcatcaagccagcccctgtgatccacccagccagcgtcatcttcaccgtgcctgccaccaccgtgaagatcgtgtccctgggcggcggctgcaacatgatccagcctgtgaatgctgctgtggcccagagcccccagaccatccccatcgccaccctgctggtgaaccccaccagcttcccctgccccctgaaccagcccctggtggccagctctgtgagccccctcatcgtgtctggcaacagcgtgaacctgcccatccccagcaccccagaggacaaggcccacatgaatgtggacatcgcctgtgctgtggctgatggagaaaatgccttccagggcctggagcccaagctggagccccaggagctgagccccctgagcgccaccgtcttccccaaggtggagcacagccctggccccccacctgtggacaagcagtgccaggagggcctgtctgaaaattctgcctaccgctggacagtggtgaagacagaggagggccggcaggccctggagcccctgccccagggcatccaggagagcctgaacaacagcagccctggggacctggaggaggtggtgaagatggagccagaagatgccacagaggagatcagcggcttcctgtag

SEQ ID NO: 19522 - DNA, 1911 bp, Artificial Sequence
  Description of Artificial Sequence: Synthetic coding sequence
atggagaaggctgtgaatgatggcagccacagcgaggagctgttctgccacctgaagaccatcagcgagaaggaggacctgccccgctgcaccagcgagagccacctgagctgcctgaagcaggacatcctgaatgagaagacagagctggaggccaccctgaaggaggccgagctggtgacccacagcgtggagctgctgctgcccctcttcaaggacaccatcgagaagatcaactttgaaaatgccaacctgagcgccctgaacctgaagatcagcgagcagaaggagatcctgatcaaggagctggacaccttcaagtctgtgaagctggccctggagcacctgctgaggaagagggactacaagcagacaggagacaacctgagctccatgctgctggagaacctgacagacaatgaaagtgagaacaccaacctgaagaagaaggtgtttgagaaggaggcccacatccaggagctgagctgcctcttccagagcgagaaggccaacaccctgaaggccaaccgcttcagccagagcgtgaaggtggtgcatgagcggctgcagatccagatccacaagcgggaggctgaaaatgacaagctgaaggagtatgtgaagagcctggagaccaagatcgccaagtggaacctgcagagcaggatgaacaagaatgaggccatcgtgatgaaggaggccagccggcagaagacagtggccctgaagaaggccagcaaggtgtacaagcagaggctggaccacttcaccggggccatcgagaagctgaccagccagatccgggaccaggaggccaagctgtctgagaccatcagcgccagcaatgcctggaagagccactatgagaagatcgtgattgagaagacagagctggaggtgcagatcgagaccatgaagaagcagatcatcaacctgctggaggacctgaagaagatggaggaccacggcaagaacagctgtgaggagatcctgaggaaggtgcacagcattgaatatgaaaatgagaccctgaacctggagaacaccaagctgaagctgcgcttcccctgccgcatcacagagagcaagaacatgaacatcctgattgtgctggacatgctgtgctacatcagcagcgagaagaccaccctggccgccctgaaggatgaggtggtgtctgtggagaatgagctgtctgagctgcaggaggtggagaagaagcagaagaccctcatcgagatgtacaagacccaggtgcagaagctgcaggaggccgctgagatcgtgaagagccgctgtgagaacctgctgcacaagaacaaccagatcaccaagaccaagaacaagaatgtggagaagatgaggggccagatggagagccacctgaaggagctggagcgggtgtgtgacagcctgacagctgctgagcggcggctgcacgagtgccaggagagcctgcagtgctgcaagggcaaatgtgccgaccaggagcacaccatccgggagctgcagggccaggtggatggcaaccacaacctgctgaccaagctgagcctggaggaggagaactgcctgatccagctgaagtgtgagaacctgcagcagaagctggagcagatggatgctgagaacaaggagctggagaagaagctggccaaccaggaggagtgcctgaagcacagcaacctgaagttcaaggagaagtctgctgagtacacagccctggcccggcagctggaggccgccctggaggagggccggcagaaggtggccgaggagattgagaagatgagcagccgggagagcgccctgcagatcaagatcctggacctggagacagagctgaggaagaagaatgaggagcagaaccagctggtgtgcaagatgaacagcgaccctgagaccccctag

SEQ ID NO: 19523 - DNA, 873 bp, Artificial Sequence
  Description of Artificial Sequence: Synthetic coding sequence
atggctgctgtggagaagaggcggcaggccgtgcccccacctgctggcttcacagacagcggccggcagagcgtgtccagagctgctggagctgctgagagcgaggaggacttcctgcggcaggtgggcgtgacagagatgctgcgggccgccctgctgaaggtgctggaggcccggcctgaggagcccatcgccttcctggcccactactttgagaacatgggcctgcggagccctgtgaatggaggagctggggagcccccaggccagctgctgctgcagcagcagaggctgggccgggccctgtggcacctgcggctggcccaccacagccagagagctgccttcaacaacaacgtgtctgtggcctatgaatgtctgtctgctgggggccgcaggaagaggcctggcctggatggccgcacctacagcgagctgctgcggcgcatctgcagagatggccaggcccctgaggaggtggtggcccccctgctgaggaaggtgcagtgccgggaccatgaagctgtgcccctgtctgtgttccgggccggcaccctgacctgctttgtgctgctggagtttgtggcccgggccggggccctcttccagctgctggaggacagcgctgctgctgtggccgacagaagagtgggccaggccgtgctggacaccctggagggcgccctgcaggccagtgatgctgctgccccagcccgcttcctggaggccggcagccggctgggccctgacagcctggccctggccctggacagagctgtgggcggcagaagacccagcgcccccatgacccgggaggagttcctggagagagctgctgccctcttcatcgccaaggtgaagcctgtgggctag

SEQ ID NO: 19524 - DNA, 1221 bp, Artificial Sequence
  Description of Artificial Sequence: Synthetic coding sequence
atggctgacagccagctgttctgtgtggccgaggagaggagcggccactgtgctgtggtggatggcaacttcctgtatgtgtggggcggctacgtgtccattgaagataatgaggtgtacctgcccaatgatgagatctggacctatgacattgattctggcctgtggaggatgcacctgatggagggggagctgcctgcctccatgagcggcagctgtggggcctgcatcaacgggaagctgtacatctttggaggctatgatgacaagggctacagcaaccggctgtactttgtgaacctgcggaccagagatgagacctacatctgggagaagatcacagactttgagggccagccccccaccccccgggacaagctgagctgctgggtgtacaaggacaggctcatctactttggaggctacggctgcagaagacacagcgagctgcaggactgctttgatgtgcatgatgcctcctgggaggagcagatcttctggggctggcacaatgatgtgcacatctttgacaccaagacccagacctggttccagcctgagatcaagggcggcgtgcccccccagccccgggccgcccacacctgtgctgtgctgggcaacaagggctacatctttggaggccgggtgctgcagaccaggatgaatgacctgcactacctgaacctggacacctggacctggagcggccgcatcaccatcaatggagagagccccaagcaccgctcctggcacaccctgacccccatcgcagatgacaagctgttcctgtgtggcggcctgtctgctgacaacatccccctgagtgatggctggatccacaacgtgaccaccaactgctggaagcagctgacccacctgcccaagacccggccccggctgtggcacacagcctgcctgggcaaggaaaatgagatcatggtgtttggaggcagcaaggatgacctgctggccctggacaccggccactgcaatgacctgctgatcttccagacccagccctacagcctgctgcggagctgcctggactgcatcggcaagaacagcatcatgctggagagccagatcagcctgctgccccccaagctgctgcagcaggtgctgaagaagatcaccttctgggccgccgccaaccaccgggaggagcagagggtgcagaaggaggagacagagaacaagtaccagtggatcagcagcaactag

SEQ ID NO: 19525 - DNA, 1113 bp, Artificial Sequence
  Description of Artificial Sequence: Synthetic coding sequence
atggtgcagcccttcaccaccatccccttccccccaccaccccagaatggcatccccacagaatatggagtgccccacacccaggactatgccggccagacaggagagcacaacctgaccctgtatggcagcacccaggcccacggggagcagagcagcaacagccccagcacccagaatggcagcctgaccacagaaggaggagcccagacagatggccagcagagccagacccagagcagcgagaacagcgagagcaagagcacccccaagaggctgcacgtgagcaacatccccttccgcttccgggaccctgacctgcggcagatgtttggccagtttgggaagatcctggatgtggagatcatcttcaatgaaagaggcagcaagggcttcggctttgtgacctttgagaacagcgcagatgctgaccgggcccgggagaagctgcatggaacagtggtggagggcaggaagattgaggtgaacaatgccacagcccgggtgatgaccaacaagaagatggtgaccccctatgccaacggctggaagctgagccctgtggtgggcgctgtgtatggccctgagctgtatgctgccagcagcttccaggctgatgtgtccctgggcaatgatgctgctgtgcccctgagcggccggggcggcatcaacacctacatccccctcatcatccctggcttcccctaccccacagctgccaccacagctgctgccttccggggggcccacctgcggggccggggccgcacagtgtatggagctgtgcgggctgtgcccccaacagccatcccagcctacccaggagtggtgtaccaggacggcttctatggagctgacctgtacattgaaagtgccaactgcttccgcagcaacagagtggacatgcagcccacagacatgcacagcctgctgctgcagccccagccccccctgctgcagcccctgcagcccctgactgtgacagtgatggccggctgcacccagcccacccccaccatgcccctgcccctgcccctggccatggagctggccctgtggagggtgtacacagaggtggccacagctgacctgcccccaacagaggtgacctag

SEQ ID NO: 19526 - DNA, 534 bp, Artificial Sequence
  Description of Artificial Sequence: Synthetic coding sequence
atgtctgaagattctgagaaggaggactacagcgacaggaccatcagtgatgaagatgaaagtgatgaggacatgttcatgaagtttgtgtctgaggacctgcaccgctgtgccctgctgacagctgacagctttggagaccccttcttccccaggaccacccagatcctgctggagtaccagctgggccgctgggtgccccggctgcgggagccccgggacctgtatggagtgagcagcagcggccccctgagccccacccgctggccctaccactgtgaggtgattgatgagaaggtgcagcacattgatggagtgtcctgctggagcgagagccaccaggccggggcccagtggtgtgacctgggcagcctgcagcccccaccaccccgcttcaagagatttgcctgcttcagcctgctgagcagccgggactacagaagagtgccccccaggtctgccaactttgtgttcctggtggagaccggcttccaccacgtgggccaggacggcctgcggctgctgaccagctag

SEQ ID NO: 19527 - DNA, 1827 bp, Artificial Sequence
  Description of Artificial Sequence: Synthetic coding sequence
atgtctgacaagagtgacctgaaggccgagctggagaggaagaagcagaggctggcccagatccgggaggagaagaagaggaaggaggaggagaggaagaagaaggaggccgacatgcagcagaagaaggagcctgtgcaggatgacagcgacctggacaggaagaggcgggagacagaggccctgctgcagagcatcggcatcagccctgagccccccctggtgcccacccccatgagccccagcagcaagtctgtgtccacccccagcgaggccggcagccaggacagcggggacctgggccccctgacccggcggcggctgcacaagctgggcgtgtccaaggtgacccaggtggacttcctgccccgggaggtggtgtcctacagcaaggagacccagacccccctggccacccaccagagcgaggaggatgaagaagatgaggagatggtggagagcaaggtgggccaggacagcgagctggagaaccaggacaagaagcaggaggtgaaggaggccccaccccgggagctgacagaggaggagaagcagcagatcctgcacagcgaggagttcctgatcttctttgacaggaccatccgggtcatcgagcgggccctggccgaggacagcgacatcttctttgactacagcggccgggagctggaggagaaggatggagatgtgcaggccggggccaacctgtccttcaaccggcagttctatgatgagcactggagcaagcaccgggtggtgacctgcatggactggagcctgcagtacccagagctgatggtggccagctacaacaacaatgaagatgcccctcatgagccagatggagtggccctggtgtggaacatgaagttcaagaagaccaccccagaatatgtgttccactgccagagctctgtgatgtctgtgtgctttgcccgcttccaccccaacctggtggtgggcggcacctacagcggccagatcgtgctgtgggacaacagaagccacaggaggacccctgtgcagaggacccccctgtctgctgctgcccacacccaccctgtgtactgtgtgaatgtggtgggcacccagaatgcccacaacctgatcaccgtgtccacagatggcaagatgtgctcctggagcctggacatgctgagcaccccccaggagagcatggagctggtgtacaacaagagcaagcctgtggccgtgacaggcatggccttccccactggagatgtgaacaactttgtggtgggcagcgaggagggcaccgtgtacacagcctgcagacatggcagcaaggccggcattggagaggtgtttgagggccaccagggccctgtgacaggcatcaactgccacatggctgtgggccccatcgacttcagccacctgtttgtgaccagcagctttgactggacagtgaagctgtggaccaccaagcacaacaagcccctgtacagctttgaggacaatgctgactatgtgtatgatgtgatgtggagccctgtgcacccagccctgtttgcctgtgtggatggcatgggccgcctggacctgtggaacctgaacaatgacacagaggtgcccacagcctctgtggccatcgagggcgccagcgccctgaacagagtgcgctgggcccaggccggcaaggaggtggccgtgggggacagcgagggccgcatctgggtgtatgatgtgggggagctggccgtgccccacaatgatgagtggaccaggtttgcccggaccctggtggagatccgggccaacagagctgacagcgaggaggagggcaccgtggagctgagcgcctag

SEQ ID NO: 19528 - DNA, 627 bp, Artificial Sequence
  Description of Artificial Sequence: Synthetic coding sequence
atggagggcgctgctgcccctgtggccggggacagaccagacctgggcctgggcgcccctggcagcccccgggaggccgtggccggggccacagctgccctggagcccaggaagccccacggcgtgaagaggcaccaccacaagcacaacctgaagcacagatatgagctgcaggagaccctgggcaagggcacctacggcaaggtgaagagggccacagagcgcttcagcggccgggtggtggccatcaagagcatcaggaaggacaagatcaaggatgagcaggacatggtgcacatcagaagagaaattgagatcatgagcagcctgaaccacccccacatcatcagcatctatgaggtgtttgagaacaaggacaagatcgtcatcatcatggagtatgccagcaaaggagagctgtatgactacatcagcgagcggcggcggctgtctgagcgggagaccaggcacttcttccggcagatcgtgtctgctgtgcactactgccacaagaatggagtggtgcaccgggacctgaagctgaagaggcccagccgggagaaccaggtgaccaccctgccccagagcgctgtgtccctgcggagctgctggacagtgatgatgtag

SEQ ID NO: 19529 - DNA, 990 bp, Artificial Sequence
  Description of Artificial Sequence: Synthetic coding sequence
atggaggtggccgagcccagcagccccacagaggaggaggaggaggaggaggagcacagcgctgagccccggcccaggaccaggagcaaccctgagggcgcagaagatagagctgtgggcgcccaggcctctgtgggcagccgctctgagggggagggggaggccgccagcgcagatgatggcagcctgaacaccagcggggccggccccaagtcctggcaggtgcccccaccagcccctgaggtgcagatccgcaccccccgggtgaactgcccagagaaggtgatcatctgcctggacctgtctgaggagatgagcctgcccaagctggagagcttcaacggcagcaagaccaatgccctgaatgtgtcccagaagatgattgagatgtttgtgaggaccaagcacaagattgacaagagccatgaatttgccctggtggtggtgaatgatgacacagcctggctgagcggcctgaccagtgacccccgggagctgtgcagctgcctgtatgacctggagacagccagctgcagcaccttcaacctggagggcctcttcagcctcatccagcagaagacagagctgcctgtgacagaaaatgtgcagaccatccccccaccctacgtggtgaggaccatcctggtgtacagccggcccccctgccagccccagttcagcctgacagagcccatgaagaagatgttccagtgcccctacttcttctttgatgtggtgtacatccacaacggcacagaggagaaggaggaggagatgtcctggaaggacatgtttgccttcatgggcagcctggacaccaagggcaccagctacaagtatgaggtggccctggccggccctgccctggagctgcacaactgcatggccaagctgctggcccaccccctgcagaggccctgccagagccacgccagctacagcctgctggaggaggaggatgaggccatcgaggtggaggccaccgtgtag

SEQ ID NO: 19530 - DNA, 885 bp, Artificial Sequence
  Description of Artificial Sequence: Synthetic coding sequence
atgagccagcctgctgggggccgcaggaagcccaggaccctgggcccccctgtgtgcagcatccggcccttcaagagcagcgagcagtacctggaggccatgaaggaggacctggccgagtggctgcgggacctgtatggcctggacattgatgctgccaacttcctgcaggtgctggagaccggcctggtgctgtgccagcacgccaacgtggtgacagatgctgccctggccttcctggccgaggccccagcccaggcccagaagatccccatgccccgggtgggcgtgtcctgcaatggagctgcccagcccggcaccttccaggcccgggacaacgtgagcaacttcatccagtggtgcaggaaggagatgggcatccaggaggtgctgatgtttgaaacagaggacctggtgctgaggaagaatgtgaagaatgtggtgctgtgcctgctggagctgggccggcgggcctggaggtttggagtggccgcccccaccctggtgcagctggaggaggagattgaggaggaggtgcggcgggagctggccctgccccccctgccccagcccggcccagatggagctgagccctgtgagcccctgcacgtgcccagcgctgtgctgcacggccagagcgtgtatgtgttcctgggccctgcccggcagccccccaaggaccggctgctgcgggctgtgctgggcagcaaaggaggagaggccagccgggtggatggagcctctgtgggggaggaggaggaggagggcaaggaggagaaggagcctgctgcccccctggagagcagcccccagcccccagagggcctgcagccccactggctgaaccaggcccccctgcccccagaggaggagagctgggtgtag

SEQ ID NO: 19531 - DNA, 1554 bp, Artificial Sequence; identical to SEQ ID NO: 18881
  Description of Artificial Sequence: Synthetic coding sequence

SEQ ID NO: 19532 - DNA, 951 bp, Artificial Sequence
  Description of Artificial Sequence: Synthetic coding sequence
atggccacctttgtggagctgagcaccaaggccaagatgcccatcgtgggcctgggcacctggaagagccccctgggcaaggtgaaggaggccgtgaaggtggccattgatgctggctaccgccacatcgactgtgcctacgtgtaccagaatgaacatgaggtgggggaggccatccaggagaagatccaggagaaggctgtgaagagagaagatctcttcatcgtgtccaagctgtggcccaccttctttgagcggcccctggtgaggaaggcctttgagaagaccctgaaggacctgaagctgagctacctggatgtgtacctgatccactggccccagggcttcaagtctggagatgacctcttccccaaggatgacaagggaaatgccatcggcggcaaggccaccttcctggatgcctgggaggccatggaggagctggtggatgagggcctggtgaaggccctgggcgtgagcaacttcagccacttccagatcgagaagctgctgaacaagccaggcctgaagtacaagcctgtgaccaaccaggtggagtgccacccctacctgacccaggagaagctgatccagtactgccacagcaagggcatcaccgtgacagcctacagccccctgggcagcccagaccggccctgggccaagccagaggaccccagcctgctggaggaccccaagatcaaggagattgctgccaagcacaagaagacagctgcccaggtgctgatccgcttccacatccagagaaatgtgattgtcatccccaagtctgtgaccccagcccgcatcgtggagaacatccaggtgtttgacttcaagctgagtgatgaggagatggccaccatcctgtccttcaacagaaactggagggcctgcaatgtgctgcagagcagccacctggaggactaccccttcaatgctgagtactag

SEQ ID NO: 19533 - DNA, 8274 bp, Artificial Sequence
  Description of Artificial Sequence: Synthetic coding sequence
gagcccaaggtggtgtttgccaaggagcagcctgtgcaccgggaggtgcaggcccaggccggggccagcaccaccctgagctgtgaggtggcccaggcccagacagaggtgatgtggtacaaggatggcaagaagctgtccttcagcagcaaggtgaggatggaggccgtgggctgcacccggcggctggtggtgcagcaggccggccaggccgtggccggggagtacagctgtgaggccggcagccagaggctgtccttccacctgcacgtggccgagcccaaggctgtgtttgccaaggagcagcctgcccaccgggaggtgcaggccgaggccggggccagcgccaccctgagctgtgaggtggcccaggcccagacagaggtgacctggtacaaggatggcaagaagctgagcagcagcctgaaggtgcacgtggaggccgccggctgcacccggcggctggtggtgcagcaggccggccaggccgacacaggagagtacagctgtgaggccggcggccagcagctgtccttccggctgcaggtggccgagcccaaggctgtgtttgccaaggagcagcctgccagccgggaggtgcaggccgaggccggcaccagcgccaccctgagctgtgaggtggcccaggcccagacagaggtgacctggtacaaggatggcaagaagctgagcagcagcagcaaggtgaggatggaggccgtgggctgcacccggcggctggtggtgcaggaggccggccaggctgatgctggggagtacagctgcaaggccggggaccagaggctgtccttccacctgcacgtggccgagcccaaggtggtgtttgccaaggagcagcctgcccaccgggaggtgcaggccgaggccggggccagcgccaccctgagctgtgaggtggcccaggcccagacagaggtgacctggtacaaggatggcaagaagctgagcagcagcagcaaggtgcgggtggaggccgtgggctgcacccggcggctggtggtgcagcaggccggccaggccgaggccggggagtacagctgtgaggccggcggccagcagctgtccttccggctgcaggtggccgagcccaaggctgtgtttgccaaggagcaggtggtgtttgccaaggaccagcctgtgcaccgggaggtgcaggccgaggccggcaccagcaccatgctgagctgtgaggtggcccaggcccagacagaggtgatgtggtacaaggatggcaagaagctgagcagcagcagcaagatgagggtggaggccgtgggctgcacccggcggctggtggtgcaggaggccggccaggctgatgctggggagtacagctgtgaggccggcggccagaggctgtccttccacctgcacgtggccgagcccaaggtggtgtttgccaaggagcagcctgcctgccgggaggtgcaggccgaggccggggccagcgccaccctgagctgtgaggtggcccagggccagatggaggtgacctggtacaaggatggcaagaagctgagcagcagcagcaaggtgcacatggaggccagcggctacacccggcggctggtggtgcagcaggccggccaggctgatgctggggagtacagctgtgaggccggcggccagaggctgtccttccggctgcacgtggccgagctggagccccagatcagcgagcggccctgcagaagagagcccctggtggtgaaggagcacgaggacatcatcctgacagccaccctggccaccccatctgctgccaccgtgacctggctgaaggatggagtggagatcagaagaagcaagagacatgaaacagccagccagggcgacacccacaccctgactgtgcacggggcccaggtgctggacagcgccatctacagctgccgggtgggcgctgagggccaggacttccctgtgcaggtggaggaggtggccgccaagttctgccgcctgctggagcctgtgtgtggggagctgggcggcaccgtgaccctggcctgtgagctgagccctgcctgtgccgaggtggtgtggaggtgtggcaacacccagctgcgggtgggcaagcgcttccagatggtggccgagggccctgtgcgcagcctgactgtgctgggcctgcgggcagaagatgctggggagtatgtgtgtgagagcagagatgaccacaccagcgcccagctgactgtgtctgtgccccgggtggtgaagttcatgagcggcctgagcacagtggtggccgaggagggcggggaggccaccttccagtgtgtggtgagccccagtgatgtggccgtggtgtggttcagagatggagccctgctgcagcccagcgagaagtttgccatcagccagagcggggccagccacagcctgaccatcagtgacctggtgctggaggatgctggccagatcaccgtggaggccgagggcgccagcagcagcgctgccctgcgggtgcgggaggcccctgtgctcttcaagaagaagctggagccccagacagtggaggagaggagctctgtgaccctggaggtggagctgacccggccctggccagagctgcgctggaccagaaatgccacagccctggcccctgggaagaatgtggagatccacgccgagggcgcccggcaccggctggtgctgcacaacgtgggctttgctgaccggggcttcttcggctgtgagaccccagatgacaagacccaggccaagctgactgtggagatgaggcaggtgcggctggtgcggggcctgcaggccgtggaggcccgggagcagggcacagccaccatggaggtgcagctgagccatgctgatgtggatggctcctggaccagagatggcctgcgcttccagcagggccccacctgccacctggccgtgcggggccccatgcacaccctgaccctgagcggcctgcggcctgaggacagcggcctgatggtgttcaaggccgagggcgtgcacaccagcgcccggctggtggtgacagagctgcctgtgtccttcagccggcccctgcaggatgtggtgaccacagagaaggagaaggtgaccctggagtgtgagctgagccggcccaacgtggatgtgcgctggctgaaggatggagtggagctgcgggccggcaagaccatggccatcgccgcccagggcgcctgccgcagcctgaccatctaccgctgtgaatttgctgaccagggcgtgtatgtgtgtgatgcccatgatgcccagagcagcgcctctgtgaaggtgcagggccgcacctacaccctcatctacagaagagtgctggccgaggatgctggggagatccagtttgtggccgagaatgctgagagccgggcccagctgcgggtgaaggagctgcctgtgaccctggtgcggcccctgcgggacaagatcgccatggagaagcaccggggcgtgctggagtgccaggtgtcccgggccagcgcccaggtgcgctggttcaagggcagccaggagctgcagcccggccccaagtatgagctggtgtctgatggcctgtacaggaagctgatcatcagtgatgtgcatgctgaagatgaggacacctacacctgtgatgctggagatgtgaagaccagcgcccagttctttgtggaggagcagagcatcaccatcgtgcggggcctgcaggatgtgacagtgatggagcccgccccagcctggtttgaatgtgagaccagcatccccagcgtgcggccccccaagtggctgctgggcaagacagtgctgcaggccggcggcaatgtgggcctggagcaggagggcaccgtgcaccggctgatgctgcggaggacctgcagcaccatgactggacctgtgcacttcaccgtgggcaagagccgcagcagcgcccggctggtggtgtctgacatccctgtggtgctgacccggcccctggagcccaagacaggccgggagctgcagagcgtggtgctgagctgtgacttccggcctgcccccaaggctgtgcagtggtacaaggatgacacccccctgagccccagcgagaagttcaagatgagcctggagggccagatggccgagctgcgcatcctgcggctgatgccagcagatgctggggtgtaccgctgccaggccggcagcgcccacagcagcacagaggtgacagtggaggcccgggaggtgacagtgacaggccccctgcaggatgctgaggccacagaggagggctgggccagcttcagctgtgagctgagccatgaagatgaggaggtggagtggagcctgaatggcatgcccctgtacaatgacagcttccacgagatcagccacaagggcagaagacacaccctggtgctgaagagcatccagagagcagatgctggcatcgtgcgggccagcagcctgaaggtgtccaccagcgcccggctggaggtgcgggtgaagcctgtggtgttcctgaaggccctggatgacctgtctgctgaggagcggggcaccctggccctgcagtgtgaggtgtctgaccctgaggcccacgtggtgtggaggaaggatggagtgcagctgggccccagcgacaagtatgacttcctgcacacagctggcacccggggcctggtggtgcatgatgtgtccccagaagatgctggcctgtacacctgccacgtgggcagcgaggagacccgggcccgggtgcgggtgcatgacctgcacgtgggcatcaccaagaggctgaagaccatggaggtgctggagggggagagctgcagctttgaatgtgtgctgagccatgagagcgccagtgaccctgccatgtggacagtgggcggcaagacagtgggcagcagcagccgcttccaggccacccggcagggcaggaagtacatcctggtggtgcgggaggccgcccccagtgatgctggggaggtggtgttttctgtgcggggcctgaccagcaaggccagcctcatcgtgcgggagaggcctgctgccatcatcaagcccctggaggaccagtgggtggcccctggagaagatgtggagctgcgctgtgagctgagccgggccggcacccctgtgcactggctgaaggacaggaaggccatcaggaagagccagaagtatgatgtggtgtgtgagggcaccatggccatgctggtgatccggggggccagcctgaaggatgctggggagtacacctgtgaggtggaggccagcaagagcacagccagcctgcacgtggaggagaaggccaactgcttcacagaggagctgaccaacctgcaggtggaggagaagggcacagctgtgttcacctgcaagacagagcaccctgctgccaccgtgacctggaggaagggcctgctggagctgcgggccagcggcaagcaccagcccagccaggagggcctgaccctgcggctgaccatcagcgccctggagaaggctgacagcgacacctacacctgtgacatcggccaggcccagagccgggcccagctgctggtgcagggccggcgggtgcacatcatcgaggacctggaggatgtggatgtgcaggagggcagcagcgccaccttccgctgccgcatcagccctgccaactatgagcctgtgcactggttcctggacaagacccccctgcacgccaatgagctgaatgaaattgatgcccagcccggcggctaccacgtgctgaccctgcggcagctggccctgaaggacagcggcaccatctactttgaagctggggaccagagggccagcgctgccctgcgggtgacagagaagcccagcgtcttcagccgggagctgacagatgccaccatcacagaaggagaggacctgaccctggtgtgtgagaccagcacctgtgacatccctgtgtgctggaccaaggatggcaagaccctgcggggcagcgcccgctgccagctgagccatgagggccaccgggcccagctgctgatcaccggggccaccctgcaggacagcggccgctacaagtgtgaggccggcggggcctgcagcagcagcatcgtgcgggtgcacgcccggcctgtgcgcttccaggaggccctgaaggacctggaggtgctggagggcggggccgccaccctgcgctgtgtgctgagctctgtggccgcccctgtgaagtggtgctacggcaacaacgtgctgcggcctggggacaagtacagcctgcggcaggagggcgccatgctggagctggtggtgaggaacctgcggccccaggacagcggccgctacagctgcagctttggagaccagaccaccagcgccaccctgactgtgacagccctgcctgcccagttcatcggcaagctgaggaacaaggaggccacagaaggagccacagccaccctgcgctgtgagctgagcaaggccgcccctgtggagtggaggaagggcagcgagaccctgagagatggagaccgctactgcctgcggcaggatggagccatgtgtgagctgcagatccggggcctggccatggtggatgctgctgagtacagctgtgtgtgtggggaggagaggaccagcgccagcctgaccatccggcccatgcctgcccacttcatcggccgcctgcggcaccaggagagcattgaaggagccacagccaccctgcgctgtgagctgagcaaggccgcccctgtggagtggaggaagggccgggagagcctgagagatggagacagacacagcctgcggcaggatggagctgtgtgtgagctgcagatctgtggcctggccgtggctgatgctggggagtacagctgtgtgtgtggggaggagaggaccagcgccaccctgactgtgaaggccctgcctgccaagttcacagagggcctgagaaatgaggaggccgtggagggcgccacagccatgctgtggtgtgagctgagcaaggtggcccctgtggagtggaggaagggccctgagaacctgagagatggagaccgctacatcctgcggcaggagggcacccgctgtgagctgcagatctgtggcctggccatggctgatgctggggagtacctgtgtgtgtgtggccaggagaggaccagcgccaccctgaccatccgggccctgcctgcccgcttcattgaagatgtgaagaaccaggaggcccgggagggcgccacagctgtgctgcagtgtgagctgaacagcgctgcccctgtggagtggaggaagggcagcgagaccctgagagatggagaccgctacagcctgcggcaggacggcaccaagtgtgagctgcagatccggggcctggccatggctgacaccggggagtacagctgtgtgtgtggccaggagaggaccagcgccatgctgactgtgcgggccctgcccatcaagttcacagagggcctgagaaatgaggaggccacagaaggagccacagctgtgctgcgctgtgagctgagcaagatggcccctgtggagtggtggaagggccacgagaccctgagagatggagacagacacagcctgcggcaggatggagcccgctgtgagctgcagatccggggcctggtggccgaggatgctggggagtacctgtgcatgtgtgggaaggagaggaccagcgccatgctgactgtgcgggccatgcccagcaagttcatcgagggcctgagaaatgaggaggccacagaaggagacacagccaccctgtggtgtgagctgagcaaggccgcccctgtggagtggaggaagggccacgagaccctgagagatggagacagacacagcctgcggcaggacggcagccgctgtgagctgcagatccggggcctggccgtggtggatgctggggagtacagctgtgtgtgtggccaggagaggaccagcgccaccctgactgtgcgggccctgcctgcccgcttcattgaagatgtgaagaaccaggaggcccgggagggcgccacagctgtgctgcagtgtgagctgagcaaggccgcccctgtggagtggaggaagggcagcgagaccctgcggggcggggaccgctacagcctgcggcaggacggcacccgctgtgagctgcagatccacggcctgtctgtggccgacaccggggagtacagctgtgtgtgtggccaggagaggaccagcgccaccctgactgtgcgggccctgcctgcccggcacagccgctctgaggaccagggcggcctgcggcggggccacagctacacagctgtgtag

SEQ ID NO: 19534 - DNA, 1449 bp, Artificial Sequence
  Description of Artificial Sequence: Synthetic coding sequence
atggtgatggagaagcccagccccctgctggtgggccgggagtttgtgcggcagtactacaccctgctgaacaaggcccctgagtacctgcaccgcttctacggcaggaacagcagctatgtgcacggcggcgtggatgccagcggcaagccccaggaggccgtgtatggccagaatgacatccaccacaaggtgctgagcctgaacttcagcgagtgccacaccaagatcagacatgtggatgcccacgccaccctgagtgatggagtggtggtgcaggtgatgggcctgctgagcaacagcggccagcctgagaggaagttcatgcagacctttgtgctggcccctgagggctctgtgcccaacaagttctacgtgcacaatgacatgttccgctatgaagatgaggtgtttggagacagcgagcctgagctggatgaggagagtgaagatgaggtggaggaggagcaggaggagcggcagcccagccctgagcctgtgcaggagaatgccaacagcggctactatgaggcccaccctgtgaccaatggaattgaggagcccctggaggagagcagccatgagcctgagcctgagcctgagagcgagaccaagacagaggagctgaagccccaggtggaggagaagaacctggaggagctggaggagaagagcaccaccccacctcctgctgagcctgtgtccctgccccaggagccccccaaggccttctcctgggcctctgtgaccagcaagaacctgcccccatctggaacagtgagcagcagcggcatccccccccacgtgaaggcccctgtgtcccagccccgggtggaggccaagccagaggtgcagagccagcccccccgggtgcgggagcagaggccccgggagcggcccggcttccccccccggggccccaggcctggccgcggggacatggagcagaatgacagcgacaacagacgcatcatccgctacccagacagccaccagctgtttgtgggcaacctgccccatgacattgatgaaaatgagctgaaggagttcttcatgagctttggaaatgtggtggagctgcgcatcaacaccaagggcgtgggcggcaagctgcccaactttggatttgtggtgtttgatgacagcgagcctgtgcagaggatcctgattgccaagcccatcatgttccggggggaggtgcggctgaatgtggaggagaagaagaccagggctgcccgggagcgggagacccggggcggcggagatgaccggcgggacatcagaagaaatgaccggggccctgggggcccccggggcatcgtgggcggcggcatgatgagggacagagatggccggggccccccaccccggggcggcatggcccagaagctgggcagcggccggggcaccggccagatggagggccgcttcaccggccagaggaggtag

SEQ ID NO: 19535 - DNA, 807 bp, Artificial Sequence
  Description of Artificial Sequence: Synthetic coding sequence
atgagcggcaggaagaggagcttcaccttcggggcctatggaggagtggacaagagcttcaccagcagaagatctgtgtggaggagtgatggccagaaccagcacttcccccaggccctggacctgagccgggtgaacctggtgcccagctacacccccagcctgtaccccaagaacacagacctgtttgagatgattgagaagatgcagggcagcaggatggatgagcagcgctgcagcttccccccacccctgaagacagaggaggactacatcccctaccccagcgtgcatgaggtgctgggccgggagggccccttccccctcatcctgctgccccagtttggaggctactggattgagggcaccaaccacgagatcaccagcatccctgagacagagcccctgcagagccccaccaccaaggtgaagctggagtgcaaccccacagcccgcatctacaggaagcacttcctgggcaaggagcacttcaactactacagcctggatgctgccctgggccacctggtgttcagcctgaagtatgatgtgattggagaccaggagcacctgcggctgctgctgcggaccaagtgcaggacctaccatgatgtgatccccatcagctgcctgacagagttccccaacgtggtgcagatggccaagctggtgtgtgaagatgtgaatgtggaccgcttctaccctgtgctgtaccccaaggccagccggctgattgtgacctttgatgaacatgtgatcagcaacaacttcaagtttggagtcatctaccagaagctgggccagtag

SEQ ID NO: 19536 - DNA, 606 bp, Artificial Sequence; identical to SEQ ID NO: 19014
  Description of Artificial Sequence: Synthetic coding sequence

SEQ ID NO: 19537 - DNA, 1707 bp, Artificial Sequence
  Description of Artificial Sequence: Synthetic coding sequence
atgggcctgctgaccttcagagatgtggccatcgagttcagcctggaggagtggcagtgcctggacacagcccagaggaacctgtacaagaatgtcatcctggagaactacagaaacctggtgttcctgggcattgctgtgtccaagcaggacctgatcacctgcctggagcaggagaaggagcccctgactgtgaagagacatgagatggtgaatgagccccctgtgatgtgcagccactttgcccaggagttctggccagagcagaacatcaaggacagctttgagaaggtgaccctgcggcgctatgaaaaatgtggaaatgacaacttccagctgaagggctgcaagtctgtggatgagtgcaagctgcacaagggcggctacaacggcctgaaccagtgcctgcccaccatgcagagcaagatgttccagtgtgacaagtatgtgaaggtgttcaacaagttcagccacagcgacagacacaagatcaagcacatggagaacaagcccttcaagtgcaaggaatgtggccgctccttctgcatgctgagccacctgaccaggcatgagaggaactacaccaaggtgaacttctgcaagtgtgaggagtgtgagaaggctgtgaaccagagcagcaagctgaccaagcacaagaggatctacacctgtgagaagctgtacaagtgccaggagtgtgacaggaccttcaaccagttcagcaacctgacagagtacaagaaggactatgcccgggagaagccctacaagtgtgaggagtgtgggaaggccttcaaccagagcagccacctgaccacccacaagatcatccacactggagagaagccctacaagtgtgaggagtgtgggaaggccttcaaccagttcagcaacctgaccacccacaagaagatccacactggagagcagccctacatctgtgaggagtgtgggaaggccttcacccagagcagcaccctgaccacccacaagaggatccacactggagagaagccctacaagtgtgaggagtgtgggaaggccttcaacagaagcagcaagctgacagagcacaagaacatccacactggagagcagccctacaagtgtgaggagtgtgggaaggccttcaacagaagcagcaacctgacagagcacaggaagatccacacagaggagaagccctacaagtgcaaggaatgtgggaaggccttcaagcacagcagcgccctgaccacccacaagaggatccacactggagagaagccctacaagtgtgaggagtgtgggaaggccttcaacagaagcagcaagctgacagagcacaagaagctgcacacaggcaagaagccctacaagtgtgaggagtgtgggaaggccttcatccagagcagcaagctgacagagcacaagaagatccacagcggggagatcccctacaagtgtgaggagtgtgggaaggccttcaagcacagcagcagcctgaccacccacaagaggatccacactggagagaagccctacaagtgtgaggagtgtgggaaggccttcagccgcagcagcaagctgacagagcacaagatcatccacactggagagaagccctacaagtgtgagcgctgtgacaaggccttcaaccagagcgccaacctgaccaagcacaagaagatccacactggagagaagctgcagaactggaatgtgtag

SEQ ID NO: 19538 - DNA, 1383 bp, Artificial Sequence
  Description of Artificial Sequence: Synthetic coding sequence
atggattctgagctgatgcacagcatcgtgggcagctaccacaagcccccagagcgggtgtttgtgcccagcttcacccagaatgagcccagccagaactgccacccagccaacctggaggtgaccagccccaagatcctgcacagccccaacagccaggccctgatcctggccctgaagaccctgcaggagaagatccaccggctggagctggagaggacccaggccgaggacaacctgaacatcctgagccgggaggccgcccagtacaagaaggccctggagaatgagaccaatgaaagaaacctggcccaccaggagctgatcaagcagaagaaggacatcagcatccagctgagcagcgcccagagccgctgcaccctgctggagaagcagctggagtacaccaagaggatggtgctgaatgtggagcgggagaagaacatgatcctggagcagcaggcccagctgcagcgggagaaggagcaggaccagatgaagctgtatgccaagctggagaagctggatgtgctggagaaggagtgcttccggctgaccaccacccagaagacagctgaggacaagatcaagcacctggaggagaagctgaaggaggaggagcaccagaggaagctgttccaggacaaggccagcgagctgcagacaggcctggagatcagcaagatcatcatgagctctgtgagcaacctgaagcacagcaaggagaagaagaagagcagcaagaagaccaagtgcatcaagagaagaccaccctggcagatctgcagcaagtttggagccctgccctttgtggccgagaagatgaggcagcaccgggacccccacatcctgcagaagcccttcaacgtgacagagacccgctgcctgcccaagcccagcaggaccacctcctggtgcaaggccatccccccagattctgagaagagcatcagcatctgtgacaacctgtctgagctgctgatggccatgcaggatgagctggaccagatgtccatggagcaccaggagctgctgaagcagatgaaggagacagagagccacagcgtgtgtgatgacattgaatgtgagctggagtgcctgctgaagaagatggagatcaagggggagcagatcagcaagctgaagaagcaccaggacagcgtgtgcaagctgcagcagaaggtgcagaacagcaagatgtctgaggccagcggcatccagcaggaggacagctaccccaagggcagcaagaacatcaagaacagccccaggaagtgcctgacagacaccaacctcttccagaagaacagcagcttccaccccatccgggtgcacaacctgcagatgaagctgcggagagatgacatcatgtgggagcagtag

SEQ ID NO: 19539 - DNA, 1833 bp, Artificial Sequence
  Description of Artificial Sequence: Synthetic coding sequence
atgagccagaccagcctgaagcagaagaagaatgaacctggcatgaggagcagcaaggagagcctggaggccgagaagaggaaggagagtgacaagacaggagtgcggctgagcaaccagatgagaagagctgtgaaccccaaccacagcctgcgctgctgccccttccagggccacagcagctgccgccgctgcctgtgtgccgctgagggcacagccctgggcccctgccacaccatccgcatctacatccacatgtgcctgctgtgggagcagggccagcagatcaccatgatgaggggcagccaggagagcagcctgaggaagacagacagccggggctacctggtgcgcagccagtggagccgcatcagccgcagccccagcaccaaggcccccagcattgatgagcccaggagcaggaacaccagcgccaagctgcccagcagcagcaccagcagcaggacccccagcaccagccccagcctgcatgacagcagccccccacccctgagcggccagcccagcctgcagcccccagccagcccccagctgcccaggagcctggacagcaggcctcccaccccacctgagccagaccccggcagccgccgcagcaccaagatgcaggagaaccctgaggcctgggcccagggcatcgtgcgggagatccggcagacccgggacagccagcccctggagtacagcaggaccagccccacagagtggaagagcagcagccagaggcggggcatctacccagccagcacccagctggacaggaacagcctgtctgagcagcagcagcagcagagagaagatgaagatgattatgaggccgcctactgggcctccatgaggagcttctatgagaagaaccccagctgcagccggccctggccacccaagcccaagaatgccatcaccatcgccctgagcagctgtgccctcttcaacatggtggatggcaggaagatctatgagcaggagggcctggagaagtacatggagtaccagctgaccaatgaaaatgtcatcctgaccccaggccctgccttccgctttgtgaaggccctgcagtatgtgaatgcccggctgcgggacctgtacccagatgagcaggacctgtttgatattgtgctgatgaccaacaaccacgcccaggtgggcgtgcggctcatcaacagcgtgaaccactacggcctgctgattgaccgcttctgcctgaccggcggcaaggaccccatcggctacctgaaggcctacctgaccaacctgtacatcgctgctgacagcgagaaggtgcaggaggccatccaggagggcatcgccagcgccaccatgtttgatggagccaaggacatggcctactgtgacacccagctgcgggtggcctttgatggagatgctgtgctcttcagtgatgaaagtgagcacttcaccaaggagcacggcctggacaagttcttccagtatgacaccctgtgtgagagcaagcccctggcccagggccccctgaagggcttcctggaggacctgggccgcctgcagaagaagttctacgccaagaatgaaaggctgctgtgccccatccgcacctacctggtgacagcccggtctgctgccagcagcggggcccgggtgctgaagaccctgcggcgctggggcctggagattgatgaggccctcttcctggccggggcccccaagagccccatcctggtgaagatccggccccacatcttctttgatgaccacatgttccacatcgagggcgcccagaggctgggcagcattgctgcctacggcttcaacaagaagttcagcagctag

SEQ ID NO: 19540 - DNA, 456 bp, Artificial Sequence
  Description of Artificial Sequence: Synthetic coding sequence
atgagcaagaacacagtgagcagcgcccgcttcaggaaggtggatgtggatgaatatgatgagaacaagtttgtggatgaggaggatggaggagatggccaggccggcccagatgaaggagaggtggacagctgcctgcggcagggcaacatgacagctgccctgcaggccgccctgaagaacccccccatcaacaccaagagccaggccgtgaaggacagagctggcagcatcgtgctgaaggtgctgatctccttcaaggccaatgacatcgagaaggctgtgcagagcctggacaagaatggagtggacctgctgatgaagtacatctacaagggctttgagagccccagcgacaacagcagcgccatgctgctgcagtggcatgagaaggccctggccgccggcggcgtgggcagcatcgtgcgggtgctgacagccaggaagacagtgtag

SEQ ID NO: 19541 - DNA, 3522 bp, Artificial Sequence
  Description of Artificial Sequence: Synthetic coding sequence
atggtgacagtgggcaccaacatcctgcccagcaggcctgctgccagcgccaacacagcccgggaggatgctgccctcttcagccgccgcatcccccccaggcacaagaatggagctgcccagcccggggccgcccctggccctggggcccctggggccaacatgggaaatgcccacagcaagagcggggacagacattctgccctgcccggccggcctgagctgtccttctacggcagcttccccaggaagtggagcgaaaatgtgttcctggacaatgagctgctgaccagcaagatcctgtctgtgctgcggccccagagcgagcggggcttccgggccggggacctgcgctaccccacccacttcctgagcaccaacagcgtgctggcctctgtgacagccagcctgaaggagcacccccggggcaccctgctgagtgatggcagccctgccctgagcagaaatgtgggcatgacagtgtcccagaagggcggcccccagcccacccccagccctgctggccctggcacccagctgggccccatcaccggggagatggatgaggccgacagcgccttcctgaagttcaagcagacagcagatgacagcctgagcctgaccagccccaacacagagagcatctttgtggaggacccctacacagccagcctgcggagtgaaattgaaagtgatggccacgagtttgaggccgagagctggagcctggccgtggatgctgcctatgccaagaagcagaagcgggaggtggtgaagaggcaggatgtgctgtatgagctgatgcagacagaggtgcaccacgtgaggaccctgaagatcatgctgaaggtgtacagccgggccctgcaggaggagctgcagttcagcagcaaggccatcggccgcctcttcccctgtgctgatgacctgctggagacccacagccacttcctggcccggctgaaggagcggcggcaggagagcctggaggagggcagtgacagaaattatgtgatccagaagatcggggacctgctggtgcagcagttctctggagaaaatggagagaggatgaaggagaagtatggagtcttctgcagcggccacaatgaggccgtgagccactacaagctgctgctgcagcagaacaagaagttccagaacctgatcaagaagattggcaacttcagcatcgtgcggcggctgggcgtgcaggagtgcatcctgctggtgacccagaggatcaccaagtaccctgtgctggtggagcgcatcatccagaacacagaagctggaacagaggactatgaggacctgacccaggccctgaacctgatcaaggacatcatcagccaggtggatgccaaggtgtctgaatgtgagaagggccagaggctgcgggagattgctgggaagatggacctgaagagcagcagcaagctgaagaatggcctgaccttcaggaaggaggacatgctgcagaggcagctgcacctggagggcatgctgtgctggaagaccaccagcggccgcctgaaggacatcctggccatcctgctgacagatgtgctgctgctgctgcaggagaaggaccagaagtatgtgtttgcctctgtggacagcaagccccctgtgatcagcctgcagaagctgattgtgcgggaggtggccaatgaggagaaggccatgttcctgatcagcgccagcctgcagggccctgagatgtatgagatctacaccagcagcaaggaggacagaaatgcctggatggcccacatccagagagctgtggagagctgcccagatgaggaggagggccccttcagcctgcctgaggaggagaggaaggtggtggaggcccgggccacccggctgcgggacttccaggagcggctgtccatgaaggaccagctgattgcccagagcctgctggagaagcagcagatctacctggagatggccgagatgggcggcctggaggacctgccccagccccggggcctcttccggggcggggaccccagcgagaccctgcagggcgagctgatcctgaagagcgccatgtctgaaattgagggcatccagagcctcatctgccggcagctgggcagcgccaacggccaggccgaggatggcggcagcagcacaggccccccccggcgggcagagacctttgctggctatgactgcaccaacagccccaccaagaatggcagcttcaagaagaaggtgagcagcacagacccccggccccgggactggaggggcccccccaacagcccagacctgaagctgagtgacagcgacatccctggcagcagcgaggagagcccccaggtggtggaggcccctggaacagaaagtgacccccggctgcccaccgtgctggagagcgagctggtgcagaggatccagaccctgagccagctgctgctgaacctgcaggccgtcatcgcccaccaggacagctatgtggagacccagagagctgccatccaggagcgggagaagcagttccggctgcagagcacccggggcaacctgctgctggagcaggagcggcagaggaactttgagaagcagcgggaggagcgggccgccctggagaagctgcagagccagctgcggcatgagcagcagcgctgggagcgggagcggcagtggcagcaccaggagctggagcgggccggggcccggctgcaggagcgggagggggaggcccggcagctgcgggagcggctggagcaggagagagctgagctggagcggcagaggcaggcctaccagcacgacctggagcggctgcgggaggcccagagagctgtggagcgggagcgggagcggctggagctgctgcggcggctgaagaagcagaacacagcccctggggccctgcccccagacaccctggccgaggcccagccccccagccaccccccatccttcaatggagagggcctggagggcccccgggtgtccatgctgcccagcggcgtgggcccagaatatgcagagaggcctgaggtggcccggcgggacagcgcccccacagagaaccggctggccaagagtgatgtgcccatccagctgctgagcgccaccaaccagttccagaggcaggccgctgtgcagcagcagatccccaccaagctggccgccagcaccaagggcggcaaggacaagggcggcaagagccggggcagccagcgctgggagagcagcgccagctttgacctgaagcagcagctgctgctgaacaagctgatgggcaaggatgagagcaccagcaggaacagaagaagcctgagccccatcctgcccggccgccacagccctgcccctcctccagaccccggcttccctgcccccagccccccacctgctgacagccccagcgagggcttcagcctgaaggccggcggcacagccctgctgcccggccccccagcccccagccccctgcctgccacccccctgagcgccaaggaggatgccagcaaggaggatgtgatcttcttctag

SEQ ID NO: 19542 - DNA, 1674 bp, Artificial Sequence
  Description of Artificial Sequence: Synthetic coding sequence
atggacagcacagtgcccagcgccctggagctgccccagaggctggccctgaacccccgggagagccccaggagccctgaggaggaggagccccacctgctgagcagcctggccgctgtgcagaccctggccagcgtcatccggccctgctacggcccccacggccggcagaagttcctggtgaccatgaagggggagaccgtgtgcaccggctgtgccacagccatcctgcgggccctggagctggagcaccctgctgcctggctgctgcgggaggccggccagacccaggctgaaaattctggagatggaacagcctttgtggtgctgctgacagaggccctgctggagcaggccgagcagctgctgaaggccggcctgccccggccccagctgcgggaggcctatgccacagccacagctgaggtgctggccaccctgcccagcctggccatccagagcctgggccccctggaggaccccagctgggccctgcacagcgtgatgaacacccacaccctgagccccatggaccacctgaccaagctggtggcccacgcctgctgggccatcaaggagctggatggcagcttcaagccagagcgggtgggcgtgtgtgccctgcccggcggcaccctggaggacagctgcctgctgcccggcctggccatcagcggcaagctgtgtggccagatggccaccgtgctgagcggggcccgggtggccctgtttgcctgccccttcggccctgcccaccccaatgccccagccacagcccggctgagcagccctgctgacctggcccagttcagcaagggcagtgaccagctgctggagaagcaggtgggccagctggccgccgccggcatcaacgtggccgtggtgctgggggaggtggatgaggagaccctgaccctggccgacaagtatggcatcgtggtgatccaggcccgctcctggatggagatcatctacctgtctgaggtgctggacacccccctgctgccccggctgctgcccccccagaggcctgggaagtgccagagggtgtaccggcaggagctgggagatggcctggccgtggtgtttgagtgggagtgcaccggcaccccagccctgactgtggtgctgcggggggccaccacccagggcctgcggtctgctgagcaggccgtgtaccacggcattgatgcctacttccagctgtgccaggaccccaggctcatccctggggccggggccacagagatggccctggccaagatgctgagtgacaagggcagccggctggagggccccagcggccctgccttcctggcctttgcctgggccctgaagtacctgcccaagaccctggccgagaatgccggcctggccgtgtctgatgtgatggccgagatgtctggagtgcaccagggcggcaacctgctgatgggcgtgggcacagagggcatcatcaacgtggcccaggagggcgtgtgggacaccctcatcgtgaaggcccagggcttccgggctgtggccgaggtggtgctgcagctggtgacagtggatgagatcgtggtggccaagaagagccccacccaccaggagatctggaacccagacagcaagaagaccaagaagcaccccccacctgtggagaccaagaagatcctgggcctgaacaactag

SEQ ID NO: 19543 - DNA, 939 bp, Artificial Sequence
  Description of Artificial Sequence: Synthetic coding sequence
atgaccaggagcctcttcaagggcaacttctggagcgctgacatcctgagcaccatcggctatgacaacatcatccagcacctgaacaacggcaggaagaactgcaaggagtttgaggacttcctgaaggagcgggccgccatcgaggagagatatggcaaggacctgctgaacctgagcaggaagaagccctgtggccagagcgagatcaacaccctgaagagggccctggaggtgttcaagcagcaggtggacaacgtggcccagtgccacatccagctggcccagagcctgcgggaggaggccaggaagatggaggagttccgggagaagcagaagctgcagaggaagaagacagagctgatcatggatgccatccacaagcagaagagcctgcagttcaagaagaccatggatgccaagaagaactatgagcagaagtgccgggacaaggatgaggccgagcaggccgtgagccgcagcgccaacctggtgaaccccaagcagcaggagaagctgtttgtgaagctggccaccagcaagacagctgtggaggacagcgacaaggcctacatgctgcacatcggcaccctggacaaggtgcgggaggagtggcagagcgagcacatcaaggcctgtgaggcctttgaggcccaggagtgtgagcgcatcaacttcttcagaaatgccctgtggctgcacgtgaaccagctgagccagcagtgtgtgaccagtgatgagcaccccagctgcatgaggatcagcaccccacccaggaggatgcagagccagcaggagcggctgcagggcctgacctggcagggcgaggaccccagccagttcctgaaggcccaccagatgatccccatcaccctgtggctgatgaccaccgtgtgcagcatcagcaagatcaatgagacccgggccttctctggatag

SEQ ID NO: 19544 - DNA, 3693 bp, Artificial Sequence
  Description of Artificial Sequence: Synthetic coding sequence
atgcccaggaagggcacccagcccagcacagccaggagaagagaggagggccccccaccacccagcccagatggagccagcagtgatgctgagcctgagccccccagcggccgcacagagagccctgccacagctgctgagacagccagcgaggagctggacaacagaagcctggaggagatcctgaacagcatccccccacctcctcctccagccatgaccaatgaagctggggccccccggctgatgatcacccacatcgtgaaccagaacttcaagagctatgctggggagaagatcctgggccccttccacaagcgcttcagctgcatcatcggccccaatggaagtggcaagagcaatgtgattgacagcatgctgtttgtgtttggctaccgggcccagaagatccgcagcaagaagctgtctgtgctgatccacaacagtgatgagcacaaggacatccagagctgcaccgtggaggtgcacttccagaagatcatcgacaaggagggagatgattatgaagtcatccccaacagcaacttctacgtgtccaggacagcctgccgggacaacacctctgtgtaccacatcagcggcaagaagaagaccttcaaggatgtgggcaacctgctgcggagccacggcatcgacctggaccacaaccgcttcctgatcctgcagggcgaggtggagcagatcgccatgatgaagcccaagggccagacagaacatgatgagggcatgctggagtacctggaggacatcatcggctgcggccgcctgaatgagcccatcaaggtgctgtgccggcgggtggagatcctgaatgagcacagaggagagaagctgaacagagtgaagatggtggagaaggagaaggatgccctggagggggagaagaacatcgccatcgagttcctgaccctggagaatgagatcttcaggaagaagaaccacgtgtgccagtactacatctatgagctgcagaagagaattgctgagatggagacccagaaggagaagatccacgaggacaccaaggagatcaatgagaagagcaacatcctgagcaatgagatgaaggccaagaacaaggatgtgaaggacacagagaagaagctgaacaagatcaccaagttcatcgaggagaacaaggagaagttcacccagctggacctggaggatgtgcaggtgcgggagaagctgaagcacgccaccagcaaggccaagaagctggagaagcagctgcagaaggacaaggagaaggtggaggagttcaagagcatcccagccaagagcaacaacatcatcaatgagaccaccaccagaaataatgccctggagaaggagaaggagaaggaggagaagaagctgaaggaggtgatggacagcctgaagcaggagacccagggcctgcagaaggagaaggagagccgggagaaggagctgatgggcttcagcaagtctgtgaatgaggcccggagcaagatggatgtggcccagagcgagctggacatctacctgagccgccacaacacagctgtgtcccagctgaccaaggccaaggaggccctgattgctgccagcgagaccctgaaggagaggaaggccgccatccgggacatcgagggcaagctgccccagacagagcaggagctgaaggagaaggagaaggagctgcagaagctgacccaggaggagaccaacttcaagagcctggtgcatgacctcttccagaaggtggaggaggccaagagcagcctggccatgaacagaagccggggcaaggtgctggatgccatcatccaggagaagaagagcggccgcatccctggcatctacggccgcctgggggacctgggcgccattgatgagaagtatgatgtggccatcagcagctgctgccacgccctggactacatcgtggtggacagcattgacatcgcccaggagtgtgtgaacttcctgaagaggcagaacattggagtggccaccttcatcggcctggacaagatggctgtgtgggccaagaagatgacagagatccagaccccagagaacaccccccggctgtttgacctggtgaaggtgaaggatgagaagatccggcaggccttctactttgccctgcgggacaccctggtggccgacaacctggaccaggccaccagggtggcctaccagaaggaccggcgctggagggtggtgaccctgcagggccagatcatcgagcagagcggcaccatgactggaggcggcagcaaggtgatgaagggccgcatgggcagcagcctggtgattgagatcagcgaggaggaggtgaacaagatggagagccagctgcagaatgacagcaagaaggccatgcagatccaggagcagaaggtgcagctggaggagcgggtggtgaagctgcggcacagcgagcgggagatgaggaacaccctggagaagttcaccgccagcatccagaggctgattgagcaggaggagtacctgaatgtgcaggtgaaggagctggaggccaacgtgctggccacagccccagacaagaagaagcagaagctgctggaggagaatgtgtctgccttcaagacagaatatgatgctgtggccgagaaggccggcaaggtggaggccgaggtgaagaggctgcacaacaccatcgtggagatcaacaaccacaagctgaaggcccagcaggacaagctggacaagatcaacaagcagctggatgaatgtgccagcgccatcaccaaggcccaggtggccatcaagacagctgacaggaacctgcagaaggcccaggacagcgtgctgaggacagagaaggagatcaaggacacagagaaggaggtggatgacctgacagctgagctgaagagcctggaggacaaggctgctgaggtggtgaagaacaccaatgctgctgagatcagcaagatcagcctgcaccccatcgaggacaaccccatcgaggagatctctgtgctgagccctgaggacctggaggccatcaagaacccagacagcatcaccaaccagatcgccctgctggaggcccgctgccacgagatgaagcccaacctgggcgccatcgccgagtacaagaagaaggaggagctgtacctgcagagggtggccgagctggacaagatcacctatgagcgggacagcttccggcaggcctatgaggacctgaggaagcagaggctgaatgagttcatggccggcttctacatcatcaccaacaagctgaaggagaactaccagatgctgaccctgggcggagatgctgagctggagctggtggacagcctggaccccttcagcgagggcatcatgttttctgtgcggccccccaagaagtcctggaagaagatcttcaacctgagcggcggggagaagaccctgagcagcctggccctggtgtttgccctgcaccactacaagcccacccccctgtacttcatggatgaaattgatgctgccctggacttcaagaatgtgtccatcgtggccttctacatctatgagcagaccaagaatgcccagttcatcatcatcagcctgaggaacaacatgtttgagatcagtgaccggctgattggcatctacaagacctacaacatcaccaagtctgtggccgtgaaccccaaggagatcgccagcaagggcctgtgctag

SEQ ID NO: 19545 - DNA, 2661 bp, Artificial Sequence
  Description of Artificial Sequence: Synthetic coding sequence
atggagctgcgctgtggcggcctgctcttcagcagcagatttgacagcggcaacctggcccacgtggagaaggtggagagcctgagcagtgatggagagggcgtgggcggcggggccagcgccctgaccagcggcatcgccagcagcccagactatgagttcaacgtgtggaccaggccagactgtgccgagacagaatttgaaaatggaaacagatcctggttctacttctctgtgcggggcggcatgcctgggaagctgatcaagatcaacatcatgaacatgaacaagcagagcaagctgtacagccagggcatggccccctttgtgaggaccctgcccacccggccccgctgggagcgcatccgggaccggcccacctttgagatgacagagacccagtttgtgctgagctttgtgcacagatttgtggagggccgcggggccaccaccttctttgccttctgctaccccttctcctacagcgactgccaggagctgctgaaccagctggaccagcgcttccctgagaaccaccccacccacagcagccccctggacaccatctactaccaccgggagctgctgtgctacagcctggatggcctgcgggtggacctgctgaccatcaccagctgccacggcctgcgggaggaccgggagccccggctggagcagctgttcccagacaccagcaccccccggcccttccgctttgctgggaagaggatcttcttcctgagcagccgggtgcaccctggagagacccccagcagctttgtgttcaacggcttcctggacttcatcctgcggccagatgacccccgggcccagaccctgcggcggctgtttgtgttcaagctgatccccatgctgaacccagatggagtggtgcggggccactacagaacagacagccggggcgtgaacctgaaccggcagtacctgaagccagatgctgtgctgcacccagccatctatggagccaaggctgtgctgctgtaccaccacgtgcacagccggctgaacagccagagcagcagcgagcaccagcccagcagctgcctgcccccagatgcccctgtgtctgacctggagaaggccaacaacctgcagaatgaggcccagtgtggccacagcgctgacagacacaatgctgaggcctggaagcagacagagcctgctgagcagaagctgaacagcgtgtggatcatgccccagcagagcgctggcctggaggagagcgccccagacaccatcccccccaaggagagcggcgtggcctactacgtggacctgcacggccacgccagcaagaggggctgcttcatgtatggcaacagcttcagtgatgagagcacccaggtggagaacatgctgtaccccaagctgatcagcctgaacagcgcccactttgacttccagggctgcaacttcagcgagaagaacatgtatgcccgggacagaagagatggccagagcaaggagggcagcggccgggtggccatctacaaggccagcggcatcatccacagctacaccctggagtgcaactacaacacaggccgctctgtgaacagcatcccagctgcctgccacgacaatggccgggccagccccccacctcctccagccttccccagccgctacacagtggagctgtttgagcaggtgggccgggccatggccatcgccgccctggacatggccgagtgcaacccctggccccgcatcgtgctgtctgagcacagcagcctgaccaacctgcgggcctggatgctgaagcacgtgaggaacagccggggcctgagcagcaccctgaatgtgggcgtgaacaagaagaggggcctgcggaccccacccaagagccacaacggcctgcctgtgtcctgcagcgagaacaccctgagccgggcccgctccttcagcacaggcaccagcgctgggggcagcagcagcagccagcagaacagcccccagatgaagaacagccccagcttccccttccacggcagcaggcctgctggcctgcccggcctgggcagcagcacccagaaggtgacccaccgggtgctgggccctgtgcgggagcccaggagccaggacagaagacggcagcagcagcccctgaaccacaggcctgctggcagcctggcccccagccctgcccccaccagcagcggccctgccagcagccacaagctgggcagctgcctgctgcctgacagcttcaacatccctggcagcagctgcagcctgctgagcagcggggacaagccagaggccgtgatggtgattggcaagggcctgctgggcactggagccaggatgccctgcatcaagacccggctgcaggcccggccccggctgggccggggcagcccccccacccggcggggcatgaagggcagcagcggccccaccagccccacccccaggacccgggagagcagcgagctggagctgggcagctgcagcgccaccccaggcctgccccaggcccggcccccccggcccaggtctgccccagccttcagccccatcagctgcagcctgagtgacagccccagctggaactgctacagccggggccccctgggccagcctgaggtgtgctttgtgcccaagagcccccccctgactgtgagcccccgggtgtag

SEQ ID NO: 19546 - DNA, 4221 bp, Artificial Sequence; identical to SEQ ID NO: 19364
  Description of Artificial Sequence: Synthetic coding sequence

SEQ ID NO: 19547 - DNA, 1308 bp, Artificial Sequence
  Description of Artificial Sequence: Synthetic coding sequence
atgggagacctggagctgctgctgcctggagaggccgaggtgctggtgcggggcctgcgctccttccccctgcgggagatgggcagcgagggctggaaccagcagcacgagaacctggagaagctgaacatgcaggccatcctggatgccaccgtgtcccagggcgagcccatccaggagctgctggtgacccacggcaaggtgcccaccctggtggaggagctgattgctgtggagatgtggaagcagaaggtgtttcctgtgttctgccgggtggaggacttcaagccccagaacaccttccccatctacatggtggtgcaccacgaggccagcatcatcaacctgctggagaccgtcttcttccacaaggaggtgtgtgagagcgcagaagatactgtgctggacctggtggactactgccacaggaagctgaccctgctggtggcccagagcggctgcggcggccccccagagggggagggcagccaggacagcaaccccatgcaggagctgcagaagcaggccgagctgatggagtttgaaattgccctgaaggccctgtctgtgctgcgctacatcacagactgtgtggaccggcagtggagcgtgtcccagcccccccagctggcccacctgaagaggatccagaggctgcaccctgtgtgctggttcctgagccctgggaagctgcagcagtttgagggcagccgctggcacacagtggcccccagcgagcagcagaagctgagcaagctggatggccaggtgtggatcgccctgtacaacctgctgctgagccctgaggcccaggcccgctactgcctgaccagctttgccaagggccgcctgctgaagctgcgggccttcctgacagacaccctgctggaccagctgcccaacctggcccacctgcagagcttcctggcccacctgaccctgacagagacccagccccccaagaaggacctggtgctggagcagatccctgagatctgggagcggctggagagagaaaatagaggcaagtggcaggccatcgccaagcaccagctgcagcacgtgttcagccccagcgagcaggacctgcggctgcaggcccggcgctgggccgagacctaccgcctggatgtgctggaggccgtggcccctgagcggccccgctgtgcctactgcagcgctgaggccagcaagcgctgcagccgctgccagaatgagtggtactgctgccgggagtgccaggtgaagcactgggagaagcacggcaagacctgtgtgctggccgcccagggcgaccgggccaagtag

SEQ ID NO: 19548 - DNA, 1377 bp, Artificial Sequence
  Description of Artificial Sequence: Synthetic coding sequence
atgaatgaggccatggccacagacagcccccggcggcccagccgctgcacaggaggagtggtggtgcggccccaggccgtgacagagcagagctacatggagagcgtggtgaccttcctgcaggatgtggtgccccaggtgtactgctgcggggacaacatccagagctacacagccaccgtcatctctgctgccaagaccctgaagagcggcctgaccatggtgggcaaggtggtgacccagctgaccggcaccctgcccagcggcgtgacagaagatgatgtggccatccacagcaacagccgccgcagccccctggtgcccggcatcatcaccgtcatcgacacagagaccgtgggggagggccaggtgctggtgtctgaggacagcgacagtgatggcatcgtggcccacttccctgcccacgagaagcctgtgtgctgcatggccttcaacaccagcggcatgctgctggtgaccacagacaccctgggccatgacttccacgtgttccagatcctgacccacccctggagcagcagccagtgtgctgtgcaccacctgtacaccctgcacagaggagaaacagaggccaaggtgcaggacatctgcttcagccatgactgccgctgggtggtggtgtccaccctgcggggcaccagccacgtgttccccatcaacccctatggaggccagccctgtgtgaggacccacatgagcccccgggtggtgaacaggatgagccgcttccagaagtctgctggcctggaggagattgagcaggagctgaccagcaagcagggcggccgctgcagccctgtgcccggcctgagcagcagccccagcggcagccccctgcacggcaagctgaacagccaggacagctacaacaacttcaccaacaacaaccctggcaacccccggctgagccccctgcccagcctgatggtggtgatgcccctggcccagatcaagcagcccatgaccctgggcaccatcaccaagaggacaggcaaggtgaagcccccaccccagatcagccccagcaagtccatgggcggggagttctgtgtggccgccatcttcggcaccagccgctcctggtttgccaacaatgccggcctgaagcgggagaaggaccagagcaagcaggtggtggtggagagcctgtacatcatcagctgctacggcaccctggtggagcacatgatggagccccagcccctgaatggcatgaactgcagccaccggctgatgcagaccaccctgtgcagcagcctgcagatgcagtacagcatcatcagcagctgcctgctggcctggttccccctggaggtgctgggccccctgctggacatgggcctgaccaccgtgtag

SEQ ID NO: 19549 - DNA, 309 bp, Artificial Sequence
  Description of Artificial Sequence: Synthetic coding sequence
atgagggccagcccctgcatcagccagcctgctgcctcctggcacccccggcccagcgccctgcggcccacagctggcagcggccctgacaccaggaccccaggcaccgtggaggatggcagcgccccctgcccagccttccgcagccctgctgtgagcccctgtggggaggagccctgctgcttccagatcagccctgctgaggagaccctggagctgggccgcctggtgtccccaggctgccacaagagcagcgccccccaggagcggcggctggacccccgggcccgctgtgtggtgcacatctag

SEQ ID NO: 19550 - DNA, 4227 bp, Artificial Sequence; identical to SEQ ID NO: 19164
  Description of Artificial Sequence: Synthetic coding sequence

SEQ ID NO: 19551 - DNA, 2994 bp, Artificial Sequence
  Description of Artificial Sequence: Synthetic coding sequence
cggcccccacctgctggcccccaggcccctgagggcgcccgggccggcagcaggcctgtgcagctgctggccctgctgagctcctggtgtgaggagctgggccgcctgctgctgctgcggcaccagaagagccggcagagcgaccccccaggcaagctgcccatgcagccccccctgagctccatgagctccatgaagcccaccctgagccacagtgatggcagcttcccctatgacagcgtgccctggcagcagaacaccaaccagcccccaggcagcctgtctgtggtgaccaccgtgtggggcgtgaccaacaccagccagagccaggtgctgggcaaccccatggccaatgccaacaaccccatgaaccctgggggcaaccccatggccagcggcatgaccaccagcaaccctggcctgaacagcccccagtttgctggccagcagcagcagttcagcgccaaggccggccctgcccagccctacatccagcagagcatgtatggccggcccaactacccaggcagcggcggctttggagccagctacccaggcggccccaatgccccagctggcatgggcatccccccccacacccggcccccagctgacttcacccagcctgctgctgctgctgctgctgctgctgtggccgctgctgctgccacagccacagccacagccacagccaccgtggccgccctgcaggagacccagaacaaggacatcaaccagtatggccccatgggccccacccaggcctacaacagccagttcatgaaccagcccggcccccggggccctgcctccatgggcggctccatgaacccagcctccatggctgctggcatgacccccagcggcatgagcggcccccccatgggcatgaaccagccccggcccccaggcatcagccccttcggcacccacggccagaggatgccccagcagacctacccaggcccccggccccagagcctgcccatccagaacatcaagaggccctacccaggagagcccaactacggcaaccagcagtatggccccaacagccagttccccacccagcccggccagtacccagcccccaaccccccccggcccctgaccagccccaactacccaggccagaggatgcccagccagcccagcagcggccagtaccccccacccaccgtgaacatgggccagtactacaagccagagcagttcaacggccagaacaacaccttcagcggcagcagctacagcaactacagccagggcaatgtgaaccggccccccaggcctgtgcctgtggccaactacccccacagccctgtgcccggcaaccccaccccacccatgaccccaggcagcagcatccccccctacctgagccccagccaggatgtgaagccacccttccccccagacatcaagcccaacatgtctgccctgcccccacctccagccaaccacaatgatgagctgcggctgaccttccctgtgagagatggagtggtgctggagcccttccggctggagcacaacctggccgtgagcaaccacgtgttccacctgcggcccaccgtgcaccagaccctgatgtggaggagtgacctggagctgcagttcaagtgctaccaccacgaggaccggcagatgaacaccaactggccagcctctgtgcaggtgtctgtgaatgccacccccctgaccatcgagcggggggacaacaagaccagccacaagcccctgcacctgaagcacgtgtgccagcctggaagaaacaccatccagatcaccgtgacagcctgctgctgcagccacctgtttgtgctgcagctggtgcaccggcccagcgtgcgctctgtgctgcagggcctgctgaagaagaggctgctgcctgctgagcactgcatcaccaagatcaagaggaacttcagctctgtggccgccagcagcggcaacaccaccctgaatggagaagatggagtggagcagacagccatcaaggtgtccctgaagtgccccatcaccttccgccgcatccagctgcctgcccggggccatgactgcaagcacgtgcagtgctttgacctggagagctacctgcagctgaactgtgagcggggcacctggcgctgccctgtgtgcaacaagacagccctgctggagggcctggaggtggaccagtacatgtggggcatcctgaatgccatccagcacagcgagtttgaggaggtgaccatcgaccccacctgctcctggaggcctgtgcccatcaagagtgacctgcacatcaaggatgatcctgatggcatccccagcaagcgcttcaagaccatgagccccagccagatgatcatgcccaacgtgatggagatgattgctgccctgggccctggccccagcccctaccccctgcccccacctcctgggggcaccaacagcaatgactacagcagccagggcaacaactaccagggccacggcaactttgacttcccccacggcaaccctgggggcacctccatgaatgacttcatgcacggccccccccagctgagccaccccccagacatgcccaacaacatggccgccctggagaagcccctgagccaccccatgcaggagaccatgcctcatgctggcagcagtgaccagccccaccccagcatccagcagggcctgcacgtgccccaccccagcagccagagcggcccccccctgcaccacagcggggcccctcctcctccacccagccagcccccccggcagcccccccaggccgcccccagcagccacccccacagcgacctgaccttcaaccccagcagcgccctggagggccaggccggggcccagggcgccagtgacatgcctgagcccagcctggacctgctgcctgagctgaccaacccagatgagctgctgagctacctggaccccccagacctgcccagcaacagcaatgatgacctgctgagcctgtttgagaacaactag

SEQ ID NO: 19552 - DNA, 3405 bp, Artificial Sequence
  Description of Artificial Sequence: Synthetic coding sequence
atgggcaaggagcaggagctgctggaggccgccaggacaggccacctgcctgctgtggagaagctgctgagcggcaagaggctgagcagcggctttggaggcggcggcggcggcggcagcggcggcggcggcggcggcagcggcggcggcggcggcggcctgggcagcagcagccaccccctgagcagcctgctgtccatgtggaggggccccaacgtgaactgtgtggacagcacaggctacacccccctgcaccacgccgccctgaatggccacaaggatgtggtggaggtgctgctgagaaatgatgccctgaccaacgtggccgacagcaagggctgctaccccctgcacctggccgcctggaagggagatgcccagatcgtgcggctgctgatccaccagggccccagccacaccagggtgaatgagcagaacaatgacaatgaaacagccctgcactgtgccgcccagtatggccacacagaggtggtgaaggtgctgctggaggagctgacagaccccaccatgaggaacaacaagtttgagacccccctggacctggccgccctgtatggccgcctggaggtggtgaagatgctgctgaatgcccaccccaacctgctgagctgcaacaccaagaagcacacccccctgcacctggccgccagaaatggccacaaggctgtggtgcaggtgctgctggatgctggcatggacagcaactaccagacagagatgggcagcgccctgcacgaggccgccctgtttgggaagacagatgtggtgcagatcctgctggccgccggcacagatgtgaacatcaaggacaaccacggcctgacagccctggacacagtgcgggagctgcccagccagaagagccagcagattgctgccctgattgaggaccacatgaccgggaagaggagcaccaaggaggtggacaagaccccaccaccccagcccccactcatcagctccatggacagcatcagccagaagagccagggagatgtggagaaggctgtgacagagctgatcatcgactttgatgccaatgctgaggaggagggcccctatgaggccctgtacaatgccatcagctgccacagcctggacagcatggccagcggccgcagcagtgaccaggacagcaccaacaaggaggccgaggccgccggcgtgaagccagctggggtgcggccccgggagaggcctcctcctccagccaagcccccaccagatgaggaggaggaggaccacatcgacaagaagtacttccccctgacagccagcgaggtgctgtccatgaggccccgcatccacggcagcgctgcccgggaggaggatgagcacccctatgagctgctgctgacagctgagaccaagaaggtggtgctggtggatggcaagaccaaggaccacagaagaagcagcagcagccgcagccaggacagcgctgagggccaggacggccaggtgcctgagcagttcagcggcctgctgcacggcagcagccctgtgtgtgaggtgggccaggaccccttccagctgctgtgcacagctggccagagccacccagatggcagcccccagcagggcgcctgccacaaggcctccatgcagctggaggagactggagtgcacgcccctggggccagccagcccagcgccctggaccagagcaagagggtgggctacctgaccggcctgcccaccaccaacagccgcagccaccctgagaccctgacccacacagccagcccccaccctgggggcgctgaggagggggacagaagtggggcccggagccgggccccacccaccagcaagcccaaggccgagctgaagctgagccgcagcctgagcaagagtgacagcgacctgctgacctgcagccccacagaagatgccaccatgggcagccgctctgagagcctgagcaactgcagcatcggcaagaagaggctggagaagagccccagctttgccagcgagtgggatgaaattgagaagatcatgagcagcatcggggagggcatcgacttcagccaggagcggcagaagatcagcggcctgcggaccctggagcagagcgtgggggagtggctggagagcatcggcctgcagcagtatgagagcaagctgctgctgaatggatttgatgatgtgcacttcctgggcagcaatgtgatggaggagcaggacctgcgggacatcggcatcagtgacccccagcacaggaggaagctgctgcaggccgcccggagcctgcccaaggtgaaggccctgggctatgatggcaacagcccccccagcgtgcccagctggctggacagcctgggcctgcaggactatgtgcacagcttcctgagcagcggctacagcagcattgacacagtgaagaacctgtgggagctggagctggtgaatgtgctgaaggtgcagctgctgggccacaggaagaggatcatcgccagcctggccgaccggccctatgaggagcccccccagaagcccccacgcttcagccagctgcgctgccaggacctgctgagccagaccagcagccccctgagccagaatgacagctgcaccggccgctctgctgacctgctgctgcccccaggggacaccggcagaagaagacatgacagcctgcatgaccctgctgcccccagcagagctgagcgcttccgcatccaggaggagcaccgggaggccaagctgaccctgcggccccccagcctggccgccccctatgcccctgtgcagagctggcagcaccagcctgagaagctgatctttgagagctgtggctatgaggccaactacctgggctccatgctgatcaaggacctgcggggcacagagagcacccaggatgcctgtgccaagatgaggaagagcacagagcacatgaagaagatccccaccatcatcctgagcatcacctacaagggcgtgaagttcattgatgccagcaacaagaatgtgattgctgagcacgagatccggaacatcagctgtgccgcccaggaccctgaggacctgtgcacctttgcctacatcaccaaggacctgcagaccagccaccactactgccacgtgttcagcacagtggatgtgaacctgacctatgagatcatcctgaccctgggccaggcctttgaggtggcctaccagctggccctgcaggcccagaagagccgggccaccggggccagcgctgctgagatgattgagaccaagagcagcaagcctgtgcccaagccccgggtgggcgtgaggaagagcgccctggagcccccagacatggaccaggatgcccagagccacgcctctgtgtcctgggtggtggaccccaagccagacagcaagaggagcctgagcaccaactag

SEQ ID NO: 19553 - DNA, 3099 bp, Artificial Sequence
  Description of Artificial Sequence: Synthetic coding sequence
atggaggccgctgctgctgtggtggccgctgaggccgaggtggagaatgaagatggagacagcagctgtggagatgtgtgcttcatggacaagggcctgcagagcatcagcgagctgagcctggacagcaccctgcatgctgtgaacctgcactgcaacaacatcagcaagattgaggccatcgaccacatctggaacctgcagcacctggacctgagcagcaaccagatcagccgcatcgagggcctgaacaccctgaccaagctgtgcaccctgaacctgagctgcaacctgatcaccaaggtggagggcctggaggagctgatcaacctgacccggctgaatgtgtcctacaaccacattgatgacctgagcggcctcatccccctgcacggcatcaagcacaagctgcgctacatcgacctgcacagcaacagaattgacagcatccaccacctgctgcagtgcatggtgggcctgcacttcctgaccaacctgatcctggagaaggatggagatgacaaccctgtgtgccgcctgcccggctacagagctgtgatcctgcagaccctgccccagctgcgcatcctggactgcaagaacatctttggagagcctgtgaacctgacagagatcaacagcagccagctgcagtgcctggagggcctgctggacaacctggtgtccagtgacagccccctgaacatcagtgaagatgagatcatcgacaggatgcctgtgatcacagcccccattgatgagctggtgcccctggagcagtttgccagcacccccagtgatgctgtgctgaccagcttcatgtctgtgtgccagagcagcgagcctgagaagaacaaccatgaaaatgacctgcagaatgagatcaagctgcagaagctggatgaccagatcctgcagctgctgaatgagaccagcaacagcattgacaacgtgctggagaaggacccccggcccaagagggacacagacatcaccagcgagagtgactatggcaacaggaaggagtgcaacaggaaggtgcccaggaggagcaagatcccctatgatgccaagaccatccagaccatcaagcaccacaacaagaactacaacagctttgtgtcctgcaacaggaagatgaagccaccctacctgaaggagctgtatgtgagcagcagcctggccaactgccccatgctgcaggagagcgagaagcccaagacagagatcatcaaggtggaccagagccacagcgaggacaacacctaccagagcctggtggagcagctggaccaggagcgggagaagcgctggagggctgagcaggccgagaacaagctgatggactacattgatgagctgcacaagcacgccaatgagaaggaggacatccacagcctggccctgctgaccacagaccggctgaaggagatcatcttccgggagaggaacagcaagggccagctggaggtgatggtgcacaagctgcagaatgagatcaagaagctgactgtggagctgatgaaggccaaggaccagcaggaggaccacctgaagcacctgcggaccctggagaagaccctggagaagatggagcggcagaagaggcagcagcaggccgcccagatccgcctcatccaggaggtggagctgaaggccagcgctgctgaccgggagatctacctgctgcggaccagcctgcaccgggagcgggagcaggcccagcagctgcaccagctgctggccctgaaggagcaggagcacaggaaggagctggagacccgggagttcttcacagatgctgacttccaggatgccctggccaaggagatcgccaaggaggagaagaagcatgagcagatgatcaaggagtaccaggagaagattgatgtgctgagccagcagtacatggacctggagaatgagttcagaattgccctgactgtggaggcccggcgcttccaggatgtgaaggatggctttgaaaatgtggccacagagctggccaagagcaagcacgccctgatctgggcccagaggaaagaaaatgaaagcagcagcctcatcaaggacctgacctgcatggtgaaggagcagaagaccaagctggccgaggtgtccaagctgaagcaggagacagctgccaacctgcagaaccagatcaacaccctggagatcctgattgaagatgacaagcagaagagcatccagatcgagctgctgaagcatgagaaggtgcagctgatcagcgagctggccgccaaggagagcctcatcttcggcctgaggacagagaggaaggtgtggggccacgagctggcccagcagggcagcagcctggcccagaacagaggcaagctggaggcccagatcgagagcctgagcagagaaaatgaatgtctgaggaagaccaatgaaagtgacagtgatgccctgcgcatcaagtgcaagatcattgatgaccagacagagaccatcaggaagctgaaggactgcctgcaggagaaggatgagcacatcaagaggctgcaggagaagatcacagaaattgagaagtgcacccaggagcagctggatgagaagagcagccagctggatgaggtgctggagaagctggagcggcacaatgaaaggaaggagaagctgaagcagcagctgaagggcaaggaggtggagctggaggagatcaggaaggcctacagcaccctgaacaggaagtggcatgacaagggggagctgctgtgccacctggagacccaggtgaaggaggtgaaggagaagtttgagaacaaggagaagaagctgaaggccgagcgggacaagagcattgagctgcagaagaatgccatggagaagctgcacagcatggatgatgccttcaagaggcaggtggatgccatcgtggaggcccaccaggccgagatcgcccagctggccaatgagaagcagaagtgcatcgacagcgccaacctgaaggtgcaccagatcgagaaggagatgagggagctgctggaggagacctgcaagaacaagaagaccatggaggccaagatcaagcagctggcctttgccctgaatgagatccagcaggacatgtag

SEQ ID NO: 19554 - DNA, 219 bp, Artificial Sequence
  Description of Artificial Sequence: Synthetic coding sequence
atgagctaccagcagcagcagtgcaagcagccctgccagcccccacctgtgtgccccacccccaagtgcccagagccctgccccccacccaagtgcccagagccctgccccagccccaagtgcccccagccctgccccccccagcagtgccagcagaagtacccacctgtgacccccagccccccctgccagcccaagtgcccccccaagagcaagtag

SEQ ID NO: 19555 - DNA, 888 bp, Artificial Sequence; identical to SEQ ID NO: 19226
  Description of Artificial Sequence: Synthetic coding sequence

SEQ ID NO: 19556 - DNA, 1491 bp, Artificial Sequence; identical to SEQ ID NO: 19263
  Description of Artificial Sequence: Synthetic coding sequence

SEQ ID NO: 19557 - DNA, 1575 bp, Artificial Sequence
  Description of Artificial Sequence: Synthetic coding sequence
atgagcagctgtgtgagcagccagcccagcagcaacagagctgccccccaggatgagctgggcggccggggcagcagcagcatccacctgggcatggagagcttcatcgtggtgacagaatgtgagcccggctgtgctgtggacctgggcctggcccgggaccggcccctggaggctgatggccaggaggtgcccctggacaccagcggcagccaggcccggccccacctgagcggcaggaagctgagcctgcaggagaggagccagggcggcctggccgccggcggcagcctggacatgaatggccgctgcatctgccccagcctgccctacagccctgtgagcagcccccagagcagcccccggctgccccggcggcccaccgtggagagccaccacgtgtccatcaccggcatgcaggactgtgtgcagctgaaccagtacaccctgaaggatgagatcggcaagggcagctatggagtggtgaagctggcctacaatgaaaatgacaacacctactatgccatgaaggtgctgagcaagaagaagctgatccggcaggccggcttcccccggcggcccccaccccggggcaccaggcctgcccctgggggctgcatccagccccggggccccatcgagcaggtgtaccaggagatcgccatcctgaagaagctggaccaccccaacgtggtgaagctggtggaggtgctggatgaccccaatgaagaccacctgtacatggtgtttgagctggtgaaccagggccctgtgatggaggtgcccaccctgaagcccctgtctgaggaccaggcccgcttctacttccaggacctgatcaagggcatcgagtacctgcactaccagaagatcatccaccgggacatcaagcccagcaacctgctggtgggagaagatggccacatcaagattgctgactttggagtgtccaatgagttcaagggcagtgatgccctgctgagcaacacagtgggcaccccagccttcatggcccctgagagcctgtctgagaccaggaagatcttcagcggcaaggccctggatgtgtgggccatgggcgtgaccctgtactgctttgtgtttggccagtgccccttcatggatgagcgcatcatgtgcctgcacagcaagatcaagagccaggccctggagttcccagaccagcctgacattgctgaggacctgaaggacctgatcaccaggatgctggacaagaaccctgagagccgcatcgtggtgcctgagatcaagctgcacccctgggtgaccaggcatggagctgagcccctgcccagtgaagatgagaactgcaccctggtggaggtgacagaggaggaggtggagaacagcgtgaagcacatccccagcctggccaccgtcatcctggtgaagaccatgatcaggaagaggagctttggaaacccctttgagggcagcagaagagaggagaggagcctgagcgcccctggcaacctgctgaccaagcagggcagcgaggacaacctgcagggcacagaccccccacctgtgggggaggaggaggtgctgctgtag

SEQ ID NO: 19558 - DNA, 1902 bp, Artificial Sequence
  Description of Artificial Sequence: Synthetic coding sequence
atgaaggccatcaagaagagcctgacagaggaggagtacctgtacctggacttcagccaccagacagagggctgcatcttccccctgcacacctctgtgaccctcttcctgctgagctactgtgactgcaagatcttcaagatctgcctggtggtgaccaaggaggtgtcccgggacagcagcctgctgagagatgacctgatccaggatgtggagatccagatcatcagccggcaggagctgccccccatcgtgcagaactgctgcctgcctgctgtggtggagaggagtgacaacttctgcagagctggcctggccgtggtgctgcggcacatcatccagaagagctatgaagctgaccccctgaagaaggagctgctggagctgctgggcttcaagaagacctgcctgaaggcctgtgccgaggtgtcccagtggacccggctgtgtgagctgaccatccccctggccatcgagaacttcctgcgggagagcagtgaccagccccccaccatccctgtggagatcctgcagctggagaagaagctgtctgagcctgtgcgggtgcacaatgatgacaagctgcggcggcagaagctgaagcagcagaaggcagatggagtgggcccccccctgaccaagggcaaggccaagagcaaggtgcacacccaggagaccagcgagggcctggacagcagcagcaagagcctggagctgaaggtggccttcagcaagctgactgtgcaggaggagcccgccaccaccaaccgggagcccagccacatcaggaaggccaaggccagtgacctgccccccctggagcacgtgtttgctgagggcctgtacttcaccctggccgacatcgtgctgctgccctgcatccaccacttcctggtgatcatcagcaggaagttcagcgagaagctggtggagttccccctgctggcctcctggtaccagaggatccaggaggtgcctggggtgaagacagctgccagcaaatgtggcatccagttcctgcacctgcccaagctgctgaccaccagcacagagcagcaccccaacctgtgtgaggtgcctggggtggaggagcagagcgaccccctcttcatcggcggcccccggcccaccatggccaagctgatggagaagggcatcgaggtgatgttcagcccccacccctgccccacctggaccctggactggaatgtgctgcctgctgctgtgagccccaaggagggcaagatgagcagtgaccgggccctgaggaagcagcagcagctgaacaacctggtgtatgtggtgaccaaccaggccaagccaggggacagaattgtggacttctgcagcggcggcggccacgtgggcatcgtgctggcccacatgctgcccagctgccaggtgaccctgattgagaacaaggagctgagcctcatccgggccaagaagagaagtgatgagctgggcctgagcaacatctggttcatccaggccaacatggagtacttcaccggcatgttcaacattggagtggccctgcacgcctgtggggtggccacagacatggtgattgagcactgcatcaagacccgggccagctttgtgacctgcccctgctgctacggcttcatccagaacaccagcaagttcaacttccccaagtctgagcagttcaagaagaccctgagctacaaggagcacatgatcctgtgccgctttgctgaccagacagctgtgcagctgcccccccagaggaggctcatcggcaagcagtgcatgtgcctggtggacctggaccgggcccgggctgctgaggagtgtggctacagcgtgcaggtgatctccatggagcctgagagctgcagccccaagaacaacatgattgtgggcgtgcccatctag

SEQ ID NO: 19559 - DNA, 519 bp, Artificial Sequence
  Description of Artificial Sequence: Synthetic coding sequence
atgagcagcggcaactaccagcagagcgaggccctgagcaagcccaccttcagcgaggagcaggccagcgccctggtggagagcgtgtttggcctgaaggtgtccaaggtgcggcccctgcccagctatgatgaccagaacttccacgtgtatgtgtccaagaccaaggatggccccacagaatatgtgctgaagatcagcaacaccaaggccagcaagaacccagacctgattgaggtgcagaaccacatcatcatgttcctgaaggctgctggcttccccacagcctctgtgtgccacaccaagggggacaacacagccagcctggtgtctgtggacagcggcagcgagatcaagagctacctggtgcggctgctgacctacctgcccggccggcccatcgccgagctgcctgtgagcccccagctgctgtatgaaattggcaagctggccgccaagctggacaagaccctgcaggagggcaagccccgggtgacccccctgctggccaagaactag

SEQ ID NO: 19560 - DNA, 2937 bp, Artificial Sequence
  Description of Artificial Sequence: Synthetic coding sequence
atgggctggaagcccagcgaggcccggggccagagccagagcttccaggccagcggcctgcagcccaggagcctgaaggccgcccggcgggccaccggccgcccagacaggagccgggccgcccggcccaccatggaccccagcgcccacaggagccgggccgccccacccaacatggaccctgacccccaggccggcgtgcaggtgggcatgagggtggtgcggggcgtggactggaagtggggccagcaggatggaggagagggcggcgtgggcaccgtggtggagctgggccgccacggcagccccagcaccccagacagaacagtggtggtgcagtgggaccagggcaccaggaccaactaccgggccggctaccagggcgcccatgacctgctgctgtatgacaatgcccagatcggcgtgcgccaccccaacatcatctgtgactgctgcaagaagcacggcctgcggggcatgcgctggaagtgccgggtgtgcctggactatgacctgtgcacccagtgctacatgcacaacaagcatgagctggcccacgcctttgacagatatgaaacagcccacagcaggcctgtgaccctgagcccccggcagggcctgccccgcatccccctgcggggcatcttccagggcgccaaggtggtgcggggccctgactgggagtggggcagccaggatggaggagagggcaagccaggccgggtggtggacatccggggctgggatgtggagaccggccgctctgtggcctctgtgacctgggcagatggcaccaccaacgtgtacagagtgggccacaagggcaaggtggacctgaagtgtgtgggggaggccgccggcggcttctactacaaggaccacctgccccggctgggcaagccagctgagctgcagaggagagtgtctgctgacagccagcccttccagcacggggacaaggtgaagtgcctgctggacacagatgtgctgcgggagatgcaggagggccatggaggctggaaccccaggatggccgagttcatcggccagacaggaacagtgcaccgcatcacagacagaggagatgtgcgggtgcagttcaaccacgagacccgctggaccttccaccctggggccctgaccaaggccctgggccgggtgggcaaggtggtgaaggtgtttggagatggcaacctgcgggtggccgtggccggccagcgctggaccttcagccccagctgcctggtggcctacagacctgaggaggatgccaacctggatgtggccgagcgggcccgggagaacaagagcagcctgtctgtggccctggacaagctgcgggcccagaagagtgaccctgagcaccctggccgcctggtggtggaggtggccctgggcaatgctgcccgggccctggacctgctgcggcggcggcctgagcaggtggacaccaagaaccagggccgcacagccctgcaggtggccgcctacctgggccaggtggagctgatccggctgctgctgcaggcccgggccggcgtggacctgcctgatgatgagggcaacacagccctgcactacgccgccctgggcaaccagcctgaggccaccagggtgctgctgtctgctggctgcagagcagatgccatcaacagcacccagagcacagccctgcacgtggccgtgcagaggggcttcctggaggtggtgcgggccctgtgtgagcggggctgtgatgtgaacctgcctgatgcccacagcgacacccccctgcacagcgccatctctgctggcactggagccagcggcatcgtggaggtgctgacagaggtgcccaacattgatgtgacagccaccaacagccagggcttcaccctgctgcaccacgccagcctgaagggccacgccctggccgtgaggaagatcctggcccgggcccggcagctggtggatgccaagaaggaggatggcttcaccgccctgcacctggccgccctgaacaaccaccgggaggtggcccagatcctgatccgggagggccgctgtgatgtgaatgtgaggaacaggaagctgcagagccccctgcacctggccgtgcagcaggcccacgtgggcctggtgcccctgctggtggatgctggctgcagcgtgaatgcagaagatgaggagggggacacagccctgcacgtggccctgcagaggcaccagctgctgcccctggtggctgatggagctggaggagaccccggccccctgcagctgctgagccggctgcaggccagcggcctgcccggcagcgctgagctgactgtgggcgctgctgtggcctgcttcctggccctggagggcgcagatgtgtcctacaccaaccaccggggccgcagccccctggacctggccgctgagggccgggtgctgaaggccctgcagggctgtgcccagcgcttccgggagcggcaggccggcggcggggccgcccctggcccccggcagaccctgggcacccccaacacagtgaccaacctgcacgtgggcgccgcccctggccctgaggccgctgagtgcctggtgtgcagcgagctggccctgctggtgctcttcagcccctgccagcacaggacagtgtgtgaggagtgtgcccggaggatgaagaagtgcatccgctgccaggtggtggtgtccaagaagctgcggccagatggcagcgaggtggccagcgctgccccagcccctggccccccccggcagctggtggaggagctgcagagccgctaccggcagatggaggagcgcatcacctgccccatctgcatcgacagccacatccggctggtgttccagtgtggccacggggcctgtgccccctgtggcagcgccctgagcgcctgccccatctgccggcagcccatccgggaccgcatccagatctttgtgtag

SEQ ID NO: 19561 - DNA, 1074 bp, Artificial Sequence
  Description of Artificial Sequence: Synthetic coding sequence
atgggcggcgctgtgtctgctggagaagataatgatgacctgattgacaacctgaaggaggcccagtacatcagaacagagcgggtggagcaggccttccgggccatcgacagaggagactactacctggagggctacagagacaatgcctacaaggacctggcctggaagcacggcaacatccacctgagcgccccctgcatctacagcgaggtgatggaggccctgaagctgcagcccggcctgtccttcctgaacctgggcagcggcaccggctacctgagcaccatggtgggcctcatcctgggccccttcggcatcaaccacggcatcgagctgcacagtgatgtggtggagtatgccaaggagaagctggagagcttcatcaagaacagcgacagctttgacaagtttgagttctgtgagcccgcctttgtggtgggcaactgcctgcagatcgccagtgacagccaccagtatgaccgcatctactgtggggccggcgtgcagaaggaccacgagaactacatgaagatcctgctgaaggtgggcggcatcctggtgatgcccatcgaggaccagctgacccagatcatgaggacaggccagaacacctgggagagcaagaacatcctggccgtgtcctttgcccccctggtgcagcccagcaagaatgacaatggcaagccagacagcgtgggcctgcccccctgtgctgtgaggaacctgcaggacctggcccgcatctacatccggaggaccctgaggaacttcatcaatgatgagatgcaggccaagggcatcccccagagggccccacccaagaggaagaggaagagggtgaagcagaggatcaacacctacgtgtttgtgggcaaccagctgatcccccagcccctggacagcgaggaggatgagaagatggaggaggacaacaaggaggaggaggagaaggaccacaatgaggccatgaagccagaggagcccccccagaacctgctgcgggagaagatcatgaagctgcccctgcctgagagcctgaaggcctacctgacctacttccgggacaagtag

SEQ ID NO: 19562 - DNA, 633 bp, Artificial Sequence
  Description of Artificial Sequence: Synthetic coding sequence
atgagctgccccaactactgcagcggcaacagcaacagcggcagcctgcggaccagccgccacatccccctgaccagcattgacctgtgccccacctctgtgtcctgtggagatgtgctgtacctgcccaccagcagccaggaccacacctgggtgacagacaactgccaggagacctgtggggagcccaccagctgccagcctgtgcactgtgaaacaggcaacctggagaccagctgtggcagcagcacagcctactacgtgccccggccctgccagggcagcagcttcctgcctgccagcttcttcagcagcagctgcctgcctgtgtcctgccggccccagagatatgtgagcagcggctgccggcccctgcggcccctgctgaacagctaccagcccatcggggactgtgtgcccaatgcctaccggccccagttctgcctgagcaagagctgccagccccagaacctgctgaccagcggctgccagcccagcagctgcctggcctaccggccccagagcctgcacgtggtgagcagcagcctgcggcccctgggccccctcttcagcggctgccagcccctgacccacgtgttcagcacctgccggcccagctgcagcggcctgtag

SEQ ID NO: 19563 - DNA, 606 bp, Artificial Sequence
  Description of Artificial Sequence: Synthetic coding sequence
atggccagcggagatgacagccccatctttgaagatgatgagagccccccctacagcctggagaagatgacagacctggtggccgtgtgggatgtggccctgagtgatggagtgcacaagattgaatttgaacatggcaccaccagcggcaagagggtggtgtatgtggatggcaaggaggagatcaggaaggagtggatgttcaagctggtgggcaaggagaccttctacgtgggcgccgccaagaccaaggccaccatcaacattgatgccatcagcggctttgcctatgagtacaccctggagatcaacgggaagagcctgaagaagtacatggaggacaggagcaagaccaccaacacctgggtgctgcacatggatggagagaacttcagaattgtgctggagaaggatgccatggatgtgtggtgcaatggcaagaagctggagacagctggggagtttgtggatgatggaacagagacccacttcagcatcggcaaccacgactgctacatcaaggctgtgagcagcggcaagaggaaggagggcatcatccacaccctcatcgtggacaaccgggagatccctgagatcgccagctag

SEQ ID NO: 19564 - DNA, 3390 bp, Artificial Sequence
  Description of Artificial Sequence: Synthetic coding sequence
atgcctgccaccaggaagcccatgagatatggccacacagagggccacacagaggtgtgctttgatgacagcggcagcttcatcgtgacctgtggcagtgatggagatgtgcgcatctgggaggacctggatgatgatgaccccaagttcatcaacgtgggggagaaggcctacagctgtgccctgaagagcggcaagctggtgacagctgtgagcaacaacaccatccaggtgcacaccttccctgagggcgtgcctgatggcatcctgacccgcttcaccaccaatgccaaccacgtggtgttcaatggagatggcaccaagattgctgctggcagcagtgacttcctggtgaagatcgtggatgtgatggacagcagccagcagaagaccttccggggccatgatgcccctgtgctgagcctgagctttgaccccaaggacatcttcctggccagcgccagctgtgatggctctgtgcgggtgtggcagatcagtgaccagacctgtgccatctcctggcccctgctgcagaagtgcaatgatgtgatcaatgccaagagcatctgccgcctggcctggcagcccaagagcggcaagctgctggccatccctgtggagaagtctgtgaagctgtaccgccgggagagctggagccaccagtttgacctgagtgacaacttcatcagccagaccctgaacatcgtgacctggagcccctgtggccagtacctggccgccggcagcatcaatggcctcatcatcgtgtggaatgtggagaccaaggactgcatggagcgggtgaagcatgagaagggctacgccatctgtggcctggcctggcaccccacctgtggccgcatctcctacacagatgctgagggcaacctgggcctgctggagaatgtgtgtgaccccagcggcaagaccagcagcagcaaggtgagcagccgggtggagaaggactacaatgacctgtttgatggagatgacatgagcaatgctggggacttcctgaatgacaatgctgtggagatccccagcttcagcaagggcatcatcaatgatgatgaagatgatgaggacctgatgatggccagcggccggccccggcagaggagccacatcctggaggatgatgaaaattctgtggacatctccatgctgaagacaggcagcagcctgctgaaggaggaggaggaggatggccaggagggcagcatccacaacctgcccctggtgaccagccagaggcccttctatgatggccccatgcccaccccccggcagaagcccttccagagcggcagcacccccctgcacctgacccaccgcttcatggtgtggaacagcatcggcatcatccgctgctacaatgatgagcaggacaatgccattgatgtggagttccatgacaccagcatccaccacgccacccacctgagcaacaccctgaactacaccatcgctgacctgagccatgaggccatcctgctggcctgtgagagcacagatgagctggccagcaagctgcactgcctgcacttcagctcctgggacagcagcaaggagtggatcatcgacctgccccagaatgaagatattgaggccatctgcctgggccagggctgggccgctgctgccaccagcgccctgctgctgcggctcttcaccatcggcggcgtgcagaaggaggtgttcagcctggccggccctgtggtgtccatggccggccatggagagcagctgttcatcgtgtaccaccggggcactggatttgatggagaccagtgcctgggcgtgcagctgctggagctgggcaagaagaagaagcagatcctgcatggagaccccctgcccctgaccaggaagagctacctggcctggattggcttctctgctgagggcaccccctgctacgtggacagcgagggcatcgtgaggatgctgaacagaggcctgggcaacacctggacccccatctgcaacacccgggagcactgcaagggcaagagtgaccactactgggtggtgggcatccacgagaacccccagcagctgcgctgcatcccctgcaagggcagccgcttcccccccaccctgcccaggcctgctgtggccatcctgtccttcaagctgccctactgccagatcgccacagagaagggccagatggaggagcagttctggaggagcgtcatcttccacaaccacctggactacctggccaagaatggctatgaatatgaggagagcaccaagaaccaggccaccaaggagcagcaggagctgctgatgaagatgctggccctgagctgcaagctggagcgggagttccgctgtgtggagctggccgacctgatgacccagaatgctgtgaacctggccatcaagtatgccagccgcagcaggaagctgatcctggcccagaagctgtctgagctggccgtggagaaggctgctgagctgacagccacccaggtggaggaggaggaggaggaggaggacttcaggaagaagctgaatgccggctacagcaacacagccacagagtggagccagccccgcttcaggaaccaggtggaggaggatgctgaggacagcggggaggctgatgatgaggagaagccagagatccacaagccaggccagaacagcttcagcaagagcaccaacagcagtgatgtgtctgccaagagcggggctgtgaccttcagcagccagggccgggtgaaccccttcaaggtgtctgccagcagcaaggagcccgccatgtccatgaacagcgcccggagcaccaacatcctggacaacatgggcaagagcagcaagaagagcacagccctgagcaggaccaccaacaatgagaagagccccatcatcaagcccctcatccccaagcccaagcccaagcaggccagcgctgccagctacttccagaagaggaacagccagaccaacaagacagaggaggtgaaggaggagaacctgaagaatgtgctgtctgagaccccagccatctgccccccccagaacacagagaaccagaggcccaagacaggcttccagatgtggctggaggagaacagaagcaacatcctgagtgacaacccagacttcagtgatgaggccgacatcatcaaggagggcatgatccgcttccgggtgctgagcacagaggagaggaaggtgtgggccaacaaggccaagggggagacagccagcgagggcacagaggccaagaagaggaagagggtggtggatgaaagtgatgaaacagagaaccaggaggagaaggccaaggagaacctgaacctgagcaagaagcagaagcccctggacttcagcaccaaccagaagctgagcgcctttgccttcaagcaggagtag

SEQ ID NO: 19565 - DNA, 1476 bp, Artificial Sequence
  Description of Artificial Sequence: Synthetic coding sequence
tctggcagcagccacagcttccctggcagcctggaggtgacagccctgatgaccacctggagcagcctgcagggcagccacgtgtccaagagggccctggcctatgccctggtggtgaccaactgccaggagcgcatccagcactggaagaaggtggacaatgactacaatgccctgcgggagcggctgagcaccctgcctgacaagctgagctacaacatcatggtgcccttcggcccctttgccttcatgcctgggaagctggtgcacaccaatgaggtgacagtgctgctgggggacaactggtttgccaagtgcagcgccaagcaggccgtgggcctggtggagcacaggaaggagcacgtgaggaagaccattgatgacctgaagaaggtgatgaagaactttgagagccgggtggagttcacagaggacctgcagaagatgtctgatgctgctggggacatcgtggacatccgggaggagatcaagtgtgactttgagttcaaggccaagcacagaattgcccacaagccccacagcaagcccaagaccagtgacatctttgaagctgacatcgccaatgatgtgaagagcaaggacctgctggccgacaaggagctgtgggcccggctggaggagctggagcggcaggaggagctgctgggggagctggacagcaagccagacacagtgattgccaatggagaggacaccaccagcagcgaggaggagaaggaggacaggaacaccaacgtgaatgccatgcaccaggtgacagacagccacaccccctgccacaaggatgtggccagcagcgagcccttcagcggccaggtgaacagccagctgaactgcagcgtgaatggcagcagcagctaccacagtgatgatgatgatgatgatgatgatgatgatgatgatgacaacattgatgatgatgatggagacaatgaccacgaggccctgggcgtgggggacaacagcatccccaccatctacttcagccacacagtggagcccaagagggtgcgcatcaacacaggcaagaacaccaccctgaagttcagcgagaagaaggaggaggccaagaggaagaggaagaacagcactggaagtggccacagcgcccaggagctgcccaccatccgcaccccagctgacatctaccgggcctttgtggatgtggtgaatggagaatatgtgcccaggaagagcatcctgaagagccgcagccgggagaacagcgtgtgcagcgacaccagcgagagcagcgctgctgagtttgatgaccggcggggcgtgctgcggagcatcagctgtgaggaggccacctgcagcgacaccagcgagagcatcctggaggaggagccccaggagaaccagaagaagctgctgcccctgtctgtgaccccagaggtgctgcggctggtgggctacagcaggaacctggcccccctgaatgtcatcctgtag

SEQ ID NO: 19566 - DNA, 981 bp, Artificial Sequence
  Description of Artificial Sequence: Synthetic coding sequence
atgctgctgagcaagtttggcagcctggcccacctgtgtggccctggaggagtggaccacctgcctgtgaagatcctgcagcctgccaaggctgacaaggagagctttgagaaggcctaccaggtgggcgctgtgctgggcagcggcggctttggaacagtgtatgccggcagcagaattgctgatggcctgcctgtggccgtgaagcacgtggtgaaggagcgggtgacagagtggggcagcctgggcggggccaccgtgcccctggaggtggtgctgctgaggaaggtgggcgccgccggcggggcccggggcgtcatccggctgctggactggtttgagaggccagatggcttcctgctggtgctggagaggcctgagcccgcccaggacctgtttgacttcatcacagagcggggggccctggatgagcccctggcccggcgcttctttgcccaggtgctggccgctgtgcgccactgccacagctgtggggtggtgcaccgggacatcaaggatgagaacctgctggtggacctgcggagcggggagctgaagctgattgactttggcagcggggccctgctgaaggacacagtgtacacagactttgatggcaccagggtgtacagccccccagagtggatccgctaccaccgctaccacggccgcagcgccaccgtgtggagcctgggcgtgctgctgtatgacatggtgtgtggggacatcccctttgagcaggatgaggagatcctgcggggccgcctgctcttcagaagaagagtgtccccagagtgccagcagctgatccgctggtgcctgagcctgcggcccagcgagcggcccagcctggaccagattgctgcccacccctggatgctgggcgcagatggaggagtgcctgagagctgtgacctgcggctgtgcaccctggaccctgatgatgtggccagcaccaccagcagcagcgagagcctgtag

SEQ ID NO: 19567 - DNA, 2880 bp, Artificial Sequence
  Description of Artificial Sequence: Synthetic coding sequence
atggccgccagcacaggctacgtgcggctgtggggcgccgcccgctgctgggtgctgcggcggcccatgctggccgctgctgggggccgggtgcccacagctgctggggcctggctgctgcggggccagaggacctgtgatgccagccccccctgggccctgtggggccggggccctgccatcggcggccagtggaggggcttctgggaggccagcagcagaggaggaggagccttctctggaggagaagatgccagcgagggcggcgctgaggagggcgctgggggcgccggcggcagcgctggagctggggagggccctgtgatcacagccctgacccccatgaccatcccagatgtgttcccccacctgcccctgattgccatcaccagaaatcctgtgttcccccgcttcatcaagatcatcgaggtgaagaacaagaagctggtggagctgctgcggaggaaggtgcggctggcccagccctacgtgggcgtcttcctgaagagagatgacagcaatgaaagtgatgtggtggagagcctggatgagatctaccacacaggcacctttgcccagatccacgagatgcaggacctgggggacaagctgaggatgattgtgatgggccaccggcgggtgcacatcagccggcagctggaggtggagcctgaggagcctgaggccgagaacaagcacaagcccaggaggaagagcaagaggggcaagaaggaggctgaagatgagctgagcgcccggcaccctgctgagctggccatggagcccaccccagagctgcctgctgaggtgctgatggtggaggtggagaatgtggtgcatgaggacttccaggtgacagaggaggtgaaggccctgacagctgagatcgtgaagaccatccgggacatcatcgccctgaaccccctgtaccgggagagcgtgctgcagatgatgcaggccggccagagggtggtggacaaccccatctacctgagtgacatgggcgccgccctgactggagctgagagccatgagctgcaggatgtgctggaggagaccaacatccccaagaggctgtacaaggccctgagcctgctgaagaaggagtttgagctgagcaagctgcagcagaggctgggccgggaggtggaggagaagatcaagcagacccacaggaagtacctgctgcaggagcagctgaagatcatcaagaaggagctgggcctggagaaggatgacaaggatgccatcgaggagaagttccgggagcggctgaaggagctggtggtgcccaagcacgtgatggatgtggtggatgaggagctgagcaagctgggcctgctggacaaccacagcagcgagttcaacgtgaccaggaactacctggactggctgaccagcatcccctggggcaagtacagcaatgaaaacctggacctggcccgggcccaggccgtgctggaggaggaccactacggcatggaggatgtgaagaagaggatcctggagttcatcgctgtgtcccagctgcggggcagcacccagggcaagatcctgtgcttctacggccccccaggagtgggcaagaccagcatcgcccggagcatcgcccgggccctgaaccgggagtacttccgcttctctgtgggcggcatgacagatgtggccgagatcaagggccacaggaggacctacgtgggcgccatgcctgggaagatcatccagtgcctgaagaagaccaagacagagaaccccctcatcctgattgatgaggtggacaagattggccggggctaccagggcgaccccagcagcgccctgctggagctgctggaccctgagcagaatgccaacttcctggaccactacctggatgtgcctgtggacctgagcaaggtgctcttcatctgcacagccaacgtgacagacaccatccctgagcccctgcgggacaggatggagatgatcaacgtgtctggctacgtggcccaggagaagctggccatcgccgagcgctacctggtgccccaggcccgggccctgtgtggcctggatgagagcaaggccaagctgagcagtgatgtgctgaccctgctgatcaagcagtactgccgggagagcggcgtgaggaacctgcagaagcaggtggagaaggtgctgaggaagagcgcctacaagatcgtgtctggagaggccgagagcgtggaggtgaccccagagaacctgcaggactttgtgggcaagcctgtgttcaccgtggagaggatgtatgatgtgaccccacctggggtggtgatgggcctggcctggacagccatgggcggcagcaccctgtttgtggagaccagcctgcggcggccccaggacaaggatgccaagggggacaaggatggcagcctggaggtgacaggccagctgggggaggtgatgaaggagagcgcccgcatcgcctacacctttgcccgggccttcctgatgcagcacgccccagccaatgactacctggtgaccagccacatccacctgcacgtgcctgagggcgccacccccaaggatggccccagcgctggctgcaccatcgtgacagccctgctgagcctggccatgggccggcctgtgcggcagaacctggccatgaccggggaggtgtccctgaccgggaagatcctgcctgtgggcggcatcaaggagaagaccatcgccgccaagagagctggggtgacctgcatcgtgctgcctgctgagaacaagaaggacttctatgacctggccgccttcatcacagagggcctggaggtgcactttgtggagcactaccgggagatctttgatattgccttcccagatgagcaggccgaggccctggccgtggagaggtag

SEQ ID NO: 19568 - DNA, 1203 bp, Artificial Sequence
  Description of Artificial Sequence: Synthetic coding sequence
atgaacccagccagcgcccccccacccctgcccccacctggccagcaggtgattcatgtgacccaggacctggacacagacctggaggccctcttcaacagcgtgatgaaccccaagcccagctcctggaggaagaagatcctgcctgagagcttcttcaaggagccagacagcggcagccacagccggcagagcagcacagacagcagcggcggccaccctggcccccggctggccggcggggcccagcacgtgcgcagccacagcagccctgccagcctgcagctgggcaccggggccggggctgctggcagccctgcccagcagcacgcccacctgcggcagcagagctatgatgtgacagatgagctgcccctgcccccaggctgggagatgaccttcaccgccaccggccagcgctacttcctgaaccacatcgagaagatcaccacctggcaggaccccaggaaggccatgaaccagcccctgaaccacatgaacctgcaccctgctgtgagcagcacccctgtgccccagaggtccatggctgtgtcccagcccaacctggtgatgaaccaccagcaccagcagcagatggcccccagcaccctgagccagcagaaccaccccacccagaaccccccagctggcctgatgtccatgcccaatgccctgaccacccagcagcagcagcagcagaagctgcggctgcagaggatccagatggagcgggagcgcatccgcatgaggcaggaggagctgatgaggcaggaggccgccctgtgccggcagctgcccatggaggccgagaccctggcccctgtgcaggccgctgtgaacccccccaccatgaccccagacatgaggagcatcaccaacaacagcagtgaccccttcctgaatggaggcccctaccacagccgggagcagagcacagacagcggcctgggcctgggctgctacagcgtgcccaccaccccagaggacttcctgagcaatgtggatgagatggacacaggagaaaatgccggccagacccccatgaacatcaacccccagcagacccgcttcccagacttcctggactgcctgcccggcaccaacgtggacctgggcaccctggagagtgaagatctcatccccctcttcaatgatgtggagagcgccctgaacaagtctgagcccttcctgacctggctgtag

SEQ ID NO: 19569 - DNA, 2625 bp, Artificial Sequence
  Description of Artificial Sequence: Synthetic coding sequence
atggaggtgctgcgggagaaggtggaggaggaggaggaggccgagcgggaggaggccgctgagtgggccgagtgggccaggatggagaagatgatgaggcctgtggaggtgaggaaggaggagatcaccctgaagcaggagaccctgcgggacctggagaagaagctgtctgagatccagatcaccgtgtctgctgagctgcctgccttcaccaaggacaccatcgacatcagcaagctgcccatctcctacaagaccaacacccccaaggaggagcacctgctgcaggtggccgacaacttcagccggcagtacagccacctgtgcccagacagagtgcccctcttcctgcaccccctgaatgaatgtgaggtgcccaagtttgtgtccaccaccctgcggcccaccctgatgccctacccagagctgtacaactgggacagctgtgcccagtttgtgtctgacttcctgaccatggtgcccctgcctgaccccctgaagccacccagccacctgtacagcagcaccaccgtgctgaagtaccagaagggcaactgctttgacttcagcaccctgctgtgcagcatgctgattggcagcggctatgatgcctactgtgtgaatggctacggcagcctggacctgtgccacatggacctgacccgggaggtgtgccccctgactgtgaagcccaaggagaccatcaagaaggaggagaaggtgctgcccaagaagtacaccatcaagccaccccgggacctgtgcagcagatttgagcaggagcaggaggtgaagaagcagcaggagatccgggcccaggagaagaagaggctgcgggaggaggaggagcggctgatggaggccgagaaggccaagccagatgccctgcacggcctgcgggtgcacagctgggtgctggtgctgagcggcaagcgggaggtgcctgagaacttcttcatcgaccccttcaccggccacagctacagcacccaggatgagcacttcctgggcatcgagagcctgtggaaccacaagaactactggatcaacatgcaggactgctggaactgctgcaaggacctgatctttgacctgggggaccctgtgcgctgggagtacatgctgctgggcacagacaagagccagctgagcctgacagaggaggatgattctggcatcaatgatgaagatgatgtggagaacctgggcaaggaggatgaggacaagagctttgacatgccccacagctgggtggagcagatcgagatcagccctgaggcctttgagacccgctgccccaacgggaagaaggtgatccagtacaagagggccaagctggagaagtgggccccctacctgaacagcaatggcctggtgtcccggctgaccacctatgaggacctgcagtgcaccaacatcctggagatcaaggagtggtaccagaaccgggaggacatgctggagctgaagcacatcaacaagaccacagacctgaagacagactacttcaagccaggccacccccaggccctgcgggtgcacagctacaagtccatgcagcctgagatggacagagtgattgagttctatgaaacagcccgggtggatggcctgatgaagcgggaggagacccccaggaccatgacagagtactaccagggccgcccagacttcctgagctacagacatgccagctttggcccccgggtgaagaagctgaccctgagcagcgctgagagcaacccccggcccatcgtgaagatcacagagcgcttcttcaggaacccagccaagccagctgaggaggatgtggccgagagggtcttcctggtggccgaggagcgcatccagctgcgctaccactgccgggaggaccacatcacagccagcaagcgggagttcctgcggaggacagaggtggacagcaaaggaaacaagatcatcatgaccccagacatgtgcatcagctttgaggtggagcccatggagcacaccaagaagctgctgtaccagtatgaggccatgatgcacctgaagcgggaggagaagctgagccgccaccaggtgtgggagagcgagctggaggtgctggagatcctgaagctgcgggaggaggaggaggccgcccacaccctgaccatcagcatctatgacaccaagagaaatgagaagagcaaggagtaccgggaggccatggagaggatgatgcatgaggagcacctgcggcaggtggagacccagctggactacctggcccccttcctggcccagctgcccccaggagagaagctgacctgctggcaggccgtgcggctgaaggatgaatgtctgagtgacttcaagcagaggctcatcaacaaggccaacctgatccaggccaggtttgagaaggagacccaggagctgcagaagaagcagcagtggtaccaggagaaccaggtgaccctgaccccagaagatgaagatctctacctgagctactgcagccaggccatgttccgcatccgcatcctggagcagaggctgaacagacacaaggagctggcccccctgaagtacctggccctggaggagaagctgtacaaggacccccggctgggggagctgcagaagatctttgcctag

SEQ ID NO: 19570 - DNA, 1851 bp, Artificial Sequence
  Description of Artificial Sequence: Synthetic coding sequence
atggatgtgatgctggagaactactgccacctgatctctgtgggctgccacatgaccaagccagatgtgatcctgaagctggagcggggggaggagccctggaccagctttgctggccacacctgcctggaggagaactggaaggccgaggacttcctggtgaagttcaaggagcaccaggagaagtacagccgctctgtggtgtccatcaaccacaagaagctggtgaaggagaagagcaagatctatgagaagaccttcaccctgggcaagaaccctgtgaacagcaagaacctgcccccagaatatgacacccacggccgcatcctgaagaatgtgtctgagctgatcatcagcaacctgaacccagccaggaagaggctgtctgagtacaacggctacggcaagagcctgctgagcaccaagcaggagaccacccaccctgaggtgaagagccacaaccagagcgcccgggccttcagccacaatgaggtgctgatgcagtaccagaagacagagaccccagcccagagctttggctacaatgactgtgagaagagcttcctgcagaggggcggcctcatcacccacagccggccctacaagggggagaaccccagcgtgtacaacaagaagagaagagccaccaacatcgagaagaagcacacctgcaatgaatgtgggaagagcttctgcaggaagtctgtgctgatcctgcaccagggcatccacagcgaggagaagccctaccagtgccaccagtgtggaaatgccttccggaggaagagctacctgattgaccaccagaggacccacactggagagaagccctttgtgtgcaatgaatgtgggaagagcttccggctgaagacagccctgacagaccaccagaggacccacactggagagaagagctatgaatgtctgcagtgcagaaatgccttccggctgaagagccacctgatccgccaccagaggacccacactggagagaagccctatgaatgtaatgactgtgggaagagcttccggcagaagaccaccctgagcctgcaccagaggatccacactggagagaagccctacatctgcaaggaatgtgggaagagcttccaccagaaggccaacctgactgtgcaccagaggacccacactggagagaagccctacatctgcaatgaatgtgggaagagcttcagccagaagaccaccctggccctgcacgagaagacccacaatgaggagaagccctacatctgcagtgaatgtgggaagagcttccggcagaagaccaccctggtggcccaccagaggacccacactggagagaagagctatgaatgtccccactgcggcaaggccttcaggatgaagagctacctgattgaccaccacaggacccacactggagagaagccctatgaatgtaatgaatgtgggaagagcttcagccagaagaccaacctgaacctgcaccagaggatccacactggagagaagccctacgtgtgcaatgaatgtgggaagagcttccggcagaaggccaccctgactgtgcaccagaagatccacacaggccagaagagctatgaatgtccccagtgtgggaaggccttcagcaggaagagctacctgatccaccaccagaggacccacactggagagaagccctacaagtgcagtgaatgtgggaagtgcttccggcagaagaccaacctgattgtgcaccagaggacccacactggagagaagccctacgtgtgcaatgaatgtgggaagagcttctcctacaagaggaacctgattgtgcaccagaggacccacaagggagaaaatattgagatgcagtag

SEQ ID NO: 19571 - DNA, 441 bp, Artificial Sequence
  Description of Artificial Sequence: Synthetic coding sequence
atgtgccacaccagctgcagcagcggctgccagcctgcctgctgtgcccccagcccctgccagcctgcctgctgcgtgcccagcagctgccaggccagctgctgcgtgcctgtgggctgccagagctctgtgtgtgtgcctgtgtccttcaagccagctgtgtgcctgcctgtgtcctgccagagctctgtgtgtgtgcccatgtccttcaagtctgctgtgtgtgtgcctgtgtcctgccagagctctgtgtgtgtgcctgtgtcctgccggcccatcgtgtgtgccgcccccagctgccagagcagcctgtgtgtgcctgtgtcctgcaggcctgtggtgtatgctgcccccagctgccagagcagcggctgctgccagcccagctgcacctctgtgctgtgccggcccatctcctacagcatcagcagctgctgctag

SEQ ID NO: 19572 - DNA, 1257 bp, Artificial Sequence; identical to SEQ ID NO: 19266
  Description of Artificial Sequence: Synthetic coding sequence

SEQ ID NO: 19573 - DNA, 3351 bp, Artificial Sequence
  Description of Artificial Sequence: Synthetic coding sequence
atgtatggcagcgcccggtctgtgggcaaggtggagcccagcagccagagccctggccgcagcccccggctgcccaggagcccccggctgggccacaggaggaccaacagcactggaggcagcagcggcagctctgtgggcggcggcagcggcaagaccctgtccatggagaacatccagagcctgaatgctgcctatgccaccagcggccccatgtacctgagtgaccatgaaaatgtgggcagcgagacccccaagagcaccatgaccctgggccgcagcggcggccgcctgccctacggcgtgaggatgacagccatgggcagcagccccaacatcgccagcagcggcgtggccagtgacaccatcgcctttggagagcaccacctgccccctgtgtccatggccagcacagtgccccacagcctgcggcaggcccgggacaacaccatcatggacctgcagacccagctgaaggaggtgctgcgggagaatgacctgctgaggaaggatgtggaggtgaaggagagcaagctgagcagctccatgaacagcatcaagaccttctggagccctgagctgaagaaggagcgggccctgaggaaggatgaggccagcaagatcaccatctggaaggagcagtacagagtggtgcaggaggagaaccagcacatgcagatgaccatccaggccctgcaggatgagctgcgcatccagagggacctgaaccagctgttccagcaggacagcagcagcaggactggagagccctgtgtggccgagctgacagaggagaacttccagaggctgcacgccgagcacgagcggcaggccaaggagctgttcctgctgaggaagaccctggaggagatggagctgagaattgagacccagaagcagaccctgaatgccagagatgagagcatcaagaagctgctggagatgctgcagagcaagggcctgagcgccaaggccacagaggaggaccacgagaggacccggcggctggccgaggccgagatgcacgtgcaccacctggagagcctgctggagcagaaggagaaggagaacagcatgctgcgggaggagatgcacagaagatttgaaaatgccccagacagcgccaagaccaaggccctgcagaccgtcatcgagatgaaggacagcaagatcagctccatggagcggggcctgcgggacctggaggaggagatccagatgctgaagagcaatggagccctgagcacagaggagcgggaggaggagatgaagcagatggaggtgtaccgcagccacagcaagttcatgaagaacaaggtggagcagctgaaggaggagctgagcagcaaggaggcccagtgggaggagctgaagaagaaggccgccggcctgcaggccgagatcggccaggtgaagcaggagctgagcaggaaggacacagagctgctggccctgcagaccaagctggagaccctgaccaaccagttcagtgacagcaagcagcacatcgaggtgctgaaggagagcctgacagccaaggagcagagagctgccatcctgcagacagaggtggatgccctgcggctgcggctggaggagaaggagaccatgctgaacaagaagaccaagcagatccaggacatggccgaggagaagggcacccaggccggggagatccatgacctgaaggacatgctggatgtgaaggagaggaaggtgaatgtgctgcagaagaagattgagaacctgcaggagcagctgcgggacaaggagaagcagatgagcagcctgaaggagcgggtgaagagcctgcaggccgacaccaccaacacagacacagccctgaccaccctggaggaggccctggccgagaaggagaggaccatcgagcggctgaaggagcagagggacagagatgagcgggagaagcaggaggagattgacaactacaagaaggacctgaaggacctgaaggagaaggtgtccctgctgcagggcgacctgtctgagaaggaggccagcctgctggacctgaaggagcacgccagcagcctggccagcagcggcctgaagaaggacagccggctgaagaccctggagatcgccctggagcagaagaaggaggagtgcctgaagatggagagccagctgaagaaggcccatgaagctgccctggaggcccgggccagccctgagatgtctgaccgcatccagcacctggagcgggagatcacccgctacaaggatgagagcagcaaggcccaggccgaggtggaccggctgctggagatcctgaaggaggtggagaatgagaagaatgacaaggacaagaagattgctgagctggagcggcaggtgaaggaccagaacaagaaggtggccaacctgaagcacaaggagcaggtggagaagaagaagagcgcccagatgctggaggaggcccggcggcgggaggacaacctgaatgacagcagccagcagctgcaggacagcctgaggaagaaggatgacagaattgaggagctggaggaggccctgcgggagagcgtgcagatcacagctgagcgggagatggtgctggcccaggaggagagcgcccggaccaatgctgagaagcaggtggaggagctgctgatggccatggagaaggtgaagcaggagctggagagcatgaaggccaagctgagcagcacccagcagagcctggccgagaaggagacccacctgaccaacctgcgggcagagaggaggaagcacctggaggaggtgctggagatgaagcaggaggccctgctggccgccatcagcgagaaggatgccaacatcgccctgctggagctgagcagcagcaagaagaagacccaggaggaggtggccgccctgaagcgggagaaggaccggctggtgcagcagctgaagcagcagacccagaacaggatgaagctgatggctgacaactatgaagatgaccacttcaagagcagccacagcaaccagaccaaccacaagcccagcccagaccagatcatccagcccctgctggagctggaccagaacagaagcaagctgaagctgtacatcggccacctgaccaccctgtgccacgaccgggaccccctcatcctgcggggcctgaccccaccagccagctacaacctggatgatgaccaggccgcctgggagaatgagctgcagaagatgacccggggccagctgcaggatgagctggagaagggggagcgggacaatgctgagctgcaggagtttgccaatgccatcctgcagcagattgctgaccactgcccagacatcctggagcaggtggtgaatgccctggaggagagcagctag

SEQ ID NO: 19574 - DNA, 3075 bp, Artificial Sequence
  Description of Artificial Sequence: Synthetic coding sequence
atgaacttcatcaaggacaacagccgggccctgatccagaggatgggcatgaccgtcatcaagcagatcacagatgacctgtttgtgtggaatgtgctgaaccgggaggaggtgaacatcatctgctgtgagaaggtggagcaggatgctgcccggggcatcatccacatgatcctgaagaagggcagcgagagctgcaacctcttcctgaagagcctgaaggagtggaactaccccctcttccaggacctgaatggccagagcctcttccaccagaccagcgagggggacctggatgacctggcccaggacctgaaggacctgtaccacacccccagcttcctgaacttctaccccctgggggaggacatcgacatcatcttcaacctgaagagcaccttcacagagcctgtgctgtggaggaaggaccagcaccaccaccgggtggagcagctgaccctgaatggcctgctgcaggccctgcagagcccctgcatcattgaaggagagagcggcaagggcaagagcaccctgctgcagagaattgccatgctgtggggcagcggcaagtgcaaggccctgaccaagttcaagtttgtgttcttcctgcggctgagccgggcccagggcggcctgtttgagaccctgtgtgaccagctgctggacatccctggcaccatcaggaagcagaccttcatggccatgctgctgaagctgcggcagagggtgctcttcctgctggatggctacaatgagttcaagccccagaactgcccagaaattgaggccctgatcaaggagaaccaccgcttcaagaacatggtgattgtgaccaccaccacagagtgcctgcggcacatccggcagtttggagccctgacagctgaggtgggggacatgacagaggacagcgcccaggccctgatccgggaggtgctgatcaaggagctggccgagggcctgctgctgcagatccagaagagccgctgcctgaggaacctgatgaagacccccctgtttgtggtgatcacctgtgccatccagatgggagagagcgagttccacagccacacccagaccaccctcttccacaccttctatgacctgctgatccagaagaacaagcacaagcacaagggcgtggccgccagtgacttcatccgcagcctggaccactgtggggacctggccctggagggcgtcttcagccacaagtttgattttgagctgcaggatgtgtcctctgtgaatgaagatgtgctgctgaccaccggcctgctgtgcaagtacacagcccagcgcttcaagcccaagtacaagttcttccacaagagcttccaggagtacacagctggaagaaggctgagcagcctgctgaccagccatgagcctgaggaggtgaccaagggaaatggctacctgcagaagatggtgtccatcagtgacatcaccagcacctacagcagcctgctgcgctacacctgtggcagctctgtggaggccaccagggctgtgatgaagcacctggccgctgtgtaccagcacggctgcctgctgggcctgagcatcgccaagaggcccctgtggaggcaggagagcctgcagagcgtgaagaacaccacagagcaggagatcctgaaggccatcaacatcaacagctttgtggagtgtggcatccacctgtaccaggagagcaccagcaagagcgccctgagccaggagtttgaggccttcttccagggcaagagcctgtacatcaacagcggcaacatcccagactacctgtttgacttctttgagcacctgcccaactgtgccagcgccctggacttcatcaagctggacttctatggaggagccatggcctcctgggagaaggccgcagaagatactggaggcatccacatggaggaggcccctgagacctacatccccagcagagctgtgtccctcttcttcaactggaagcaggagttccgcaccctggaggtgaccctgcgggacttcagcaagctgaacaagcaggacatccgctacctgggcaagatcttcagcagcgccaccagcctgcggctgcagatcaagagatgtgccggcgtggccggcagcctgagcctggtgctgagcacctgcaagaacatctacagcctgatggtggaggccagccccctgaccattgaagatgagcggcacatcacctctgtgaccaacctgaagaccctgagcatccatgacctgcagaaccagaggctgcccggcggcctgacagacagcctgggcaacctgaagaacctgaccaagctgatcatggacaacatcaagatgaatgaggaggatgccatcaagctggccgagggcctgaagaacctgaagaagatgtgcctcttccacctgacccacctgagtgacatcggggagggcatggactacatcgtgaagagcctgagcagcgagccctgtgacctggaggagatccagctggtgtcctgctgcctgagcgccaatgctgtgaagatcctggcccagaacctgcacaacctggtgaagctgagcatcctggacctgtctgagaactacctggagaaggatggaaatgaggccctgcacgagctgattgacaggatgaatgtgctggagcagctgacagccctgatgctgccctggggctgtgatgtgcagggcagcctgagcagcctgctgaagcacctggaggaggtgccccagctggtgaagctgggcctgaagaactggaggctgacagacacagagatccgcatcctgggcgccttcttcggcaagaaccccctgaagaacttccagcagctgaacctggccggcaacagagtgtccagtgatggctggctggccttcatgggcgtgtttgagaacctgaagcagctggtgttctttgacttcagcaccaaggagttcctgcctgaccctgccctggtgaggaagctgagccaggtgctgagcaagctgaccttcctgcaggaggcccggctggtgggctggcagtttgatgatgatgacctgagcgtcatcaccggggccttcaagctggtgacagcctag

SEQ ID NO: 19575 - DNA, 1065 bp, Artificial Sequence
  Description of Artificial Sequence: Synthetic coding sequence
atggccgagagccccacagaggaggccgccacagctggggccggggctgctggccctggggccagctctgtggccggcgtggtgggcgtgtctggcagcggcggcggctttggaccacccttcctgcctgatgtgtgggccgctgctgctgctgctgggggcgccggcggccctggcagcggcctggcccccctgcccggcctgcccccatctgctgctgcccatggagctgccctgctgagccactgggaccccaccctgagcagtgactgggatggagagaggacagccccccagtgcctgctgcgcatcaagagggacatcatgagcatctacaaggagcccccacctggcatgtttgtggtgcctgacacagtggacatgaccaagatccacgccctgatcaccggcccctttgacaccccctatgaaggaggcttcttcctgtttgtgttccgctgccccccagactaccccatccaccccccccgggtgaagctgatgaccaccggcaacaacacagtgcgcttcaaccccaacttctacagaaatggcaaggtgtgcctgagcatcctgggcacctggacaggccctgcctggagccctgcccagagcatcagctctgtgctgatcagcatccagagcctgatgacagagaacccctaccacaatgagcccggctttgagcaggagcggcaccctggggacagcaagaactacaatgaatgcatcagacatgagaccatccgggtggccgtgtgtgacatgatggagggcaagtgcccctgcccagagcccctgcggggcgtgatggagaagagcttcctggagtactatgacttctatgaggtggcctgcaaggaccggctgcacctgcagggccagaccatgcaggacccctttggagagaagaggggccactttgactaccagagcctgctgatgaggctgggcctcatccggcagaaggtgctggagcggctgcacaatgaaaatgctgagatggacagcgacagcagcagcagcggcacagaaacagacctgcacggcagcctgcgggtgtag

SEQ ID NO: 19576 - DNA, 2487 bp, Artificial Sequence
  Description of Artificial Sequence: Synthetic coding sequence
atggattctgaggccttccagagcgcccgggacttcctggacatgaacttccagagcctggccatgaagcacatggacctgaagcagatggagctggacacagctgctgccaaggtggatgagctgaccaagcagctggagagcctgtggagcgacagccctgcccctcctggcccccaggccggcccccccagcaggcctccccgctacagcagcagcagcatccctgagcccttcggcagccggggcagccccaggaaggccgccacagatggagctgacaccccatttggccgctctgagagcgcccccaccctgcacccctacagccccctgagccccaagggccggcccagcagccccaggacccccctgtacctgcagccagatgcctacggcagcctggaccgggccaccagcccccggccccgggcctttgatggagctggcagcagcctgggccgggcccccagccccaggcctggccctggccccctgcggcagcagggcccccccaccccatttgacttcctgggccgggccggcagcccccggggcagccccctggccgagggcccccaggccttcttccctgagcggggccccagcccccggcccccagccacagcctatgatgccccagccagcgccttcggcagcagcctgctgggcagcggcggcagcgcctttgccccacccctgcgggcccaggatgacctgaccctgcggcggcggccccccaaggcctggaatgaaagtgacctggatgtggcctatgagaagaagcccagccagacagccagctatgagcggctggatgtgtttgcccggcctgccagccccagcctgcagctgctgccctggagggagagcagcctggatggcctgggcggcaccgggaaggacaacctgaccagcgccaccctgcccaggaactacaaggtgagccccctggccagtgaccggcggagtgatgctggcagctaccgccgcagcctgggcagcgctggccccagcggcaccctgcccaggtcctggcagcctgtgagccgcatccccatgccacccagcagcccccagcccaggggggccccccggcagaggcccatccccctgtccatgatcttcaagctgcagaatgccttctgggagcacggggccagccgggccatgctgcccggcagccccctcttcacccgggcccccccacccaagctgcagccccagccccagccccagccccagccccagagccagccccagccccagctgcccccccagccccagacccagccccagacccccaccccagccccccagcacccccagcagacctggccccctgtgaatgaaggaccacccaagccacccacagagctggagcctgagcctgagattgagggcctgctgacccctgtgctggaggccggagatgtggatgagggccctgtggcccggcccctgagccccacccggctgcagcctgccctgcccccagaggcccagagcgtgcctgagctggaggaggtggcccgggtgctggccgagatcccccggcccctgaagagaagaggctccatggagcaggccccagctgtggccctgccccccacccacaagaagcagtaccagcagatcatcagccgcctcttccaccgccacggcggccctggccctgggggccctgagcctgagctgagccccatcacagagggcagcgaggcccgggccggccccccagccccagcccccccagcccccatccccccaccagcccccagccagagcagccccccagagcagccccagagcatggagatgaggtctgtgctgaggaaggccggcagccccaggaaggcccggcgggcccggctgaaccccctggtgctgctgctggatgctgccctgactggagagctggaggtggtgcagcaggccgtgaaggagatgaatgaccccagccagcccaatgaggagggcatcacagccctgcacaatgccatctgtggggccaactacagcatcgtggacttcctgatcacagctggggccaacgtgaacagcccagacagccacggctggacccccctgcactgtgccgccagctgcaatgacaccgtcatctgcatggccctggtgcagcacggggccgccatctttgccaccaccctgagtgatggagccacagcctttgagaagtgtgacccctaccgggagggctacgccgactgtgccacctacctggctgatgtggagcagagcatgggcctgatgaacagcggggctgtgtatgccctgtgggactacagcgctgagtttggagatgagctgtccttccgggagggggagagcgtgacagtgctgcggagagatggccctgaggagacagactggtggtgggccgccctgcacggccaggagggctacgtgcccaggaactacttcggcctcttcccccgggtgaagccccagaggagcaaggtgtag

SEQ ID NO: 19577 - DNA, 1131 bp, Artificial Sequence
  Description of Artificial Sequence: Synthetic coding sequence
atggtggtggaggtggacagcatgcctgctgccagctctgtgaagaagcccttcggcctgcggagcaagatgggcaagtggtgctgccgctgcttcccctgctgccgggagagcggcaagagcaatgtgggcaccagcggggaccatgatgacagcgccatgaagaccctgcggagcaagatgggcaagtggtgccgccactgcttcccctgctgccggggcagcggcaagagcaatgtgggcgccagcggggaccatgatgattctgccatgaagaccctgaggaacaagatgggcaagtggtgctgccactgcttcccctgctgccggggcagcagcaagagcaaggtgggcgcctggggagactatgatgacagcgccttcatggagccccgctaccacgtgcggggggaggacctggacaagctgcaccgggccgcctggtggggcaaggtgcccaggaaggacctgattgtgatgctgcgggacacagatgtgaacaagcaggacaagcagaagaggacagccctgcacctggccagcgccaatggaaacagcgaggtggtgaagctgctgctggaccggcgctgccagctgaatgtgctggacaacaagaagaggacagccctgatcaaggctgtgcagtgccaggaggatgaatgtgccctgatgctgctggagcacggcacagaccccaacatcccagatgaatatggcaacaccaccctgcactacgccatctacaatgaagacaagctgatggccaaggccctgctgctgtatggagctgacatcgagagcaagaacaagcacggcctgacccccctgctgctgggcgtgcatgagcagaagcagcaggtggtgaagttcctgatcaagaagaaggccaacctgaatgccctggacagatatggccgcacagccctgatcctggccgtgtgctgcggcagcgccagcatcgtgtccctgctgctggagcagaacattgatgtgagcagccaggacctgagcggccagacagcccgggagtatgctgtgagcagccaccaccacgtgatctgccagctgctgagtgactacaaggagaagcagatgctgaagatcagcagcgagaacagcaaccctggatag

SEQ ID NO: 19578 - DNA, 765 bp, Artificial Sequence
  Description of Artificial Sequence: Synthetic coding sequence
atgcctgccagcttccccatgctgcgctgtgcccggagcccctgctggacagtgtgctggagcccctggtgccgggccctgcctgatggccgctgcagctgcctgagcagcccccccagccccctgggccccacccgggaccctgtggccaccttcctggagacctgccgggagcccggcagccagcctgctggccctgccagcctgcgggcagagtacctgcccccatctgtggccagcatcaaggtgtctgctgagctgctgcgggccgccctgaaggatggccacagcggcgtgcccctgtgctgtgccaccctgcagtggctgctggccgagaatgctgctgtggatgtggtgcgggcccgggccctgagcagcatccagggcgtggccccagatggagccaacgtgcacctgattgtgcgggaggtggccatgacagacctgtgcccagctggccccatccaggccgtggagatccaggtggagagcagcagcctggccgacatctgccgggcccaccacgctgtggtgggccgcatgcagaccatggtgacagagcaggccacccagggcagcagcgccccagacctgcgggtgcagtacctgcggcagatccacgccaaccacgagaccctgctgcgggaggtgcagaccctgcgggaccggctgtgcacagaagatgaggccagcagctgtgccacagcccagaggctgctgcaggtgtaccggcagctgcggcaccccagcctcatcctgctgtag

SEQ ID NO: 19579 - DNA, 2046 bp, Artificial Sequence
  Description of Artificial Sequence: Synthetic coding sequence
atgtgtggcatctttgcctacctgaactaccacgtgcccaggacccggcgggagatcctggagaccctcatcaagggcctgcagaggctggagtaccggggctatgattctgctggggtgggctttgatggcggcaatgacaaggactgggaggccaatgcctgcaagatccagctgatcaagaagaagggcaaggtgaaggccctggatgaggaggtgcacaagcagcaggacatggacctggacattgaatttgatgtgcacctgggcatcgcccacacccgctgggccacccatggagagcccagccctgtgaacagccacccccagaggagtgacaagaacaatgagttcatcgtcatccacaacggcatcatcaccaactacaaggacctgaagaagttcctggagagcaagggctatgactttgaaagtgaaacagacacagagaccatcgccaagctggtgaagtacatgtatgacaaccgggagagccaggacaccagcttcaccaccctggtggagagggtcatccagcagctggagggcgcctttgccctggtgttcaagtctgtgcacttccctggccaggccgtgggcacccggcggggcagccccctgctgattggagtgcgctctgagcacaagctgagcacagaccacatccccatcctgtacagaacaggcaaggacaagaagggcagctgcaacctgagccgggtggacagcaccacctgcctcttccctgtggaggagaaggctgtggagtactactttgccagtgatgccagcgctgtgattgagcacaccaacagagtcatcttcctggaggatgatgatgtggccgctgtggtggatggccgcctgagcatccaccgcatcaagaggacagctggggaccaccctggccgggctgtgcagaccctgcagatggagctgcagcagatcatgaagggcaacttcagcagcttcatgcagaaggagatctttgagcagcctgagagcgtggtgaacaccatgaggggccgggtgaactttgatgactacacagtgaacctgggcggcctgaaggaccacatcaaggagatccagcgctgcagaagactcatcctgattgcctgtggcaccagctaccacgccggcgtggccacccggcaggtgctggaggagctgacagagctgcctgtgatggtggagctggccagtgacttcctggacaggaacacccctgtgttcagagatgatgtgtgcttcttcctgagccagagcggggagacagctgacaccctgatgggcctgcgctactgcaaggagcggggggccctgactgtgggcatcaccaacacagtgggcagcagcatcagccgggagacagactgtggggtgcacatcaatgccggccctgagattggagtggccagcaccaaggcctacaccagccagtttgtgtccctggtgatgtttgccctgatgatgtgtgatgaccgcatctccatgcaggagaggaggaaggagatcatgctgggcctgaagaggctgcctgacctgatcaaggaggtgctgtccatggatgatgagatccagaagctggccacagagctgtaccaccagaagtctgtgctgatcatgggccggggctaccactacgccacctgcctggagggcgccctgaagatcaaggagatcacctacatgcacagcgagggcatcctggccggggagctgaagcacggccccctggccctggtggacaagctgatgcctgtgatcatgatcatcatgagggaccacacctacgccaagtgccagaatgccctgcagcaggtggtggcccggcagggccggcctgtggtgatctgtgacaaggaggacacagagaccatcaagaacaccaagaggaccatcaaggtgccccacagcgtggactgcctgcagggcatcctgagcgtcatccccctgcagctgctggccttccacctggccgtgctgcggggctatgatgtggacttccccaggaacctggccaagtctgtgacagtggagtag

SEQ ID NO: 19580 - DNA, 498 bp, Artificial Sequence
  Description of Artificial Sequence: Synthetic coding sequence
atggaggacctgtttgagaccttccaggatgagatgggcttcagcaacatggaggatgatggccctgaggaggaggagcgggtggccgagccccaggccaacttcaacaccccccaggccctgcgctttgaggagctgctggccaacctgctgaatgagcagcaccagatcgccaaggagctgtttgagcagctgaagatgaagaagcccagcgccaagcagcagaaggaggtggagaaggtgaagccccagtgcaaggaggtgcaccagaccctcatcctggaccctgcccagaggaagaggctgcagcagcagatgcagcagcacgtgcagctgctgacccagatccacctgctggccacctgcaaccccaacctgaaccctgaggccagcagcacccgcatctgcctgtcctgggagcccctgctgaaggcccccagccccttcaccatcagcaccacccccagcttccggccctgcagcaaccctgtgacctag

SEQ ID NO: 19581 - DNA, 633 bp, Artificial Sequence
  Description of Artificial Sequence: Synthetic coding sequence
atggccgcctctgtggagcagcgggagggcaccatccaggtgcagggccaggccctcttcttccgggaggccctgcccggcagcggccaggcccgcttctctgtgctgctgctgcacggcatccgcttcagcagcgagacctggcagaacctgggcaccctgcaccggctggcccaggccggctacagagctgtggccatcgacctgcccggcctgggccacagcaaggaggccgccgccccagcccccatcggggagctggcccctggcagcttcctggccgctgtggtggatgccctggagctgggcccccctgtggtgatcagccccagcctgagcggcatgtacagcctgcccttcctgacagcccctggcagccagctgcccggctttgtgcctgtggcccccatctgcacagacaagatcaatgctgccaactatgcctctgtgaagaccccagccctgattgtgtatggagaccaggaccccatgggccagaccagctttgagcacctgaagcagctgcccaaccaccgggtgctgatcatgaagggggccggccacccctgctacctggacaagccagaggagtggcacacaggcctgctggacttcctgcagggcctgcagtag

SEQ ID NO: 19582 - DNA, 1248 bp, Artificial Sequence
  Description of Artificial Sequence: Synthetic coding sequence
atgagagctgctgacagcggctcctgggagcgggtgcggcagctggccgcccagggcgagcccgcccccagctgtggggccggggccggccctgcccggcccccaggccctgctgcctgtgagcagtgtgtggatgctgctggccctggggaccggcccagggctggggtgccccgggtgcgggcagatggagactgcagccagcctgtgctgctgcgggaggaggtgtcccggctgcaggaggaggtgcacctgctgcggcagatgaaggagatgctggccaaggacctggaggagagccagggcggcaagagcagcgaggtgctgagcgccacagagctgcgggtgcagctggcccagaaggagcaggagctggcccgggccaaggaggccctgcaggccatgaaggctgacaggaagaggctgaagggggagaagacagacctggtgtcccagatgcagcagctgtatgccaccctggagagccgggaggagcagctgcgggacttcatccggaactatgagcagcacaggaaggagagtgaagatgctgtgaaggccctggccaaggagaaggacctgctggagcgggagaagtgggagctgcggcggcaggccaaggaggccacagaccacgccacagccctgcggagccagctggacctgaaggacaacaggatgaaggagctggaggccgagctggccatggccaagcagagcctggccaccctgaccaaggatgtgcccaagaggcacagcctggccatgcctggagagaccgtgctgaatggaaaccaggagtgggtggtgcaggccgacctgcccctgacagctgccatccggcagagccagcagaccctgtaccacagccaccccccccaccctgctgaccggcaggccgtgcgggtgagcccctgccacagccggcagcccagcgtcatcagtgatgccagcgctgctgagggggacaggagcagcacccccagcgacatcaacagccccaggcacaggacccacagcctgtgcaatggagacagccctggccctgtgcagaagaacctgcacaaccccatcgtgcagagcctggaggacctggaggaccagaagaggaagaagaagaaggagaagatgggcttcggcagcatcagccgggtgtttgcccggggcaagcagaggaagagcctggaccccggcctgtttgatggaacagccccagactactacattgaagaagatgctgactggtag

SEQ ID NO: 19583 - DNA, 693 bp, Artificial Sequence
  Description of Artificial Sequence: Synthetic coding sequence
atggaggccgctgagacagaggccgaggccgccgccctggaggtgctggccgaggtggccggcatcctggagcctgtgggcctgcaggaggaggccgagctgcctgccaagatcctggtggagtttgtggtggacagccagaagaaggacaagctgctgtgcagccagctgcaggtggccgacttcctgcagaacatcctggcccaggaggacacagccaagggcctggaccccctggccagcgaggacaccagccggcagaaggccatcgccgccaaggagcagtggaaggagctgaaggccacctaccgggagcacgtggaggccatcaagattggcctgaccaaggccctgacccagatggaggaggcccagaggaagaggacccagctgcgggaggcctttgagcagctgcaggccaagaagcagatggccatggagaagagaagagctgtgcagaaccagtggcagctgcagcaggagaagcacctgcagcacctggccgaggtgtctgctgagggcaagctgctcttccctgaggccgaggccgaggccgagaacctgcctgatgacaagccccagcagcccacccggccccaggagcagagcactggagacaccatgggccgggaccccggggtgtccttcaaggctgtgggcctgcagcctgctggagatgtgaacctgccctag

SEQ ID NO: 19584 - DNA, 2547 bp, Artificial Sequence
  Description of Artificial Sequence: Synthetic coding sequence
atgcaggccgaggccgctgactggttcagctccatgcccttccagaagcacgtgtactaccccctggccagcggccctgagggcccagatgtggccgtggccgctgctgctgctggggccgcctccatggcctgtgcccctccttctgctgccagcggccccctgcccttcttccagttccggccccggctggagagcgtggactggaggcggctgagcgccattgatgtggacaaggtggccggggctgtggatgtgctgaccctgcaggagaacatcatgaacatcaccttctgcaagctggaggatgagaagtgcccccactgccagagcggcgtggaccctgtgctgctgaagctgatccggctggcccagttcaccatcgagtacctgctgcacagccaggagttcctgaccagccagctgcacaccctggaggagcggctgcggctgagccactgtgatggagagcagagcaagaagctgctgaccaagcaggccggggagatcaagaccctgaaggaggagtgcaagaggaggaagaagatgatcagcacccagcagctgatgattgaggccaaggccaactactaccagtgccacttctgtgacaaggccttcatgaaccaggccttcctgcagagccacatccagaggaggcacacagaggagaacagccactttgagtaccagaagaatgcccagatcgagaagctgcggagtgaaattgtggtgctgaaggaggagctgcagctgaccaggtctgagctggaggccgcccaccacgccagcgctgtgcgcttcagcaaggagtatgagatgcagaagaccaaggaggaggacttcctgaagctgtttgaccgctggaaggaggaggagaaggagaagctggtggatgagatggagaaggtgaaggagatgttcatgaaggagttcaaggagctgaccagcaagaacagcgccctggagtaccagctgtctgagatccagaagagcaacatgcagatcaagagcaacatcggcaccctgaaggatgcccacgagttcaaggaggacaggagcccctacccccaggacttccacaacgtgatgcagctgctggacagccaggagagcaagtggacagcccgggtgcaggccatccaccaggagcacaagaaggagaagggccgcctgctgagccacatcgagaagctgcggacctccatgattgatgacctgaatgccagcaatgtgttctacaagaagagaattgaggagctgggccagaggctgcaggagcagaatgaactcatcatcacccagaggcagcagatcaaggacttcacctgcaaccccctgaacagcatcagcgagcccaaggtgaatgccccagccctgcacaccctggagaccaagagcagcctgcccatggtgcatgagcaggccttcagcagccacatcctggagcccatcgaggagctgtctgaggaggagaagggccgggagaatgagcagaagctgaacaacaacaagatgcacctgaggaaggccctgaagagcaacagcagcctgaccaagggcctgcggaccatggtggagcagaacctgatggagaagctggagaccctgggcatcaatgctgacatccggggcatcagcagtgaccagctgcaccgggtgctgaagtctgtggagagcgagcggcacaagcaggagcgggagatccccaacttccaccagatccgggagttcctggagcaccaggtgtcctgcaagattgaggagaaggccctgctgagcagtgaccagtgcagcgtgtcccagatggacaccctgagcactggagaggtgcccaagatgatccagctgcccagcaagaaccggcagctgatccggcagaaggctgtgtccacagacaggacctctgtgcccaagatcaagaagaatgtgatggaggaccccttccccaggaagagcagcaccatcaccaccccacccttcagcagcgaggaggagcaggaggatgatgacctgatccgggcctatgccagccctggccccctgcctgtgcccccaccccagaacaagggcagctttgggaagaacacagtgaagagtgatgctgatggaacagagggcagcgagattgaggacacagatgacagccccaagccagctggggtggccgtgaagacccccacagagaaggtggagaagatgttcccccacaggaagaatgtgaacaagcctgtgggcggcaccaacgtgcctgagatgttcatcaagaaggaggagctgcaggagctgaagtgtgctgatgtggaggatgaggactgggacatcagcagcctggaggaggagatcagcctgggcaagaagagcggcaaggagcagaaggagcccccaccagccaagaatgagccccactttgcccacgtgctgaatgcctggggcgccttcaaccccaagggccccaagggggagggcctgcaggagaatgaaagcagcaccctgaagagcagcctggtgacagtgacagactggagcgacaccagtgatgtgtag

SEQ ID NO: 19585 - DNA, 1185 bp, Artificial Sequence
  Description of Artificial Sequence: Synthetic coding sequence
atggtggtggaggtggacagcatgcctgctgccagctctgtgaagaagcccttcggcctgcggagcaagatgggcaagtggtgctgccgctgcttcccctgctgccgggagagcggcaagagcaatgtgggcaccagcggggaccatgatgacagcgccatgaagaccctgcggagcaagatgggcaagtggtgccgccactgcttcccctgctgccggggcagcggcaagagcaatgtgggcgccagcggggaccatgatgattctgccatgaagaccctgaggaacaagatgggcaagtggtgctgccactgcttcccctgctgccggggcagcagcaagagcaaggtgggcgcctggggagactatgatgacagcgccttcatggagccccgctaccacgtgcggggggaggacctggacaagctgcaccgggccgcctggtggggcaaggtgcccaggaaggacctgattgtgatgctgcgggacacagatgtgaacaagcaggacaagcagaagaggacagccctgcacctggccagcgccaatggaaacagcgaggtggtgaagctgctgctggaccggcgctgccagctgaatgtgctggacaacaagaagaggacagccctgatcaaggtgtgcagcagccagctgtaccagcatgaagctgtgcagtgccaggaggatgaatgtgccctgatgctgctggagcacggcacagaccccaacatcccagatgaatatggcaacaccaccctgcactacgccatctacaatgaagacaagctgatggccaaggccctgctgctgtatggagctgacatcgagagcaagaacaagcacggcctgacccccctgctgctgggcgtgcatgagcagaagcagcaggtggtgaagttcctgatcaagaagaaggccaacctgaatgccctggacagatatggccgcacagccctgatcctggccgtgtgctgcggcagcgccagcatcgtgtccctgctgctggagcagaacattgatgtgagcagccaggacctgagcggccagacagcccgggagtatgctgtgagcagccaccaccacgtgatctgccagctgctgagtgactacaaggagaagcagatgctgaagatcagcagcgagaacagcaacccagaaaatgtgtccaggaccaggaacaagtag

SEQ ID NO: 19586 - DNA, 1308 bp, Artificial Sequence
  Description of Artificial Sequence: Synthetic coding sequence
atggcccccttcggcaggaacctgctgaagaccaggcacaagaacagaagccccaccaaggacatggacagcgaggagaaggagatcgtggtgtgggtgtgccaggaggagaagctggtgtgtggcctgaccaagaggaccaccagcgcagatgtgatccaggccctgctggaggagcacgaggccaccttcggggagaagcgcttcctgctgggcaagcccagcgactactgcatcatcgagaagtggaggggcagcgagcgggtgctgccccccctgacccgcatcctgaagctgtggaaggcctggggagatgagcagcccaacatgcagtttgtgctggtgaaggcagatgccttcctgcctgtgcccctgtggaggacagctgaggccaagctggtgcagaacacagagaagctgtgggagctgagccctgccaactacatgaagaccctgcccccagacaagcagaagagaattgtgaggaagaccttcaggaagctggccaagatcaagcaggacacagtgtcccatgaccgggacaacatggagaccctggtgcacctgatcatcagccaggaccacaccatccaccagcaggtgaagaggatgaaggagctggacctggagattgaaaaatgtgaggccaagttccacctggacagagtggagaatgatggagagaactacgtgcaggatgcctacctgatgcccagcttcagcgaggtggagcagaacctggacctgcagtatgaggagaaccagaccctggaggacctgtctgagagtgatggcatcgagcagctggaggagcggctgaagtactaccgcatcctgattgacaagctgtctgctgagattgagaaggaggtgaagtctgtgtgcatcgacatcaatgaagatgctgagggggaggccgccagcgagctggagagcagcaacctggagagcgtgaagtgtgacctggagaagtccatgaaggccggcctgaagatccacagccacctgagcggcatccagaaggagatcaagtacagcgacagcctgctgcagatgaaggccaaggagtatgagctgctggccaaggagttcaacagcctgcacatcagcaacaaggatggctgccagctgaaggaaaatagagccaaggagagcgaggtgcccagcagcaatggagagatcccccccttcacccagagggtcttcagcaactacaccaatgacacagacagcgacaccggcatcagcagcaaccacagccaggacagcgagaccaccgtgggagatgtggtgctgctgagcacctag

SEQ ID NO: 19587 - DNA, 1644 bp, Artificial Sequence
  Description of Artificial Sequence: Synthetic coding sequence
atggccggcaccaagaacaagacccgggcccaggccaagacagagaagaaggccgccatccaggccaaggccggggctgagcgggaggccactggagtggtgcggcctgtggccaagacccgggccaaggccaaggccaagacaggcagcaagacagatgctgtggccgagatgaaggctgtgtccaagaacaaggtggtggccgagaccaaggagggcgccctgtctgagcccaagaccctgggcaaggccatgggagacttcacccccaaggctggaaatgaaagcaccagcagcacctgcaagaatgaagctggaacagatgcctggttctgggccggggaggaggccaccatcaacagctggttctggaatggagaggaggccggcaacagcttcagcaccaagaatgacaagccagagatcggggcccaggtgtgtgccgaggagctggagcctgctgctggagctgactgcaagcccaggtctggagctgaggaggaggaggaggagaatgtcatcggcaactggttctgggagggagatgacaccagctttgaccccaaccccaagcctgtgagccgcatcgtgaagccccagcctgtgtatgagatcaatgagaagaaccggcccaaggactggagcgaggtgaccatctggcccaatgccccagctgtgaccccagctgtgctgggcttccgcagccaggcccccagcgaggccagccccccatcctacatcgtgctggccagcgctgaggagaatgcctgcagcctgcctgtggccacagcctgccggcccagcaggaacaccaggagctgcagccagcccatccctgagtgccgctttgacagcgacccctgcatccagaccattgatgagatccggcggcagatccgcatccgggaggtgaatggcatcaagccctttgcctgcccctgcaagatggagtgctacatggacagcgaggagtttgagaagctggtgtccctgctgaagagcaccacagaccccctcatccacaagatcgcccgcatcgccatgggcgtgcacaacgtgcacccctttgcccaggagttcatcaatgaggtgggcgtggtgaccctcatcgagagcctgctgtccttccccagccctgagatgaggaagaagacagtcatcaccctgaaccccccatctggagatgagcggcagaggaagattgagctgcacgtgaagcacatgtgcaaggagaccatgtccttccccctgaacagccctggccagcagagcggcctgaagatcctgggccagctgaccacagactttgtgcaccactacatcgtggccaactacttcagcgagctgttccacctgctgagcagcggcaactgcaagaccaggaacctggtgctgaagctgctgctgaacatgtctgagaaccccacagctgcccgggacatgatcaacatgaaggccctggccgccctgaagctgatcttcaaccagaaggaggccaaggccaacctggtgtctggagtggccatcttcatcaacatcaaggagcacatcaggaagggcagcatcgtggtggtggaccacctgagctacaacaccctgatggccatcttccgggaggtgaaggagatcatcgagaccatgtag

SEQ ID NO: 19588 - DNA, 1362 bp, Artificial Sequence
  Description of Artificial Sequence: Synthetic coding sequence
atggccaggaaggtggtgtccaggaagaggaaggccccagccagccctggggccggcagtgatgcccagggcccccagtttggctgggaccacagcctgcacaagaggaagaggctgccccctgtgaagaggagcctggtgtactacctgaagaaccgggaggtgcggctgcagaatgagaccagctacagccgggtgctgcacggctatgctgcccagcagctgcccagcctgctgaaggagcgggagttccacctgggcaccctgaacaaggtgtttgccagccagtggctgaaccaccggcaggtggtgtgtggcaccaagtgcaacaccctgtttgtggtggatgtgcagaccagccagatcaccaagatccccatcctgaaggaccgggagcctggaggagtgacccagcagggctgcggcatccacgccatcgagctgaaccccagcaggaccctgctggccactggaggagacaaccccaacagcctggccatctaccgcctgcccaccctggaccctgtgtgtgtgggagatgatggccacaaggactggatcttcagcatcgcctggatcagtgacaccatggctgtgtctggcagcagagatggctccatgggcctgtgggaggtgacagatgatgtgctgaccaagagtgatgcccggcacaacgtgtcccgggtgcctgtgtatgcccacatcacccacaaggccctgaaggacatccccaaggaggacaccaacccagacaactgcaaggtgcgggccctggccttcaacaacaagaacaaggagctgggcgctgtgtccctggatggctacttccacctgtggaaggccgagaacaccctgagcaagctgctgagcaccaagctgccctactgccgggagaatgtgtgcctggcctacggcagcgagtggagcgtgtatgctgtgggcagccaggcccacgtgtccttcctggacccccggcagcccagctacaacgtgaagtctgtgtgcagccgggagcggggcagcggcatccgctctgtgtccttctatgagcacatcatcaccgtgggcaccggccagggcagcctgctcttctatgacatccgggcccagcgcttcctggaggagcggctgagcgcctgctacggcagcaagccccggctggccggggagaacctgaagctgaccaccgggaagggctggctgaaccatgatgagacctggaggaactacttcagtgacatcgacttcttccccaatgctgtgtacacccactgctatgacagcagcggcaccaagctgtttgtggccggcggccccctgcccagcggcctgcacggcaactatgccggcctgtggagctag

SEQ ID NO: 19589 - DNA, 2439 bp, Artificial Sequence
  Description of Artificial Sequence: Synthetic coding sequence
atggaggccttccaggagctgaggaagcccagcgcccggctggagtgtgaccactgcagcttccggggcacagattatgaaaatgtgcagatccacatgggcaccatccaccctgagttctgtgatgagatggatgctgggggcctgggcaagatgatcttctaccagaagagcgccaagctgttccactgccacaagtgcttcttcaccagcaagatgtacagcaatgtgtactaccacatcaccagcaagcacgccagcccagacaagtggaatgacaagcccaagaaccagctgaacaaggagacagatcctgtgaagagcccccccctgcctgagcaccagaagatcccctgcaacagcgctgagcccaagagcatcccagccctgtccatggagacccagaagctgggctctgtgctgagccctgagagccccaagcccacccccctgacccccctggagccccagaagccaggctctgtggtgtccccagagctgcagacccccctgcccagccctgagcccagcaagccagcctctgtgagcagccctgagccccccaagtctgtgcctgtgtgtgagagccagaagctggcccctgtgcccagccctgagccccagaagccagcccctgtgtccccagagagcgtgaaggccaccctgagcaaccccaagccccagaagcagagccacttccctgagaccctgggccccccatctgccagcagccctgagagccctgtgctggccgccagccctgagccctggggccccagccctgctgccagccctgagagcaggaagagcgcccggaccaccagccctgagcccaggaagcccagccccagcgagagccctgagccctggaagcccttccctgctgtgtccccagagcccaggaggcctgccccagctgtgtccccaggctcctggaagccaggccccccaggcagcccccggccctggaagagcaaccccagcgccagcagcggcccctggaagccagccaagccagcccccagcgtgtccccaggcccctggaagcccatccccagcgtgtccccaggcccctggaagcccacccccagcgtgtcctctgcctcctggaagagcagctctgtgagccccagctcctggaagagccccccagccagccctgagagctggaagagcggccccccagagctgaggaagacagcccccaccctgagccctgagcactggaaggctgtgccccctgtgtccccagagctgaggaagccaggcccccccctgagccctgagatccgcagccctgctggcagccctgagctgaggaagcccagcggcagcccagacctgtggaagctgagcccagaccagaggaagaccagccctgccagcctggacttccctgagagccagaagagcagccggggcggcagcccagacctgtggaagagcagcttcttcatcgagccccagaagcctgtgtttcctgagaccaggaagccaggccccagcggccccagcgagagccccaaggccgccagtgacatctggaagcctgtgctgagcattgacacagagcccaggaagccagccctcttccctgagcccgccaagacagcccccccagccagccctgaggccaggaagagggccctcttccctgagcccaggaagcacgccctcttccctgagctgcccaagagcgccctcttcagcgagagccagaaggctgtggagctgggagatgagctgcagattgatgccattgatgaccagaagtgtgacatcctggtgcaggaggagctgctggccagccccaagaagctgctggaggacaccctcttccccagcagcaagaagctgaagaaggacaaccaggagagcagtgatgctgagctgagcagcagcgagtacatcaagacagacctggatgccatggacatcaagggccaggagagcagcagtgaccaggagcaggtggatgtggagagcattgacttcagcaaggagaacaagatggacatgaccagccctgagcagagcagaaatgtgctgcagttcacagaggagaaggaggccttcatcagcgaggaggagatcgccaagtacatgaagaggggcaagggcaagtactactgcaagatctgctgctgccgggccatgaagaagggagctgtgctgcaccacctggtgaacaagcacaacgtgcacagcccctacaagtgcaccatctgtgggaaggccttcctgctggagagcctgctgaagaaccacgtggccgcccacggccagagcctgctgaagtgcccccgctgcaactttgagagcaacttcccccggggcttcaagaagcacctgacccactgccagagccgccacaatgaggaggccaacaagaagctgatggaggccctggagccccccctggaggagcagcagatctag

SEQ ID NO: 19590 - DNA, 1974 bp, Artificial Sequence
  Description of Artificial Sequence: Synthetic coding sequence
atggatgagcaggaggccctgaacagcatcatgaatgacctggtggccctgcagatgaacagaagacacaggatgcctggctatgagaccatgaagaacaaggacaccggccacagcaaccggcagaagaagcacaacagcagcagcagcgccctgctgaacagccccaccgtgaccaccagcagctgtgccggggccagcgagaagaagaagttcctgagtgatgtgcgcatcaagtttgagcacaatggagagcggcgcatcatcgccttcagcaggcctgtgaagtatgaagatgtggagcacaaggtgaccaccgtgtttggccagcccctggacctgcactacatgaacaatgagctgagcatcctgctgaagaaccaggatgacctggacaaggccatcgacatcctggacaggagcagctccatgaagagcctgcgcatcctgctgctgagccaggacaggaaccacaacagcagcagcccccacagcggcgtgtcccggcaggtgcgcatcaaggccagccagagcgctggggacatcaacaccatctaccagcccccagagcccaggagccgccacctgtctgtgagcagccagaaccctggccgcagcagccccccacctggctacgtgcctgagcggcagcagcacatcgcccggcagggcagctacaccagcatcaacagcgagggggagttcatccctgagaccagcgagcagtgcatgctggaccccctgagcagcgctgagaacagcctgagcggcagctgccagagcctggacagatctgctgacagccccagcttcaggaagagcaggatgagccgggcccagagcttcccagacaaccggcaggagtacagcgaccgggagacccagctgtatgacaagggcgtgaagggcggcacctacccccggcgctaccacgtgtctgtgcaccacaaggactacagtgatggaagaaggaccttcccccgcatccgccgccaccagggcaacctcttcaccctggtgcccagcagccgcagcctgagcaccaatggagagaacatgggcctggccgtgcagtacctggacccccggggccgcctgcggtctgctgacagtgaaaatgccctgtctgtgcaggagagaaatgtgcccaccaagagccccagcgcccccatcaactggaggcggggcaagctgctgggccagggcgccttcggccgggtgtacctgtgctatgatgtggacaccggccgggagctggccagcaagcaggtgcagtttgatcctgacagccctgagaccagcaaggaggtgtctgccctggagtgtgagatccagctgctgaagaacctgcagcacgagagaattgtgcagtactacggctgcctgcgggacagagctgagaagaccctgaccatcttcatggagtacatgcctgggggctctgtgaaggaccagctgaaggcctatggagccctgacagaatctgtgaccaggaagtacacccggcagatcctggagggcatgagctacctgcacagcaacatgattgtgcaccgggacatcaagggggccaacatcctgcgggacagcgctggaaatgtgaagctgggggactttggagccagcaagaggctgcagaccatctgcatgtctggaacaggcatgaggtctgtgacaggcaccccctactggatgagccctgaggtgatctctggagagggctacggcaggaaggcagatgtgtggagcctgggctgcaccgtggtggagatgctgacagagaagccaccctgggccgagtatgaggccatggccgccatcttcaagatcgccacccagcccaccaacccccagctgcccagccacatcagcgagcacggccgggacttcctgcggcgcatctttgtggaggcccggcagaggccttctgctgaggagctgctgacccaccactttgcccagctgatgtactag

SEQ ID NO: 19591 - DNA, 2547 bp, Artificial Sequence; identical to SEQ ID NO: 19584
  Description of Artificial Sequence: Synthetic coding sequence

SEQ ID NO: 19592 - DNA, 4074 bp, Artificial Sequence
  Description of Artificial Sequence: Synthetic coding sequence
atggctgacacagacctcttcatggagtgtgaggaggaggagctggagccctggcagaagatcagtgatgtgattgaggacagcgtggtggaggactacaacagcgtggacaagaccaccacagctggcaaccccctggtgcagcagggcggccagcccctcatcctgacccagaacccagcccctggcctgggcaccatggtgacccagcctgtgctgcggcctgtgcaggtgatgcagaatgccaaccacgtgaccagcagccctgtggccagccagcccatcttcatcaccacccagggcttccctgtgagaaatgtgcggcctgtgcagaatgccatgaaccaggtgggcatcgtgctgaatgtgcagcagggccagacagtgcggcccatcaccctggtgcctgcccctggcacccagtttgtgaagcccaccgtgggcgtgccccaggtgttcagccagatgacccctgtgcggcccggcagcaccatgcctgtgcggcccaccaccaacaccttcaccaccgtcatcccagccaccctgaccatccgcagcacagtgccccagagccagagccagcagaccaagagcacccccagcaccagcaccacccccacagccacccagcccaccagcctgggccagctggccgtgcagagccctggccagagcaaccagaccaccaaccccaagctggcccccagcttccccagccccccagctgtgtccatcgccagctttgtgacagtgaagaggcctggggtgactggagagaacagcaatgaggtggccaagctggtgaacaccctgaacaccatccccagcctgggccagagccctggccctgtggtggtgagcaacaacagcagcgcccacggcagccagaggaccagcggccctgagagctccatgaaggtgaccagcagcatccctgtgtttgacctgcaggacggcggcaggaagatctgcccccgctgcaatgcccagttccgggtgacagaggccctgcggggccacatgtgctactgctgcccagagatggtggagtaccagaagaagggcaagagcctggacagcgagcccagcgtgcccagcgctgccaagccacccagccctgagaagacagcccctgtggccagcacccccagcagcacccccatcccagccctgagcccccccaccaaggtgcctgagcccaatgaaaatgtgggagatgctgtgcagaccaagctgatcatgctggtggatgacttctactacggcagagatggcggcaaggtggcccagctgaccaacttccccaaggtggccaccagcttccgctgcccccactgcaccaagaggctgaagaacaacatccgcttcatgaaccacatgaagcaccacgtggagctggaccagcagaatggagaggtggatggccacaccatctgccagcactgctaccggcagttcagcacccccttccagctgcagtgccacctggagaatgtgcacagcccctatgagagcaccaccaagtgcaagatctgtgagtgggcctttgagagcgagcccctcttcctgcagcacatgaaggacacccacaagccaggagagatgccctacgtgtgccaggtgtgccagtaccgcagcagcctgtacagcgaggtggatgtgcacttcaggatgattcatgaggacaccaggcacctgctgtgcccctactgcctgaaggtgttcaagaatggaaatgccttccagcagcactacatgaggcaccagaagagaaatgtgtaccactgcaacaagtgccgcctgcagttcctgtttgccaaggacaagattgagcacaagctgcagcaccacaagaccttcaggaagcccaagcagctggagggcctgaagccaggcaccaaggtgaccatccgggccagccggggccagcccaggacagtgcctgtgagcagcaatgacaccccaccttctgccctgcaggaggccgcccccctgaccagctccatggaccccctgcctgtgttcctgtacccacctgtgcagaggagcatccagaagagagctgtgaggaagatgtctgtgatgggccggcagacctgcctggagtgcagctttgagatcccagacttccccaaccacttccccacctacgtgcactgcagcctgtgccgctacagcacctgctgcagccgggcctatgccaaccacatgatcaacaaccacgtgcccaggaagagccccaagtacctggccctcttcaagaacagcgtgtctggcatcaagctggcctgcaccagctgcacctttgtgacctctgtgggagatgccatggccaagcacctggtgttcaaccccagccacaggagcagcagcatcctgccccggggcctgacctggatcgcccacagcagacatggccagacccgggacagagtgcatgacagaaatgtgaagaacatgtacccacctccttccttccccaccaacaaggccgccaccgtgaagtctgctggggccaccccagctgagcctgaggagctgctgacccccctggccccagccctgcccagccctgccagcacagccaccccaccacccacccccacccacccccaggccctggccctgccccccctggccacagaaggagcagaatgtctgaatgtggatgaccaggatgagggcagccctgtgacccaggagcctgagctggccagcggcggcggcggcagcggaggagtgggcaagaaggagcagctgtctgtgaagaagctgcgggtggtgctgtttgccctgtgctgcaacacagagcaggccgctgagcacttcaggaacccccagaggcgcatccgccgctggctgcggcgcttccaggccagccagggcgagaacctggagggcaagtacctgagctttgaggccgaggagaagctggccgagtgggtgctgacccagcgggagcagcagctgcctgtgaatgaggagaccctcttccagaaggccaccaagattggccgcagcctggagggcggcttcaagatctcctatgagtgggccgtgcgcttcatgctgcggcaccacctgacccctcatgccaggagagctgtggcccacaccctgcccaaggatgtggccgagaatgccggcctcttcatcgactttgtgcagaggcagatccacaaccaggacctgcccctgtccatgattgtggccattgatgagatcagcctcttcctggacacagaggtgctgagcagtgatgacagaaaagaaaatgccctgcagacagtgggcactggagagccctggtgtgatgtggtgctggccatcctggctgatggcaccgtgctgcccaccctggtgttctaccggggccagatggaccagcctgccaacatgccagacagcatcctgctggaggccaaggagagcggctacagtgatgatgagatcatggagctgtggagcaccagggtgtggcagaagcacacagcctgccagaggagcaagggcatgctggtgatggactgccacaggacccacctgtctgaggaggtgctggccatgctgagcgccagcagcaccctgcctgctgtggtgcctgctggctgcagcagcaagatccagcccctggatgtgtgcatcaagaggacagtgaagaacttcctgcacaagaagtggaaggagcaggcccgggagatggctgacacagcctgtgacagtgatgtgctgctgcagctggtgctggtgtggctgggggaggtgctgggcgtgattggagactgcccagagctggtgcagaggagcttcctggtggcctctgtgctgcccggcccagatggcaacatcaacagccccaccagaaatgctgacatgcaggaggagctgattgccagcctggaggagcagctgaagctgtctggagagcacagcgagagcagcaccccccggcccaggagcagccctgaggagaccatcgagcctgagagcctgcaccagctgtttgaaggagagagcgagacagagagcttctacggctttgaggaggccgacctggacctgatggagatctag

SEQ ID NO: 19593 - DNA, 2904 bp, Artificial Sequence
  Description of Artificial Sequence: Synthetic coding sequence
atgggccctggccagcctgccagcacctgtgtgcacctggcccccaggacccagctggatggccgcagtgaccccaaggtgctgcagacccagaaccagctgcagttcaacagaaatgtgcccacccacagcagcaacctggccatccgctacagctgcccccacgccatcagaattgagaagctgaagcacagctacaatgaaagctaccactgcaaggatgctgactgccgggtgggccctgacctgggcagctctgtgtccttcagcgtcatcagccaggagcggctgtcctatgctgtgcacctggccaggagagatgtgaagaggcggcagtttgagaagcacatcaaggagcaccacctgcggagccagccccagagcagccagaagtgtggccacaccaagtacaagatcccagaccaccgggtggagaggaaggagagcaagagccaggccgcctgccagtgcagccaccagcccagcaaggtggagatcagcagcagcggggccaaggtgtacctgtacagcagccaccctggccagagcgacctgactgtgcccaacagcccccccacccatgaccccggcctgcagccccacccccgcatcggggaccacaagaacatcagcgagcagaagagcctgctggaggtgcagaggctgcagaaggagctgagcagctgcatccacaagattgaggaggtgaccaagaaggaccggctggaggaggccctggaccctgatgaggagcggcgcatccgcatccggcggcaggagcaggccgcccggagcgccaggatgctgtatgtgctgcagcagcaggtgaaggagatccaggaggagctggacaagctgagcccccacaagatcaagcacaccaagaagtcctgggccatgagcaagctggccgccgcccacagaggagccatccgggccctgcagatgtttgtgacccagttcacagacagaggagagcaccccctgcctgcccgctgcaaggagctgggcagcctcatccggcagctgagcctgtgcagcgtgaagctggatgctgaccccagcgtgcctgatgtggtgattgacatcctgcagcagatcgaggccctggagagcctgctggagaagaagctgagccccaagaaggtgaagaagtgcttcagcgagatccgcagccgcttccccatcggcagccagaaggccctggagcgctggcccagcaccagccccaagggggagcggcggcccctgacagccaaggacaccttcccccaggagaccagccggcccagcgtggccaagcagctgctggccgacaagtaccagcctgacacagagctgcctgagacccagaggctgcagagcgagctggatgtgctggatgctgacatcgtgctggaggagggccccttcatcctggaccagagcgccagcttcaaggatgaggtgctggccgtggccaagaccaaggccggcaagaagaagcctgtgacagaaaatgtgcccttcaggaagaaggacaccctggccccagcccggcagcagggcctgaggaaggccgagcggggccggcagagccagccccacagcaagagccgggtgcagcagaccaccgtgagcagccggctgaagatgaaccggcagcctgtgaaggacaggaaggccccctggatcccccccaaccccaccagccccccagccagccccaagtgtgccgcctggctgaaggtgaagaccagccccagagatgccaccaaggagcccctgcagcaggaggacccccaggaggagagccacctgactggagctgtggagcacgaggccgcccggctggcctggctggatgctgagaccagcaagaggctgaaggagctggaggagctgaaggccaaggagattgacagcatgcagaagcagaggctggactggctggatgctgagaccagcaggaggaccaaggagctgaatgagctgaaggccgaggagatgtaccgcctgcagcagctgtctgtgtctgccacccacctggccgacaaggtggaggaggccgtgctggaccggctgaagcccctgctggtgaaggcccagagggtgaacagcaccacagaggccaacatccacctgaaggatggcagctctgtgaacacagccaaggcccagcctgcccaggaggtggccgctgtggactttgagagcaacaacatccggcagctggatgacttcctggaggactgtgccagcgagctgtgggccgtgacccacgccaagatcctgggcagcgagaccctggccaccgtggaggacagcaaggacagcccagacctggagatcatgatgaggaggatggaggagatggagaagtaccaggagagcgtgcggcagcgctacaacaagatcgcctatgctgacccccggctgtggatgcaggaggagaacaatgaccagaagatcagcgccatcagcgagaagcccctgagcccccaccccatccgcatcaccaagacagtggacaggaaggaccctgctgtgaacatcatgctggagcggccctgcaatggaaacagcctggatgaatctgtgggcacagaggagggcagcgagaagcgggaggcccccctgctgagcctggccgaggacagccagcagaaggagggccgggcccccctgtttgtgcccccaggcatgcagcacagcattggagactactgcagcagatttgagcagtacctgcgcatcatcagccatgaagctgtgggcagcttcaacccctggctgattgctgagagcttcagcgaggagctggtggatgaggccctgggcgctgtggccgctgagctgcaggacatgtgtgaagattatgcagaggccgtgttcaccagcgagttcctggaggccgccacctag

SEQ ID NO: 19594 - DNA, 6840 bp, Artificial Sequence
  Description of Artificial Sequence: Synthetic coding sequence
atgtaccgcagcagcgcccggagctctgtgagcagccaccggcccaaggatgatggcggcggcggccccaggagcggccgcagcagcggcagcagcagcggccctgcccggcgcagcagccccccacctccacccagcggcagcagcagcaggaccccagcccggcggcccaggagccccagcggccaccggggccggcgggccagccccagccccccccggggccggcgggtgagccccagccccccccgggcccggcggggcagccccagccccccccggggccggcggctcttccccccaggccctgctggcttccggggcagcagcagaggagagagcagagctgactatgccagagatggccgcggggaccaccctggggacagcggcagcagaagaagaagccctggcctgtgcagcgacagcctggagaagagcctgcgcatcaccgtgggcaatgaccacttctgtgtgtccaccccagagcggcggcggctgagtgaccggctgggcagccctgtggacaacctggaggacatggacagagatgacctgacagatgacagcgtcttcaccaggagcagccagtgcagccggggcctggagcgctacatcagccaggaggagggccccctgagccccttcctgggccagctggatgaggactaccgcaccaaggagaccttcctgcacagaagtgactacagcccccacatcagctgccatgatgagctgctgcggggcacagagaggaaccgggagaagctgaagggctacagcatccgctctgaggagaggagccgggaggccaagaggcccaggtatgatgacacagtgaagatcaacagcatgggcggggaccaccccagcttcaccagcggcaccaggaactaccggcagaggagaagaagccccagcccccgcttcctggaccctgagttccgggagctggacctggcccggaggaagcgggaggaggaggaggagaggagccgcagcctgagccaggagctggtgggcgtggatggcggcggcaccggctgcagcatccctggcctgtctggagtgctgacagccagcgagcccggctacagcctgcacaggcctgaggaggtgtctgtgatgcccaagaagagcatcctgaagaagagaattgaggtggacatcatggagcccagcatgcagctggagagcttcagcagcagcaccagcagcagccaggaccaccccctgtacagcggccaccccagcctgcccctgagcggggccatcgccgcctttgccagcgagattgaaaataaaggcaccatggtggagacagccctgaaggagccccagggcaacctgtaccagtggggccccctgcccggcatccccaaggacaacagccccctgcgggagaagtttggcagcttcctgtgccacaaggacaacctggacctgaaggccgagggccctgagcggcacacagacttcctgctgccccatgagcgggccagccaggacggcagcggcttcagccgcatcctgtccatgctggccgacagcaccagcacccaggagaagagaagaagaagcttcccagacattgaagatgaggagaagttcctgtatggagatgaggaggaggacctgaaggccgagagcgtgcccaagcccctgggcagcagcgagagcgaggtgatgaggcagaaggccagcagcctgcccagcagcgccccagctgtgaagctggagagcctggaggagaccaacccagaatatgccaagatccatgacctgctgaagaccatcggcctggacattggagtggccgagatcagccagctggccgcccggacccaggagcggctgcacggcaagaagcccagcctgcggagcagcgctgaccggcgcagctctgtggaccgctacttctctgctgaccactgcagctctgtggaccaccgcttctctgctgaccgctgcagctctgtggaccactgcttctctgctgaccggcgcagcagtgacccccaccggctggagagccgggaggcccaccacagcaacacccacagccctgaggtgagccacccccacccccccagccctgtggacccctacctgctgaccaagaacagcccccccttcctgaagagtgaccaccctgtgggccacatcagcggccctgaggtggtgggcagcggcttccagagctctgtggccgtgcgctgcatgctgcccagcgcccccagcgcccccatccggctgccccacacagctgccctgagccagttccacatgccccgggccagccagtttgctgctgcccgcatcccccccaactaccagggccctgccatccccccagccagctttgatgcctaccgccactacatggcctatgctgccagccgctggcccatgtaccccaccagccagcccagcaaccaccctgtgcctgagccccaccgcatcatgcccatcaccaagcaggccaccaggagccggcccaacctgcgggtcatccccaccgtgaccccagacaagcccaagcagaaggagagcctgcggggcagcatcccagctgcccaggtgcctgtgcaggtgtccatccccagcctcatccgctacaaccctgagaagatcagtgatgagaagaacagagccagccagaagcagaaggtgattgaggagcgggagaagctgaagaatgaccgggaggcccggcagaagaagatgtactacctgaggacagagctggagcggctgcacaagcagcagggcgagatgctgaggaagaagagaagagagaaggatggccacaaggaccccctgctggtggaggtgtcccggctgcaggacaacatcatgaaggacattgctgagctgcggcaggaggccgaggaggccgagaagaagcagagcgagctggacaaggtggcccagatcctgggcatcaacatctttgacaagagccagaagagcctgagtgacagccgggagcccacagagaagccaggcaaggccgagaagagcaagagccctgagaaggtgagcagcttcagcaacagcagcagcaacaaggagagcaaggtgaacaatgagaagttccgcaccaagagccccaagccagctgagagcccccagagcgccaccaagcagctggaccagcccacagctgcctatgagtactatgatgctggcaaccactggtgcaaggactgcaacaccatctgtggcaccatgtttgacttcttcacccacatgcacaacaagaagcacacccagaccctggacccctacaaccggccctgggccagcaagacccagagcgaggccaagcaggatgccatcaagaggacagacaagatcaccgtgcctgccaagggcagcgagttcctggtgcccatcagcggcttctactgccagctgtgtgaggagttcctgggggaccccatcagcggggagcagcacgtgaagggccaccagcacaatgagaagtacaagaagtatgtggatgagaaccccctgtatgaggagaggaggaacctggaccggcaggccggcctggccgtggtgctggagacagagcggcggcggcagagcgagctgaagaggaagctgtctgagaagcccaaggaggagaagaaggagaagaaggccaaggctgtgaaggaggtgaaggaggatgacaaggtgtctgagaagctggaggaccagctgtctgagggcaggaacagccctgagaaggccgagaacaagaggaacacaggcatcaagctgcagctgaaggaggaggtgaagaaggagagccccaccagcagcagctttgggaagttctcctggaagaagccagagaaggaggaggagaagagcagcctggtgacccccagcatcagcaaggaggagatcctggagagcagcaaggacaaggaggatggcaagacagaggccggcaaggccaagcccatcaagatcaagctgagcggcaagacagtggtggcccacaccagcccctggatgcctgtggtgaccaccagcacccagaccaagatccggcccaacctgcccatccccagcacagtgctgaggaagagctgcagcgccaccatgagcaagccagcccccctgaacaccttcctgagcatcaagagcagcggcaccacagccaagcccctgcctgtggtgaaggagagcagcgctgacctgctgctgcccccagacatcatcagcaaggccttcggcggggaggaggtgatcctgaagggcagccctgaggagaaggtggtgctggccgagaagtctgagcccagccacctgcctgagcagatcctgcccccacctcctcctcctcctcctcctcctcctcctcctcctcctgtgatcccccaccctgctgcccccagcgctgcccaggccaatgccatcctggcccctgtgaagagcaaccctgtggtgtcccagaccctgagccctggctttgtgggccccaacatcctgaaccctgtgctgcctgtggccatcatggccagcgcccagcctgctgccatccccagtgatgaaacagcccctggggtgtctgagagtgaccgggaccagaccctcttctctgtgctggtgcggcccccaccacccctgagcagcgtcttcagcgagcaggccaagaagctggagaagaggaacagctgcctggccacagccaatgccaaggacctgtatgacatcttctacagcagcggcggcaagggggcccctgagaccaagggggcccctgagaccaagctgagcggcggccccctggccaacggggagaacagcaacctgagcaggaccaagagcagtgacaccagcagcaccagccccctgaacagcagcgccagccaggaggagctgcaccaggatgagggcctggtggccgcccccatcgtgagcaacagcgagaagcccatcgccaagaccctggtggccctgggcaagtggagcgtggtggagcacgtgggccccaagagcacaggcagcacctacggcttcctgcagcccctgacccggctgtgccagagccggccctatgagaccatcacccccaagacagacaccctggccatctggaccagcagcagcttccagagcgacaccagccgggacatcagccctgagaagtctgagctggacctgggggagcccggccccccaggagtggagcccccaccccagctgctggacatccagtgcaaggagagccagaagctggtggagatccacctgcgggagagcgtgaaccaggacaaggagagccaggagctgaggaagtctgaggactgccgggagagcgagattgagaccaacacagagctgaaggagcgggtgaaggagctgtctgagggcatcgtggatgagggcgtgtccaccagcatcggcccccacagcattgatgacagcaacctgaaccacggcaaccgctacatgtgggagggggaggtgaagcagcccaacctgctgatgattgacaaggaggccgagcagagcaacaagctgatgactggaagtgagacccccagcaaggtggtgatcaagctgagcccccaggcctgcagcttcaccaaggccaagctggacagcttcctgtctgaggcccggagcctgctgaacccccaggacacccctgtgaagatcagcgcccctgagctgctgctgcacagccctgcccggagcgccatgtgcctgaccggcagcccccaggagcagggcgtgtctgtggtgtctgaggagggcctggagaacagcgcccctgagagcgccagcaggaccagccgctaccgcagcctgaagctgaagcgggagaggagcaaggacttccaggtgaagaagatctatgagctggccgtgtgggatgagaacaagaagaggcctgagacctgggagagccctgagaagcccaagacagaggccctggagctgcaggatgtgcaccctgagctgactgtgaccatcgagagcaaggccctggaggactttgaggccacagacctgaaggtggaggagctgacagccctgggcaacctgggggacatgcctgtggacttctgcaccaccagggtgtccccagcccacaggagccccaccgtgctgtgccagaaggtgtgtgaggagaacagcgtgagccccatcggctgcaacagcagtgaccctgctgactttgagcccatccccagcttcagcggcttccccctggacagccccaagaccctggtgctggactttgaaacagaaggagagaggaacagccccaaccccaggtctgtgcgcatccccagccccaacatcctgaagacaggcctgacagaaaatgtggaccggggcctgggcggcctggagggcacccaccaggccctggacctgctggccggcggcatgatgcctgaggaggtgaaggagagcagccagctggacaagcaggagagcctgggcctggagctgaagaccatcaacagcgctggcctgggccccagcccctgcctgcctgacctggtggactttgtgaccaggaccagcggcgtgcagaaggacaagctgtgcagccccctgtctgagcccggggaccccagcaagtgcagcagcctggagctgggccccctgcagctggagatcagcaatgccagcaccacagaggtggccatcctgcaggtggatgatgattctggggaccccctgaacctggtgaaggcccctgtgagccgcagccccccccgggagcaggtgattgaggacaacatggtgccccagggcatgcctgagcaggagaccaccgtgggcgccatccaggaccacacagagagctctgtgcacaactag

SEQ ID NO: 19595 - DNA, 1932 bp, Artificial Sequence
  Description of Artificial Sequence: Synthetic coding sequence
atgggccaggagagcagcaagcctgtgtggcccaaccccaccggcggctaccagagcaacacaggaagaagatatggaagaagacatgcctacgtgtccttccggccccccaccagccagcgggagcgcatcgccagccagaggaagaccaacagcgaggtgcccatgcacaggtctgcccccagccagaccaccaagaggagccgcagccccttcagcaccacccggcgctcctgggatgacagcgagagcagcggcaccaacctgaacatcgacaatgaagactacagccgctacccaccccgggagtaccgggccagcggcagccggcggggcatggcctacggccacatcgacagctatggagcagatgacagcgaggaggagggcgccggccctgtggagaggcctcctgtgcggggcaagacaggcaagttcaaggatgacaagctgtatgaccctgagaagggggcccggagcctggccggccccccaccccacttcagcagcttcagcagagatgtgcgggaggagcgggacaagctggaccctgtgcctgctgcccgctgcagcgccagcagagctgacttcctgccccagagctctgtggccagccagagcagcagcgagggcaagctggccaccaagggggacagcagcgagcgggagcggcgggagcagaacctgcctgcccggcccagccgggcccctgtgtccatctgtggcggcggggagaacaccagcaagtctgctgaggagcctgtggtgcggcccaagatccggaacctggccagccccaactgtgtgaagcccaagatcttctttgacacagatgatgatgatgacatgccccacagcaccagccgctggagggacacagccaatgacaatgaaggccacagtgatggcctggcccggcggggccgcggggagagcagcagcggctacccagagcccaagtacccagaggacaagcgggaggcccggagtgaccaggtgaagccagagaaggtgcccaggagaagaaggaccatggctgaccctgacttctggacccacagtgatgactactacaagtactgtgatgaagattctgacagcgacaaggagtggattgctgccctgcggaggaagtaccgcagccgggagcagaccctgagcagcagtggagagagctgggagaccctgcccgggaaggaggagcgggagcccccccaggccaaggtgtctgccagcacaggcaccagccctggccctggggccagcgccagcgctggagctggagctggggccagcgctggcagcaatggcagcaactacctggaggaggtgcgggagcccagcctgcaggaggagcaggccagcctggaggagggggagatcccctggctgcagtaccatgaaaatgacagcagcagcgagggggacaatgattctggccacgagctgatgcagcccggggtcttcatgctggatggcaacaacaacctggaggatgacagctctgtgtctgaggacctggaggtggactggagcctgtttgatggctttgctgatggcctgggcgtggccgaggccatctcctatgtggacccccagttcctgacctacatggccctggaggagcggctggcccaggccatggagacagccctggcccacctggagagcctggccgtggatgtggaggtggccaaccccccagccagcaaggagagcattgatgccctgcctgagatcctggtgacagaggaccacggggctgtgggccaggagatgtgctgccccatctgctgcagtgaatatgtgaagggggaggtggccacagagctgccctgccaccactacttccacaagccctgtgtgtccatctggctgcagaagagcggcacctgccctgtgtgccgctgcatgttccccccacccctgtag

SEQ ID NO: 19596 - DNA, 1113 bp, Artificial Sequence
  Description of Artificial Sequence: Synthetic coding sequence
atgcccacagagaccctgcagacaggctccatggtgaagcctgtgtccccagctggcaccttcaccagcgctgtgcccctgcgcatcctgaacaagggccctgactacttccggcggcaggccgagcccaaccccaagaggctgtctgctgtggagcggctggaggccgacaaggccaagtatgtgaagagccaggaggtgatcaatgccaagcaggagcctgtgaagccagctgtgctggccaagccccctgtgtgcccagctgccaagagggccctgggcagccccaccctgaaggtgtttggaaaccacgccaagacagaaagtggagtgcagcgggagaacctgaagctggagatcctgaagaacatcatcaacagcagcgagggcagcagcagcggcagcggccacaagcacagcagcaggaactggccaccccacaggtctgaggccacagacctgcaccgccacagctttgctgagagcctgaaggtgtaccccacccagggcagaagaagcccccaggagggcggcagccacgtgggccgccgcctgctggagcagagcgctgagagcttcctgcacgtgagccacagcagcagtgacatcaggaaggtgacctctgtgaagcccctgaaggccatcccctgcagcagcagcgccccacccctgccccccaagcccaagattgctgccatcgcctccatgaagagccctgaggccgaccctgtggagcccgcctgtggggtgtcccggcggcccagcctgcagaggagcaagagtgacctgagtgaccgctacttccgggtggatgctgatgtggagcgcttcttcaactactgcggcctggaccctgaggagctggagaacctgggcatggagaactttgcccgggccaacagcgacatcatcagcctgaacttccgcagcgcctccatgatcagcagtgactgtgagcagagccaggacagcaacagcgacctgagaaatgatgattctgccaatgacagagtgccctacggcatcagcgccattgaaagaaatgcccgcatcatcaagtggctgtacagcatcaagcaggcccgggagagccagaaggtgagccacgtgtag

SEQ ID NO: 19597 - DNA, 3126 bp, Artificial Sequence
  Description of Artificial Sequence: Synthetic coding sequence
atggctgctgctgctgctgctggagctgccagcggcctgcccggccctgtggcccagggcctgaaggaggccctggtggacaccctgaccggcatcctgagccctgtgcaggaggtgcgggctgctgctgaggagcagatcaaggtgctggaggtgacagaggagtttggagtgcacctggccgagctgactgtggacccccagggcgccctggccatccggcagctggccagcgtcatcctgaagcagtatgtggagacccactggtgtgcccagagcgagaagttccggcccccagagaccacagagcgggccaagatcgtcatccgggagctgctgcccaacggcctgcgggagagcatcagcaaggtgcgcagctctgtggcctatgctgtgtctgccatcgcccactgggactggccagaggcctggccccagctgttcaacctgctgatggagatgctggtgtctggggacctgaatgctgtgcacggggccatgagggtgctgacagagttcacccgggaggtgacagacacccagatgcccctggtggcccctgtgatcctgcctgagatgtacaagatcttcaccatggccgaggtgtatggcatccgcaccaggagcagagctgtggagatcttcaccacctgtgcccacatgatctgcaacatggaggagctggagaagggggccgccaaggtgctgatcttccctgtggtgcagcagttcacagaggcctttgtgcaggccctgcagatcccagatggccccaccagtgacagcggcttcaagatggaggtgctgaaggctgtgacagccctggtgaagaacttccccaagcacatggtgtcctccatgcagcagatcctgcccatcgtgtggaacaccctgacagaatctgctgccttctacgtgaggacagaggtgaactacacagaggaggtggaggaccctgtggacagtgatggagaggtgctgggctttgagaacctggtgttcagcatctttgaatttgtgcacgccctgctggagaacagcaagttcaagagcacagtgaagaaggccctgcctgagctgatctactacatcatcctgtacatgcagatcacagaggagcagatcaaggtgtggacagccaacccccagcagtttgtggaggatgaagatgatgacaccttctcctacacagtgagaattgctgcccaggacctgctgctggccgtggccacagacttccagaatgaatctgctgctgccctggccgccgccgccaccaggcacctgcaggaggccgagcagaccaagaacagcggcacagagcactggtggaagatccacgaggcctgcatgctggccctgggctctgtgaaggccatcatcacagacagcgtgaagaatggccgcatccactttgacatgcacggcttcctgaccaacgtcatcctggccgacctgaacctgtctgtgagccccttcctgctgggccgggccctgtgggccgccagccgcttcaccgtggccatgagccctgagctgatccagcagttcctgcaggccaccgtgtctggcctgcacgagacccagccccccagcgtgcgcatctctgctgtgcgggccatctggggctactgtgaccagctgaaggtgtctgagagcacccacgtgctgcagcccttcctgcccagcatcctggatggcctcatccacctggccgcccagttcagcagcgaggtgctgaacctggtgatggagaccctgtgcatcgtgtgcaccgtggaccctgagttcaccgcctccatggagagcaagatctgccccttcaccatcgccatcttcctgaagtacagcaatgaccctgtggtggccagcctggcccaggacatcttcaaggagctgagccagatcgaggcctgccagggccccatgcagatgaggctcatccccaccctggtgtccatcatgcaggccccagctgacaagatcccagctggcctgtgtgccacagccatcgacatcctgaccaccgtggtgaggaacaccaagccacccctgagccagctgctgatctgccaggccttccctgctgtggcccagtgcaccctgcacacagatgacaatgccaccatgcagaatggaggagaatgtctgcgggcctacgtgtctgtgaccctggagcaggtggcccagtggcatgatgagcagggccacaacggcctgtggtacgtgatgcaggtggtgtcccagctgctggaccccaggaccagcgagttcaccgctgcctttgtgggccgcctggtgtccaccctcatcagcaaggccggccgggagctgggggagaacctggaccagatcctgcgggccatcctgagcaagatgcagcaggccgagaccctgtctgtgatgcagagcctcatcatggtgtttgcccacctggtgcacacccagctggagcccctgctggagttcctgtgcagcctgcccggccccaccgggaagccagccctggagtttgtgatggccgagtggaccagccggcagcacctgttctacggccagtatgagggcaaggtgtcctctgtggccctgtgcaagctgctgcagcacggcatcaatgctgatgacaagaggctgcaggacatccgggtgaagggggaggagatctacagcatggatgagggcatccgcaccaggagcaagagcgccaagaaccctgagcgctggaccaacatccccctgctggtgaagatcctgaagctgatcatcaatgagctgagcaatgtgatggaggccaatgctgcccggcaggccaccccagctgagtggagccaggatgacagcaatgacatgtgggaggaccaggaggaggaggaggaggaggaggaggatggcctggccggccagctgctgagtgacatcctggccaccagcaaatatgaggaggactactatgaagatgatgaagaagatgatcctgatgccctgaaggaccccctgtaccagattgacctgcaggcctacctgacagacttcctgtgccagtttgcccagcagccctgctacatcatgttttctggccacctgaatgacaatgaaagaagagtgctgcagaccatcggcatctag

SEQ ID NO: 19598 - DNA, 156 bp, Artificial Sequence
  Description of Artificial Sequence: Synthetic coding sequence
atgagcagccacaagaccttccgcatcaagcgcttcctggccaagaagcagaagcagaaccggcccatcccccagtggatccgcatgaagacaggcaacaagatccgctacaacagcaagagaagacactggaggaggaccaagctgggcctgtag

SEQ ID NO: 19599 - DNA, 3627 bp, Artificial Sequence
  Description of Artificial Sequence: Synthetic coding sequence
atggacagcctgcctgatgagttctttgtgcgccaccctgctgtggaggaccagaggaaggaggagacagagaacaagctggagaagagcagcggccagctgaacaagcaggagaatgacatccccacagacctggtgcctgtgaacctgctgctggaggtgaagaagctgctgaatgccatcaacaccctgcccaagggcgtggtgccccacatcaagaagttcctgcaggaggacttctccttccagaccatgcagcgggaggtggccgccaacagccagaatggagaggagatcgtgcctgccctgaccctgcgcttcctgatcacccagctggaggccgccctgaggaacatccaggccggcaactacacagcccaccagatcaacatcggctactacctgaccctgctcttcctgtatggagtggccctgacagagcggggcaagaaggaggactacacagaagctgagaacaagttcctggtgatgaagatgatgatccaggagaatgagatctgtgagaacttcatgagcctggtgtacttcggccggggcctgctgcgctgtgcccagaagcgctacaacggcggcctgctggagttccacaagagcctgcaggagattggagacaagaatgaccactggtttgatattgaccccacagaagatgaggacctgcccaccaccttcaaggacctgctgaacaacttcatcaagaccacagagagcaacatcatgaagcagaccatctgcagctacctggactgtgagaggagctgtgaggccgacatcctgaagaacaccagctacaagggcttcttccagctgatgtgcagcaagagctgctgcgtgtacttccacaagatctgctggaagaagttcaagaacctgaagtacccaggagaaaatgaccagagcttcagcggcaagaagtgcctgaaggagggctgcacaggagacatggtgaggatgctgcagtgtgatgtgcccggcatcgtgaagatcctgtttgaggtggtgaggaaggatgagtacatcaccatcgagaacctgggcgccagctacaggaagctgatcagcctgaagatcacagacacagacatccggcccaagatcagcctgaagttcaacaccaaggatgagatgcccatcttcaagctggactacaactacttctaccacctgctgcacatcatcatcatctctggaacagacatcgtgcggcagatctttgatgaggccatgcccccacccctgctgaagaaggagctgctgatccacaagaatgtgctggagagctactacaaccacctgtggaccaaccaccccctgggcggctcctggcacctgctgtacccacccaacaaggagctgccccagagcaagcagtttgacctgtgcctgctgctggccctgatcaagcacctgaatgtgtttcctgcccccaagaagggctggaacatggagccccccagcagtgacatcagcaagtctgctgacatcctgcggctgtgcaagtacagagacatcctgctgtctgagatcctgatgaatggcctgacagagagccagttcaacagcatctggaagaaggtgtctgacatcctgctgcggctgggcatgatgcaggaggacatcgacaaggtgaaggagaaccccatcgagaacatcagcctggactaccaccagctgtctgtgtacctgggcatccctgtgcctgagatcatccagaggatgctgagctgctaccagcagggcatcgccctgcagagcatcaccggcagccagagaattgaaattgaggagctgcagaatgaggaggaggagctgagcccccccctgatggagtacaacatcaacgtgaagagccaccctgagatccagtttgctgagatcaacaaggatggcaccagcatccccagcgagagcagcacagagagcctgaaggacctgcaggaggtgaagagcaagcagaggaagaagaagaagaccaagaacaagaagaacaaggacagcaaagaagaccaggtgccctacgtggtggagaaggaggagcagctgaggaaggagcaggccaacccccacagcgtgagccgcctcatcaaggatgatgccagtgatgtgcaggaggacagcgccatggaggacaagttctacagcctggatgagctgcacatcctggacatgattgagcagggcagcgctgggaaggtgaccacagattatggagaaacagagaaggagcggctggcccggcagaggcagctgtacaagctgcactaccagtgtgaggacttcaagaggcagctgaggacagtgaccttccgctggcaggagaaccagatgcagatcaagaagaaggacaagatcatcgccagcctgaaccagcaggtggccttcggcatcaacaaggtgtccaagctgcagaggcagatccacgccaaggacaatgagatcaagaacctgaaggagcagctgtccatgaagaggagccagtgggagatggagaagcacaacctggagagcaccatgaagacctacgtgtccaagctgaatgctgagaccagccgggccctgacagctgaggtgtacttcctgcagtgccggcgggactttggcctgctgcacctggagcagacagagaaggagtgcctgaaccagctggcccgggtgacccacatggccgccagcaacctggagagcctgcagctgaaggctgctgtggacagctggaatgccatcgtggctgatgtgaggaacaagatcgccttcctgcggacccagtacaatgagcagatcaacaaggtgaagcagggctttgccctgagcaccctgccccctgtgcagctgcccccacctccacccagccctgagatcctgatgcagcagttcctgggccggcccctggtgaaggagagcttcttccggcccatcctgactgtgccccagatgcctgctgtgtgccctggggtggtgtctgccaccggccagccccgggcccccctgatgactggaattgcctgggccctgcctgcccctgtgggagatgctgtgccccccagcgctggcctgcggagtgaccccagcatcatgaactgggagcgcatcacagaccggctgaagacagccttcccccagcagaccaggaaggagctgacagacttcctgaggaagctgaaggatgcctacggcaagagcctgtctgagctgacctttgatgagatcgtgtgcaagatcagccagttcatcgaccccaagaagagccagagccagggcaagtctgtgtccaatgtgaactgtgtgagccccagccacagccccagccagccagatgctgcccagccccccaagccagcctggaggcccctgaccagccagggccctgccacctgggagggcgccagcaacccagatgaggaggaggaggaggaggagccctgcgtcatctgccacgagaacctgagccctgagaacctgtctgtgctgccctgtgcccacaagttccacgcccagtgcatccggccctggctgatgcagcagggcacctgccccacctgccgcctgcacgtgctgctgcctgaggagttccctggccaccccagccggcagctgcccaagatctag

SEQ ID NO: 19600 - DNA, 996 bp, Artificial Sequence
  Description of Artificial Sequence: Synthetic coding sequence
atgagccggcagctgagccgggcccggcctgccaccgtgctgggcgccatggagatgggccgcaggatggatgcccccaccagcgctgctgtgacccgggccttcctggagcggggccacacagaaattgacacagcctttgtgtacagcgagggccagagcgagaccatcctgggcggcctgggcctgcggctgggcggcagtgactgccgggtgaagattgacaccaaggccatccccctgtttggaaacagcctgaagccagacagcctgcgcttccagctggagaccagcctgaagaggctgcagtgcccccgggtggacctcttctacctgcacatgccagaccacagcacccctgtggaggagaccctgcgggcctgccaccagctgcaccaggagggcaagtttgtggagctgggcctgagcaactatgctgcctgggaggtggccgagatctgcaccctgtgcaagagcaatggctggatcctgcccaccgtgtaccagggcatgtacaatgccatcacccggcaggtggagacagagctgttcccctgcctgcggcacttcggcctgcgcttctacgccttcaaccccctggccggcggcctgctgaccgggaagtacaagtatgaggacaagaatggcaagcagcctgtgggccgcttcttcggcaacacctgggccgagatgtacagaaaccgctactggaaggagcaccactttgagggcatcgccctggtggagaaggccctgcaggccgcctacggggccagcgcccccagcatgaccagcgccaccctgcgctggatgtaccaccacagccagctgcagggcgcccatggagatgctgtgatcctgggcatgagcagcctggagcagctggagcagaacctggccgctgctgaggagggccccctggagcctgctgtggtggatgccttcaaccaggcctggcacctggtgacccatgaatgtcccaactacttcagatag

SEQ ID NO: 19601 - DNA, 1131 bp, Artificial Sequence
  Description of Artificial Sequence: Synthetic coding sequence
atgagccctgaggtggccctgaaccgcatcagccccatgctgagccccttcatcagctctgtggtgagaaatggcaaggtgggcctggatgccaccaactgcctgcgcatcacagacctgaagagcggctgcaccagcctgaccccaggccccaactgtgaccgcttcaagctgcacatcccctatgctggggagaccctgaagtgggacatcatcttcaatgcccagtacccagagctgcccccagacttcatctttggagaagatgctgagttcctgcctgaccccagcgccctgcagaacctggcctcctggaaccccagcaacccagaatgtctgctgctggtggtgaaggagctggtgcagcagtaccaccagttccagtgcagccggctgcgggagagcagccggctgatgtttgagtaccagaccctgctggaggagccccagtatggagagaacatggagatctatgccggcaagaagaacaactggacaggagagttcagcgcccgcttcctgctgaagctgcctgtggacttcagcaacatccccacctacctgctgaaggatgtgaatgaagaccccggggaggatgtggccctgctgtctgtgtcctttgaggacacagaggccacccaggtgtaccccaagctgtacctgagccccagaattgaacatgccctgggcggcagcagcgccctgcacatcccagccttccctgggggcggctgcctgattgattatgtgccccaggtgtgccacctgctgaccaacaaggtgcagtatgtgatccagggctaccacaagagaagagagtacatcgccgccttcctgagccacttcggcaccggggtggtggagtatgatgctgagggcttcaccaagctgaccctgctgctgatgtggaaggacttctgcttcctggtgcacatcgacctgcccctcttcttcccccgggaccagcccaccctgaccttccagagcgtgtaccacttcaccaacagcggccagctgtacagccaggcccagaagaactacccctacagcccccgctgggatggaaatgagatggccaagagggccaagcgggagagcaacagagatggagaggagagcagcagcgcctag

SEQ ID NO: 19602 - DNA, 1881 bp, Artificial Sequence
  Description of Artificial Sequence: Synthetic coding sequence
atggatgagcaggaggccctgaacagcatcatgaatgacctggtggccctgcagatgaacagaagacacaggatgcctggctatgagaccatgaagaacaaggacaccggccacagcaaccggcagagtgatgtgcgcatcaagtttgagcacaacggggagcggcgcatcatcgccttcagcaggcctgtgaagtatgaagatgtggagcacaaggtgaccaccgtgtttggccagcccctggacctgcactacatgaacaatgagctgagcatcctgctgaagaaccaggatgacctggacaaggccatcgacatcctggacaggagcagctccatgaagagcctgcgcatcctgctgctgagccaggacaggaaccacaacagcagcagcccccacagcggcgtgtcccggcaggtgcgcatcaaggccagccagagcgctggggacatcaacaccatctaccagcccccagagcccaggagccgccacctgtctgtgagcagccagaaccctggccgcagcagccccccacctggctacgtgcctgagcggcagcagcacatcgcccggcagggcagctacaccagcatcaacagcgagggggagttcatccctgagaccagcgagcagtgcatgctggaccccctgagcagcgctgagaacagcctgagcggcagctgccagagcctggacagatctgctgacagccccagcttcaggaagagcaggatgagccgggcccagagcttcccagacaaccggcaggagtacagcgaccgggagacccagctgtatgacaagggcgtgaagggcggcacctacccccggcgctaccacgtgtctgtgcaccacaaggactacagtgatggccgccgcaccttcccccgcatcagaagacaccagggcaacctcttcaccctggtgcccagcagccgcagcctgagcaccaacggggagaacatgggcctggccgtgcagtacctggacccccggggccgcctgcggtctgctgacagtgaaaatgccctgtctgtgcaggagagaaatgtgcccaccaagagccccagcgcccccatcaactggaggcggggcaagctgctgggccagggcgccttcggccgggtgtacctgtgctatgatgtggacaccggccgggagctggccagcaagcaggtgcagtttgatcctgacagccctgagaccagcaaggaggtgtctgccctggagtgtgagatccagctgctgaagaacctgcagcacgagcgcatcgtgcagtactacggctgcctgcgggacagagctgagaagaccctgaccatcttcatggagtacatgcctgggggctctgtgaaggaccagctgaaggcctacggggccctgacagagagcgtgaccaggaagtacacccggcagatcctggagggcatgagctacctgcacagcaacatgattgtgcaccgggacatcaagggggccaacatcctgcgggacagcgctggaaatgtgaagctgggggactttggagccagcaagaggctgcagaccatctgcatgagcggcaccggcatgaggtctgtgacaggcaccccctactggatgagccctgaggtgatcagcggggagggctacggcaggaaggcagatgtgtggagcctgggctgcaccgtggtggagatgctgacagagaagccaccctgggccgagtatgaggccatggccgccatcttcaagatcgccacccagcccaccaacccccagctgcccagccacatcagcgagcacggccgggacttcctgcggcgcatctttgtggaggcccggcagaggcccagcgctgaggagctgctgacccaccactttgcccagctgatgtactag

SEQ ID NO: 19603 - DNA, 1701 bp, Artificial Sequence; identical to SEQ ID NO: 19423
  Description of Artificial Sequence: Synthetic coding sequence

SEQ ID NO: 19604 - DNA, 456 bp, Artificial Sequence
  Description of Artificial Sequence: Synthetic coding sequence
atggagggctgtgtgagcaacctgatggtgtgcaacctggcctacagcggcaagctggaggagctgaaggagagcatcctggccgacaagagcctggccaccaggacagaccaggacagcaggacagccctgcactgggcctgcagcgctggccacacagaaattgtggagttcctgctgcagctgggcgtgcctgtgaatgacaaggatgatgctggctggagccccctgcacatcgccgccagcgctggaagagatgagatcgtgaaggccctgctgggcaaaggagcccaggtgaatgctgtgaaccagaatggctgcacccccctgcactatgctgccagcaagaacagacatgaaattgctgtgatgctgctggagggcggggccaacccagatgccaaggaccactatgaggccacagccatgcacagagctgctgccaaggacacctag

SEQ ID NO: 19605 - DNA, 2220 bp, Artificial Sequence; identical to SEQ ID NO: 19521
  Description of Artificial Sequence: Synthetic coding sequence

SEQ ID NO: 19606 - DNA, 1692 bp, Artificial Sequence
  Description of Artificial Sequence: Synthetic coding sequence
atgagccggcccagcagccgggccatctacctgcacaggaaggagtacagccagaacctgaccagcgagcccaccctgctgcagcaccgggtggagcacctgatgacctgcaagcagggcagccagagggtgcagggcccagaagatgccctgcagaagctgtttgagatggatgcccagggccgggtgtggagccaggacctgatcctgcaggtgagagatggctggctgcagctgctggacatcgagaccaaggaggagctggacagctaccgcctggacagcatccaggccatgaatgtggccctgaacacctgcagctacaacagcatcctgagcatcaccgtgcaggagcccggcctgcccggcaccagcaccctgctcttccagtgccaggaggtgggcgctgagcggctgaagaccagcctgcagaaggccctggaggaggagctggagcagaggccccggctgggcggcctgcagcccggccaggaccgctggaggggccctgccatggagcggcccctgcccatggagcaggcccgctacctggagcccggcatccccccagagcagccccaccagaggaccctggagcacagcctgccccccagcccccggcccctgcccaggcacaccagcgcccgggagcccagcgccttcaccctgcccccaccaagaagaagcagcagcccagaagatcctgagagagatgaggaggtgctgaaccacgtgctgcgggacatcgagctgttcatgggcaagctggagaaggcccaggccaagaccagcaggaagaagaagtttgggaagaagaacaaggaccagggcggcctgacccaggcccagtacatcgactgcttccagaagatcaagcacagcttcaacctgctgggccgcctggccacctggctgaaggagaccagcgcccctgagctggtgcacatcctcttcaagagcctgaacttcatcctggcccgctgcccagaggccggcctggccgcccaggtgatcagccccctgctgacccccaaggccatcaacctgctgcagagctgcctgagccccccagagagcaacctgtggatgggcctgggccctgcctggaccaccagcagagctgactggacaggagatgagcccctgccctaccagcccaccttcagtgatgactggcagctgcctgagcccagcagccaggcccccctgggctaccaggaccctgtgtccctgcggcccagcagccccaagccagcccagcctgccctgaagatgcaggtgctgtatgaatttgaggccaggaacccccgggagctgactgtggtgcagggcgagaagctggaggtgctggaccacagcaagcgctggtggctggtgaagaatgaagctggccgcagcggctacatccccagcaacatcctggagcccctgcagcccggcaccccaggcacccagggccagagccccagccgggtgcccatgctgcggctgagcagcaggcctgaggaggtgacagactggctgcaggccgagaacttcagcacagccaccgtgaggaccctgggcagcctgaccggcagccagctgctgcgcatccggcctggagagctgcagatgctgtgcccccaggaggccccccgcatcctgagccggctggaggccgtgcggaggatgctgggcatcagcccctag

SEQ ID NO: 19607 - DNA, 525 bp, Artificial Sequence
  Description of Artificial Sequence: Synthetic coding sequence
atgacctgctgccagaccagcttctgtggctaccccagcttcagcatcagcggcacctgtggcagcagctgctgccagcccagctgctgtgagaccagctgctgccagcccaggagctgccagaccagcttctgtggcttccccagcttcagcaccagcggcacctgcagcagcagctgctgccagcccagctgctgtgagaccagctgctgccagcccagctgctgtgagaccagctgctgccagcccagctgctgccagatcagcagctgtggcaccggctgcggcattggaggcggcatctcctatggccaggagggcagcagtggagctgtgtccacccgcatccgctggtgcaggccagacagccgggtggagggcacctacctgcccccctgctgcgtggtgtcctgcaccccacccagctgctgccagctgcaccacgcccaggccagctgctgccggcccagctactgcggccagagctgctgcaggcctgtgtgctgctgtgagcccacctgctag

SEQ ID NO: 19608 - DNA, 1173 bp, Artificial Sequence
  Description of Artificial Sequence: Synthetic coding sequence
atgagaggagaccggggccggggccggggcggccgcttcggcagcagaggaggccctgggggcggcttccggccctttgtgccccacatcccctttgacttctacctgtgtgagatggccttcccccgggtgaagccagccccagatgagaccagcttcagcgaggccctgctgaagaggaaccaggacctggcccccaacagcgctgagcaggccagcatcctgagcctggtgaccaagatcaacaacgtgattgacaacctgattgtggcccctggcacctttgaggtgcagatcgaggaggtgcggcaggtgggcagctacaagaagggcaccatgaccaccggccacaacgtggccgacctggtggtgatcctgaagatcctgcccaccctggaggccgtggccgccctgggcaacaaggtggtggagagcctgcgggcccaggaccccagcgaggtgctgaccatgctgaccaatgagaccggctttgagatcagcagcagtgatgccaccgtgaagatcctgatcaccaccgtgccccccaacctgaggaagctggaccctgagctgcacctggacatcaaggtgctgcagagcgccctggccgccatcagacatgcccgctggtttgaagaaaatgccagccagagcacagtgaaggtgctgatccggctgctgaaggacctgcgcatccgcttccctggctttgagcccctgaccccctggatcctggacctgctgggccactatgctgtgatgaacaaccccacccggcagcccctggccctgaatgtggcctaccgccgctgcctgcagatcctggccgccggcctcttcctgcccggctctgtgggcatcacagacccctgtgagagcggcaacttccgggtgcacacagtgatgaccctggagcagcaggacatggtgtgctacacagcccagaccctggtgcgcatcctgagccatggaggcttcaggaagatcctgggccaggagggagatgccagctacctggccagcgagatcagcacctgggatggagtcatcgtgacccccagcgagaaggcctatgagaagcccccagagaagaaggagggggaggaggaggaggagaacacagaggagcccccccagggcgaggaggaggagagcatggagacccaggagtag

SEQ ID NO: 19609 - DNA, 3606 bp, Artificial Sequence
  Description of Artificial Sequence: Synthetic coding sequence
atgcccagaggagaggcccctggccctggaagaagaggagccaaggatgaggccctgggggaggagagcggggagcgctggagccctgagttccacctgcagaggaagctggccgacagcagccacagcgagcagcaggacaggaacagagtgtctgaggagctgatcatggtggtgcaggagatgaagaagtacttccccagcgagaggaggaacaagcccagcaccctggatgccctgaactatgccctgcgctgtgtgcacagcgtgcaggccaacagcgagttcttccagatcctgagccagaatggagccccccaggctgatgtgtccatgtacagcctggaggagctggccaccatcgccagcgagcacaccagcaagaacacagacacctttgtggccgtgttctccttcctgagcggccgcctggtgcacatcagcgagcaggccgccctgatcctgaacaggaagaaggatgtgctggccagcagccactttgtggacctgctggccccccaggacatgagggtcttctacgcccacacagcccgggcccagctgcccttctggaacaactggacccagagagctgcccgctatgaatgtgcccctgtgaagcccttcttctgccgcatcagaggaggagaggacaggaagcaggagaagtgccacagccccttccgcatcatcccctacctgatccacgtgcaccacccagcccagcctgagctggagagcgagccctgctgcctgactgtggtggagaagatccacagcggctatgaggccccccgcatccctgtgaacaagaggatcttcaccaccacccacaccccaggctgtgtgttcctggaggtggatgagaaggctgtgcccctgctgggctacctgccccaggacctgattggcaccagcatcctgagctacctgcaccctgaggacaggagcctgatggtggccatccaccagaaggtgctgaagtatgccggccaccccccatttgagcacagccccatccgcttctgcacccagaatggagactacatcatcctggacagctcctggagcagctttgtgaacccctggagcaggaagatctccttcatcatcggccgccacaaggtgaggaccagccccctgaatgaagatgtgtttgccaccaagatcaagaagatgaatgacaatgacaaggacatcacagagctgcaggagcagatctacaagctgctgctgcagcctgtgcacgtgtctgtgagcagcggctacggcagcctgggcagcagcggcagccaggagcagctggtgtccatcgccagcagcagcgaggccagcggccaccgggtggaggagaccaaggccgagcagatgaccctgcagcaggtgtatgcctctgtgaacaagatcaagaacctgggccagcagctgtacatcgagagcatgaccaagagcagcttcaagcctgtgacaggcaccaggacagagcccaatggaggaggagagtgcaagaccttcaccagcttccaccagaccctgaagaacaacagcgtgtacacagagccctgtgaggacctgagaaatgatgagcacagccccagctaccagcagatcaactgcatcgacagcgtcatccgctacctgaagagctacaacatcccagccctgaagaggaagtgcatcagctgcaccaacaccaccagcagcagcagcgaggaggacaagcagaaccacaaggcagatgatgtgcaggccctgcaggccggcctgcagatcccagccatccccaagtctgagatgcccaccaacggccgcagcattgacaccggcggcggggccccccagatcctgagcacagccatgctgagcctgggcagcggcatcagccagtgtggctacagcagcaccatcgtgcacgtgcccccacctgagacagccagagatgccaccctcttctgtgagccctggaccctgaacatgcagcctgcccccctgaccagcgaggagttcaagcacgtgggcctgacagctgctgtgctgagcgcccacacccagaaggaggagcagaactacgtggacaagttccgggagaagatcctgagcagcccctacagcagctacctgcagcaggagagccgcagcaaggccaagtacagctacttccagggcgacagcaccagcaagcagaccaggtctgctggctgcaggaagggcaagcacaagaggaagaagctgcctgagcccccagacagcagcagcagcaacacaggcagcggcccccggcggggggcccaccagaatgcccagccctgctgccccagcgctgccagcagcccccacaccagcagccccaccttccccccagctgccatggtgcccagccaggccccctacctggtgcctgccttccccctgcctgctgccaccagccctggccgggagtatgctgcccctggaacagcccctgagggcctgcacggcctgcccctgtctgagggcctgcagccctacccagccttccccttcccctacctggacaccttcatgacagtgttcctgcctgacccccctgtgtgccccctgctgagccccagcttcctgccctgccccttcctgggcgccacagccagcagcgccatcagccccagcatgagcagcgccatgagccccaccctggaccccccacccagcgtgaccagccagaggcgggaggaggagaagtgggaggcccagagcgagggccaccccttcatcaccagccgcagcagcagccccctgcagctgaacctgctgcaggaggagatgccccggcccagcgagagcccagaccagatgagaagaaacacctgcccccagacagagtactgtgtgactggaaacaacggcagcgagagcagccctgccaccactggagccctgagcacaggcagccccccccgggagaaccccagccaccccacagccagcgccctgagcacaggcagcccccccatgaagaaccccagccaccccacagccagcgccctgagcacaggcagcccccccatgaagaaccccagccaccccacagccagcaccctgtccatgggcctgccccccagcaggacccccagccaccccacagccaccgtgctgagcacaggcagccccccatctgagagccccagcaggactggatctgctgccagcggcagcagtgacagcagcatctacctgaccagctctgtgtacagcagcaagatcagccagaatggccagcagagccaggatgtgcagaagaaggagaccttccccaacgtggccgaggagcccatctggaggatgatccggcagaccccagagcgcatcctgatgacctaccaggtgcctgagcgggtgaaggaggtggtgctgaaggaggacctggagaagctggagagcatgaggcagcagcagccccagttcagccacggccagaaggaggagctggccaaggtgtacaactggatccagagccagacagtgacccaggagattgacatccaggcctgtgtgacctgtgaaaatgaagacagcgcagatggagctgccaccagctgtggccaggtgctggtggaggacagctgctag

SEQ ID NO: 19610 - DNA, 1296 bp, Artificial Sequence
  Description of Artificial Sequence: Synthetic coding sequence
atgtctgaccagatcaagttcatcatggacagcctgaacaaggagcccttcaggaagaactacaacctgatcacctttgacagcctggagcccatgcagctgctgcaggtgctgagtgatgtgctggccgagattgaccccaagcagctggtggacatccgggaggagatgcctgagcagacagccaagaggatgctgagcctgctgggcatcctgaagtacaagcccagcggaaatgccacagacatgagcaccttccggcagggcctggtgattggcagcaagcctgtgatctaccctgtgctgcactggctgctgcagaggaccaatgagctgaagaagagggcctacctggcccgcttcctgatcaagctggaggtgcccagcgagttcctgcaggatgagaccgtggccgacaccaacaagcagtatgaggagctgatggaggccttcaagaccctgcacaaggagtatgagcagctgaagatcagcggcttcagcacagctgagatcaggaaggacatcagcgccatggaggaggagaaggaccagctgatcaagagggtggagcacctgaagaagagggtggagacagcccagaaccaccagtggatgctgaagatcgcccggcagctgcgggtggagaaggagcgggaggagtacctggcccagcagaagcaggagcagaagaaccagctgttccacgctgtgcagaggctgcagagggtgcagaaccagctgaagtccatgaggcaggccgctgctgatgccaagccagagagcctgatgaagaggctggaggaggagatcaagttcaacctgtacatggtgacagagaagttccccaaggagctggagaacaagaagaaggagctgcacttcctgcagaaggtggtgtctgagcccgccatgggccacagcgacctgctggagctggagagcaagatcaatgagatcaacacagagatcaaccagctgattgagaagaagatgatgagaaatgagcccatcgagggcaagctgagcctgtaccggcagcaggccagcatcatcagcaggaagaaggaggccaaggccgaggagctgcaggaggccaaggagaagctggccagcctggagcgggaggcctctgtgaagaggaaccagacccgggagtttgatggaacagaggtgctgaagggagatgagcggcaggacctgaccctgagcccccggctggagtgtggcggcgtcatcatggcctactgcagcctgaagctgctgggcagcagtgacccccccaccagcgccagctag

SEQ ID NO: 19611 - DNA, 1119 bp, Artificial Sequence
  Description of Artificial Sequence: Synthetic coding sequence
atggccagcagcgccagcgcccggaccccagctgggaagagggtcatcaaccaggaggagctgcggcggctgatgaaggagaagcagaggctgagcaccagcaggaagagaattgagagcccctttgccaagtacaaccggctgggccagctgagctgtgccctgtgcaacacccctgtgaagtctgagctgctgtggcagacccacgtgctgggcaagcagcaccgggagaaggtggccgagctgaagggggccaaggaggccagccagggcagcagcgccagcagcgccccccacagcgtgaagaggaaggccccagatgctgatgaccaggatgtgaagagggccaaggccaccctggtgccccaggtgcagcccagcaccagcgcctggaccaccaactttgacaagattggcaaggagttcatccgggccacccccagcaagcccagcggcctgagcctgctgcctgactatgaagatgaggaggaggaggaggaggaggaggagggagatggagagaggaagagaggagatgccagcaagcccctgagtgatgcccagggcaaggagcacagcgtgagcagcagccgggaggtgaccagctctgtgctgcccaatgacttcttcagcaccaacccccccaaggcccccatcatcccccacagcggcagcattgagaaggccgagatccacgagaaggtggtggagcggcgggagaacacagctgaggccctgcctgagggcttctttgatgatcctgaggtggatgcccgggtgaggaaggtggatgcccccaaggaccagatggacaaggagtgggatgagttccagaaggccatgaggcaggtgaacaccatcagcgaggccatcgtggccgaggaggatgaggagggccgcctggaccggcagattggagaaattgatgagcagatcgagtgctaccgccgggtggagaagctgaggaaccggcaggatgagatcaagaacaagctgaaggagatcctgaccatcaaggagctgcagaagaaggaggaggagaatgctgacagtgatgatgaaggagagctgcaggacctgctgagccaggactggagggtgaagggggccctgctgtag

SEQ ID NO: 19612 - DNA, 1782 bp, Artificial Sequence
  Description of Artificial Sequence: Synthetic coding sequence
atgagccggcccagcagccgggccatctacctgcacaggaaggagtacagccagaacctgaccagcgagcccaccctgctgcagcaccgggtggagcacctgatgacctgcaagcagggcagccagagggtgcagggcccagaagatgccctgcagaagctgtttgagatggatgcccagggccgggtgtggagccaggacctgatcctgcaggtgagagatggctggctgcagctgctggacatcgagaccaaggaggagctggacagctaccgcctggacagcatccaggccatgaatgtggccctgaacacctgcagctacaacagcatcctgagcatcaccgtgcaggagcccggcctgcccggcaccagcaccctgctcttccagtgccaggaggtgggcgctgagcggctgaagaccagcctgcagaaggccctggaggaggagctggagcagaggccccggctgggcggcctgcagcccggccaggaccgctggaggggccctgccatggagcggcccctgcccatggagcaggcccgctacctggagcccggcatccccccagagcagccccaccagaggaccctggagcacagcctgccccccagcccccggcccctgcccaggcacaccagcgcccgggagcccagcgccttcaccctgcccccaccaagaagaagcagcagcccagaagatcctgagagagatgaggaggtgctgaaccacgtgctgcgggacatcgagctgttcatgggcaagctggagaaggcccaggccaagaccagcaggaagaagaagtttgggaagaagaacaaggaccagggcggcctgacccaggcccagtacatcgactgcttccagaagatcaagcacagcttcaacctgctgggccgcctggccacctggctgaaggagaccagcgcccctgagctggtgcacatcctcttcaagagcctgaacttcatcctggcccgctgcccagaggccggcctggccgcccaggtgatcagccccctgctgacccccaaggccatcaacctgctgcagagctgcctgagccccccagagagcaacctgtggatgggcctgggccctgcctggaccaccagcagagctgactggacaggagatgagcccctgccctaccagcccaccttcagtgatgactggcagctgcctgagcccagcagccaggcccccctgggctaccaggaccctgtgtccctgcggcggggcagccaccggctgggcagcaccagccacttcccccaggagaagacccacaaccacgacccccagcccggggaccccaacagccggcccagcagccccaagccagcccagcctgccctgaagatgcaggtgctgtatgaatttgaggccaggaacccccgggagctgactgtggtgcagggcgagaagctggaggtgctggaccacagcaagcgctggtggctggtgaagaatgaagctggccgcagcggctacatccccagcaacatcctggagcccctgcagcccggcaccccaggcacccagggccagagccccagccgggtgcccatgctgcggctgagcagcaggcctgaggaggtgacagactggctgcaggccgagaacttcagcacagccaccgtgaggaccctgggcagcctgaccggcagccagctgctgcgcatccggcctggagagctgcagatgctgtgcccccaggaggccccccgcatcctgagccggctggaggccgtgcggaggatgctgggcatcagcccctag

SEQ ID NO: 19613 - DNA, 1050 bp, Artificial Sequence
  Description of Artificial Sequence: Synthetic coding sequence
atgaagctgaccagcgagaagctgcccaagaaccccttctacgcctctgtgtcccagtatgctgccaagaaccagaagttcttccagtggaagaaggagaagacagaaagtgactacacccacgccaacctggtggacaaggccctgcagctgctgaaggagcgcatcctgaagggggacaccctggcctacttcctgcggggccagctgtactttgaggagggctggtatgaggaggccctggagcagtttgaggagatcaaggagaaggaccaccaggccacctaccagctgggcgtgatgtactatgatggcctgggcaccaccctggatgctgagaagggcgtggactacatgaagaagatcctggacagcccctgccccaaggcccggcacctgaagtttgctgctgcctacaacctgggccgggcctactatgagggcaaaggagtgaagaggagcaatgaggaggccgagcggctgtggctgattgctgctgacaatggaaaccccaaggcctctgtgaaggcccagagcatgctgggcctgtactacagcaccaaggagcccaaggagctggagaaggccttctactggcacagcgaggcctgtggaaatggaaacctggagagccagggcgccctgggcctgatgtacctgtatggccagggcatccggcaggacacagaagctgccctgcagtgcctgcgggaggccgctgagagaggaaatgtgtatgcccagggcaacctggtggagtactactacaagatgaagttcttcaccaagtgtgtggccttcagcaagagaattgctgactatgatgaggtgcatgacatccccatgattgcccaggtgacagactgcctgcctgagttcatcggccggggcatggccatggccagcttctaccacgcccgctgcctgcagctgggcctgggcatcaccagagatgagaccacagccaagcactactacagcaaggcctgccgcctgaacccagccctggctgatgagctgcacagcctgctgatccggcagaggatctag

SEQ ID NO: 19614 - DNA, 1236 bp, Artificial Sequence
  Description of Artificial Sequence: Synthetic coding sequence
atgggcctgaagaagatgaagggcctgtcctatgatgaggcctttgccatggccaatgaccccctggagggcttccacgaggtgaacctggccagccccaccagcccagacctgctgggcgtgtatgagagcggcacccaggagcagaccaccagccccagcgtcatctaccggccccaccccagcgccctgagctctgtgcccatccaggccaatgccctggatgtgtctgagctgcccacccagcctgtgtacagcagcccccggcggctgaactgtgccgagatcagcagcatctccttccacgtgacagatcctgccccctgcagcaccagcggcgtgacagctggcctgaccaagctgaccaccaggaaggacaactacaatgctgagcgggagttcctgcagggcgccaccatcacagaggcctgtgatggcagtgatgacatcttcggcctgagcacagacagcctgagccggctgcggagccccagcgtgctggaggtgcgggagaagggctatgaaaggctgaaggaggagctggccaaggcccagcgggagctgaagctgaaggatgaggagtgtgagcggctgagcaaggtgcgggaccagctgggccaggagctggaggagctgacagccagcctgtttgaggaggcccacaagatggtgcgggaggccaacatcaagcaggccacagctgagaagcagctgaaggaggcccagggcaagattgatgtgctgcaggccgaggtggccgccctgaagaccctggtgctgagcagcagccccaccagccccacccaggagcccctgcccggcggcaagacccccttcaagaagggccacaccaggaacaagagcaccagcagcgccatgagcggcagccaccaggacctgagcgtcatccagcccatcgtgaaggactgcaaggaggccgacctgagcctgtacaatgagttccggctgtggaaggatgagcccaccatggacaggacctgccccttcctggacaagatctaccaggaggacatcttcccctgcctgaccttcagcaagtctgagctggccagcgctgtgctggaggccgtggagaacaacaccctgagcattgagcctgtgggcctgcagcccatccgctttgtgaaggccagcgctgtggagtgtggcggccccaagagcctgctgtatgtgaccttcctgcacacctttgacaccttcagccgggacagctag

SEQ ID NO: 19615 - DNA, 2148 bp, Artificial Sequence
  Description of Artificial Sequence: Synthetic coding sequence
atgtttggaaggaagaggtctgtgtcctttggaggcttcggctggattgacaagaccatgctggccagcctgaaggtgaagaagcaggagctggccaacagcagtgatgccaccctgcctgaccggcccctgagcccccccctgacagccccacccaccatgaagagcagcgagttctttgagatgctggagaagatgcaggatgactacatcccctaccccagcattgatgaggtggtggagaagggcggcccctacccccaggtgatcctgccccagtttggaggctactggattgaggaccctgaaaatgtgggcacccccaccagcctgggcagcagcatctgtgaggaggaggaggaggacaacctgagccccaacaccttcggctacaagctggagtgcaagggggaggcccgggcctacagaagacacttcctgggcaaggaccacctgaacttctactgcaccggcagcagcctgggcaacctgatcctgtctgtgaagtgtgaggaggccgagggcatcgagtacctgcgggtcatcctgcggagcaagctgaagacagtgcatgagcgcatccccctggccggcctgagcaagctgcccagcgtgccccagatcgccaaggccttctgtgatgatgctgtgggcctgcgcttcaaccctgtgctgtaccccaaggccagccagatgattgtgtcctatgatgaacatgaggtgaacaacaccttcaagtttggagtcatctaccagaaggcccggcagaccctggaggaggagctgtttggaaataatgaggagagccctgccttcaaggagttcctggacctgctgggggacaccatcaccctgcaggacttcaagggcttccggggcggcctggatgtgacccacggccagacaggagtggagagcgtgtacaccaccttccgggaccgggagatcatgtttcatgtgtccaccaagctgcccttcacagatggagatgcccagcagctgcagaggaagaggcacatcggaaatgacatcgtggccatcatcttccaggaggagaacaccccatttgtgcctgacatgattgccagcaacttcctgcacgcctacatcgtggtgcaggtggagaccccaggcacagagacccccagctacaaggtgtctgtgacagcccgggaggatgtgcccacctttggaccacccctgcccagcccccctgtgttccagaagggccctgagttccgggagttcctgctgaccaagctgaccaatgcagaaaatgcctgctgcaagagtgacaagtttgccaagctggaggacaggaccagggctgccctgctggacaacctgcatgatgagctgcacgcccacacccaggccatgctgggcctgggccctgaggaggacaagtttgaaaatggaggccatggaggcttcctggagagcttcaagagggccatccgggtgcgcagccacagcatggagaccatggtgggcggccagaagaagagccacagcggcggcatccctggcagcctgagcggcggcatcagccacaacagcatggaggtgaccaagaccaccttcagcccccctgtggtggccgccaccgtgaagaaccagagccgcagccccatcaagagaagaagtggcctcttcccccggctgcacactggaagtgagggccagggcgacagccgggcccgctgtgacagcaccagcagcacccccaagaccccagatggcggccacagcagccaggagatcaagtctgagaccagcagcaaccccagcagccctgagatctgccccaacaaggagaagcccttcatgaagctgaaggaaaatggccgggccatcagccgcagcagcagcagcaccagctctgtgagcagcacagctggggagggggaggccatggaggagggggacagcggcggcagccagcccagcaccaccagccccttcaagcaggaggtgtttgtgtacagccccagccccagcagcgagagccccagcctgggcgccgccgccacccccatcatcatgagccgcagccccacagatgccaagagcaggaacagccccaggagcaacctgaagttccgctttgacaagctgagccacgccagcagtggagctggccactag

SEQ ID NO: 19616 - DNA, 2271 bp, Artificial Sequence
  Description of Artificial Sequence: Synthetic coding sequence
atggaggaggagctgaagtgccctgtgtgtggcagcctcttccgggagcccatcatcctgccctgcagccacaacgtgtgcctgccctgtgcccggaccatcgctgtgcagaccccagatggagagcagcacctgccccagcccctgctgctgagccggggcagcggcctgcaggccggggctgctgctgctgccagcctggagcatgatgctgctgctggccctgcctgtggcggggccggcggcagcgctgctgggggcctgggcggcggggccggcggcggcggggaccatgctgacaagctgagcctgtacagcgagacagacagcggctacggcagctacacccccagcctgaagagccccaatggagtgcgggtgctgcccatggtgcctgcccctcctggcagcagcgctgctgctgcccggggagctgcctgcagcagcctgagcagcagcagcagcagcatcacctgcccccagtgccacaggtctgccagcctggaccaccggggcctgcggggcttccagaggaaccggctgctggaggccatcgtgcagcgctaccagcagggcagaggagctgtgcccggcaccagcgctgctgctgctgtggccatctgccagctgtgtgacaggaccccacctgagcctgctgccaccctgtgtgagcagtgtgatgtgctgtactgcagcgcctgccagctgaagtgccaccccagccggggcccctttgccaagcaccggctggtgcagcccccacctcctcctcctcctcctgctgaggccgccagcggccccaccggcacagcccagggcgcccccagcggcggcggcggctgcaagagccctgggggcgctggggccggggccaccggcggcagcacagccaggaagttccccacctgcccagagcacgagatggagaactacagcatgtactgtgtgtcctgcaggacccctgtgtgctacctgtgcctggaggagggcagacatgccaagcatgaggtgaagcccctgggcgccatgtggaagcagcacaaggcccagctgagccaggccctgaatggagtgtctgacaaggccaaggaggccaaggagttcctggtgcagctgaagaacatcctgcagcagatccaggagaatggcctggactatgaggcctgcctggtggcccagtgtgatgccctggtggatgccctgacccggcagaaggccaagctgctgaccaaggtgaccaaggagcgggagcacaagctgaagatggtgtgggaccagatcaaccactgcaccctgaagctgcggcagagcacaggcctgatggagtactgcctggaggtgatcaaggaaaatgaccccagcggcttcctgcagatcagtgatgccctgatcaagagggtgcaggtgtcccaggagcagtgggtgaagggggccctggagcccaaggtgtctgctgagtttgacctgaccctggacagcgagcccctgctgcaggccatccaccagctggacttcatccagatgaagtgccgggtgccccctgtgcccctgctgcagctggagaagtgctgcaccaggaacaacagcgtgaccctggcctggaggatgccacccttcacccacagccctgtggatggctacatcctggagctggatgatggagctgggggccagttccgggaggtgtatgtgggcaaggagaccctgtgcaccattgatggcctgcacttcaacagcacctacaatgcccgggtgaaggccttcaacagcagtggagtgggcccctacagcaagacagtggtgctgcagaccagtgatgtggcctggttcacctttgaccccaacagcggccaccgggacatcatcctgagcaatgacaaccagacagccacctgcagcagctatgatgacagagtggtgctgggcacagctgccttcagcaagggcgtgcactactgggagctgcacgtggacagatatgacaaccacccagaccctgccttcggcgtggcccgggcctctgtggtgaaggacatgatgctgggcaaggatgacaaggcctgggccatgtatgtggacaacaacagatcctggttcatgcactgcaacagccacaccaacagaacagaaggaggagtgtgcaagggggccaccgtgggcgtgctgctggacctgaacaagcacaccctgaccttcttcatcaatggccagcagcagggccccacagccttcagccatgaggtgcagcccagcgtgaccagcctcttctag

SEQ ID NO: 19617 - DNA, 2352 bp, Artificial Sequence
  Description of Artificial Sequence: Synthetic coding sequence
atggaggaggagctgaagtgccctgtgtgtggcagcctcttccgggagcccatcatcctgccctgcagccacaacgtgtgcctgccctgtgcccggaccatcgctgtgcagaccccagatggagagcagcacctgccccagcccctgctgctgagccggggcagcggcctgcaggccggggctgctgctgctgccagcctggagcatgatgctgctgctggccctgcctgtggcggggccggcggcagcgctgctgggggcctgggcggcggggccggcggcggcggggaccatgctgacaagctgagcctgtacagcgagacagacagcggctacggcagctacacccccagcctgaagagccccaatggagtgcgggtgctgcccatggtgcctgcccctcctggcagcagcgctgctgctgcccggggagctgcctgcagcagcctgagcagcagcagcagcagcatcacctgcccccagtgccacaggtctgccagcctggaccaccggggcctgcggggcttccagaggaaccggctgctggaggccatcgtgcagcgctaccagcagggcagaggagctgtgcccggcaccagcgctgctgctgctgtggccatctgccagctgtgtgacaggaccccacctgagcctgctgccaccctgtgtgagcagtgtgatgtgctgtactgcagcgcctgccagctgaagtgccaccccagccggggcccctttgccaagcaccggctggtgcagcccccacctcctcctcctcctcctgctgaggccgccagcggccccaccggcacagcccagggcgcccccagcggcggcggcggctgcaagagccctgggggcgctggggccggggccaccggcggcagcacagccaggaagttccccacctgcccagagcacgagatggagaactacagcatgtactgtgtgtcctgcaggacccctgtgtgctacctgtgcctggaggagggcagacatgccaagcatgaggtgaagcccctgggcgccatgtggaagcagcacaaggcccagctgagccaggccctgaatggagtgtctgacaaggccaaggaggccaaggagttcctggtgcagctgaagaacatcctgcagcagatccaggagaatggcctggactatgaggcctgcctggtggcccagtgtgatgccctggtggatgccctgacccggcagaaggccaagctgctgaccaaggtgaccaaggagcgggagcacaagctgaagatggtgtgggaccagatcaaccactgcaccctgaagctgcggcagagcacaggcctgatggagtactgcctggaggtgatcaaggaaaatgaccccagcggcttcctgcagatcagtgatgccctgatcaagagggtgcaggtgtcccaggagcagtgggtgaagggggccctggagcccaaggtgtctgctgagtttgacctgaccctggacagcgagcccctgctgcaggccatccaccagctggacttcatccagatgaagtgccgggtgccccctgtgcccctgctgcagctggagaagtgctgcaccaggaacaacagcgtgaccctggcctggaggatgccacccttcacccacagccctgtggatggctacatcctggagctggatgatggagctgggggccagttccgggaggtgtatgtgggcaaggagaccctgtgcaccattgatggcctgcacttcaacagcacctacaatgcccgggtgaaggccttcaacagcagtggagtgggcccctacagcaagacagtggtgctgcagaccagtgatgtggcctggttcacctttgaccccaacagcggccaccgggacatcatcctgagcaatgacaaccagacagccacctgcagcagctatgatgacagagtggtgctgggcacagctgccttcagcaagggcgtgcactactgggagctgcacgtggacagatatgacaaccacccagaccctgccttcggcgtggcccgggcctctgtggtgaaggacatgatgctgggcaaggatgacaaggcctgggccatgtatgtggacaacaacagatcctggttcatgcactgcaacagccacaccaacagaacagaaggaggagtgtgcaagggggccaccgtgggcgtgctgctggacctgaacaagcacaccctgaccttcttcatcaatggccagcagcagggccccacagccttcagccacgtggatggagtcttcatgcctgccctgagcctgaacagaaatgtgcaggtgaccctgcacacaggcctggaggtgcccaccaacctgggccggcccaagctgagcggcaactag

SEQ ID NO: 19618 - DNA, 471 bp, Artificial Sequence
  Description of Artificial Sequence: Synthetic coding sequence
atggtgcctgtgttcaccagcagcgccctgcctgtgaaggatgtggaggacaagccagagcagcagaccaggacccgggagacagacaagagccccaccagcacagagccccggcagcagcccagcgccctgtttgcccggggcaacaggaaggctgtgaagagcccccagaggagcagcagcaagatcaaggagaacaagcacccctttgccctgtatggctggggcgagaagcagacagacaccggcagccagaagacccacaacgtgtgtgccagcgcccctgtgcatgagatccacgagagcgccctgcgggccaagaacagacggcaggtggagaagaggaagctggtggcccagaggcagagggcccacagcgtggatgtggagaagaacaggaagatgaaggccagcagcagcgagaacccctggatgacagagtacatgcgctgctacagcgcccgggcctag

SEQ ID NO: 19619 - DNA, 813 bp, Artificial Sequence; identical to SEQ ID NO: 18630
  Description of Artificial Sequence: Synthetic coding sequence

SEQ ID NO: 19620 - DNA, 1158 bp, Artificial Sequence
  Description of Artificial Sequence: Synthetic coding sequence
atggccgccccagacctgagcaccaacctgcaggaggaggccacctgtgccatctgcctggactacttcacagatcctgtgatgacagactgtggccacaacttctgccgggagtgcatccgccgctgctggggccagcctgagggcccctatgcctgcccagaatgtcgggagctgagcccccagaggaacctgcggcccaaccggcccctggccaagatggccgagatggcccggcggctgcacccccccagccctgtgccccagggcgtgtgcccagcccaccgggagcccctggccgccttctgtggagatgagctgcggctgctgtgtgccgcctgtgagaggtctggagagcactgggcccaccgggtgcggcccctgcaggatgctgctgaggacctgaaggccaagctggagaagagcctggagcacctgaggaagcagatgcaggatgccctgctcttccaggcccaggctgatgagacctgtgtgctgtggcagaagatggtggagagccagaggcagaatgtgctgggggagtttgagcggctgcggcggctgctggccgaggaggagcagcagctgctgcagaggctggaggaggaggagctggaggtgctgccccggctgcgggagggcgccgcccacctgggccagcagagcgcccacctggccgagctgattgctgagctggagggccgctgccagctgcctgccctgggcctgctgcaggacatcaaggatgccctgcggcgggtgcaggatgtgaagctgcagcccccagaggtggtgcccatggagctgaggacagtgtgccgggtgcccggcctggtggagaccctgcggcgcttccggggccgctgtggcggcccccgctggggagatgacagcagaagaggccctgccaaggacctgggcagccagccccgggtgctgtgcccagccacagccagcagcaagctgactgtgtcctggtggtgggtggtgggcaagaccagcagcgcccacaccagtgacatcagctgtgtgggcatcttcacccccaacaacagcagcaccagcggaaatgagctgggcatccagggcttccacagcgccctgaacagaattgccagcgctgacaccactggagtgtccacagaccccacagactag

SEQ ID NO: 19621 - DNA, 1251 bp, Artificial Sequence
  Description of Artificial Sequence: Synthetic coding sequence
atgcccctgtacaatgacagcttccacgagatcagccacaagggccgccgccacaccctggtgctgaagagcatccagagagcagatgctggcatcgtgcgggccagcagcctgaaggtgtccaccagcgcccggctggaggtgcgggtgaagcctgtggtgttcctgaaggccctggatgacctgtctgctgaggagcggggcaccctggccctgcagtgtgaggtgtctgaccctgaggcccacgtggtgtggaggaaggatggagtgcagctgggccccagcgacaagtatgacttcctgcacacagctggcacccggggcctggtggtgcatgatgtgtccccagaagatgctggcctgtacacctgccacgtgggcagcgaggagacccgggcccgggtgcgggtgcatgacctgcacgtgggcatcaccaagaggctgaagaccatggaggtgctggagggggagagctgcagctttgaatgtgtgctgagccatgaaagtgccagtgaccctgccatgtggacagtgggcggcaagacagtgggcagcagcagccgcttccaggccacccggcagggcaggaagtacatcctggtggtgcgggaggccgcccccagtgatgctggggaggtggtgttttctgtgcggggcctgaccagcaaggccagcctgattgtgcgggagaggcctgctgccatcatcaagcccctggaggaccagtgggtggcccctggagaagatgtggagctgcgctgtgagctgagcagagctggcacccctgtgcactggctgaaggacaggaaggccatcaggaagagccagaagtatgatgtggtgtgtgagggcaccatggccatgctggtgatccggggggccagcctgaaggatgctggggagtacacctgtgaggtggaggccagcaagagcacagccagcctgcacgtggaggagaaggccaactgcttcacagaggagctgaccaacctgcaggtggaggagaagggcacagctgtgttcacctgcaagacagagcaccctgctgccaccgtgacctggaggaagggcctgctggagctgcgggccagcggcaagcaccagcccagccaggagggcctgaccctgcggctgaccatcagcgccctggagaaggctgacagcgacacctacacctgtgacatcggccaggcccagagccgggcccagctgctggtgcagggcgaggccgccaagtgtgcccgggcctag

SEQ ID NO: 19622 - DNA, 2130 bp, Artificial Sequence
  Description of Artificial Sequence: Synthetic coding sequence
atggagaagcaccggggcgtgctggagtgccaggtgtcccgggccagcgcccaggtgcgctggttcaagggcagccaggagctgcagcccggccccaagtatgagctggtgtctgatggcctgtacaggaagctgatcatcagtgatgtgcatgctgaagatgaggacacctacacctgtgatgctggagatgtgaagaccagcgcccagttctttgtggaggagcagagcatcaccatcgtgcggggcctgcaggatgtgacagtgatggagcccgccccagcctggtttgaatgtgagaccagcatccccagcgtgcggccccccaagtggctgctgggcaagacagtgctgcaggccggcggcaatgtgggcctggagcaggagggcaccgtgcaccggctgatgctgcggaggacctgcagcaccatgactggacctgtgcacttcaccgtgggcaagagccgcagcagcgcccggctggtggtgtctgacatccctgtggtgctgacccggcccctggagcccaagacaggccgggagctgcagagcgtggtgctgagctgtgacttccggcctgcccccaaggctgtgcagtggtacaaggatgacacccccctgagccccagcgagaagttcaagatgagcctggagggccagatggccgagctgcgcatcctgcggctgatgccagcagatgctggggtgtaccgctgccaggccggcagcgcccacagcagcacagaggtgacagtggaggcccgggaggtgacagtgacaggccccctgcaggatgctgaggccacagaggagggctgggccagcttcagctgtgagctgagccatgaagatgaggaggtggagtggagcctgaatggcatgcccctgtacaatgacagcttccacgagatcagccacaagggcagaagacacaccctggtgctgaagagcatccagagagcagatgctggcatcgtgcgggccagcagcctgaaggtgtccaccagcgcccggctggaggtgcgggtgaagcctgtggtgttcctgaaggccctggatgacctgtctgctgaggagcggggcaccctggccctgcagtgtgaggtgtctgaccctgaggcccacgtggtgtggaggaaggatggagtgcagctgggccccagcgacaagtatgacttcctgcacacagctggcacccggggcctggtggtgcatgatgtgtccccagaagatgctggcctgtacacctgccacgtgggcagcgaggagacccgggcccgggtgcgggtgcatgacctgcacgtgggcatcaccaagaggctgaagaccatggaggtgctggagggggagagctgcagctttgaatgtgtgctgagccatgagagcgccagtgaccctgccatgtggacagtgggcggcaagacagtgggcagcagcagccgcttccaggccacccggcagggcaggaagtacatcctggtggtgcgggaggccgcccccagtgatgctggggaggtggtgttttctgtgcggggcctgaccagcaaggccagcctcatcgtgcgggagaggcctgctgccatcatcaagcccctggaggaccagtgggtggcccctggagaagatgtggagctgcgctgtgagctgagccgggccggcacccctgtgcactggctgaaggacaggaaggccatcaggaagagccagaagtatgatgtggtgtgtgagggcaccatggccatgctggtgatccggggggccagcctgaaggatgctggggagtacacctgtgaggtggaggccagcaagagcacagccagcctgcacgtggaggagaaggccaactgcttcacagaggagctgaccaacctgcaggtggaggagaagggcacagctgtgttcacctgcaagacagagcaccctgctgccaccgtgacctggaggaagggcctgctggagctgcgggccagcggcaagcaccagcccagccaggagggcctgaccctgcggctgaccatcagcgccctggagaaggctgacagcgacacctacacctgtgacatcggccaggcccagagccgggcccagctgctggtgcagggcgaggccgccaagtgtgcccgggcctag

SEQ ID NO: 19623 - DNA, 16809 bp, Artificial Sequence
  Description of Artificial Sequence: Synthetic coding sequence
atgctggtgatccggggggccagcctgaaggatgctggggagtacacctgtgaggtggaggccagcaagagcacagccagcctgcacgtggaggagaaggccaactgcttcacagaggagctgaccaacctgcaggtggaggagaagggcacagctgtgttcacctgcaagacagagcaccctgctgccaccgtgacctggaggaagggcctgctggagctgcgggccagcggcaagcaccagcccagccaggagggcctgaccctgcggctgaccatcagcgccctggagaaggctgacagcgacacctacacctgtgacatcggccaggcccagagccgggcccagctgctggtgcagggccggcgggtgcacatcatcgaggacctggaggatgtggatgtgcaggagggcagcagcgccaccttccgctgccgcatcagccctgccaactatgagcctgtgcactggttcctggacaagacccccctgcacgccaatgagctgaatgaaattgatgcccagcccggcggctaccacgtgctgaccctgcggcagctggccctgaaggacagcggcaccatctactttgaagctggggaccagagggccagcgctgccctgcgggtgacagagaagcccagcgtcttcagccgggagctgacagatgccaccatcacagaaggagaggacctgaccctggtgtgtgagaccagcacctgtgacatccctgtgtgctggaccaaggatggcaagaccctgcggggcagcgcccgctgccagctgagccatgagggccaccgggcccagctgctgatcaccggggccaccctgcaggacagcggccgctacaagtgtgaggccggcggggcctgcagcagcagcatcgtgcgggtgcacgcccggcctgtgcgcttccaggaggccctgaaggacctggaggtgctggagggcggggccgccaccctgcgctgtgtgctgagctctgtggccgcccctgtgaagtggtgctacggcaacaacgtgctgcggcctggggacaagtacagcctgcggcaggagggcgccatgctggagctggtggtgaggaacctgcggccccaggacagcggccgctacagctgcagctttggagaccagaccaccagcgccaccctgactgtgacagccctgcctgcccagttcatcggcaagctgaggaacaaggaggccacagaaggagccacagccaccctgcgctgtgagctgagcaaggccgcccctgtggagtggaggaagggcagcgagaccctgagagatggagaccgctactgcctgcggcaggatggagccatgtgtgagctgcagatccggggcctggccatggtggatgctgctgagtacagctgtgtgtgtggggaggagaggaccagcgccagcctgaccatccggcccatgcctgcccacttcatcggccgcctgcggcaccaggagagcattgaaggagccacagccaccctgcgctgtgagctgagcaaggccgcccctgtggagtggaggaagggccgggagagcctgagagatggagacagacacagcctgcggcaggatggagctgtgtgtgagctgcagatctgtggcctggccgtggctgatgctggggagtacagctgtgtgtgtggggaggagaggaccagcgccaccctgactgtgaaggccctgcctgccaagttcacagagggcctgagaaatgaggaggccgtggagggcgccacagccatgctgtggtgtgagctgagcaaggtggcccctgtggagtggaggaagggccctgagaacctgagagatggagaccgctacatcctgcggcaggagggcacccgctgtgagctgcagatctgtggcctggccatggctgatgctggggagtacctgtgtgtgtgtggccaggagaggaccagcgccaccctgaccatccgggccctgcctgcccgcttcattgaagatgtgaagaaccaggaggcccgggagggcgccacagctgtgctgcagtgtgagctgaacagcgctgcccctgtggagtggaggaagggcagcgagaccctgagagatggagaccgctacagcctgcggcaggacggcaccaagtgtgagctgcagatccggggcctggccatggctgacaccggggagtacagctgtgtgtgtggccaggagaggaccagcgccatgctgactgtgcgggccctgcccatcaagttcacagagggcctgagaaatgaggaggccacagaaggagccacagctgtgctgcgctgtgagctgagcaagatggcccctgtggagtggtggaagggccacgagaccctgagagatggagacagacacagcctgcggcaggatggagcccgctgtgagctgcagatccggggcctggtggccgaggatgctggggagtacctgtgcatgtgtgggaaggagaggaccagcgccatgctgactgtgcgggccatgcccagcaagttcatcgagggcctgagaaatgaggaggccacagaaggagacacagccaccctgtggtgtgagctgagcaaggccgcccctgtggagtggaggaagggccacgagaccctgagagatggagacagacacagcctgcggcaggacggcagccgctgtgagctgcagatccggggcctggccgtggtggatgctggggagtacagctgtgtgtgtggccaggagaggaccagcgccaccctgactgtgcgggccctgcctgcccgcttcattgaagatgtgaagaaccaggaggcccgggagggcgccacagctgtgctgcagtgtgagctgagcaaggccgcccctgtggagtggaggaagggcagcgagaccctgcggggcggggaccgctacagcctgcggcaggacggcacccgctgtgagctgcagatccacggcctgtctgtggccgacaccggggagtacagctgtgtgtgtggccaggagaggaccagcgccaccctgactgtgcgggccctgcctgcccgcttcacccaggacctgaagaccaaggaggccagcgagggcgccacagccaccctgcagtgtgagctgagcaaggtggcccctgtggagtggaagaagggccctgagaccctgagagatggcggccgctacagcctgaagcaggacggcacccgctgtgagctgcagatccatgacctgtctgtggctgatgctggggagtacagctgcatgtgtggccaggagaggaccagcgccaccctgactgtgcgggccctgcctgcccgcttcacagagggcctgagaaatgaggaggccatggagggcgccacagccaccctgcagtgtgagctgagcaaggccgcccctgtggagtggaggaagggcctggaggccctgagagatggagacaagtacagcctgcggcaggatggagctgtgtgtgagctgcagatccacggcctggccatggctgacaacggggtgtacagctgtgtgtgtggccaggagaggaccagcgccaccctgactgtgcgggccctgcctgcccgcttcatcgaggacatgaggaaccagaaggccacagaaggagccaccgtgaccctgcagtgcaagctgaggaaggccgcccctgtggagtggaggaagggccccaacaccctgaaggatggagaccgctacagcctgaagcaggacggcaccagctgtgagctgcagatccggggcctggtgattgctgatgctggggagtacagctgcatctgtgagcaggagaggaccagcgccaccctgactgtgcgggccctgcctgcccgcttcattgaagatgtgaggaaccacgaggccacagaaggagccacagctgtgctgcagtgtgagctgagcaaggccgcccctgtggagtggaggaagggcagcgagaccctgagagatggagaccgctacagcctgcggcaggacggcacccgctgtgagctgcagatccggggcctggccgtggaggacaccggggagtacctgtgtgtgtgtggccaggagaggaccagcgccaccctgactgtgcgggccctgcctgcccgcttcatcgacaacatgaccaaccaggaggcccgggagggcgccacagccaccctgcactgtgagctgagcaaggtggcccctgtggagtggaggaagggccctgagaccctgagagatggagacagacacagcctgcggcaggacggcacccgctgtgagctgcagatccggggcctgtctgtggctgatgctggggagtacagctgtgtgtgtggccaggagaggaccagcgccaccctgaccatccgggaggccacagagggcgccacagccatgctgcagtgtgagctgagcaaggtggcccctgtggagtggaggaaaggacctgagaccctgagagatggagaccgctacaacctgcggcaggacggcacccgctgtgagctgcagatccacggcctgtctgtggccgacacaggagagtacagctgtgtgtgtggccaggagaagaccagcgccaccctgactgtgaaggccccccagcccgtcttccgggagcccctgcagagcctgcaggccgaggagggcagcacagccaccctgcagtgtgagctgtctgagcccacagccaccgtggtgtggagcaagggcggcctgcagctgcaggccaacggccggcgggagccccggctgcagggctgcacagctgagctggtgctgcaggacctgcagcgggaggacaccggggagtacacctgcacctgtggcagccaggccaccagcgccaccctgactgtgacagctgcccctgtgcgcttcctgcgggagctgcagcaccaggaggtggatgaaggaggaacagcccacctgtgctgtgagctgagcagagctggggcctctgtggagtggaggaagggcagcctgcagctgttcccctgtgccaagtaccagatggtgcaggatggagctgctgctgagctgctggtgcggggcgtggagcaggaggatgctggggactacacctgtgacaccggccacacccagagcatggccagcctgtctgtgcgggtgccccggcccaagttcaagacccggctgcagagcctggagcaggagactggagacatcgcccggctgtgctgccagctgagtgatgctgagagcggggctgtggtgcagtggctgaaggagggcgtggagctgcatgctggccccaagtatgagatgaggagccagggcgccacccgggagctgctgatccaccagctggaggccaaggacaccggggagtatgcctgtgtgactggaggccagaagacagctgccagcctgcgggtgacagagcctgaggtgaccatcgtgcggggcctggtggatgctgaggtgacagcagatgaagatgtggagttcagctgtgaggtgtccagagctggggccaccggggtgcagtggtgcctgcagggcctgcccctgcagagcaatgaggtgacagaggtggccgtgagagatggccgcatccacaccctgcggctgaagggcgtgaccccagaagatgctggcaccgtgtccttccacctgggcaaccacgccagcagcgcccagctgactgtgcgggcccctgaggtgaccatcctggagcccctgcaggatgtgcagctgtctgagggccaggatgccagcttccagtgccgcctgagccgggccagcggccaggaggcccgctgggccctgggcggcgtgcccctgcaggccaatgagatgaatgacatcaccgtggagcagggcaccctgcacctgctgaccctgcacaaggtgaccctggaggatgctggcaccgtgtccttccacgtgggcacctgcagcagcgaggcccagctgaaggtgacagccaagaacacagtggtgcggggcctggagaatgtggaggccctggagggcggggaggccctgtttgagtgccagctgagccagcctgaggtggccgcccacacctggctgctggatgatgagcctgtgcacaccagtgaaaatgctgaggtggtgttctttgaaaatggcctgcggcacctgctgctgctgaagaacctgcggccccaggacagctgccgggtgaccttcctggccggggacatggtgaccagcgccttcctgactgtgcggggctggaggctggagatcctggagcccctgaagaatgctgctgtgcgggccggggcccaggcctgcttcacctgcaccctgtctgaggccgtgcctgtgggggaggcctcctggtacatcaatggagctgctgtgcagccagatgacagcgactggacagtgacagcagatggcagccaccacgccctgctgctgcggagcgcccagccccaccacgccggggaggtgacctttgcctgcagagatgctgtggccagcgcccggctgactgtgctgggcctgcctgaccccccagaagatgctgaggtggtggcccggagcagccacacagtgaccctgtcctgggccgcccccatgtctgatggcggcggcggcctgtgtggctacagagtggaggtgaaggagggcgccaccggccagtggaggctgtgccacgagctggtgcccggcccagaatgtgtggtggatggcctggcccctggagagacctaccgcttccgggtggccgctgtgggccctgtgggcgctggggagcctgtgcacctgccccagacagtgcggctggccgagccccccaagcctgtgcccccccagcccagcgcccctgagagccggcaggtggccgctggagaagatgtgtccctggagctggaggtggtggccgaggccggggaggtgatctggcacaagggcatggagcgcatccagcccggcggccgctttgaggtggtgtcccagggccggcagcagatgctggtgatcaagggcttcaccgctgaggaccagggcgagtaccactgcggcctggcccagggcagcatctgcccagctgctgccaccttccaggtggccctgagccctgcctctgtggatgaggccccccagcccagcctgcccccagaggccgcccaggagggggacctgcacctgctgtgggaggccctggccaggaagaggaggatgagccgggagcccaccctggacagcatcagcgagctgcctgaggaggatggccgcagccagaggctgccccaggaggccgaggaggtggccccagacctgtctgagggctacagcacagcagatgagctggccaggactggagatgctgacctgagccacaccagcagtgatgatgagagcagagctggcacccccagcctggtgacctacctgaagaaggccggccggcccggcaccagccccctggccagcaaggtgggcgccccagctgcccccagcgtgaagccccagcagcagcaggagcccctggccgctgtgcggccccccctgggggacctgagcaccaaggacctgggggaccccagcatggacaaggctgctgtgaagatccaggccgccttcaagggctacaaggtgaggaaggagatgaagcagcaggagggccccatgttcagccacaccttcggggacacagaggcccaggtgggagatgccctgcggctggagtgtgtggtggccagcaaggcagatgtgcgggcccgctggctgaaggatggagtggagctgacagatggccgccaccaccacatcgaccagctgggagatggcacctgcagcctgctgatcaccggcctggacagagcagatgctggctgctacacctgccaggtgagcaacaagtttggccaggtgacccacagcgcctgtgtggtggtgtctggcagcgagagcgaggccgagagcagcagtggaggagagctggatgatgccttccggcgggccgcccggcggctgcacaggctcttccgcaccaagagccctgctgaggtgtctgatgaggagctgttcctgtctgcagatgagggccctgctgagcctgaggagcctgctgactggcagacctacagagaagatgagcacttcatctgcatccgctttgaggccctgacagaggcccggcaggccgtgacccgcttccaggagatgtttgccaccctgggcatcggcgtggagatcaagctggtggagcagggcccccggcgggtggagatgtgcatcagcaaggagaccccagcccctgtggtgcccccagagcccctgcccagcctgctgaccagtgatgctgcccctgtgttcctgacagagctgcagaaccaggaggtgcaggacggctaccctgtgtcctttgactgtgtggtgacaggccagcccatgcccagcgtgcgctggttcaaggatggcaagctgctggaggaggatgaccactacatgatcaatgaagaccagcagggcggccaccagctgatcatcacagctgtggtgcctgctgacatgggcgtgtaccgctgcctggccgagaacagcatgggcgtgagcagcaccaaggccgagctgcgggtggacctgaccagcacagattatgacacagctgctgatgccacagagagcagcagctacttcagcgcccagggctacctgagcagccgggagcaggagggcacagagagcaccacagatgagggccagctgccccaggtggtggaggagctgcgggacctgcaggtggcccctggcacccggctggccaagttccagctgaaggtgaagggctacccagccccccggctgtactggttcaaggatggccagcccctgacagccagcgcccacatccgcatgacagacaagaagatcctgcacaccctggagatcatctctgtgacccgggaggacagcggccagtatgctgcctacatcagcaatgccatgggcgccgcctacagcagcgcccggctgctggtgcggggcccagatgagcctgaggagaagccagccagtgatgtgcatgagcagctggtgccccccaggatgctggagcgcttcacccccaagaaggtgaagaagggcagcagcatcaccttctctgtgaaggtggagggccggcctgtgcccaccgtgcactggctgcgggaggaggccgagcggggcgtgctgtggattggccctgacaccccaggctacacagtggccagcagcgcccagcagcacagcctggtgctgctggatgtgggccggcagcaccagggcacctacacctgcatcgccagcaatgctgctggccaggccctgtgcagcgccagcctgcacgtgtctggcctgcccaaggtggaggagcaggagaaggtgaaggaggccctgatcagcaccttcctgcagggcaccacccaggccatcagcgcccagggcctggagacagccagctttgctgacctgggcggccagaggaaggaggagcccctggccgccaaggaggccctgggccacctgagcctggccgaggtgggcacagaggagttcctgcagaagctgaccagccagatcacagagatggtgtctgccaagatcacccaggccaagctgcaggtgcctggaggagacagtgatgaggacagcaagaccccatctgccagccccaggcatggccgcagccggcccagcagcagcatccaggagagcagcagcgagagtgaagatggagatgcccggggggagatctttgacatctacgtggtgacagctgactacctgcccctgggcgctgagcaggatgccatcaccctgcgggagggccagtatgtggaggtgctggatgctgcccaccccctgcgctggctggtgaggaccaagcccaccaagagcagccccagccggcagggctgggtgtccccagcctacctggaccggcggctgaagctgagccctgagtggggcgctgctgaggcccctgagttccctggagaggccgtgtctgaagatgagtacaaggcccggctgagcagcgtcatccaggagctgctgagcagcgagcaggcctttgtggaggagctgcagttcctgcagagccaccacctgcagcacctggagcgctgcccccacgtgcccatcgctgtggccggccagaaggccgtcatcttcagaaatgtgcgggacatcggccgcttccacagcagcttcctgcaggagctgcagcagtgtgacacagatgatgatgtggccatgtgcttcatcaagaaccaggccgcctttgagcagtacctggagttcctggtgggccgggtgcaggccgagagcgtggtggtgtccacagccatccaggagttctacaagaagtatgcagaggaggccctgctggccggggaccccagccagcccccacctccacccctgcagcactacctggagcagcctgtggagcgggtgcagcgctaccaggccctgctgaaggagctgatccggaacaaggccaggaaccggcagaactgtgccctgctggagcaggcctatgctgtggtgtctgccctgccccagagagctgagaacaagctgcacgtgtccctgatggagaactacccaggcaccctgcaggccctgggggagcccatccggcagggccacttcatcgtgtgggagggcgcccctggggccaggatgccctggaagggccacaacagacatgtgttcctgttcaggaaccacctggtgatctgcaagccccggcgggacagcaggacagacacagtgtcctatgtgttcaggaacatgatgaagctgagcagcattgacctgaatgaccaggtggagggagatgaccgggcctttgaggtgtggcaggagcgggaggacagcgtgaggaagtacctgctgcaggccaggacagccatcatcaagagctcctgggtgaaggagatctgtggcatccagcagaggctggccctgcctgtgtggaggcccccagactttgaggaggagctggccgactgcacagctgagctgggggagaccgtgaagctggcctgccgggtgacaggcacccccaagcctgtgatctcctggtacaaggatggcaaggctgtgcaggtggacccccaccacatcctgattgaggaccctgatggcagctgtgccctgatcctggacagcctgactggagtggacagcggccagtacatgtgctttgctgccagcgctgctggcaactgcagcaccctgggcaagatcctggtgcaggtgcccccaagatttgtgaacaaggtgcgggccagcccctttgtggagggagaagatgcccagttcacctgcaccattgaaggagccccctacccccagatccgctggtacaaggatggagccctgctgaccaccggcaacaagttccagaccctgtctgagcccaggagcggcctgctggtgctggtgatccgggccgccagcaaagaagacctgggcctgtatgaatgtgagctggtgaaccggctgggcagcgcccgggccagcgctgagctgcgcatccagagccccatgctgcaggcccaggagcagtgccaccgggagcagctggtggccgctgtggaggacaccaccctggagagagctgaccaggaggtgacctctgtgctgaagaggctgctgggccccaaggcccctggccccagcactggagacctgaccggccctggcccctgccccaggggggccccagccctgcaggagaccggcagccagccccctgtgacaggcaccagcgaggccccagctgtgcccccccgggtgccccagcccctgctgcacgagggccctgagcaggagcctgaggccatcgcccgggcccaggagtggacagtgcccatccgcatggagggcgccgcctggccaggggccggcaccggggagctgctgtgggatgtgcacagccacgtggtgcgggagaccacccagaggacctacacctaccaggccatcgacacccacacagcccggccccccagcatgcaggtgaccattgaagatgtgcaggcccagacaggaggaacagcccagtttgaggccatcatcgagggggacccccagcccagcgtgacctggtacaaggacagcgtgcagctggtggacagcacccggctgagccagcagcaggagggcaccacctacagcctggtgctgcggcacgtggccagcaaggatgctggggtgtacacctgcctggcccagaacacaggaggccaggtgctgtgcaaggccgagctgctggtgctgggcggggacaatgaaccagattctgagaagcagagccacaggaggaagctgcacagcttctatgaggtgaaggaggagatcggccggggcgtgtttggatttgtgaagagggtgcagcacaagggcaacaagatcctgtgtgccgccaagttcatccccctgcggagcaggacccgggcccaggcctaccgggagcgggacatcctggccgccctgagccaccccctggtgacaggcctgctggaccagtttgagaccaggaagaccctcatcctgatcctggagctgtgcagcagcgaggagctgctggaccggctgtacaggaagggcgtggtgacagaggccgaggtgaaggtgtacatccagcagctggtggagggcctgcactacctgcacagccatggagtgctgcacctggacatcaagcccagcaacatcctgatggtgcacccagcccgggaggacatcaagatctgtgactttggatttgcccagaacatcaccccagctgagctgcagttcagccagtatggcagccctgagtttgtgtccccagagatcatccagcagaaccctgtgtctgaggccagtgacatctgggccatgggcgtcatctcctacctgagcctgacctgcagcagcccctttgctggggagagtgaccgggccaccctgctgaatgtgctggagggccgggtgtcctggagcagccccatggccgcccacctgtctgaagatgccaaggacttcatcaaggccaccctgcagagggccccccaggcccggcccagcgctgcccagtgcctgagccacccctggttcctgaagtccatgcctgctgaggaggcccacttcatcaacaccaagcagctgaagttcctgctggcccggagccgctggcagaggagcctgatgagctacaagagcatcctggtgatgaggagcatccctgagctgctgcggggccccccagacagccccagcctgggcgtggcccggcacctgtgccgggacaccggcggcagcagcagcagcagcagcagcagtgacaatgagctggccccctttgcccgggccaagagcctgccccccagccctgtgacccacagccccctgctgcacccccggggcttcctgcggcccagcgccagcctgcctgaggaggccgaggccagcgagaggagcacagaggccccagcccccccagccagccctgagggcgccggccccccagctgcccagggctgtgtgcccaggcacagcgtcatccgcagcctcttctaccaccaggccggggagagccctgagcacggggccctggcccctggcagccgccgccacccagcccggcggcggcacctgctgaagggcggctacatcgccggggccctgcccggcctgcgggagcccctgatggagcaccgggtgctggaggaggaggccgcccgggaggagcaggccaccctgctggccaaggcccccagctttgaaacagccctgcggctgcctgccagcggcacccacctggcccctggccacagccacagcctggagcatgacagccccagcaccccccggcccagcagcgaggcctgtggggaggcccagaggctgcccagcgcccccagcggcggggcccccatccgggacatgggccacccccagggcagcaagcagctgcccagcactggaggccaccctggaacagcccagcctgagcggcccagcccagacagcccctggggccagcctgcccccttctgccaccccaagcagggcagcgccccccaggagggctgcagcccccaccctgctgtggccccctgccccccaggcagcttccccccaggcagctgcaaggaggcccccctggtgcccagcagccccttcctgggccagccccaggcccccccagccccagccaaggccagcccccccctggacagcaagatgggccctggggacatcagcctgcccggccggcccaagccaggcccctgcagcagccctggcagcgccagccaggccagcagcagccaggtgagcagcctgcgggtgggcagcagccaggtgggcacagagcccggccccagcctggatgctgagggctggacccaggaggccgaggacctgagtgacagcacccccaccctgcagaggccccaggagcaggccaccatgaggaagttcagcctgggcggccggggcggctacgccggcgtggccggctacggcacctttgcctttggaggagatgctgggggcatgctgggccagggccccatgtgggccagaattgcctgggccgtgtcccagagcgaggaggaggagcaggaggaggcccgggcagagagccagagcgaggagcagcaggaggcccgggcagagagccccctgccccaggtgtctgcccggcctgtgcctgaggtgggccgggcccccaccaggagcagccctgagcccaccccctgggaggacatcggccaggtgtccctggtgcagatccgggacctgtctggagatgctgaggccgctgacaccatcagcctggacatcagcgaggtggaccctgcctacctgaacctgagtgacctgtatgacatcaagtacctgccctttgagttcatgatcttcaggaaggtgcccaagagcgcccagcctgagccccccagccccatggccgaggaggagctggccgagttccctgagcccacctggccctggccaggagagctgggcccccatgctggcctggagatcacagaggagagtgaagatgtggatgccctgctggccgaggccgctgtgggcaggaagaggaagtggagcagccccagccgcagcctcttccacttccctggccgccacctgcccctggatgagcctgctgagctgggcctgcgggagcgggtgaaggcctctgtggagcacatcagccgcatcctgaagggccggcctgagggcctggagaaggagggcccccccaggaagaagccaggcctggccagcttccggctgagcggcctgaagtcctgggaccgggcccccaccttcctgcgggagctgagtgatgaaacagtggtgctgggccagagcgtgaccctggcctgccaggtgtctgcccagcctgctgcccaggccacctggagcaaggatggagcccccctggagagcagcagccgggtgctgatcagcgccaccctgaagaacttccagctgctgaccatcctggtggtggtggccgaggacctgggcgtgtacacctgcagcgtgtccaatgccctgggcaccgtgaccaccaccggggtgctgaggaaggccgagcggcccagcagcagcccctgcccagacattggagaggtgtatgcagatggagtgctgctggtgtggaagcctgtggagagctatggccctgtgacctacatcgtgcagtgcagcctggagggcggctcctggaccaccctggccagtgacatctttgactgctgctacctgaccagcaagctgagcagaggaggcacctacaccttcagaacagcctgtgtgtccaaggccggcatgggcccctacagcagccccagcgagcaggtgctgctgggcggccccagccacctggccagcgaggaggagagccagggccgcagcgcccagcccctgcccagcaccaagacctttgccttccagacccagatccagaggggccgcttctctgtggtgcggcagtgctgggagaaggccagcggccgggccctggccgccaagatcatcccctaccaccccaaggacaagacagctgtgctgcgggagtatgaggccctgaagggcctgcggcacccccacctggcccagctgcatgctgcctacctgagccccaggcacctggtgctgatcctggagctgtgcagcggccctgagctgctgccctgcctggccgagcgggccagctacagcgagagcgaggtgaaggactacctgtggcagatgctgagcgccacccagtacctgcacaaccagcacatcctgcacctggacctgcggtctgagaacatgatcatcacagagtacaacctgctgaaggtggtggacctgggcaatgcccagagcctgagccaggagaaggtgctgcccagcgacaagttcaaggactacctggagaccatggcccctgagctgctggagggccagggcgctgtgccccagacagacatctgggccatcggcgtgacagccttcatcatgctgtctgctgagtaccctgtgtcctctgagggcgcccgggacctgcagaggggcctgaggaagggcctggtgcggctgagccgctgctacgccggcctgagcggcggcgctgtggccttcctgcggagcaccctgtgtgcccagccctggggccggccctgtgccagcagctgcctgcagtgcccctggctgacagaggagggccctgcctgcagcaggcctgcccctgtgaccttccccacagcccggctgcgggtgtttgtgaggaaccgggagaagaggcgggccctgctgtacaagaggcacaacctggcccaggtgaggtag

SEQ ID NO: 19624 - DNA, 11220 bp, Artificial Sequence
  Description of Artificial Sequence: Synthetic coding sequence
atgctggtgatccggggggccagcctgaaggatgctggggagtacacctgtgaggtggaggccagcaagagcacagccagcctgcacgtggaggagaaggccaactgcttcacagaggagctgaccaacctgcaggtggaggagaagggcacagctgtgttcacctgcaagacagagcaccctgctgccaccgtgacctggaggaagggcctgctggagctgcgggccagcggcaagcaccagcccagccaggagggcctgaccctgcggctgaccatcagcgccctggagaaggctgacagcgacacctacacctgtgacatcggccaggcccagagccgggcccagctgctggtgcagggccggcgggtgcacatcatcgaggacctggaggatgtggatgtgcaggagggcagcagcgccaccttccgctgccgcatcagccctgccaactatgagcctgtgcactggttcctggacaagacccccctgcacgccaatgagctgaatgaaattgatgcccagcccggcggctaccacgtgctgaccctgcggcagctggccctgaaggacagcggcaccatctactttgaagctggggaccagagggccagcgctgccctgcgggtgacagagaagcccagcgtcttcagccgggagctgacagatgccaccatcacagaaggagaggacctgaccctggtgtgtgagaccagcacctgtgacatccctgtgtgctggaccaaggatggcaagaccctgcggggcagcgcccgctgccagctgagccatgagggccaccgggcccagctgctgatcaccggggccaccctgcaggacagcggccgctacaagtgtgaggccggcggggcctgcagcagcagcatcgtgcgggtgcacgcccggcctgtgcgcttccaggaggccctgaaggacctggaggtgctggagggcggggccgccaccctgcgctgtgtgctgagctctgtggccgcccctgtgaagtggtgctacggcaacaacgtgctgcggcctggggacaagtacagcctgcggcaggagggcgccatgctggagctggtggtgaggaacctgcggccccaggacagcggccgctacagctgcagctttggagaccagaccaccagcgccaccctgactgtgacagccctgcctgcccagttcatcggcaagctgaggaacaaggaggccacagaaggagccacagccaccctgcgctgtgagctgagcaaggccgcccctgtggagtggaggaagggcagcgagaccctgagagatggagaccgctactgcctgcggcaggatggagccatgtgtgagctgcagatccggggcctggccatggtggatgctgctgagtacagctgtgtgtgtggggaggagaggaccagcgccagcctgaccatccggcccatgcctgcccacttcatcggccgcctgcggcaccaggagagcattgaaggagccacagccaccctgcgctgtgagctgagcaaggccgcccctgtggagtggaggaagggccgggagagcctgagagatggagacagacacagcctgcggcaggatggagctgtgtgtgagctgcagatctgtggcctggccgtggctgatgctggggagtacagctgtgtgtgtggggaggagaggaccagcgccaccctgactgtgaaggccctgcctgccaagttcacagagggcctgagaaatgaggaggccgtggagggcgccacagccatgctgtggtgtgagctgagcaaggtggcccctgtggagtggaggaagggccctgagaacctgagagatggagaccgctacatcctgcggcaggagggcacccgctgtgagctgcagatctgtggcctggccatggctgatgctggggagtacctgtgtgtgtgtggccaggagaggaccagcgccaccctgaccatccgggccctgcctgcccgcttcattgaagatgtgaagaaccaggaggcccgggagggcgccacagctgtgctgcagtgtgagctgaacagcgctgcccctgtggagtggaggaagggcagcgagaccctgagagatggagaccgctacagcctgcggcaggacggcaccaagtgtgagctgcagatccggggcctggccatggctgacaccggggagtacagctgtgtgtgtggccaggagaggaccagcgccatgctgactgtgcgggccctgcccatcaagttcacagagggcctgagaaatgaggaggccacagaaggagccacagctgtgctgcgctgtgagctgagcaagatggcccctgtggagtggtggaagggccacgagaccctgagagatggagacagacacagcctgcggcaggatggagcccgctgtgagctgcagatccggggcctggtggccgaggatgctggggagtacctgtgcatgtgtgggaaggagaggaccagcgccatgctgactgtgcgggccatgcccagcaagttcatcgagggcctgagaaatgaggaggccacagaaggagacacagccaccctgtggtgtgagctgagcaaggccgcccctgtggagtggaggaagggccacgagaccctgagagatggagacagacacagcctgcggcaggacggcagccgctgtgagctgcagatccggggcctggccgtggtggatgctggggagtacagctgtgtgtgtggccaggagaggaccagcgccaccctgactgtgcgggccctgcctgcccgcttcattgaagatgtgaagaaccaggaggcccgggagggcgccacagctgtgctgcagtgtgagctgagcaaggccgcccctgtggagtggaggaagggcagcgagaccctgcggggcggggaccgctacagcctgcggcaggacggcacccgctgtgagctgcagatccacggcctgtctgtggccgacaccggggagtacagctgtgtgtgtggccaggagaggaccagcgccaccctgactgtgcgggccccccagcctgtgttccgggagcccctgcagagcctgcaggccgaggagggcagcacagccaccctgcagtgtgagctgtctgagcccacagccaccgtggtgtggagcaaaggaggcctgcagctgcaggccaatggaagaagagagccccggctgcagggctgcacagctgagctggtgctgcaggacctgcagagagaagatactggagagtacacctgcacctgtggcagccaggccaccagcgccaccctgactgtgacagctgcccctgtgcgcttcctgcgggagctgcagcaccaggaggtggatgagggcggcacagcccacctgtgctgtgagctgagccgggccggggcctctgtggagtggaggaagggcagcctgcagctgttcccctgtgccaagtaccagatggtgcaggatggagctgctgctgagctgctggtgcggggcgtggagcaggaggatgctggggactacacctgtgacaccggccacacccagagcatggccagcctgtctgtgcgggtgccccggcccaagttcaagacccggctgcagagcctggagcaggagaccggggacatcgcccggctgtgctgccagctgagtgatgctgagagcggggctgtggtgcagtggctgaaggagggcgtggagctgcacgccggccccaagtatgagatgaggagccagggcgccacccgggagctgctgatccaccagctggaggccaaggacacaggagaatatgcctgtgtgactggaggccagaagacagctgccagcctgcgggtgacagagcctgaggtgaccatcgtgcggggcctggtggatgctgaggtgacagcagatgaagatgtggagttcagctgtgaggtgtcccgggccggggccactggagtgcagtggtgcctgcagggcctgcccctgcagagcaatgaggtgacagaggtggccgtgagagatggccgcatccacaccctgcggctgaagggcgtgaccccagaagatgctggcaccgtgtccttccacctgggcaaccacgccagcagcgcccagctgactgtgcgggcccctgaggtgaccatcctggagcccctgcaggatgtgcagctgtctgagggccaggatgccagcttccagtgccgcctgagccgggccagcggccaggaggcccgctgggccctgggcggcgtgcccctgcaggccaatgagatgaatgacatcaccgtggagcagggcaccctgcacctgctgaccctgcacaaggtgaccctggaggatgctggcaccgtgtccttccacgtgggcacctgcagcagcgaggcccagctgaaggtgacagccaagaacacagtggtgcggggcctggagaatgtggaggccctggagggcggggaggccctgtttgagtgccagctgagccagcctgaggtggccgcccacacctggctgctggatgatgagcctgtgcacaccagtgaaaatgctgaggtggtgttctttgaaaatggcctgcggcacctgctgctgctgaagaacctgcggccccaggacagctgccgggtgaccttcctggccggggacatggtgaccagcgccttcctgactgtgcggggctggaggctggagatcctggagcccctgaagaatgctgctgtgcgggccggggcccaggcctgcttcacctgcaccctgtctgaggccgtgcctgtgggggaggcctcctggtacatcaacggggctgctgtgcagccagatgacagcgactggacagtgacagcagatggcagccaccacgccctgctgctgcggagcgcccagccccaccacgccggggaggtgacctttgcctgcagagatgctgtggccagcgcccggctgactgtgctgggcctgcctgaccccccagaagatgctgaggtggtggcccggagcagccacacagtgaccctgtcctgggccgcccccatgtctgatggcggcggcggcctgtgtggctacagagtggaggtgaaggagggcgccaccggccagtggaggctgtgccacgagctggtgcccggcccagaatgtgtggtggatggcctggcccctggagagacctaccgcttccgggtggccgctgtgggccctgtgggcgctggggagcctgtgcacctgccccagacagtgcggctggccgagccccccaagcctgtgcccccccagcccagcgcccctgagagccggcaggtggccgccggggaggatgtgtccctggagctggaggtggtggccgaggccggggaggtgatctggcacaagggcatggagcgcatccagcccggcggccgctttgaggtggtgtcccagggccggcagcagatgctggtgatcaagggcttcaccgctgaggaccagggcgagtaccactgcggcctggcccagggcagcatctgcccagctgctgccaccttccaggtggccctgagccctgcctctgtggatgaggccccccagcccagcctgcccccagaggccgcccaggagggggacctgcacctgctgtgggaggccctggccaggaagaggaggatgagccgggagcccaccctggacagcatcagcgagctgcctgaagaagatggccgcagccagaggctgccccaggaggccgaggaggtggccccagacctgtctgagggctacagcacagcagatgagctggccaggactggagatgctgacctgagccacaccagcagtgatgatgagagccgggccggcacccccagcctggtgacctacctgaagaaggccggccggcccggcaccagccccctggccagcaaggtgggcgccccagctgcccccagcgtgaagccccagcagcagcaggagcccctggccgctgtgcggccccccctgggggacctgagcaccaaggacctgggggaccccagcatggacaaggctgctgtgaagatccaggccgccttcaagggctacaaggtgaggaaggagatgaagcagcaggagggccccatgttcagccacacctttggagacacagaggcccaggtgggagatgccctgcggctggagtgtgtggtggccagcaaggcagatgtgcgggcccgctggctgaaggatggagtggagctgacagatggccgccaccaccacatcgaccagctgggagatggcacctgcagcctgctgatcaccggcctggacagagcagatgctggctgctacacctgccaggtgagcaacaagtttggccaggtgacccacagcgcctgtgtggtggtgtctggcagcgagagcgaggccgagagcagcagcggcggggagctggatgatgccttcagaagagctgcccggcggctgcacaggctcttccgcaccaagagccctgctgaggtgtctgatgaggagctgttcctgtctgcagatgagggccctgctgagcctgaggagcctgctgactggcagacctaccgggaggatgagcacttcatctgcatccgctttgaggccctgacagaggcccggcaggccgtgacccgcttccaggagatgtttgccaccctgggcattggagtggagatcaagctggtggagcagggccccaggagagtggagatgtgcatcagcaaggagaccccagcccctgtggtgcccccagagcccctgcccagcctgctgaccagtgatgctgcccctgtgttcctgacagagctgcagaaccaggaggtgcaggacggctaccctgtgtcctttgactgtgtggtgacaggccagcccatgcccagcgtgcgctggttcaaggatggcaagctgctggaggaggatgaccactacatgatcaatgaagaccagcagggcggccaccagctgatcatcacagctgtggtgcctgctgacatgggcgtgtaccgctgcctggctgaaaattccatgggcgtgagcagcaccaaggccgagctgcgggtggacctgaccagcacagattatgacacagctgctgatgccacagagagcagcagctacttcagcgcccagggctacctgagcagccgggagcaggagggcacagagagcaccacagatgagggccagctgccccaggtggtggaggagctgcgggacctgcaggtggcccctggcacccggctggccaagttccagctgaaggtgaagggctacccagccccccggctgtactggttcaaggatggccagcccctgacagccagcgcccacatccgcatgacagacaagaagatcctgcacaccctggagatcatctctgtgaccagagaagattctggccagtatgctgcctacatcagcaatgccatgggcgccgcctacagcagcgcccggctgctggtgcggggcccagatgagcctgaggagaagccagccagtgatgtgcatgagcagctggtgccccccaggatgctggagcgcttcacccccaagaaggtgaagaagggcagcagcatcaccttctctgtgaaggtggagggccggcctgtgcccaccgtgcactggctgcgggaggaggccgagcggggcgtgctgtggattggaccagacaccccaggctacacagtggccagcagcgcccagcagcacagcctggtgctgctggatgtgggccggcagcaccagggcacctacacctgcatcgccagcaatgctgctggccaggccctgtgcagcgccagcctgcacgtgtctggcctgcccaaggtggaggagcaggagaaggtgaaggaggccctgatcagcaccttcctgcagggcaccacccaggccatcagcgcccagggcctggagacagccagctttgctgacctgggcggccagaggaaggaggagcccctggccgccaaggaggccctgggccacctgagcctggccgaggtgggcacagaggagttcctgcagaagctgaccagccagatcacagagatggtgtctgccaagatcacccaggccaagctgcaggtgcctggaggagacagtgatgaggacagcaagacccccagcgccagccccaggcatggccgcagccggcccagcagcagcatccaggagagcagcagcgagagtgaagatggagatgcccggggggagatctttgacatctacgtggtgacagctgactacctgcccctgggcgctgagcaggatgccatcaccctgcgggagggccagtatgtggaggtgctggatgctgcccaccccctgcgctggctggtgaggaccaagcccaccaagagcagccccagccggcagggctgggtgtccccagcctacctggaccggcggctgaagctgagccctgagtggggcgctgctgaggcccctgagttccctggagaggccgtgtctgaagatgagtacaaggcccggctgagcagcgtcatccaggagctgctgagcagcgagcaggcctttgtggaggagctgcagttcctgcagagccaccacctgcagcacctggagcgctgcccccacgtgcccatcgctgtggccggccagaaggctgtgatcttcagaaatgtgcgggacatcggccgcttccacagcagcttcctgcaggagctgcagcagtgtgacacagatgatgatgtggccatgtgcttcatcaagaaccaggccgcctttgagcagtacctggagttcctggtgggccgggtgcaggccgagagcgtggtggtgtccacagccatccaggagttctacaagaagtatgcagaggaggccctgctggccggggaccccagccagcccccacctccacccctgcagcactacctggagcagcctgtggagcgggtgcagcgctaccaggccctgctgaaggagctgatccggaacaaggccaggaaccggcagaactgtgccctgctggagcaggcctatgctgtggtgtctgccctgccccagagagctgagaacaagctgcacgtgtccctgatggagaactacccaggcaccctgcaggccctgggggagcccatccggcagggccacttcatcgtgtgggagggcgcccctggggccaggatgccctggaagggccacaacagacatgtgttcctgttcaggaaccacctggtgatctgcaagccccggcgggacagcaggacagacacagtgtcctatgtgttcaggaacatgatgaagctgagcagcattgacctgaatgaccaggtggagggagatgaccgggcctttgaggtgtggcaggagagagaagattctgtgaggaagtacctgctgcaggccaggacagccatcatcaagagctcctgggtgaaggagatctgtggcatccagcagaggctggccctgcctgtgtggaggcccccagactttgaggaggagctggccgactgcacagctgagctgggggagaccgtgaagctggcctgccgggtgacaggcacccccaagcctgtgatctcctggtacaaggatggcaaggctgtgcaggtggacccccaccacatcctgattgaagatcctgatggcagctgtgccctgatcctggacagcctgactggagtggacagcggccagtacatgtgctttgctgccagcgctgctggcaactgcagcaccctgggcaagatcctggtgcaggtgccccccaggtttgtgaacaaggtgcgggccagcccctttgtggagggggaggatgcccagttcacctgcaccatcgagggcgccccctacccccagatccgctggtacaaggatggagccctgctgaccactggaaacaagttccagaccctgtctgagcccaggagcggcctgctggtgctggtgatccgggccgccagcaaggaggacctgggcctgtatgaatgtgagctggtgaaccggctgggcagcgcccgggccagcgctgagctgcgcatccagagccccatgctgcaggcccaggagcagtgccaccgggagcagctggtggccgctgtggaggtgacagagcaggagaccaaggtgcccaagaagacagtcatcatcgaggagaccatcaccaccgtggtgaagagcccccggggccagaggaggagccccagcaagagccccagccgcagccccagccgctgcagcgccagccccctgcggcccggcctgctggccccagacctgctgtacctgcctggagctggccagcccaggaggcctgaggccgagcccggccagaagcctgtggtgcccaccctgtatgtgacagaagctgaggcccacagccctgccctgcccggcctgagcggcccccagcccaagtgggtggaggtggaggagaccatcgaggtgcgggtgaagaagatgggcccccagggcgtgagccccaccacagaggtgcccaggagcagcagcggccacctgttcaccctgcccggggccaccccaggaggagaccccaacagcaacaacagcaacaacaagctgctggcccaggaggcctgggcccagggcacagccatggtgggcgtgcgggagcccctggtgttccgggtggatgcccggggctctgtggactgggccgccagcggcatgggcagcctggaggaggagggcaccatggaggaggccggggaggaggagggggaggatggagatgcctttgtgacagaggagagccaggacacccacagcctgggggaccgggaccccaagatcctgacccacaatggaaggatgctgaccctggccgacctggaggactatgtgcctggagagggggagaccttccactgcggcggccctggccctggggccccagatgaccccccctgtgaggtgtctgtcatccagcgggagattggagagcccaccgtgggccagcctgtgctgctgtctgtgggccacgccctgggcccccggggccccctgggcctcttccggcctgagcccaggggggccagccccccaggcccccaggtgcgcagcctggagggcaccagcttcctgctgcgggaggccccagcccggcctgtgggcagcgccccctggacccagagcttctgcacccgcatcagaagatctgctgacagcggccagagcagcttcaccacagagctgagcacccagacagtgaactttggcaccgtgggggagaccgtgaccctgcacatctgcccagacagagatggagatgaggccgcccagccctag

SEQ ID NO: 19625 - DNA, 1071 bp, Artificial Sequence
  Description of Artificial Sequence: Synthetic coding sequence
atggccacagctgccctgctgcggggggccaccccaggccggggcggccctgtgtggcgctggaggctgcgggccgccccccgctgccgcctggcccacagcagctgcagccctggaggagaccccacagctggggccgcctgggcctgcttccggctggatggccgcaccctgctgcgggtgcggggcccagatgctgcccccttcctgctgggcctgctgaccaatgagctgcccctgcccagccctgctgctgctggggcccctcctgctgcccgggccggctacgcccacttcctgaatgtgcagggccgcaccctgtatgatgtgatcctgtatggcctgcaggagcacagcgaggtgtctggcttcctgctggagtgtgacagctctgtgcagggcgccctgcagaagcacctggccctgtaccgcatccggaggaaggtgacagtggagccccaccctgagctgcgggtgtgggccgtgctgcccagcagccctgaggcctgtggggccgccagcctgcaggagagagctggagctgctgccatcctgatccgggaccccaggacagccaggatgggctggaggctgctgacccaggatgagggccctgccctggtgcctgggggccgcctgggggacctgtgggactaccaccagcaccgctacctgcagggcgtgcctgagggcgtgcgggacctgcccccaggagtggccctgcccctggagagcaacctggccttcatgaatggagtgtccttcaccaagggctgctacatcggccaggagctgacagcccggacccaccacatgggcgtcatcaggaagaggctcttccctgtgcgcttcctggaccccctgcccaccagcggcatcacccctggggccaccgtgctgacagccagcggccagacagtgggcaagttccgggccggccagggcaatgtgggcctggccctgctgtggagcgagaagatcaagggccccctgcacatccgggccagcgagggcgcccaggtggccctggccgcctctgtgcctgactggtggcccaccgtgtccaagtag

SEQ ID NO: 19626 - DNA, 1395 bp, Artificial Sequence
  Description of Artificial Sequence: Synthetic coding sequence
atgagagctgcccggcggggcctgcactgtgccggggctgagcggccccggcggcggggccgcctgtgggacagcagcggcgtgccccagaggcagaagaggcctggcccctggaggacccagacccaggagcagatgagcagagatgtgtgcatccacacctggccctgcacctactacctggagcccaagaggcgctgggtgacaggccagctgagcctgaccagcctgagcctgcgcttcatgacagacagcactggagagatcctggtgtccttccccctgagcagcatcgtggagatcaagaaggaggccagccacttcatcttcagcagcatcaccatcctggagaagggccacgccaagcactggttcagcagcctgcggcccagcagaaatgtggtgttcagcatcatcgagcacttctggagggagctgctgctgagccagcctggagctgtggctgatgcctctgtgcccaggaccagaggagaggagctgaccggcctgatggccggcagccagaagaggctggaggacacagcccgggtgctgcaccaccagggccagcagctggacagcgtgatgaggggcctggacaagatggagagtgacctggaggtggccgaccggctgctgacagagctggagagccctgcctggtggcccttcagcagcaagctgtggaagaccccacctgagaccaagcccagagaagatgtgtccatgaccagctgtgagccctttgggaaggagggcatcctgatcaagatcccagctgtgatcagccacaggacagagagccacgtgaagccaggccgcctgactgtgctggtgtctggcctggagatccatgacagcagcagcctgctgatgcacagatttgagcgggaggatgtggatgacatcaaggtgcacagcccctatgagatcagcatccggcagcgcttcatcggcaagccagacatggcctaccgcctcatcagcgccaagatgcctgaggtgatccccatcctggaggtgcagttcagcaagaagatggagctgctggaggatgccctggtgctgcggagcgcccggaccagcagccctgctgagaagagctgcagcgtgtggcacgccgccagcggcctgatgggccgcaccctgcaccgggagcccccagctggggaccaggagggcacagccctgcacctgcagaccagcctgcctgccctgtctgaggccgacacccaggagctgacccagatcctgcggaggatgaagggcctggccctggaggccgagagcgagctggagcggcaggatgaggccctggatggagtggccgctgctgtggaccgggccaccctgaccatcgacaagcacaacagaaggatgaagaggctgacctag

SEQ ID NO: 19627 - DNA, 669 bp, Artificial Sequence
  Description of Artificial Sequence: Synthetic coding sequence
atgaccagctgtgagccctttgggaaggagggcatcctgatcaagatcccagctgtgatcagccacaggacagagagccacgtgaagccaggccgcctgactgtgctggtgtctggcctggagatccatgacagcagcagcctgctgatgcacagatttgagcgggaggatgtggatgacatcaaggtgcacagcccctatgagatcagcatccggcagcgcttcatcggcaagccagacatggcctaccgcctcatcagcgccaagatgcctgaggtgatccccatcctggaggtgcagttcagcaagaagatggagctgctggaggatgccctggtgctgcggagcgcccggaccagcagccctgctgagaagagctgcagcgtgtggcacgccgccagcggcctgatgggccgcaccctgcaccgggagcccccagctggggaccaggagggcacagccctgcacctgcagaccagcctgcctgccctgtctgaggccgacacccaggagctgacccagatcctgcggaggatgaagggcctggccctggaggccgagagcgagctggagcggcaggatgaggccctggatggagtggccgctgctgtggaccgggccaccctgaccatcgacaagcacaacagaaggatgaagaggctgacctag

SEQ ID NO: 19628 - DNA, 201 bp, Artificial Sequence
  Description of Artificial Sequence: Synthetic coding sequence
atgccccagtaccagacctgggaggagttcagcagagctgctgagaagctgtacctggccgaccccatgaaggcccgggtggtgctgaagtaccgccacagtgatggcaacctgtgtgtgaaggtgacagatgacctggtgcagtggcacctgaactactgcaccctgcggcacggcattgctgggggcctggagacctag

SEQ ID NO: 19629 - DNA, 249 bp, Artificial Sequence
  Description of Artificial Sequence: Synthetic coding sequence
atgccccagtaccagacctgggaggagttcagcagagctgctgagaagctgtacctggccgaccccatgaaggcccgggtggtgctgaagtaccgccacagtgatggcaacctgtgtgtgaaggtgacagatgacctggtgcggcagtgcctggccctgctgctgcggctgcagtgcagcggcatgatcatcgcccactgcatcctggacctgctgggcagcagcggccccctggccagcgccagctag

SEQ ID NO: 19630 - DNA, 651 bp, Artificial Sequence
  Description of Artificial Sequence: Synthetic coding sequence
atgcaggccaacggggccggcggcggcggcggcggcggcggcggcggcggcggcggcggcggcggcggcggcggccagggccagaccccagagctggcctgcctgagcgcccagaatggagagagcagccccagcagcagcagcagcgctggggacctggcccacgccaacggcctgctgcccagcgcccccagcgctgccagcaacaacagcaacagcctgaatgtgaacaacggggtgcctggaggagctgctgctgccagcagcgccaccgtggccgccgccagcgccaccacagctgccagcagcagcctggccaccccagagctgggcagcagcctgaagaagaagaagaggctgagccagagtgatgaagatgtgatccggctgattggccagcacctgaatggcctgggcctgaaccagacagtggacctgctgatgcaggagagcggctgccgcctggagcaccccagcgccaccaagttcaggaaccacgtgatggagggggactgggacaaggccgagaatgacctgaatgagctgaagcccctggtgcacagcccccacgccatcgtggcccagaccttcagcgagaccagcatcaacttcttccccctgacagctgccttctgccacgtgcggggctag

SEQ ID NO: 19631 - DNA, 2340 bp, Artificial Sequence; identical to SEQ ID NO: 19401
  Description of Artificial Sequence: Synthetic coding sequence

SEQ ID NO: 19632 - DNA, 666 bp, Artificial Sequence
  Description of Artificial Sequence: Synthetic coding sequence
atggctgctgccagcggctctgtgctgcagcgctgcatcgtgtccccagctggccgccacagcgccagcctcatcttcctgcacggcagcggggacagcggccagggcctgaggatgtggatcaagcaggtgctgaaccaggacctgaccttccagcacatcaagatcatctaccccacagccccaccccgcttcaagatcaccaatgactgcccagagcacctggagagcattgatgtgatgtgccaggtgctgacagacctgattgatgaggaggtgaagagcggcatcaagaagaaccgcatcctgattggaggcttctccatgggcggctgcatggccatccacctggcctacagaaaccaccaggatgtggccggcgtgtttgccctgagcagcttcctgaacaaggccagcgctgtgtaccaggccctgcagaagagcaatggagtgctgcctgagctgttccagtgccacggcacagcagatgagctggtgctgcacagctgggccgaggagaccaacagcatgctgaagagcctgggcgtgaccaccaagttccacagcttccccaacgtgtaccacgagctgagcaagacagagctggacatcctgaagctgtggatcctgaccaagctgcccggggagatggagaagcagaagtag

SEQ ID NO: 19633 - DNA, 714 bp, Artificial Sequence
  Description of Artificial Sequence: Synthetic coding sequence
atggctgctgccagcggctctgtgctgcagcgctgcatcgtgtccccagctggccgccacagcgccagcctcatcttcctgcacggcagcggggacagcggccagggcctgaggatgtggatcaagcaggtgctgaaccaggacctgaccttccagcacatcaagatcatctaccccacagccccacccaggagctacacccccatgaagggcggcatcagcaatgtgtggtttgaccgcttcaagatcaccaatgactgcccagagcacctggagagcattgatgtgatgtgccaggtgctgacagacctgattgatgaggaggtgaagagcggcatcaagaagaaccgcatcctgattggaggcttctccatgggcggctgcatggccatccacctggcctacagaaaccaccaggatgtggccggcgtgtttgccctgagcagcttcctgaacaaggccagcgctgtgtaccaggccctgcagaagagcaatggagtgctgcctgagctgttccagtgccacggcacagcagatgagctggtgctgcacagctgggccgaggagaccaacagcatgctgaagagcctgggcgtgaccaccaagttccacagcttccccaacgtgtaccacgagctgagcaagacagagctggacatcctgaagctgtggatcctgaccaagctgcccggggagatggagaagcagaagtag

SEQ ID NO: 19634 - DNA, 471 bp, Artificial Sequence
  Description of Artificial Sequence: Synthetic coding sequence
atggagacagccaaggagatgacccgggagagcctgcccatcaagtgcctggaggccgtcatcctgggcatctacctgaccaacggccagcccagcattgagcgcttccccatctccttcaagacctacttcagcggcaactacttccaccacgtggtgctgggcatctactgcaatggccgctatggcagcctgggcatgagcagaagagctgagctgatggacaagcccctgaccttccgcaccctgagtgacctgatctttgattttgaagattcctacaagaagtacctgcacacagtgaagaaggtgaagattggcctgtatgtgccccatgagccccacagcttccagcccatcgagtggaagcagctggtgctgaatgtgtccaagatgctgcgggctgacatcaggaaggagctggagaagtatgcccgggacatgaggatgaagggcctgtgcagccactag

SEQ ID NO: 19635 - DNA, 936 bp, Artificial Sequence
  Description of Artificial Sequence: Synthetic coding sequence
atgacaggcagcgctgctgacacccaccgctgcccccaccccaagggggccaagggcaccaggagccgcagcagccacgcccggcctgtgtccctggccaccagcggcggcagcgaggaggaggacaaggatggcggcgtgctcttccacgtgaacaagagcggcttccccatcgacagccacacctgggagaggatgtggatgcacgtggccaaggtgcaccccaagggcggggagatggtgggcgccatcagaaatgctgccttcctggccaagcccagcatcccccaggtgcccaactaccgcctgtccatgaccatcccagactggctgcaggccatccagaactacatgaagaccctgcactacctgaccaacggccagcccagcattgagcgcttccccatctccttcaagacctacttcagcggcaactacttccaccacgtggtgctgggcatctactgcaatggccgctatggcagcctgggcatgagcagaagagctgagctgatggacaagcccctgaccttccgcaccctgagtgacctgatctttgattttgaagattcctacaagaagtacctgcacacagtgaagaaggtgaagattggcctgtatgtgccccatgagccccacagcttccagcccatcgagtggaagcagctggtgctgaatgtgtccaagatgctgcgggctgacatcaggaaggagctggagaagtatgcccgggacatgaggatgaagatcctgaagccagccagcgcccacagccccacccaggtgcgcagccggggcaagagcctgagcccccggcggcggcaggccagccccccccggcggctgggccggcgggagaagagccctgccctgcctgagaagaaggtggccgacctgagcaccctgaatgaggtgggctaccagatccgcatctag

SEQ ID NO: 19636 - DNA, 873 bp, Artificial Sequence
  Description of Artificial Sequence: Synthetic coding sequence
atgtggatgcacgtggccaaggtgcaccccaagggcggggagatggtgggcgccatcagaaatgctgccttcctggccaagcccagcatcccccaggtgcccaactaccgcctgtccatgaccatcccagactggctgcaggccatccagaactacatgaagaccctgcagtacaaccacacaggcacccagttctttgagatcaggaagatgaggcccctgagcggcctgatggagacagccaaggagatgacccgggagagcctgcccatcaagtgcctggaggccgtcatcctgggcatctacctgaccaacggccagcccagcattgagcgcttccccatctccttcaagacctacttcagcggcaactacttccaccacgtggtgctgggcatctactgcaatggccgctatggcagcctgggcatgagccggcgggcagagctgatggacaagcccctgaccttccgcaccctgagtgacctgatctttgattttgaggacagctacaagaagtacctgcacacagtgaagaaggtgaagattggcctgtatgtgccccatgagccccacagcttccagcccatcgagtggaagcagctggtgctgaatgtgtccaagatgctgcgggctgacatcaggaaggagctggagaagtatgcccgggacatgaggatgaagatcctgaagccagccagcgcccacagccccacccaggtgcgcagccggggcaagagcctgagcccccggcggcggcaggccagccccccccggcggctgggcagaagagagaagagccctgccctgcctgagaagaaggtggccgacctgagcaccctgaatgaggtgggctaccagatccgcatctag

SEQ ID NO: 19637 - DNA, 756 bp, Artificial Sequence
  Description of Artificial Sequence: Synthetic coding sequence
atgaccatcccagactggctgcaggccatccagaactacatgaagaccctgcagtacaaccacacaggcacccagttctttgagatcaggaagatgaggcccctgagcggcctgatggagacagccaaggagatgacccgggagagcctgcccatcaagtgcctggaggccgtcatcctgggcatctacctgaccaacggccagcccagcattgagcgcttccccatctccttcaagacctacttcagcggcaactacttccaccacgtggtgctgggcatctactgcaatggccgctatggcagcctgggcatgagcagaagagctgagctgatggacaagcccctgaccttccgcaccctgagtgacctgatctttgattttgaagattcctacaagaagtacctgcacacagtgaagaaggtgaagattggcctgtatgtgccccatgagccccacagcttccagcccatcgagtggaagcagctggtgctgaatgtgtccaagatgctgcgggctgacatcaggaaggagctggagaagtatgcccgggacatgaggatgaagatcctgaagccagccagcgcccacagccccacccaggtgcgcagccggggcaagagcctgagcccccggcggcggcaggccagccccccccggcggctgggccggcgggagaagagccctgccctgcctgagaagaaggtggccgacctgagcaccctgaatgaggtgggctaccagatccgcatctag

SEQ ID NO: 19638 - DNA, 873 bp, Artificial Sequence; identical to SEQ ID NO: 19636
  Description of Artificial Sequence: Synthetic coding sequence

SEQ ID NO: 19639 - DNA, 723 bp, Artificial Sequence
  Description of Artificial Sequence: Synthetic coding sequence
atggccggcagccctgagctggtggtgctggaccccccctgggacaaggagctggccgccggcacagagagccaggccctggtgtctgccaccccccgggaggacttccgggtgcgctgcaccagcaagagagctgtgacagagatgctgcagctgtgtggccgctttgtgcagaagctgggagatgccctgcctgaggagatccgggagcccgccctgagagatgcccagtggacctttgagagcgctgtgcaggagaacatcagcatcaatggccaggcctggcaggaggccagtgacaactgcttcatggacagcgacatcaaggtgctggaggaccagtttgatgagatcatcgtggacatcgccaccaagaggaagcagtaccccaggaagatcctggagtgtgtgatcaagaccatcaaggccaagcaggagatcctgagcctgcctgccctgattgagcagggcgagggcttcagccaggtgctgaggatgcagcccgtcatccacctgcagaggatccaccaggaggtgttcagcagctgccacaggaagccagatgccaagccagagaacttcatcacccagatcgagaccacccccacagaaacagccagcaggaagaccagtgacatggtgctgaagaggaagcagaccaaggactgcccccagaggaagtggtaccccctgcggcccaagaagatcaacctggacacctag

SEQ ID NO: 19640 - DNA, 519 bp, Artificial Sequence
  Description of Artificial Sequence: Synthetic coding sequence
atggccggcagccctgagctggtggtgctggaccccccctgggacaaggagctggccgccggcacagagagccaggccctggtgtctgccaccccccgggaggacttccgggtgcgctgcaccagcaagagagctgtgacagagatgctgcagctgtgtggccgctttgtgcagaagctgggagatgccctgcctgaggagatccgggagcccgccctgagagatgcccagtggacctttgagagcgctgtgcaggagaacatcagcatcaatggccaggcctggcaggaggccagtgacaactgcttcatggacagcgacatcaaggtgctggaggaccagtttgatgagatcatcgtggacatcgccaccaagaggaagcagtaccccaggaagatcctggagtgtgtgatcaagaccatcaaggccaagcaggagatcctgaagcagtaccaccctgtggtgcaccccctggacctgaagtatgaccctgaccctgtgctggcctgcatcaactag

SEQ ID NO: 19641 - DNA, 846 bp, Artificial Sequence
  Description of Artificial Sequence: Synthetic coding sequence
atggccggcagccctgagctggtggtgctggaccccccctgggacaaggagctggccgccggcacagagagccaggccctggtgtctgccaccccccgggaggacttccgggtgcgctgcaccagcaagagagctgtgacagagatgctgcagctgtgtggccgctttgtgcagaagctgggagatgccctgcctgaggagatccgggagcccgccctgagagatgcccagtggacctttgagagcgctgtgcaggagaacatcagcatcaatggccaggcctggcaggaggccagtgacaactgcttcatggacagcgacatcaaggtgctggaggaccagtttgatgagatcatcgtggacatcgccaccaagaggaagcagtaccccaggaagatcctggagtgtgtgatcaagaccatcaaggccaagcaggagatcctgaagcagtaccaccctgtggtgcaccccctggacctgaagtatgaccctgaccctgccccccacatggagaacctgaagtgccgcggggagaccgtggccaaggagatcagcgaggccatgaagagcctgcctgccctgattgagcagggcgagggcttcagccaggtgctgaggatgcagcctgtgatccacctgcagaggatccaccaggaggtgttcagcagctgccacaggaagccagatgccaagccagagaacttcatcacccagatcgagaccacccccacagaaacagccagcaggaagaccagtgacatggtgctgaagaggaagcagaccaaggactgcccccagaggaagtggtaccccctgcggcccaagaagatcaacctggacacctag

SEQ ID NO: 19642 - DNA, 228 bp, Artificial Sequence
  Description of Artificial Sequence: Synthetic coding sequence
atggacagcgacatcaaggtgctggaggaccagtttgatgagatcatcgtggacatcgccaccaagaggaagcagtaccccaggaagatcctggagtgtgtgatcaagaccatcaaggccaagcaggagatcctgaagcagtaccaccctgtggtgcaccccctggacctgaagtatgaccctgaccccggggccaagccaggcggcctggccctgggcgctgtgtag

SEQ ID NO: 19643 - DNA, 279 bp, Artificial Sequence
  Description of Artificial Sequence: Synthetic coding sequence
atggaggactaccaggccgctgaggagacagcctttgtggtggatgaggtgagcaacatcgtgaaggaggccattgaaagtgccatcggcggcaatgcctaccagcacagcaaggtgaaccagtggaccaccaacgtggtggagcagaccctgagccagctgaccaagctgggcaagcccttcaagtacatcggaaatggagtgctcttcctgctgtacctgagagatggcttcctgaccctcatccggggggccagcagcaccaggaacaacagctag

SEQ ID NO: 19644 - DNA, 204 bp, Artificial Sequence
  Description of Artificial Sequence: Synthetic coding sequence
atgcagaagaatggagctggcctgcacacagccagcagctgcttctgggacagcagcacagatggcatgatcttcatccacgtgtgtgaggtgctgctgtgtgagatctatgactggaagttccccatctttgaatgtaatgcctgcctgagccccttcaagaccttcaacaaccggctggccaaggtgctgtgtgtggcctag

SEQ ID NO: 19645 - DNA, 342 bp, Artificial Sequence
  Description of Artificial Sequence: Synthetic coding sequence
atggaggactaccaggccgctgaggagacagcctttgtggtggatgaggtgagcaacatcgtgaaggaggccattgaaagtgccatcggcggcaatgcctaccagcacagcaaggtgaaccagtggaccaccaacgtggtggagcagaccctgagccagctgaccaagctgggcaagcccttcaagtacatcgtgacctgtgtgatcatgcagaagaatggagctggcctgcacacagccagcagctgcttctgggacagcagcacagatggcagctgcaccgtgcgctgggagaacaagaccatgtactgcatcgtgtctgccttcggcctgagcatctag

SEQ ID NO: 19646 - DNA, 2037 bp, Artificial Sequence
  Description of Artificial Sequence: Synthetic coding sequence
atgtatgctgctgtggagcacggccctgtgctgtgcagcgacagcaacatcctgtgcctgtcctggaagggccgggtgcccaagtctgagaaggagaagcctgtgtgcagaagacgctactatgaggagggctggctggccactggaaatggccggggcgtggtgggcgtgaccttcaccagcagccactgcagaagagacaggagcaccccccagaggatcaacttcaacctgcggggccacaacagcgaggtggtgctggtgcgctggaatgagccctaccagaagctggccacctgtgatgctgatggcggcatctttgtgtggatccagtatgagggccgctggagcgtggagctggtgaatgacagaggagcccaggtgtctgacttcacctggagccatgatggcacccaggccctgatctcctacagagatggctttgtgctggtgggctctgtgtctggccagaggcactggagcagcgagatcaacctggagagccagatcacctgtggcatctggaccccagatgaccagcaggtgctgtttggaacagcagatggccaggtgattgtgatggactgccacggccgcatgctggcccacgtgctgctgcatgaaagtgatggagtgctgggcatgtcctggaactaccccatcttcctggtggaggacagcagcgagagtgacacagacagtgatgattatgccccaccccaggacggccctgctgcctaccccatccctgtgcagaacatcaagcccctgctgactgtgtccttcaccagcggggacatcagcctgatgaacaactatgatgacctgagccccaccgtcatccgcagcggcctgaaggaggtggtggcccagtggtgcacccagggcgacctgctggccgtggccggcatggagcggcagacccagctgggggagctgcccaacggccccctgctgaagagcgccatggtgaagttctacaacgtgcggggggagcacatcttcaccctggacaccctggtgcagaggcccatcatcagcatctgctggggccaccgggacagccggctgctgatggccagcggccctgccctgtatgtggtgcgggtggagcaccgggtgagcagcctgcagctgctgtgccagcaggccatcgccagcaccctgcgggaggacaaggatgtgtccaagctgaccctgcccccccggctgtgcagctacctgagcacagccttcatccccaccatcaagccacccatcccagaccccaacaacatgagggactttgtgtcctaccccagcgctggaaatgaaaggctgcactgcaccatgaagaggacagaagatgatcctgaggtgggcggcccctgctacaccctgtacctggagtacctgggcggcctggtgcccatcctgaagggccgccgcatcagcaagctgcggcctgagtttgtgatcatggaccccaggacagacagcaagccagatgagatctacggcaacagcctcatcagcaccgtcatcgacagctgcaactgcagcgacagcagtgacatcgagctgagtgatgactgggccgccaagaagagccccaagatcagccgggccagcaagagccccaagctgccccgcatcagcattgaggccaggaagagccccaagctgccccgggccgcccaggagctgagccgcagcccccggctgcccctgaggaagcccagcgtgggcagccccagcctgacccggcgggagttcccctttgaggacatcacccagcacaactacctggcccaggtgaccagcaacatctggggcaccaagttcaagatcgtgggcctggccgccttcctgcccaccaacctgggcgctgtgatctacaagaccagcctgctgcacctgcagccccggcagatgaccatctacctgcctgaggtgaggaagatctccatggactacatcaacctgcccgtcttcaaccccaacgtgttttctgaagatgaagatgacctgcctggagatgctgtgtggacagactag

SEQ ID NO: 19647 - DNA, 4632 bp, Artificial Sequence
  Description of Artificial Sequence: Synthetic coding sequence
atgtatgctgctgtggagcacggccctgtgctgtgcagcgacagcaacatcctgtgcctgtcctggaagggccgggtgcccaagtctgagaaggagaagcctgtgtgcagaagacgctactatgaggagggctggctggccactggaaatggccggggcgtggtgggcgtgaccttcaccagcagccactgcagaagagacaggagcaccccccagaggatcaacttcaacctgcggggccacaacagcgaggtggtgctggtgcgctggaatgagccctaccagaagctggccacctgtgatgctgatggcggcatctttgtgtggatccagtatgagggccgctggagcgtggagctggtgaatgacagaggagcccaggtgtctgacttcacctggagccatgatggcacccaggccctgatctcctacagagatggctttgtgctggtgggctctgtgtctggccagaggcactggagcagcgagatcaacctggagagccagatcacctgtggcatctggaccccagatgaccagcaggtgctgtttggaacagcagatggccaggtgattgtgatggactgccacggccgcatgctggcccacgtgctgctgcatgaaagtgatggagtgctgggcatgtcctggaactaccccatcttcctggtggaggacagcagcgagagtgacacagacagtgatgattatgccccaccccaggacggccctgctgcctaccccatccctgtgcagaacatcaagcccctgctgactgtgtccttcaccagcggggacatcagcctgatgaacaactatgatgacctgagccccaccgtcatccgcagcggcctgaaggaggtggtggcccagtggtgcacccagggcgacctgctggccgtggccggcatggagcggcagacccagctgggggagctgcccaacggccccctgctgaagagcgccatggtgaagttctacaacgtgcggggggagcacatcttcaccctggacaccctggtgcagaggcccatcatcagcatctgctggggccaccgggacagccggctgctgatggccagcggccctgccctgtatgtggtgcgggtggagcaccgggtgagcagcctgcagctgctgtgccagcaggccatcgccagcaccctgcgggaggacaaggatgtgtccaagctgaccctgcccccccggctgtgcagctacctgagcacagccttcatccccaccatcaagccacccatcccagaccccaacaacatgagggactttgtgtcctaccccagcgctggaaatgaaaggctgcactgcaccatgaagaggacagaagatgatcctgaggtgggcggcccctgctacaccctgtacctggagtacctgggcggcctggtgcccatcctgaagggccgccgcatcagcaagctgcggcctgagtttgtgatcatggaccccaggacagacagcaagccagatgagatctacggcaacagcctcatcagcaccgtcatcgacagctgcaactgcagcgacagcagtgacatcgagctgagtgatgactgggccgccaagaagagccccaagatcagccgggccagcaagagccccaagctgccccgcatcagcattgaggccaggaagagccccaagctgccccgggccgcccaggagctgagccgcagcccccggctgcccctgaggaagcccagcgtgggcagccccagcctgacccggcgggagttcccctttgaggacatcacccagcacaactacctggcccaggtgaccagcaacatctggggcaccaagttcaagatcgtgggcctggccgccttcctgcccaccaacctgggcgctgtgatctacaagaccagcctgctgcacctgcagccccggcagatgaccatctacctgcctgaggtgaggaagatctccatggactacatcaacctgcccgtcttcaaccccaacgtgttttctgaagatgaagatgacctgcctgtgactggagccagcggcgtgcctgagaacagccccccctgcaccgtgaacatccccatcgcccccatccacagcagcgcccaggccatgagccccacccagagcatcggcctggtgcagagcctgctggccaaccagaatgtgcagctggatgtgctgaccaaccagaccacagctgtgggcacagctgagcacgccggggacagcgccacccagtaccctgtgagcaaccgctacagcaaccctggccaggtgatcttcggctctgtggagatgggccgcatcatccagaaccccccacccctgagcctgcccccaccaccccagggccccatgcagctgagcacagtgggccacggggaccgggaccacgagcacctgcagaagagcgccaaggccctgcggcccaccccccagctggccgcagaaggagatgctgtggtgttttctgccccccaggaggtgcaggtgaccaagatcaaccccccaccaccctacccaggcaccatcccagctgcccccaccacagctgcccctcctccacccctgcccccaccccagccccctgtggatgtgtgcctgaagaagggggacttcagcctgtaccccacctctgtgcactaccagacccccctgggctatgagcgcatcaccacctttgacagcagtggaaatgtggaggaggtgtgccggcccaggaccaggatgctgtgcagccagaacacctacaccctgcccggccctggcagcagcgccaccctgcggctgacagccacagagaagaaggtgccccagccctgcagcagcgccaccctgaaccggctgactgtgccccgctacagcatccccactggagaccccccaccctacccagagatcgccagccagctggcccagggccgcggggccgcccagaggagtgacaacagcctcatccacgccaccctgcggaggaacaaccgggaggccaccctgaagatggcccagctggccgacagcccccgggcccccctgcagcccctggccaagagcaagggcggccctggaggagtggtgacccagctgcctgcccggcccccaccagccctgtacacctgcagccagtgcagcggcaccggccccagcagccagcccggggccagcctggcccacacagccagcgccagccccctggccagccagagcagctacagcctgctgagccccccagacagcgcccgggacagaacagattatgtgaacagcgccttcacagaagatgaggccctgagccagcactgccagctggagaagcccctgcggcacccccccctgcctgaggccgctgtgaccctgaagaggcccccaccctaccagtgggaccccatgctgggggaggatgtgtgggtgccccaggagaggacagcccagaccagcggccccaaccccctgaagctgagcagcctgatgctgagccagggccagcacctggatgtgtcccggctgcccttcatcagccccaagagccctgccagccccacagccaccttccagacaggctacggcatgggcgtgccctacccaggcagctacaacaacccccccctgcccggggtgcaggccccctgcagccccaaggatgccctgagccccacccagtttgcccagcaggagcctgctgtggtgctgcagcccctgtacccacccagcctgagctactgcaccctgccccccatgtacccaggcagcagcacctgcagcagcctgcagctgccccctgtggccctgcacccctggagcagctacagcgcctgcccccccatgcagaacccccagggcaccctgccccccaagccccacctggtggtggagaagcccctggtgagccccccacctgctgacctgcagagccacctgggcacagaggtgatggtggagacagctgacaacttccaggaggtgctgagcctgacagagagccctgtgccccagaggacagagaagtttgggaagaagaacaggaagaggctggacagcagagctgaggagggctctgtgcaggccatcacagagggcaaggtgaagaaggaggcccggaccctgagtgacttcaacagcctcatcagcagcccccacctgggccgggagaagaagaaggtgaagagccagaaggaccagctgaagagcaagaagctgaacaagaccaatgagttccaggacagcagcgagagcgagcctgagctgttcatctctggagatgagctgatgaaccagagccagggcagcaggaagggctggaagagcaagaggagccccagggctgctggggagctggaggaggccaagtgccggcgggccagcgagaaggaggatggccgcctgggcagccagggctttgtgtatgtgatggccaacaagcagcccctgtggaatgaggccacccaggtgtaccagctggactttggaggccgggtgacccaggagagcgccaagaacttccagatcgagctggagggccggcaggtgatgcagtttggaagaattgatggcagcgcctacatcctggacttccagtaccccttctctgctgtgcaggcctttgctgtggccctggccaacgtgacccagaggctgaagtag

SEQ ID NO: 19648 - DNA, 3234 bp, Artificial Sequence
  Description of Artificial Sequence: Synthetic coding sequence
atggacagcaagatgaagaagatggccgagctgcagctgtctgtggtgtctgaccccaagaacaggaaggccatcgagaaccagatccagcagtgggagcagaacctggagaagttccacatggacctcttcaggatgcgctgctacctggccagcctgcagggcggggagctgcccaaccccaagagcctgctggccgccgccagccggcccagcaagctggccctgggccgcctgggcatcctgtctgtgagcagcttccacgccctggtgtgcagcagagatgattctgccctgaggaagaggaccctgagcctgacccagagaggaagaaacaagaagggcatcttcagcagcctgaagggcctggacaccctggccaggaagggcaaggagaagaggcccagcatcacccagatctttgacagcagcggcagccacggcttcagcggcacccagctgccccagaacagcagcaacagcagcgaggtggatgagctgctgcacatctacggcagcacagtggatggagtgccccgggacaatgcctgggagatccagacctacgtgcacttccaggacaaccacggcgtgacagtgggcatcaagccagagcaccgggtggaggacatcctgaccctggcctgcaagatgaggcagctggagcccagccactacggcctgcagctgaggaagctggtggatgacaacgtggagtactgcatcccagccccctatgagtacatgcagcagcaggtgtatgatgaaattgaggtgttccccctgaatgtgtatgatgtgcagctgaccaagacaggctctgtgtgtgactttggatttgctgtgacagcccaggtggatgagcggcagcacctgagccgcatcttcatcagtgatgtgctgcctgatggcctggcctatggagagggcctgaggaaaggaaatgagatcatgaccctgaatggagaggccgtgtctgacctggacctgaagcagatggaggccctcttcagcgagaagtctgtgggcctgaccctgattgcccggcccccagacaccaaggccaccctgtgcacctcctggagcgacagcgacctcttcagccgggaccagaagagcctgctgcccccacccaaccagagccagctgctggaggagttcctggacaacttcaagaagaacacagccaatgacttcagcaatgtgcctgacatcaccaccggcctgaagaggagccagacagatggcaccctggaccaggtgagccaccgggagaagatggagcagaccttccgctctgctgagcagatcacagccctgtgccgctccttcaatgacagccaggccaacggcatggagggcccccgggagaaccaggaccccccacccaggagcctggcccggcacctgagtgatgctgaccggctgaggaaggtgatccaggagctggtggacacagagaagagctatgtgaaggacctgagctgcctgtttgagctgtacctggagcccctgcagaatgagaccttcctgacccaggatgagatggagagcctgtttggcagcctgcctgagatgctggagttccagaaggtgttcctggagaccctggaggatggcatcagcgccagcagtgacttcaacaccctggagacccccagccagttcaggaagctgctcttcagcctgggcggcagcttcctgtactatgctgaccacttcaagctgtacagcggcttctgtgccaaccacatcaaggtgcagaaggtgctggagcgggccaagacagacaaggccttcaaggccttcctggatgccaggaaccccaccaagcagcacagcagcaccctggagagctacctgatcaagcctgtgcagagggtgctgaagtaccccctgctgctgaaggagctggtgtccctgacagaccaggagagcgaggagcactaccacctgacagaggccctgaaggccatggagaaggtggccagccacatcaatgagatgcagaagatctatgaggactatggcaccgtgtttgaccagctggtggccgagcagagcggcacagagaaggaggtgacagagctgtccatgggagagctgctgatgcacagcacagtgtcctggctgaaccccttcctgagcctgggcaaggccaggaaggacctggagctgactgtgtttgtgttcaagagagctgtgatcctggtgtacaaggagaactgcaagctgaagaagaagctgcccagcaacagcaggcctgcccacaacagcacagacctggaccccttcaagttccgctggctgatccccatcagcgccctgcaggtgcggctgggcaacccagctggaacagagaacaacagcatctgggagctgatccacaccaagtcagaaattgagggccggcctgagaccatcttccagctgtgctgcagcgacagcgagagcaagaccaacatcgtgaaggtgatccgcagcatcctgcgggagaacttcagaagacacatcaagtgtgagctgcccctggagaagacctgcaaggaccggctggtgcccctgaagaacagagtgcctgtgtctgccaagctggccagcagccgcagcctgaaggtgctgaagaacagcagcagcaatgagtggacaggagagaccgggaagggcaccctgctggacagtgatgagggcagcctgagcagcggcacccagagcagcggctgccccacagctgagggccggcaggacagcaagagcaccagccctgggaagtacccccaccctggcctggccgactttgctgacaacctgatcaaggagagtgacatcctgagtgatgaagatgatgaccaccggcagacagtgaagcagggcagccccaccaaggacatcgagatccagttccagaggctgcgcatcagtgaagatcctgatgtgcaccctgaggccgagcagcagcccggccctgagagcggggagggccagaagggcggggagcagcccaagctggtgcggggccacttctgccccatcaagaggaaggccaacagcaccaagagggaccggggcaccctgctgaaggcccagatccgccaccagagcctggacagccagagtgaaaatgccaccatcgacctgaacagcgtgctggagcgggagttctctgtgcagagcctgacctctgtggtgtctgaggagtgcttctatgaaacagagagccacggcaagagctag

SEQ ID NO: 19649 - DNA, 579 bp, Artificial Sequence
  Description of Artificial Sequence: Synthetic coding sequence
atgagccagtgtgcctgcctggaggaggtgcacctgcccaacatcaagccaggagagggcctgggcatgtacatcaagagcacctatgatggcctgcacgtgatcaccggcaccacagaaaatgtgggctggcagctgaagaacctggtgaagaagctgcgggagaaccccaccggggtggtgctgctgctgaagaagaggcccaccggcagcttcaacttcaccccagcccccctgaagaacctgcgctggaagccacccctggtgcagaccagccccccaccagccaccacccagagccctgagagcaccatggacaccagcctgaagaaggagaagagcgccatcctggacctgtacatccccccacctcctgctgtgccctacagccccagagatgaaaatggcagctttgtgtatggaggcagcagcaagtgcaagcagcccctgcccggccccaagggcagcgagagccccaacagcttcctggaccaggagagcagaagaagacgcttcaccatcgctgacagcgaccagctgcccggctacagcgtggagaccaacatcctgcccacctag

SEQ ID NO: 19650 - DNA, 1668 bp, Artificial Sequence
  Description of Artificial Sequence: Synthetic coding sequence
atggagcctgtgaccaagtggagccccaagcaggtggtggactggacccggggcctggatgactgcctgcagcagtatgtgcacaagtttgagcgggagaagatcaacggggagcagctgctgcagatcagccaccaggacctggaggagctgggcgtgacccgcatcggccaccaggagctggtgctggaggccgtggacctgctgtgtgccctgaactacggcctggagacagacaacatgaagaacctggtgctgaagctgcgggccagcagccacaacctgcagaactacatcagcagcaggaggaagagccctgcctatgatggcaacaccagcaggaaggccccaaatgagttcctgacctctgtggtggagctgattggagctgccaaggccctgctggcctggctggaccgggcccccttcaccggcatcacagacttctctgtgaccaagaacaagatcatccagctgtgcctggacctgaccaccaccgtgcagaaggactgctttgtggccgagatggaggacaaggtgctgactgtggtgaaggtgctgaatggcatctgtgacaagaccatccgcagcaccacagatcctgtgatgagccagtgtgcctgcctggaggaggtgcacctgcccaacatcaagccaggagagggcctgggcatgtacatcaagagcacctatgatggcctgcacgtgatcaccggcaccacagagaacagccctgctgacaggagccagaagatccacgccggagatgaggtgatccaggtgaaccagcagacagtggtgggctggcagctgaagaacctggtgaagaagctgcgggagaaccccactggagtggtgctgctgctgaagaagaggcccaccggcagcttcaacttcaccccagcccccctgaagaacctgcgctggaagccacccctggtgcagaccagccccccaccagccaccacccagagccctgagagcaccatggacaccagcctgaagaaggagaagagcgccatcctggacctgtacatccccccacctcctgctgtgccctacagccccagagatgaaaatggcagctttgtgtatggaggcagcagcaagtgcaagcagcccctgcccggccccaagggcagcgagagccccaacagcttcctggaccaggagagcagaagaagacgcttcaccatcgctgacagcgaccagctgcccggctacagcgtggagaccaacatcctgcccaccaagatgagggagaagacccccagctatggcaagccccggcccctgtccatgccagcagatggcaactggatgggcatcgtggacccctttgcccggccccggggccacggcaggaagggggaggatgccctgtgccgctacttcagcaatgaaagaattcctcccatcatcgaggagagcagcagccccccctaccgcttcagccggcccaccacagagcggcacctggtgagaggagctgactacatccggggcagccgctgctacatcaacagcgacctgcacagcagcgccaccatccccttccaggaggagggcaccaagaagaagagcggcagcagcgccaccaagagcagcagcacagagcccagcctgctggtgtcctggttcacccggctgaagctgctgacccactag

SEQ ID NO: 19651 - DNA, 708 bp, Artificial Sequence
  Description of Artificial Sequence: Synthetic coding sequence
atgaggagccgggtgctgtggggcgccgcccgctggctgtggccccggcgggctgtgggccctgcccggcggcccctgagcagcggcagcccccccctggaggagctgttcacccggggcggccccctgcggaccttcctggagcggcaggccggcagcgaggcccacctgaaggtgcggcggcctgagctgctggccgtcatcaagctgctgaatgagaaggagcgggagctgcgggagacagagcacctgctgcatgatgaaaatgaagacctgaggaagctggctgaaaatgagatcaccctgtgccagaaggagatcacccagctgaagcaccagatcatcctgctgctggtgcccagcgaggagacagatgaaaatgacctgatcctggaggtgacagctggggtgggcggcggcctgcggcatgccagcgccagcatcggcggcagcgaggcctaccgccacatgaagtttgaaggaggagtgcaccgggtgcagagggtgcccaagacagagaagcagggccgggtgcacaccagcaccatgacagtggccatcctgccccagcccacagagatcaacctggtgatcaaccccaaggacctgagaattgacaccaagagggccagcggggccggcggccagcacgtgaacaccacagattctgctgtgagaattgtgcacctgcccacagactggaagtag

SEQ ID NO: 19652 - DNA, 816 bp, Artificial Sequence
  Description of Artificial Sequence: Synthetic coding sequence
atgaggagccgggtgctgtggggcgccgcccgctggctgtggccccggcgggctgtgggccctgcccggcggcccctgagcagcggcagcccccccctggaggagctgttcacccggggcggccccctgcggaccttcctggagcggcaggccggcagcgaggcccacctgaaggtgcggcggcctgagctgctggccgtcatcaagctgctgaatgagaaggagcgggagctgcgggagacagagcacctgctgcatgatgaaaatgaagacctgaggaagctggctgaaaatgagatcaccctgtgccagaaggagatcacccagctgaagcaccagatcatcctgctgctggtgcccagcgaggagacagatgaaaatgacctgatcctggaggtgacagctggggtgggcggccaggaggccatgctgttcaccagcgagatctttgacatgtaccagcagtatgctgccttcaagcgctggcactttgagaccctggagtacttccccagcgagctgggcggcctgcggcatgccagcgccagcatcggcggcagcgaggcctaccgccacatgaagtttgaaggaggagtgcaccgggtgcagagggtgcccaagacagagaagcagggccgggtgcacaccagcaccatgacagtggccatcctgccccagcccacagagatcaacctggtgatcaaccccaaggacctgagaattgacaccaagagggccagcggggccggcggccagcacgtgaacaccacagattctgctgtgagaattgtgcacctgcccacagactggaagtag

SEQ ID NO: 19653 - DNA, 1143 bp, Artificial Sequence
  Description of Artificial Sequence: Synthetic coding sequence
atgaggagccgggtgctgtggggcgccgcccgctggctgtggccccggcgggctgtgggccctgcccggcggcccctgagcagcggcagcccccccctggaggagctgttcacccggggcggccccctgcggaccttcctggagcggcaggccggcagcgaggcccacctgaaggtgcggcggcctgagctgctggccgtcatcaagctgctgaatgagaaggagcgggagctgcgggagacagagcacctgctgcatgatgaaaatgaagacctgaggaagctggctgaaaatgagatcaccctgtgccagaaggagatcacccagctgaagcaccagatcatcctgctgctggtgcccagcgaggagacagatgaaaatgacctgatcctggaggtgacagctggggtgggcggccaggaggccatgctgttcaccagcgagatctttgacatgtaccagcagtatgctgccttcaagcgctggcactttgagaccctggagtacttccccagcgagctgggcggcctgcggcatgccagcgccagcatcggcggcagcgaggcctaccgccacatgaagtttgaaggaggagtgcaccgggtgcagagggtgcccaagacagagaagcagggccgggtgcacaccagcaccatgacagtggccatcctgccccagcccacagagatcaacctggtgatcaaccccaaggacctgagaattgacaccaagagggccagcggggccggcggccagcacgtgaacaccacagattctgctgtgagaattgtgcacctgcccaccggggtggtgtctgagtgccagcaggagaggagccagctgaagaacaaggagctggccatgaccaagctgcgggccaagctgtacagcatgcacctggaggaggagatcaacaagaggcagaatgccaggaagatccagatcggcagcaagggccgctctgagaagatccgcacctacaacttcccccagaacagagtgacagaccaccgcatcaacaagaccctgcatgacctggagaccttcatgcagggcgactacctgctggatgagctggtgcagagcctgaaggagtatgctgactatgagagcctggtggagatcatcagccagaaggtgtag

SEQ ID NO: 19654 - DNA, 3561 bp, Artificial Sequence
  Description of Artificial Sequence: Synthetic coding sequence
atgtgtgaggtgatgcccaccatcaatgaaggagaccggctgggccccccccacggggctgatgctgatgccaactttgagcagctgatggtgaacatgctggatgagcgggagaagctgctggagagcctgcgggagagccaggagaccctggccgccacccagagccggctgcaggatgccatccacgagcgggaccagctgcagaggcacctgaacagcgccctgccccaggagtttgccaccctgacccgggagctgtccatgtgccgggagcagctgctggagcgggaggaggagatcagcgagctgaaggccgagaggaacaacacccggctgctgctggagcacctggagtgcctggtgtccagacatgagaggagcctgaggatgacagtggtgaagaggcaggcccagagccccagcggcgtgagcagcgaggtggaggtgctgaaggccctgaagagcctgtttgagcaccacaaggccctggatgagaaggtgcgggagcggctgcgggccgccctggagcgggtgaccaccctggaggagcagctggccggggcccaccagcaggtgtctgccctgcagcagggcgctggggtgagagatggagctgctgaggaggagggcaccgtggagctgggccccaagaggctgtggaaggaggacaccggccgggtggaggagctgcaggagctgctggagaagcagaactttgagctgagccaggcccgggagcggctggtgaccctgaccaccaccgtgacagagctggaggaggacctgggcacagcccggcgggacctgatcaagtctgaggagctgagcagcaagcaccagagggacctgcgggaggccctggcccagaaggaggacatggaggagcgcatcaccaccctggagaagcgctacctggccgcccagcgggaggccaccagcatccatgacctgaatgacaagctggagaatgagctggccaacaaggagagcctgcaccggcagtgtgaggagaaggcccggcacctgcaggagctgctggaggtggccgagcagaagctgcagcagaccatgaggaaggccgagaccctgcctgaggtggaggccgagctggcccagagaattgctgccctgaccaaggccgaggagagacatggcaacatcgaggagcacctgcggcagctggagggccagctggaggagaagaaccaggagctggcccgggtgcggcagcgggagaagatgaatgaagaccacaacaagaggctgagtgacacagtggaccggctgctgtctgagagcaatgaaaggctgcagctgcacctgaaggagaggatggccgccctggaggagaagggccgcctgtctgaggagattgagaagctgcggcaggaggtggaccagctgaagggccggggcggcccctttgtggatggagtgcacagccgcagccacatgggcagcgctgctgatgtgcgcttcagcctgggcaccaccacccacgcccctcctggggtgcaccggcgctacagcgccctgcgggaggagagcgccaaggactgggagaccagccccctgcccggcatgctggccccagctgctggccctgcctttgacagcgaccctgagatcagtgatgtggatgaagatgagcccggcggcctggtgggcagcgcagatgtggtgagccccagcggccacagtgatgcccagaccctggccatgatgctgcaggagcagctggatgccatcaatgaggagatccgcatgatccaggaggagaaggagagcacagagctgcgggcagaggagattgagaccagggtgaccagcggctccatggaggccctgaacctgaagcagctgaggaagaggggcagcatccccaccagcctgacagccctgagcctggccagcgccagcccccccctgagcggccgcagcacccccaagctgaccagccgctctgctgcccaggacctggacaggatgggcgtgatgaccctgcccagcgacctgaggaagcacaggaggaagctgctgagccctgtgtcccgggaggagaaccgggaggacaaggccaccatcaagtgtgagaccagcccccccagcagccccaggaccctgcggctggagaagctgggccacccagccctgagccaggaggagggcaagagcgccctggaggaccagggcagcaaccccagcagcagcaacagcagccaggacagcctgcacaagggggccaagaggaagggcatcaagagcagcatcggccgcctgtttgggaagaaggagaagggccgcctcatccagctgagcagagatggagccactggacatgtgctgctgacagattctgagttctccatgcaggagcccatggtgcctgccaagctgggcacccaggccgagaaggaccggcggctgaagaagaagcaccagctgctggaggatgcccggaggaagggcatgccctttgcccagtgggatggccccaccgtggtgtcctggctggagctgtgggtgggcatgcctgcctggtacgtggccgcctgccgggccaacgtgaagagcggggccatcatgtctgccctgagtgacacagagatccagcgggagatcggcatcagcaatgccctgcaccggctgaagctgcggctggccatccaggagatggtgtccctgaccagccccagcgccccacccaccagcaggaccagcagtggaaatgtgtgggtgacccatgaggagatggagaccctggagaccagcaccaagacagacagcgaggagggctcctgggcccagaccctggcctatggagacatgaaccacgagtggattggaaatgagtggctgcccagcctgggcctgccccagtaccgcagctacttcatggagtgcctggtggatgccaggatgctggaccacctgaccaagaaggacctgcgggtgcacctgaagatggtggacagcttccacaggaccagcctgcagtatggcatcatgtgcctgaagaggctgaactatgacaggaaggagctggagaagagaagagaggagagccagcacgagatcaaggatgtgctggtgtggaccaatgaccaggtggtgcactgggtgcagagcatcggcctgcgggactatgccggcaacctgcatgaaagtggagtgcacggggccctgctggccctggatgagaactttgaccacaacaccctggccctgatcctgcagatccccacccagaacacccaggcccggcaggtgatggagcgggagttcaacaacctgctggccctgggcacagacaggaagctggatgatggagatgacaaggtgttcagaagagcccccagctggaggaagcgcttccggccccgggagcaccacggccggggcggcatgctgagcgccagcgctgagaccctgcctgctggcttccgggtgtccaccctgggcaccctgcagcccccaccagccccacccaagaagatcatgcctgaggcccacagccactacctgtatggccacatgctgagcgccttccgggactag

SEQ ID NO: 19655 - DNA, 1803 bp, Artificial Sequence
  Description of Artificial Sequence: Synthetic coding sequence
atgagccgggtggccaagtaccgccggcaggtgtctgaagatcctgacatcgacagcctgctggagaccctgagccctgaggagatggaggagctggagaaggagctggatgtggtggaccctgatggctctgtgcctgtgggcctgcggcagaggaaccagacagagaagcagagcactggagtgtacaaccgggaggccatgctgaacttctgtgagaaggagaccaagaagctgatgcagcgggagatgtccatggatgagagcaagcaggtggagaccaagacagatgccaagaatggagaggagcggggcagagatgccagcaagaaggccctgggcccccggcgggacagcgacctgggcaaggagcccaagaggggcggcctgaagaagagcttcagccgggacagagatgaagctgggggcaagtctggagagaagcccaaggaggagaagatcatccggggcatcgacaagggccgggtgcgggctgctgtggacaagaaggaggccggcaaggatggccgcggggaggagagagctgtggccaccaagaaggaggaggagaagaagggcagtgacaggaacacaggcctgagccgggacaaggacaagaagcgggaggagatgaaggaggtggccaagaaggaggatgatgagaaggtgaagggggagaggaggaacacagacaccaggaaggagggggagaagatgaagagagctgggggcaacacagacatgaagaaggaggatgagaaggtgaagaggggcactggaaacacagacaccaagaaggatgatgagaaggtgaagaagaatgagcccctgcacgagaaggaggccaaggatgacagcaagaccaagaccccagagaagcagaccccatctggccccaccaagcccagcgagggccctgccaaggtggaggaggaggccgcccccagcatctttgatgagcccctggagcgggtgaagaacaatgaccctgagatgacagaggtgaatgtgaacaacagcgactgcatcaccaatgagatcctggtgcgcttcacagaggccctggagttcaacacagtggtgaagctgtttgccctggccaacaccagggcagatgaccacgtggcctttgccatcgccatcatgctgaaggccaacaagaccatcaccagcctgaacctggacagcaaccacatcaccgggaagggcatcctggccatcttccgggccctgctgcagaacaacaccctgacagagctgcgcttccacaaccagaggcacatctgtggcggcaagacagagatggagatcgccaagctgctgaaggagaacaccaccctgctgaagctgggctaccactttgagctggccggccccaggatgacagtgaccaacctgctgagcaggaacatggacaagcagaggcagaagaggctgcaggagcagaggcaggcccaggaggccaagggggagaagaaggacctgctggaggtgcccaaggccggggctgtggccaagggcagccccaagcccagcccccagcccagccccaagcccagccccaagaacagccccaagaagggcggggccccagctgcccctcctcctcctcctccacccctggcccctcctctcatcatggagaacctgaagaacagcctgagccctgccacccagaggaagatgggagacaaggtgctgcctgcccaggagaagaacagccgggaccagctgctggccgccatccgcagcagcaacctgaagcagctgaagaaggtggaggtgcccaagctgctgcagtag

SEQ ID NO: 19656 - DNA, 828 bp, Artificial Sequence
  Description of Artificial Sequence: Synthetic coding sequence
atgggcacccggctgcccctggtgctgcggcagctgcggcggcccccccagcccccaggccccccccggcggctgcgggtgccctgccgggccagcagcggcggcggcggcggcggcggcggcggccgggagggcctgctgggccagaggcggccccaggacggccaggcccggagcagctgcagccctgggggccgcaccccagctgcccgggacagcatcgtgcgggaggtgatccagaacagcaaggaggtgctgagcctgctgcaggagaagaacccagccttcaagcctgtgctggccatcatccaggccggagatgacaacctgatgcaggagatcaaccagaacctggccgaggaggccggcctgaacatcacccacatctgcctgcccccagacagcagcgaggccgagatcattgatgagatcctgaagatcaatgaagacaccagggtgcacggcctggccctgcagatcagcgagaacctcttcagcaacaaggtgctgaatgccctgaagccagagaaggatgtggatggagtgacagacatcaacctgggcaagctggtgagaggagatgcccatgaatgttttgtgtcccctgtggccaaggccgtcatcgagctgctggagaagagcggcgtgaacctggatggcaagaagatcctggtggtgggcgcccacggcagcctggaggccgccctgcagtgcctcttccagaggaagggctccatgaccatgagcatccagtggaagacccggcagctgcagagcaagacagagagccgctctgtgacccggctggagtgccggcgggtcatctag

SEQ ID NO: 19657 - DNA, 999 bp, Artificial Sequence
  Description of Artificial Sequence: Synthetic coding sequence
tgaggaagagagggcctgctgggccagaggcggccccaggacggccaggcccggagcagctgcagccctgggggccgcaccccagctgcccgggacagcatcgtgcgggaggtgatccagaacagcaaggaggtgctgagcctgctgcaggagaagaacccagccttcaagcctgtgctggccatcatccaggccggagatgacaacctgatgcaggagatcaaccagaacctggccgaggaggccggcctgaacatcacccacatctgcctgcccccagacagcagcgaggccgagatcattgatgagatcctgaagatcaatgaagacaccagggtgcacggcctggccctgcagatcagcgagaacctcttcagcaacaaggtgctgaatgccctgaagccagagaaggatgtggatggagtgacagacatcaacctgggcaagctggtgagaggagatgcccatgaatgttttgtgtcccctgtggccaaggccgtcatcgagctgctggagaagtctgtgggcgtgaacctggatggcaagaagatcctggtggtgggcgcccacggcagcctggaggccgccctgcagtgcctcttccagaggaagggctccatgaccatgagcatccagtggaagacccggcagctgcagagcaagctgcatgaagctgacatcgtggtgctgggcagccccaagccagaggagatccccctgacctggatccagcccggcaccaccgtgctgaactgcagccatgacttcctgagcggcaaggtgggctgcggcagcccccgcatccactttggaggcctcatcgaggaggatgatgtgatcctgctggccgccgccctgcgcatccagaacatggtgagcagcggccgccgctggctgcgggagcagcagcaccggcgctggaggctgcactgcctgaagctgcagcccctgagccctgtgcccagcgacatcgagatcagccggggccagaccccctag

SEQ ID NO: 19658 - DNA, 2937 bp, Artificial Sequence
  Description of Artificial Sequence: Synthetic coding sequence
atgggcacccggctgcccctggtgctgcggcagctgcggcggcccccccagcccccaggccccccccggcggctgcgggtgccctgccgggccagcagcggcggcggcggcggcggcggcggcggccgggagggcctgctgggccagaggcggccccaggacggccaggcccggagcagctgcagccctgggggccgcaccccagctgcccgggacagcatcgtgcgggaggtgatccagaacagcaaggaggtgctgagcctgctgcaggagaagaacccagccttcaagcctgtgctggccatcatccaggccggagatgacaacctgatgcaggagatcaaccagaacctggccgaggaggccggcctgaacatcacccacatctgcctgcccccagacagcagcgaggccgagatcattgatgagatcctgaagatcaatgaagacaccagggtgcacggcctggccctgcagatcagcgagaacctcttcagcaacaaggtgctgaatgccctgaagccagagaaggatgtggatggagtgacagacatcaacctgggcaagctggtgagaggagatgcccatgaatgttttgtgtcccctgtggccaaggccgtcatcgagctgctggagaagagcggcgtgaacctggatggcaagaagatcctggtggtgggcgcccacggcagcctggaggccgccctgcagtgcctcttccagaggaagggctccatgaccatgagcatccagtggaagacccggcagctgcagagcaagctgcacgaggccgacatcgtggtgctgggcagccccaagccagaggagatccccctgacctggatccagcccggcaccaccgtgctgaactgcagccatgacttcctgagcggcaaggtgggctgcggcagcccccgcatccactttggaggcctgattgaagaagatgatgtgatcctgctggccgccgccctgcgcatccagaacatggtgtcctctggaagacgctggctgcgggagcagcagcaccggcgctggaggctgcactgcctgaagctgcagcccctgagccctgtgcccagcgacatcgagatcagccggggccagacccccaaggctgtggatgtgctggccaaggagatcggcctgctggctgatgaaattgagatctacggcaagagcaaggccaaggtgcggctgtctgtgctggagcggctgaaggaccaggctgatggcaagtatgtgctggtggccggcatcacccccacccccctgggggagggcaagagcacagtgaccatcggcctggtgcaggccctgacagcccacctgaatgtgaacagctttgcctgcctgcggcagcccagccagggccccacctttggagtgaagggcggggccgccggcggcggctacgcccaggtgatccccatggaggagttcaacctgcacctgaccggggacatccacgccatcacagctgccaacaacctgctggccgccgccatcgacacccgcatcctgcacgagaacacccagacagacaaggccctgtacaaccggctggtgcccctggtgaatggagtgcgggagttcagcgagatccagctggcccggctgaagaagctgggcatcaacaagacagaccccagcaccctgacagaggaggaggtgtccaagtttgcccggctggacatcgaccccagcaccatcacctggcagagggtgctggacaccaatgaccgcttcctgaggaagatcaccatcggccagggcaacacagagaagggccactaccggcaggcccagtttgatattgctgtggccagcgagatcatggctgtgctggccctgacagacagcctggccgacatgaaggcccggctgggccgcatggtggtggccagtgacaagagcggccagcctgtgacagcagatgacctgggcgtgactggagccctgactgtgctgatgaaggatgccatcaagcccaacctgatgcagaccctggagggcacccctgtgtttgtgcatgctggcccctttgccaacatcgcccacggcaacagctctgtgctggccgacaagatcgccctgaagctggtgggggaggagggctttgtggtgacagaggccggctttggagctgacatcggcatggagaagttcttcaacatcaagtgccgggccagcggcctggtgcccaacgtggtggtgctggtggccaccgtgcgggccctgaagatgcacggcggcggccccagcgtgacagctggggtgcccctgaagaaggagtacacagaggagaacatccagctggtggctgatggctgctgcaacctgcagaagcagatccagatcacccagctgtttggagtgcctgtggtggtggccctgaatgtgttcaagacagacaccagggctgagattgacctggtgtgtgagctggccaagagagctggggcctttgatgctgtgccctgctaccactggagcgtgggcggcaagggctctgtggacctggcccgggctgtgcgggaggccgccagcaagaggagccgcttccagttcctgtatgatgtgcaggtgcccatcgtggacaagatccgcaccatcgcccaggccgtgtatggagccaaggacatcgagctgagccctgaggcccaggccaagattgaccgctacacccagcagggcttcggcaacctgcccatctgcatggccaagacccacctgagcctgagccaccagcctgacaagaagggcgtgccccgggacttcatcctgcccatcagtgatgtgcgggccagcatcggggccggcttcatctaccccctggtgggcaccatgagcaccatgcctggcctgcccacccggccctgcttctatgacatcgacctggacacagaaacagagcaggtgaagggcctcttctag

SEQ ID NO: 19659 - DNA, 408 bp, Artificial Sequence
  Description of Artificial Sequence: Synthetic coding sequence
atgatccccaacggctacctgatgtttgaagatgagaacttcatcgagagctctgtggccaagctgaatgccctgaggaagagcggccagttctgtgatgtgcggctgcaggtgtgtggccacgagatgctggcccacagagctgtgctggcctgctgcagcccctacctgtttgagatcttcaacagcgacagcgacccccacggcatcagccacgtgaagtttgatgacctgaaccctgaggccgtggaggtgctgctgaactatgcctacacagcccagctgaaggctgacaaggagctggtgaaggatgtgtacagcgctgccaagaagctgaagatggacagagtgaagcagcacctgctgtacttctgcctgcacagcaccagcaccagcagcctgctgtag

SEQ ID NO: 19660 - DNA, 1929 bp, Artificial Sequence
  Description of Artificial Sequence: Synthetic coding sequence
atgatccccaacggctacctgatgtttgaagatgagaacttcatcgagagctctgtggccaagctgaatgccctgaggaagagcggccagttctgtgatgtgcggctgcaggtgtgtggccacgagatgctggcccacagagctgtgctggcctgctgcagcccctacctgtttgagatcttcaacagcgacagcgacccccacggcatcagccacgtgaagtttgatgacctgaaccctgaggccgtggaggtgctgctgaactatgcctacacagcccagctgaaggctgacaaggagctggtgaaggatgtgtacagcgctgccaagaagctgaagatggacagagtgaagcaggtgtgtggggactacctgctgagcaggatggatgtgaccagctgcatctcctacagaaactttgccagctgcatgggagacagccggctgctgaacaaggtggatgcctacatccaggagcacctgctgcagatcagcgaggaggaggagttcctgaagctgccccggctgaagctggaggtgatgctggaggacaacgtgtgcctgcccagcaatggcaagctgtacaccaaggtgatcaactgggtgcagaggagcatctgggagaatggagacagcctggaggagctgatggaggaggtgcagaccctgtactacagcgctgaccacaagctgctggatggcaacctgctggatggccaggccgaggtgtttggaagtgatgatgaccacatccagtttgtgcagaagaagcccccaagagaaaatggccacaagcagatcagcagcagcagcacaggctgcctgagcagccccaatgccaccgtgcagagccccaagcatgagtggaagatcgtggccagcgagaagaccagcaacaacacctacctgtgcctggccgtgctggatggcatcttctgtgtgatcttcctgcacggcaggaacagcccccagagcagccccaccagcacccccaagctgagcaagagcctgagctttgagatgcagcaggatgagctgattgagaagcccatgagccccatgcagtatgcccggagcggcctgggcacagctgagatgaatggcaagctgattgctgctgggggctacaaccgggaggagtgcctgaggacagtggagtgctacaacccccacacagaccactggagcttcctggcccccatgaggaccccccgggcccgcttccagatggctgtgctgatgggccagctgtatgtggtgggcggcagcaatggccacagtgatgacctgagctgtggggagatgtatgacagcaacattgatgactggatccctgtgcctgagctgcggaccaaccgctgcaatgctggggtgtgtgccctgaatggcaagctgtacatcgtgggcggcagtgacccctacggccagaagggcctgaagaactgtgatgtgtttgatcctgtgaccaagctgtggaccagctgtgcccccctgaacatcagaagacaccagagcgctgtgtgtgagctgggcggctacctgtacatcattggaggagctgagagctggaactgcctgaacacagtggagcgctacaaccctgagaacaacacctggaccctcatcgcccccatgaatgtggccaggagaggagctggggtggccgtgctgaatggcaagctgtttgtgtgtggcggctttgatggcagccacgccatcagctgtgtggagatgtatgaccccaccagaaatgagtggaagatgatgggcaacatgaccagccccaggagcaatgccggcatcgccaccgtgggcaacaccatctatgctgtgggcggctttgatggaaatgagttcctgaacacagtggaggtgtacaacctggagagcaatgagtggagcccctacaccaagatcttccagttctag

SEQ ID NO: 19661 - DNA, 408 bp, Artificial Sequence
  Description of Artificial Sequence: Synthetic coding sequence
atgagcaagaacacagtgagcagcgcccgcttcaggaaggtggatgtggatgaatatgatgagaacaagtttgtggatgaggaggatggaggagatggccaggccggcccagatgaaggagaggtggacagctgcctgcggcagggcaacatgacagctgccctgcaggccgccctgaagaacccccccatcaacaccaagagccaggccgtgaaggacagagctggcagcatcgtgctgaaggtgctgatctccttcaaggccaatgacatcgagaaggctgtgcagagcctggacaagaatggagtggacctgctgatgaagtacatctacaagggctttgagagccccagcgacaacagcagcgccatgctgctgcagtggcatgagaaggtgcccctggtgtag

SEQ ID NO: 19662 - DNA, 849 bp, Artificial Sequence
  Description of Artificial Sequence: Synthetic coding sequence
atggccagcagcttcctgcctgctggggccatcaccggggacagcggcggggagctgagcagtggagatgattctggagaggtggagttcccccacagccctgagattgaggagaccagctgcctggccgagctgtttgagaaggccgccgcccacctgcagggcctcatccaggtggccagccgggagcagctgctgtacctgtatgcccgctacaagcaggtgaaggtgggcaactgcaacacccccaagcccagcttctttgattttgagggcaagcagaagtgggaggcctggaaggccctgggggacagcagccccagccaggccatgcaggagtacatcgctgtggtgaagaagctggaccccggctggaacccccagatccctgagaagaagggcaaggaggccaacacaggctttggaggccctgtgatcagcagcctgtaccacgaggagaccatccgggaggaggacaagaacatctttgactactgccgggagaacaacatcgaccacatcaccaaggccatcaagagcaagaatgtggatgtgaatgtgaaggatgaggagggccgggccctgctgcactgggcctgtgaccggggccacaaggagctggtgacagtgctgctgcagcacagagctgacatcaactgccaggacaatgaaggccagacagccctgcactacgccagcgcctgtgagttcctggacatcgtggagctgctgctgcagagcggggctgaccccaccctgcgggaccaggacggctgcctgcctgaggaggtgacaggctgcaagacagtgtccctggtgctgcagaggcacaccaccgggaaggcctag

SEQ ID NO: 19663 - DNA, 9354 bp, Artificial Sequence
  Description of Artificial Sequence: Synthetic coding sequence
atgaggagcagcaagagcaaggaggtgcccctgcccaaccccaggaacagccagagcaaggacacagtgcaggccgacatcaccacctcctgggatgccctgagccagaccaaggccgccctgcggcacatcgagaacaagctggaggtggcccccaccagcacagctgtgtgtgacagcgtgatggacaccaagaagagcagcaccagcgccaccaggaagatcagcaggaaggatggccgctacctggatgacagctgggtgaatgcccccatcagcaagagcaccaagagcaggaaggagaagagccgcagccccctgcgggccaccaccctggagagcaatgtgaagaagaacaacagagtggagttccgggagcccctggtgtcctaccgggagatccatggagcccccagcaacttcagcagcagccacctggagagcaagcacgtgtactgtgtggatgtgaatgaggagaagacagaaagtggcaactggatgattggcagccgggaggagaggaacatccgcagctgtgactttgagagcagccagagcagcgtcatcaatgacacagtggtgcgcttcctgaatgacaggcctgccattgatgccctgcagaacagcgagtgcctgatccgcatgggcgcctccatgaggacagaggaggagatgcccaacagaaccaagggcagcgagaacaacctgaagctgtctgtgaacaacatggcccatgacacagaccccaaggccctgcggctgacagacagcagccccagcagcaccagcaccagcaacagccagaggctggacatcctgaagaggcggcagcatgatgtgaagctggagaagctgaaggagcgcatcaggaagcagtgggagcacagcgaggagaccaacggccggggccagaagctgggccacatcgaccaccctgtgatggtggtgaatgtggacaacagcgtgacagccaaggtgaggaaggtggccacagcccccccagccccagcctacaagggcttcaaccccagcgagaccaagatccgcaccccagatggcaaggtgtggcaggaggccgagttccagaacatgagccgggagctgtacagagacctggccctgcactttgctgatgacatcagcatcaaggagaagccagctgagaagagcaaggagaagaaggtggtgaagcctgtgaggaaggtgcagaaggtggcccagctgagcagcacagagtgcaggacaggcagcagccacctgatcagcaccagctcctggagagatggccagaagctggtgaagaagatcctgggccctgcccccaggatggagcccaaggagcagaggacagccagcagtgaccggggcggccgggagaggacagccaagagcggcggccacatcggccgggcagagagtgacccccggctggatgtgctgcaccgccacctgcagaggaacagcgagaggagccgcagcaagagccgctctgagaacaacatcaagaagctggccagcagcctgcctgacaacaagcaggaggagaacacagccctgaacaaggacttcctgcccatcgagatccggggcatcctggatgacctgcagctggacagcacagcccacacagccaagcaggacacagtggagctgcagaaccagaagagcagcgcccctgtgcacgcccccaggagccacagccctgtgaagaggaagccagacaagatcacagccaatgaagacccccctgtgatcagcaagaggaggcactatgacacagatgaggtgcggcagtacatcgtgcggcagcaggaggagaggaagaggaagcagaatgaggagaagaaggcccagaaggaggccacagagcagaagaacaagaggctgcaggagctgtacaggaagcagaaggaggccttcaccaaggtgaagaatgtgcccccatctgagcccagcgccacccggcggctgcaggagacctacagcaagctgctgctggagaagaccctgctggaggagcccagccaccagcacgtgacccaggagacccaggccaagccaggctaccagcccagcggggagagtgacaaggagaacaaggtgcaggagaggcctccttctgccagcagcagcagtgacatgagcctgtctgagcccccccagcccctggccaggaaggacctgatggagagcacctggatgcagcctgagcggctgagcccccaggtgcaccacagccagccccagccctttgctggaacagctggcagcctgctgagccacctgctgagcctggagcacgtgggcatcctgcacaaggactttgagagcatcctgcccaccaggaagaaccacaacatggccagccggcccctgaccttcaccccccagccctacgtgaccagccctgctgcctacacagatgccctgctgaagcccagcgccagccagtacaagagcaagctggacagaattgaggccctgaaggccacagctgccagcctgagcagcagaattgaaagtgaggccaagaagctggccggggccagcatcaactacggcagcgcctggaacacagaatatgatgtgcagcaggccccccaggaggatggcccctggaccaaggctgtgaccccacctgtgaaggatgacaatgaagatgtgttcagcgcccgcatccagaagatgctgggcagctgtgtgtcccatgccacctttgatgatgacctgcccggggtgggcaacctgtctgagttcaagaagctgcctgagatgatccggccccagagcgccatcagcagcttccgggtgcgcagccctggccccaagccagagggcctgctggcccagctgtgcaagaggcagacagacagcagcagcagtgacatgcaggcctgcagccaggacaaggccaagatcagcctgggcagcagcattgattctgtgtctgagggccccctgctgtctgagggcagcctgtctgaggaggagggggaccaggacggccagcccctgctgaaggtggccgagatcctgaaggagaaggagttctgccctggagagaggaacagctatgagcccatcaaggagttccagaaggaggccgagaagttcctgcccctgtttggccacatcggcggcacccagagcaagggcccctgggaggagctggccaagggcagcccccacagcgtcatcaacatcttcaccaagagctaccagctgtatggcaagggctttgaggacaagctggaccggggcaccagcaccagccggcccctgaatgccacagccacccccctgagcggcgtgtcctatgaagatgactttgtgagcagccctggcaccggcaccagcacagagaagaagagcaccctggagccccacagcaccctgagcccccaggaggaccacagcaacaggaagagcgcctatgaccccagctctgtggatgtgaccagccagcacagcagcggggcccagagcgctgccagcagccgcagcagcaccagcagcaagggcaagaagggcaagaaggagaagacagagtggctggacagcttcaccggaaatgtgcagaacagcctgctggatgaggagaaggccgagcggggcagccaccagggcaagaagagcggcaccagcagcaagctgtctgtgaaggactttgagcagaccctggacacagacagcaccctggaggacctgagcggccacagcgtgtctgtgtccagtgacaagggccgcagccagaagacccccaccagccccctgagccccagcagccagaagagcctgcagtttgatgtggccggcaccagcagcgagaggagcaagagctctgtgatgccacccaccatcaccggcttcaagcccaatgcccccctgacagacctgaacccagctgccagcaggaccaccacagagaacatggcccccatccctggcagcaagcgcttcagccctgctggcctgcaccacaggatggctgctgagctgagctacctgaatgccatcgaggagagcgtgcggcagctgagtgatgtggagcgggtgcggggcatcagcctggcccagcaggagagcgtgtccctggcccagatcatcaaggcccagcagcagagacatgagcgggacctggccctgctgaagctgaaggccgagcaggaggccctggagagccagaggcagctggaggagaccaggaacaaggccgcccaggtgcacgccgagagcctgcagcaggtggtgcagagccagcgggaggtgacagaggtgctgcaggaggccacctgcaagattgctgcccagcagagcgagacagcccggctgaccacagatgctgcccggcagatctgtgagatggccgagctgaccaggacccacatcagtgatgctgtggtggccagcggggcccccctggccatcctgtatgaccaccagaggcagcacctgcctgactttgtgaagcagctgcggaccaggacagaaacagacaggaagagccccagcgtgtccctgagccagagcaaggagggcaccctggacagcaagcaccagaagtacagcgccagctatgacagctacagcgagagcagcggctacaagaaccacgaccggcgcagcagcagcggcagcagccggcaggagagccccagcgtgcccagctgcaaggaaaatgagaagaagctgaatggagagaagattgagagcagcattgatgagcaggtgcagacagctgctgatgacagcctgcggagtgacagcgtgcccagcctgcctgatgagaaggacagcaccagcatcgccacagagtacagcctgaagtttgatgagagcatgacagaagatgaaattgaggagcagagcttccgcagcctgctgcccagcgagagccaccggcgcttcaacatggagaagagaagaggccaccatgatgacagtgatgaggaggccagccctgagaagaccaccctgagcacagccaaggagctgaacatgcccttcagcggcggccaggacagcttcagcaagttcaccatggagatggtgcggcagtacatgaaggaggaggagatgagagctgcccaccagagcagcctgctgcggctgcgggagaaggccctgaaggagaagaccaaggccgagctggcctggctggagcaccagaagaagcacctgcgggacaagggggaggatgacaagatgccacccctgaggaagaagcagaggggcctgctgctgcggctgcagcaggagaaggccgagatcaagaggctgcaggaggccaacaaggccgccaggaaggagcggcagctgatcctgaagcagcaggaggagattgagaagatccggcagaccaccatcaagctgcaggagaagctgaagtctgctggggagagcaagctggacagccacagtgatgatgacaccaaggacaacaaggccaccagccctggccccacagacctggagaccaggagccccagccccatcagcatcagcagcagcgagaccagcagcatcatgcagaagctgaagaagatgaggagcaggatggatgagaagttcctgaccaagcgggagcagaagctgatgcagaggcggcagcacgccgaggagctgctggagtggaagaggcggctggatgctgaggaggccgagatccggcagatggagaagcaggccctggccgcctgggacaaggagctgatcaagcccaagacccccaagaaggagctggaggaccagaggacagagcagaaggagatcgccagcgaggaggagagccctgtgcccctgtacagccacctgaacagcgagagcagcatccctgaggagctgggcagccctgctgtggagtatgtgcccagcgagagcatcggccaggagcagcccggcagcccagaccacagcatcctgacagaggagatgatctgcagccaggagctggagagcagcaccagccccagcaagcacagcctgcccaagagctgcacctctgtgtccaagcaggagagcagcaagggcagccacaggactggaggccagtgccacctgcccatcaagagccaccagcactgctacagctggagcgatgagagcctgtccatgacccagagcgagaccaccagtgaccagagcgacatcgagggccgcatccgggccctgaaggatgagctgaggaagaggaagtctgtggtgaaccagctgaagaaggagcagaagaagaggcagaaggagcggctgaaggcccaggaggccagcctcatcaagcagctggagagctatgatgagttcatcaagaagacagaggccgagctgagccaggacctggagaccagccccacagccaagccccagatcaagaccctgagcagcgccagcgagaagcccaagatcaagcccctgacccccctgcacagaagtgaaacagccaagaactggaagagcctgacagaaagtgagaggagccggggcagcctggagagcattgctgagcacgtggatgccagcctgagcggcagcgagaggtctgtgtctgagaggagcctgagcgcctatgccaagagggtgaatgagtgggacagcaggacagaggacttccagacccccagccctgtgctgcggagcagcaggaagatccgggaggagagcggggacagcctggagaatgtgcctgccctgcacctgctgaaggagctgaatgccaccagccgcatcctggacatgtctgatggcaaggtgggggagagcagcaagaagtctgagatcaaggagattgagtacaccaagctgaagaagagcaagattgaagatgccttcagcaaggagggcaagagtgatgtgctgctgaagctggtgctggagcagggcgacagcagcgagatcctgagcaagaaggacctgcccctggacagtgaaaatgtgcagaaggacctggtgggcctggccatcgagaacctgcacaagtctgaggagatgctgaaggagcggcagagcgaccaggacatgaaccacagccccaacatccagagcggcaaggacatccacgagcagaagaacaccaaggagaaggacctgtcctggagcgagcacctgtttgcccccaaggagatcccctacagtgaagattttgaggtgtcctccttcaagaaggagatctctgctgagctgtacaaggatgactttgaggtgagcagcctgctgagcctgaggaaggacagccagagctgccgggacaagccccagcccatgaggagcagcaccagcggggccaccagctttggcagcaatgaggagatcagtgaatgtctgtctgagaagagcctgagcatccacagcaatgtgcacagcgaccggctgctggagctgaagagccccacagagctgatgaagagcaaggagaggagtgatgtggagcacgagcagcaggtgacagagagccccagcctggcctctgtgcccacagcagatgagctgtttgacttccacatcggggacagagtgctgattggaaatgtgcagcccggcatcctgcgcttcaagggggagaccagctttgccaagggcttctgggccggcgtggagctggacaagccagagggcaacaacaacggcacctatgatggcatcgcctactttgagtgcaaggagaagcacggcatctttgccccaccccagaagatcagccacatccctgagaactttgatgattatgtggacatcaatgaagatgaggactgctacagtgatgagcgctaccagtgctacaaccaggagcagaatgacacagagggccccaaggaccgggagaaggatgtgtctgagtacttctatgagaagagcctgcccagcgtgaatgacatcgaggcctctgtgaacagaagccgcagcctgaagattgaaacagacaacgtgcaggacatcagcggcgtgctggaggcccacgtgcaccagcagagctctgtggacagccagatcagcagcaaagaaaacaaggacctgatcagtgatgccacagagaaggtgtccattgctgctgaagatgacaccctggacaacaccttcagcgaggagctggagaagcagcagcagttcacagaggaggaggacaacctgtatgcagaggccagcgagaagctgtgcacccccctgctggacctgctgacccgggagaagaaccagctggaggcccagctgaagagcagcctgaatgaggagaagaagagcaagcagcagctggagaagatcagcctgctgacagacagcctgctgaaggtgtttgtgaaggacacagtgaaccagctgcagcagatcaagaagaccagagatgagaagatccagctgagcaaccaggagctgctgggagatgaccagaagaaggtgaccccccaggacctgagccagaatgtggaggagcagagccccagcatcagcggctgcttcctgagcagcgagctggaggatgagaaggaggagatcagcagcccagacatgtgccccaggcctgagagccctgtgtttggagccagcggccaggaggagctggccaagaggctggccgagctggagctgagccgggagttcctgagcgccctgggagatgaccaggactggtttgatgaggactttggcctgagcagcagccacaagatccagaagaacaaggccgaggagaccatcgtgcccctgatggccgagcccaagagggtgacccagcagccctgtgagaccctgctggccgtgccccacacagctgaggaggtggagatcctggtgcacaatgctgctgaggagctgtggaagtggaaggagctgggccatgacctgcacagcatcagcatccccaccaagctgctgggctgtgccagcaagggcctggacatcgagagcaccagcaagagggtgtacaagcaggccgtgtttgacctgaccaaggagatctttgaggagatctttgctgaggaccccaacctgaaccagcctgtgtggatgaagccctgccgcatcaacagcagctacttccggcgggtgaagaaccccaacaacctggatgagatcaagagcttcatcgccagcgaggtgctgaagctgttcagcctgaagaaggagcccaaccacaagacagactggcagaagatgatgaagtttggaaggaagaagagggacagagtggaccacatcctggtgcaggagctgcacgaggaggaggcccagtgggtgaactatgatgaagatgagctgtgtgtgaagatgcagctggctgatggcatctttgagaccctcatcaaggacaccattgatgtgctgaaccagatcagcgagaagcagggccgcatgctgctggtgtag

SEQ ID NO: 19664 - DNA, 2946 bp, Artificial Sequence; identical to SEQ ID NO: 18691
  Description of Artificial Sequence: Synthetic coding sequence

SEQ ID NO: 19665 - DNA, 648 bp, Artificial Sequence
  Description of Artificial Sequence: Synthetic coding sequence
atgtctgccaagagagctgagctgaagaagacccacctggtgaaggagcggcactgctggaccagcaagaactacaaggctgtgtgcctggagctgaagccagagcccaccaagacctttgactacaaggctgtgaagcaggagggccgcttcaccaaggccggcgtgacccaggacctgaagaatgagctgcgggaggtgcgggaggagctgaaggagaagatggaggagatcaagcagatcaaggacctgatggacaaggactttgacaagctgcatgaatttgtggagatcatgaaggagatgcagaaggacatggatgagaagatggacatcctgatcaacacccagaagaactacaagctgcccctgcggcgggcccccaaggagcagcaggagctgcggctgatgggcaagacccaccgggagccccagctgcggcccaagaagatggatggagccagcggcgtgaatggagccccctgtgccctgcacaagaagaccatggccccccagaagaccaagcagggcagcctggaccccctgcaccactgcggcacctgctgtgagaagtgcctgctgtgtgccctgaagaacaactacaacagaggcatctatgctgctgtgggcctgctggacctgtggtag

SEQ ID NO: 19666 - DNA, 606 bp, Artificial Sequence
  Description of Artificial Sequence: Synthetic coding sequence
atgtctgccaagagagctgagctgaagaagacccacctgagcaagaactacaaggctgtgtgcctggagctgaagccagagcccaccaagacctttgactacaaggctgtgaagcaggagggccgcttcaccaaggccggcgtgacccaggacctgaagaatgagctgcgggaggtgcgggaggagctgaaggagaagatggaggagatcaagcagatcaaggacctgatggacaaggactttgacaagctgcatgaatttgtggagatcatgaaggagatgcagaaggacatggatgagaagatggacatcctgatcaacacccagaagaactacaagctgcccctgcggcgggcccccaaggagcagcaggagctgcggctgatgggcaagacccaccgggagccccagctgcggcccaagaagatggatggagccagcggcgtgaatggagccccctgtgccctgcacaagaagaccatggccccccagaagaccaagcagggcagcctggaccccctgcaccactgcggcacctgctgcgtgtctgagaccctgcctgagcccagcactggagcccggcccctggccccagccccctggtag

SEQ ID NO: 19667 - DNA, 300 bp, Artificial Sequence
  Description of Artificial Sequence: Synthetic coding sequence
atgtctgccaagagagctgagctgaagaagacccacctgagcaagaactacaaggctgtgtgcctggagctgaagccagagcccaccaaggtgcgcagcccctttgaggccatgcaggccgcccggcctgagatccacggggaggtgaccaggagccagggcagctttgctgaccccagcggccaggacctgagccagacctttgactacaaggctgtgaagcaggagggccgcttcaccaaggccggccgcaccccccggctgctggaggagctgagcctgctgctgctgcccctgtag

SEQ ID NO: 19668 - DNA, 639 bp, Artificial Sequence
  Description of Artificial Sequence: Synthetic coding sequence
atgtctgccaagagagctgagctgaagaagacccacctgagcaagaactacaaggctgtgtgcctggagctgaagccagagcccaccaagacctttgactacaaggctgtgaagcaggagggccgcttcaccaaggccggcgtgacccaggacctgaagaatgagctgcgggaggtgcgggaggagctgaaggagaagatggaggagatcaagcagatcaaggacctgatggacaaggactttgacaagctgcatgaatttgtggagatcatgaaggagatgcagaaggacatggatgagaagatggacatcctgatcaacacccagaagaactacaagctgcccctgcggcgggcccccaaggagcagcaggagctgcggctgatgggcaagacccaccgggagccccagctgcggcccaagaagatggatggagccagcggcgtgaatggagccccctgtgccctgcacaagaagaccatggccccccagaagaccaagcagggcagcctggaccccctgcaccactgcggcacctgctgtgagaagtgcctgctgtgtgccctgaagaacaactacaacagagcccagctgcagaacctgcctgctgtgcccatccaccacctgcaggccccctag

SEQ ID NO: 19669 - DNA, 402 bp, Artificial Sequence
  Description of Artificial Sequence: Synthetic coding sequence
tgatatgagctgcgggaggagcacctggacaagatcttcaagcaccgggagctgcagcagaagctggtggatgccaagctggagcaggcccaggagatgatgaaggaggccgaggagcggcacaagcgggagaaggagtacctgctgaaccaggccgctgagtggaagctgcaggccaaggtgctgaaggagcaggagaccgtgctgcaggcccaggtgcggcctgggggccggggcatgggcgtgctgagcagcctgagcccagacaagaaggccggggccaagggcggccagcagaagagcagctatgtggccggagatggcggcatgggcattggaaatgaggagcagctgcacatctacagctacttccaggtgaagatcaaggcccagtactactag

SEQ ID NO: 19670 - DNA, 687 bp, Artificial Sequence
  Description of Artificial Sequence: Synthetic coding sequence
atggccagcgaggagctgcagaaggacctggaggaggtgaaggtgctgctggagaaggccaccaggaagagggtgagagatgccctgacagctgagaagagcaagattgaaacagagatcaagaacaagatgcagcagaagagccagaagaaggccgagctgctggacaatgagaagccagctgctgtggtggcccccatcaccaccggctacacagtgaagatcagcaactacggctgggaccagagcgacaagtttgtgaagatctacatcaccctgactggagtgcaccaggtgcccacagaaaatgtgcaggtgcacttcacagagaggagctttgacctgctggtgaagaacctgaatggcaagagctacagcatgattgtgaacaacctgctgaagcccatctctgtggagggcagcagcaagaaggtgaagacagacacagtgctgatcctgtgcaggaagaaggtggagaacacccgctgggactacctgacccaggtggagaaggagtgcaaggagaaggagaagcccagctatgacacagaaacagaccccagcgagggcctgatgaatgtgctgaagaagatctatgaagatggagatgatgacatgaagaggaccatcaacaaggcctgggtggagagccgggagaagcaggccaagggggacacagagttctag

SEQ ID NO: 19671 - DNA, 558 bp, Artificial Sequence
  Description of Artificial Sequence: Synthetic coding sequence
atgcagcagaagagccagaagaaggccgagctgctggacaatgagaagccagctgctgtggtggcccccatcaccaccggctacacagtgaagatcagcaactacggctgggaccagagcgacaagtttgtgaagatctacatcaccctgactggagtgcaccaggtgcccacagaaaatgtgcaggtgcacttcacagagaggagctttgacctgctggtgaagaacctgaatggcaagagctacagcatgattgtgaacaacctgctgaagcccatctctgtggagggcagcagcaagaaggtgaagacagacacagtgctgatcctgtgcaggaagaaggtggagaacacccgctgggactacctgacccaggtggagaaggagtgcaaggagaaggagaagcccagctatgacacagaaacagaccccagcgagggcctgatgaatgtgctgaagaagatctatgaagatggagatgatgacatgaagaggaccatcaacaaggcctgggtggagagccgggagaagcaggccaagggggacacagagttctag

SEQ ID NO: 19672 - DNA, 1134 bp, Artificial Sequence
  Description of Artificial Sequence: Synthetic coding sequence
atggagcagctgcctgacctgcacagccacttcagtgacctgaacctggaggcccacatgtatgccagccagtggttcctgaccctcttcaccgccaagttccccctgtgcatggtgttccacatcatcgacctgctgctgtgtgagggcctgaacatcatcttccacgtggccctggccctgctgaagaccagcaaagaagacctgctgcaggccgactttgagggcgccctgaagttcttccgggtgcagctgcccaagcgctacagagcagaagaaaatgcccggcggctgatggagcaggcctgcaacatcaaggtgcccaccaagaagctgaagaagtatgagaaggagtaccagaccatgagggagagccagctgcagcaggaggaccccatggaccgctacaagagagaaaatagaaggctgcaggaggcctccatgaggctggagcaggagaatgatgacctggcccacgagctggtgaccagcaagatcgccctgagaaatgacctggaccaggccgaggacaaggcagatgtgctgaacaaggagctgctgctgaccaagcagaggctggtggagacagaggaggagaagaggaagcaggaggaggagacagcccagctgaaggaggtgttcaggaagcagctggagaaggccgagtatgagatcaagaagaccacagccatcatcgccgagtacaagcagatctgcagccagctgagcacccggctggagaagcagcaggccgccagcaaggaggagctggaggtggtgaagggcaagatgatggcctgcaagcactgcagcgacatcttcagcaaggagggcgccctgaagctggccgccaccggccgggaggaccagggcatcgagacagatgatgagaaggacagcctgaagaagcagctgcgggagatggagctggagctggcccagaccaagctgcagctggtggaggccaagtgcaagatccaggagctggagcaccagagaggagccctgatgaatgagatccaggccgccaagaacagctggttcagcaagaccctgaacagcatcaagacagccaccggcacccagcccctgcagcctgcccctgtgacccagccccccaaggagagcacctag

SEQ ID NO: 19673 - DNA, 762 bp, Artificial Sequence
  Description of Artificial Sequence: Synthetic coding sequence
atgattgagaacagctcctggagcatgacctttgaggagagagaaaatagaaggctgcaggaggcctccatgaggctggagcaggagaatgatgacctggcccacgagctggtgaccagcaagatcgccctgagaaatgacctggaccaggccgaggacaaggcagatgtgctgaacaaggagctgctgctgaccaagcagaggctggtggagacagaggaggagaagaggaagcaggaggaggagacagcccagctgaaggaggtgttcaggaagcagctggagaaggccgagtatgagatcaagaagaccacagccatcatcgccgagtacaagcagatctgcagccagctgagcacccggctggagaagcagcaggccgccagcaaggaggagctggaggtggtgaagggcaagatgatggcctgcaagcactgcagcgacatcttcagcaaggagggcgccctgaagctggccgccaccggccgggaggaccagggcatcgagacagatgatgagaaggacagcctgaagaagcagctgcgggagatggagctggagctggcccagaccaagctgcagctggtggaggccaagtgcaagatccaggagctggagcaccagagaggagccctgatgaatgagatccaggccgccaagaacagctggttcagcaagaccctgaacagcatcaagacagccaccggcacccagcccctgcagcctgcccctgtgacccagccccccaaggagagcacctag

SEQ ID NO: 19674 - DNA, 759 bp, Artificial Sequence
  Description of Artificial Sequence: Synthetic coding sequence
atgggcaagagctatgatggccgggcctacgtgatcaccggcatgtggaaccccaatgcccctgtgttcctggccctgaatgaggagacccccaaggacaagcaggtgtacatgacagtggccgtggacatggtggtgacagaggtggtggagcctgtgcgcttcctgctggagaccgtggtgcgggtgtacccagccaatgaacgcttctggtacttcagcaggaagaccttcacagagaccttcttcatgaggctgaagcagagcgagggcaagggccacaccaatgctggagatgccatctatgaggtggtgtccctgcagcgggagagtgacaaggaggagcctgtgacccccaccagcggcggcggccccatgagcccccaggatgatgaagctgaggaggagagtgacaatgagctgagcagcggcactggagatgtgtccaaggactgcccagagaagatcctgtacagctggggcgagctgctgggcaagtggcacagcaacctgggcgcccggcccaagggcctgagcaccctggtgaagagcggcgtgcctgaggccctgcgggcagaggtgtggcagctgctggccggctgccacgacaaccaggccatgctggaccgctaccgcatcctgatcaccaaggtgtgctggagcctgctggaggtgcacagccggccctgcctgcccggctaccaccagtggaagctgcagaacagcaagtactgcaggatggccaacgtggccgcctag

SEQ ID NO: 19675 - DNA, 2484 bp, Artificial Sequence
  Description of Artificial Sequence: Synthetic coding sequence
atggaggtgcgggccagcctgcagaaggtgtctggcagcagtgacagcgtggccaccatgaacagcgaggagtttgtgctggtgccccagtatgcagatgacaacagcaccaagcatgaggagaagccccagctgaagatcgtgtccaatggagatgagcagctggagaaggccatggaggagatcctgcgggacagcgagaagaggcccagcagcctgctggtggactgccagagcagcagcgagatcagtgaccacagctttggagacatcccagccagccagaccaacaagcccagcctgcagctgatcctggaccccagcaacacagagatcagcaccccccggcccagcagccctgggggcctgcctgaggaggacagcgtgctcttcaacaagctgacctacctgggctgcatgaaggtgagcagccccagaaatgaggtggaggccctgcgggccatggccaccatgaagagcagcagccagtaccccttccctgtgaccctgtatgtgcccaacgtgcctgagggctctgtgcgcatcatcgaccagagcagcaatgtggagatcgccagcttccccatctacaaggtgctcttctgtgcccggggccatgatggcaccacagagagcaactgctttgccttcacagagagcagccacggcagcgaggagttccagatccacgtgttcagctgtgagatcaaggaggccgtgagccgcatcctgtacagcttctgcacagccttcaagaggagcagccggcaggtgtctgatgtgaaggacagcgtcatccccaccccagacagtgatgtgttcaccttctctgtgtccctggaggtgaaggaggatgatggcaagggcaacttccggctgctggtgatccccatcccctttgagtacttcagccctgtgcccaaggaccgggacaagttctacttcaagctgaagcagggcatcgagaagaaggtggtgatcaccgtgcagcagctgagcaacaaggagctggccatcgagcgctgcttcggcatgctgctgagccctggaagaaatgtgaagaacagcgacatgcacctgctggacatggagagcatgggcaagagctatgatggccgggcctacgtgatcaccggcatgtggaaccccaatgcccctgtgttcctggccctgaatgaggagacccccaaggacaagcaggtgtacatgacagtggccgtggacatggtggtgacagaggtggtggagcctgtgcgcttcctgctggagaccgtggtgcgggtgtacccagccaatgaacgcttctggtacttcagcaggaagaccttcacagagaccttcttcatgaggctgaagcagagcgagggcaagggccacaccaatgctggagatgccatctatgaggtggtgtccctgcagcgggagagtgacaaggaggagcctgtgacccccaccagcggcggcggccccatgagcccccaggatgatgaggccgaggaggagagtgacaatgagctgagcagcggcactggagatgtgtccaaggactgcccagagaagatcctgtacagctggggcgagctgctgggcaagtggcacagcaacctgggcgcccggcccaagggcctgagcaccctggtgaagtctggagtgcctgaggccctgcgggcagaggtgtggcagctgctggccggctgccacgacaaccaggccatgctggaccgctaccgcatcctgatcaccaaggacagcgcccaggagagcgtcatcacccgggacatccacaggaccttccctgcccatgactacttcaaggacacaggaggagatggccaggagagcctgtacaagatctgcaaggcctacagcgtgtatgatgaagatattggctactgccagggccagagcttcctggccgctgtgctgctgctgcacatgcctgaggagcaggccttctgtgtgctggtgaagatcatgtatgactatggcctgcgggacctgtacagaaacaactttgaggacctgcactgcaagttctaccagctggagcggctgatgcaggagcagctgcctgacctgcacagccacttcagtgacctgaacctggaggcccacatgtatgccagccagtggttcctgaccctcttcaccgccaagttccccctgtgcatggtgttccacatcatcgacctgctgctgtgtgagggcctgaacatcatcttccacgtggccctggccctgctgaagaccagcaaagaagacctgctgcaggccgactttgagggcgccctgaagttcttccgggtgcagctgcccaagcgctacagagcagaagaaaatgcccggcggctgatggagcaggcctgcaacatcaaggtgcccaccaagaagctgaagaagtatgagaaggagtaccagaccatgagggagagccagctgcagcaggaggaccccatggaccgctacaagttcttcttcctgtag

SEQ ID NO: 19676 - DNA, 2580 bp, Artificial Sequence
  Description of Artificial Sequence: Synthetic coding sequence
atgggcaaccgggagatggaggagctgatccccctggtgaaccggctgcaggatgccttcagcgccctgggccagagctgcctgctggagctgccccagattgctgtggtgggcggccagagcgctgggaagagctctgtgctggagaactttgtgggccgggacttcctgccccggggcagcggcatcgtgacccggcggcccctggtgctgcagctggtgaccagcaaggccgagtatgcagagttcctgcactgcaagggcaagaagttcacagactttgatgaggtgcggctggagattgaagctgagacagacagagtgacaggcatgaacaagggcatcagcagcatccccatcaacctgcgggtgtacagcccccacgtgctgaacctgaccctgattgacctgcccggcatcaccaaggtgcctgtgggggaccagcccccagacatcgagtaccagatccgggagatgatcatgcagttcatcacccgggagaactgcctgatcctggccgtgaccccagccaacacagacctggccaacagtgatgccctgaagctggccaaggaggtggacccccagggcctgcggaccatcggggtcatcaccaagctggacctgatggatgagggcacagatgccagagatgtgctggagaacaagctgctgcccctgcggcggggctacgtgggcgtggtgaacagaagccagaaggacattgatggcaagaaggacatcaaggccgccatgctggccgagaggaagttcttcctgagccacccagcctaccgccacatcgctgacaggatgggcaccccccacctgcagaaggtgctgaaccagcagctgaccaaccacatccgggacaccctgcccaacttcaggaacaagctgcagggccagctgctgagcattgaacatgaggtggaggcctacaagaacttcaagccagaggaccccaccaggaagaccaaggccctgctgcagatggtgcagcagtttgctgtggactttgagaagagaattgagggcagcggggaccaggtggacaccctggagctgtctggaggagccaagatcaaccgcatcttccacgagcgcttcccctttgagatcgtgaagatggagttcaatgagaaggagctgcggcgggagatctcctatgccatcaagaacatccacggcatcagaacaggcctcttcaccccagacatggcctttgaggccatcgtgaagaagcagatcgtgaagctgaagggccccagcctgaagtctgtggacctggtgatccaggagctgatcaacacagtgaagaagtgcaccaagaagctggccaacttcccccggctgtgtgaggagacagaaagaattgtggccaaccacatccgggagcgggagggcaagaccaaggaccaggtgctgctgctgattgacatccaggtgtcctacatcaacaccaaccacgaggacttcatcggctttgccaatgcccagcagaggagcagccaggtgcacaagaagaccaccgtgggcaaccaggtgatcaggaagggctggctgaccatcagcaacatcggcatcatgaagggcggcagcaagggctactggtttgtgctgacagctgagagcctgtcctggtacaaggatgatgaggagaaggagaagaagtacatgctgcccctggacaacctgaaggtgagagatgtggagaagagcttcatgagcagcaagcacatctttgccctcttcaacacagagcagagaaatgtgtacaaggactaccgcttcctggagctggcctgtgacagccaggaggatgtggacagctggaaggccagcctgctgcgggccggcgtgtacccagacaagtctgtggctgaaaatgatgaaaatggccaggccgagaacttctccatggacccccagctggagcggcaggtggagaccatccggaacctggtggacagctacatgagcatcatcaacaagtgcatccgggacctgatccccaagaccatcatgcacctgatgatcaacaacgtgaaggacttcatcaacagcgagctgctggcccagctgtacagcagcgaggaccagaacaccctgatggaggagagcgctgagcaggcccagaggagagatgagatgctgaggatgtaccaggccctgaaggaggccctgggcatcatcggggacatcagcacagccaccgtgtccaccccagcccctcctcctgtggatgacagctggatccagcacagcagaagaagccccccacccagccccaccacccagaggcggcccaccctgagcgcccccctggcccggcccaccagcggccggggccctgccccagccatccccagccctggcccccacagcggggcccctcctgtgcccttccggcccggccccctgccccccttccccagcagcagtgacagctttggagccccaccccaggtgcccagccggcccacccgggccccacccagcgtgcccagccggcggcccccacccagccccacccggcccaccatcatccggcccctggagagcagcctgctggactag

SEQ ID NO: 19677 - DNA, 1761 bp, Artificial Sequence
  Description of Artificial Sequence: Synthetic coding sequence
tctgagagcctgagcagcgctgtgtttgtggagggcctgaagaggcagggcggctgtgcccggctggaggaggcctgcctgtctgaggccggggaggacctgactggagtgcgcttcagcctgcccgggaagaacttcccctgtggcagcagcagcagcagcagccgcagcaggaacagcagcagcagcaacagcagcagcagcagcagcaccaccaccaccaccaccagcagcagcggggcccaggacaggatgcctgtgctggagcgctacttccaccctgctgagctgggccgccgctggacaggccctgagggcgtgctgcccagcagccctggcagccggcccggctgccagcagggccccctgccctgggacctgcctgagatgatccgcatggtgaagctggtgtggaagagcaagtctgagctgcaggccaccaagcagaggggcatcctggacaatgaagatgccctgcgctccttccctggggacatccggctgcggggccagacaggagtgcgggcagagcggcggggcagctaccccttcatcgacttccggctgctgaacagcaccacctacagcggggagatcggcaccaagaagaaggtgaagaggctgctgtccttccagcgctacttccacgccagccggctgctgcggggcatcatcccccaggcccccctgcacctgctggatgaggactacctgggccaggcccggcacatgctgagcaaggtgggcatgtgggactttgacatcttcctgtttgaccggctgaccaatggaaacagcctggtgaccctgctgtgccacctgttcaacacccacggcctcatccaccacttcaagctggacatggtgaccctgcaccgcttcctggtgatggtgcaggaggactaccacagccagaacccctaccacaatgctgtgcacgccgcagatgtgacccaggccatgcactgctacctgaaggagcccaagctggccagcttcctgacccccctggacatcatgctgggcctgctggccgctgctgcccatgatgtggaccaccctggggtgaaccagcccttcctgatcaagaccaaccaccacctggccaacctgtaccagaacatgtctgtgctggagaaccaccactggaggagcaccatcggcatgctgcgggagagccggctgctggcccacctgcccaaggagatgacccaggacatcgagcagcagctgggcagcctcatcctggccacagacatcaaccggcagaatgagttcctgacccggctgaaggcccacctgcacaacaaggacctgcggctggaggatgcccaggacagacacttcatgctgcagatcgccctgaagtgtgccgacatctgcaacccctgccgcatctgggagatgagcaagcagtggagcgagcgggtgtgtgaggagttctaccggcagggcgagctggagcagaagtttgagctggagatcagccccctgtgcaaccagcagaaggacagcatccccagcatccagatcggcttcatgagctacatcgtggagcccctcttccgggagtgggcccacttcaccggcaacagcaccctgtctgagaacatgctgggccacctggcccacaacaaggcccagtggaagagcctgctgccccggcagcacaggagccggggcagcagcggcagcggccctgaccatgaccacgccggccagggcacagagagcgaggagcaggagggggacagcccctag

SEQ ID NO: 19678 - DNA, 525 bp, Artificial Sequence
  Description of Artificial Sequence: Synthetic coding sequence
atgaccaccaagaacctggagaccaaggtgacagtgaccagcagccccatcagaggagctggagatggcatggagacagaggagccccccaagtctgtggaggtgaccagcggcgtgcagagcaggaagcaccacagcctgcagagcccctggaagaaggctgtgcccagcgagagccctggggtgctgcagctgggcaagatgctgacagagaaggccatggaggtgaaggctgtgcgcatcctggtgcccaaggccgccatcacccatgacatccccaacaagaacaccaaggtgaagagcctgggccaccacaagggggagttcctgggccagagcgagggcgtgattgagcccaacaaggagctgtctgaggtgaagaatgtgctggagaagctgaagaacagcgagcggcggctgctgcaggacaaggagggcctgagcaaccagctgcgggtgcagacagaggtgcggcgggccctgattgacaagatgagcaccaccctgtatgtgtggaccttctag

SEQ ID NO: 19679 - DNA, 1203 bp, Artificial Sequence; identical to SEQ ID NO: 19075
  Description of Artificial Sequence: Synthetic coding sequence

SEQ ID NO: 19680 - DNA, 276 bp, Artificial Sequence
  Description of Artificial Sequence: Synthetic coding sequence
atggatgctgacagtgatgtggccctggacatcctgatcaccaacgtggtgtgtgtgttccgcacccgctgccacctgaacctgaggaagatcgccctggagggcgccaacgtcatctacaagagagatgtgggcaaggtgctgatgaagctgaggaagccccgcatcacagccaccatctggagcagcggcaagatcatctgcacaggagccaccagcgaggaggaggccaagtttggagcccggcggctggcccggagcctgcagaagctgtag

SEQ ID NO: 19681 - DNA, 492 bp, Artificial Sequence
  Description of Artificial Sequence: Synthetic coding sequence
atggatgctgacagtgatgtggccctggacatcctgatcaccaacgtggtgtgtgtgttccgcacccgctgccacctgaacctgaggaagatcgccctggagggcgccaacgtcatctacaagagagatgtgggcaaggtgctgatgaagctgaggaagccccgcatcacagccaccatctggagcagcggcaagatcatctgcacaggagccaccagcgaggaggaggccaagtttggagcccggcggctggcccggagcctgcagaagctgggcttccaggtgatcttcacagacttcaaggtggtgaatgtgctggccgtgtgcaacatgccctttgagatccggctgcctgagttcaccaagaacaaccggccccacgccagctatgagcctgagctgcaccctgctgtgtgctaccgcatcaagagcctgcgggccaccctgcagatcttcagcacaggcagcatcaccgtgacaggcatcctgtag

SEQ ID NO: 19682 - DNA, 1023 bp, Artificial Sequence
  Description of Artificial Sequence: Synthetic coding sequence
atgctggaggcccctggccccagtgatggctgtgagctgagcaaccccagcgccagccgggtgtcctgtgccggccagatgctggaggtgcagcccggcctgtactttggaggagctgctgctgtggccgagccagaccacctgcgggaggccggcatcacagctgtgctgactgtggacagcgaggagcccagcttcaaggccggccctggggtggaggacctgtggaggctgtttgtgcctgccctggacaagccagagacagacctgctgagccacctggacagatgtgtggccttcatcggccaggcccgggcagagggccgggctgtgctggtgcactgccacgccggcgtgagccgctctgtggccatcatcacagccttcctgatgaagacagaccagctgccctttgagaaggcctatgagaagctgcagatcctgaagccagaggccaagatgaatgaaggatttgagtggcagctgaagctgtaccaggccatgggctatgaggtggacaccagcagcgccatctacaagcagtaccgcctgcagaaggtgacagagaagtacccagagctgcagaacctgccccaggagctgtttgctgtggaccccaccaccgtgtcccagggcctgaaggatgaggtgctgtacaagtgcaggaaatgtagaagaagcctcttccgcagcagcagcatcctggaccaccgggagggcagcggccccatcgcctttgcccacaagaggatgacccccagctccatgctgaccaccggccggcaggcccagtgcaccagctacttcatcgagcctgtgcagtggatggagagcgccctgctgggcgtgatggatggccagctgctgtgccccaagtgcagcgccaagctgggcagcttcaactggtatggagagcagtgcagctgtggccgctggatcaccccagccttccagatccacaagaacagagtggatgagatgaagatcctgcctgtgctgggcagccagacaggcaagatctag

SEQ ID NO: 19683 - DNA, 807 bp, Artificial Sequence
  Description of Artificial Sequence: Synthetic coding sequence
atgtggcccctgacagccctgctgctgctggccaccctggagaagcccatcctgagcctgcaccccccctggaccaccatcttcaagggggagcgggtgaccctgaagtgtgatggctaccaccccctgctgctggagctgcagcccatcagcaccctgtggtacctgggccacctgctgctgcccagccacaagaagagcattgaggtgcagaccccaggagtgtaccgctgccagaccaggggggcccctgtgtctgaccccatccacctgtctgtgtccaatgactggctgatcctgcaggtgccctatgcccctgtgtttgaaggagagcccctggtgctgcgctgccggggctggtatgacaaggtggtgtacaagctgcactactaccatgatggccaggccgtgcgctacttccacagcagcgccaactacacagtgctgcaggcccgggccagtgacagcggccgctaccagtgcagcggcaccatgagaattcctgtggagagcgcccccatgttcagcgccaaggtggccgtgacagtgcaggaggcccggcatgctgctgctgtgcgggtgctgcaggtgcagcccaggggggcccccctgcggctgggccggcgggtgcacagccctggggcccggggccgcggggcccgcatcgtgctggtgcggggcggctaccgccacccccagtgcccagagacccagagcgtggccgccgcccctggggccggcttcagccctggccctggcctgcaccaccggcccagctccatgggccgcagcctgggctcctggtag

SEQ ID NO: 19684 - DNA, 936 bp, Artificial Sequence
  Description of Artificial Sequence: Synthetic coding sequence
atgtggcccctgacagccctgctgctgctggccaccctggagaagcccatcctgagcctgcaccccccctggaccaccatcttcaagggggagcgggtgaccctgaagtgtgatggctaccaccccctgctgctggagctgcagcccatcagcaccctgtggtacctgggccacctgctgctgcccagccacaagaagagcattgaggtgcagaccccaggagtgtaccgctgccagaccaggggggcccctgtgtctgaccccatccacctgtctgtgtccaatgactggctgatcctgcaggtgccctatgcccctgtgtttgaaggagagcccctggtgctgcgctgccggggctggtatgacaaggtggtgtacaagctgcactactaccatgatggccaggccgtgcgctacttccacagcagcgccaactacacagtgctgcaggcccgggccagtgacagcggccgctaccagtgcagcggcaccatgagaattcctgtggagagcgcccccatgttcagcgccaaggtggccgtgacagtgcaggccgcccgctgtgccgccagcactggagcccccagcacccagagccgcagccccaggagccgcagcagcaacagaactggagcccggcggctgcccccacctgctgtgtctggaaatgctgtgcggggctgcagcagccggggccgggtgctgccctggacccggcccccacctccaccccagctgcacggcccccagccctggctgctggtgattggccgcttccccagcgagagcccccgctgcccagacaggagccgctggagcccccccagcggcaccccacctcctcctggctgcagcagcagaagagctgccccccggctgcggggccaccccccagccctgcggcggcggccctggaacaaccggctggagccctag

SEQ ID NO: 19685 - DNA, 957 bp, Artificial Sequence
  Description of Artificial Sequence: Synthetic coding sequence
atgtggcccctgacagccctgctgctgctggtgcccagcagcggccaggccgccaccctggagaagcccatcctgagcctgcaccccccctggaccaccatcttcaagggggagcgggtgaccctgaagtgtgatggctaccaccccctgctgctggagctgcagcccatcagcaccctgtggtacctgggccacctgctgctgcccagccacaagaagagcattgaggtgcagaccccaggagtgtaccgctgccagaccaggggggcccctgtgtctgaccccatccacctgtctgtgtccaatgactggctgatcctgcaggtgccctatgcccctgtgtttgaaggagagcccctggtgctgcgctgccggggctggtatgacaaggtggtgtacaagctgcactactaccatgatggccaggccgtgcgctacttccacagcagcgccaactacacagtgctgcaggcccgggccagtgacagcggccgctaccagtgcagcggcaccatgagaattcctgtggagagcgcccccatgttttctgccaaggtggccgtgacagtgcaggccgcccgctgtgccgccagcactggagcccccagcacccagagccgcagccccaggagccgcagcagcaacagaactggagcccggcggctgcccccacctgctgtgtctggaaatgctgtgcggggctgcagcagccggggccgggtgctgccctggaccaggcctcctcctccaccccagctgcacggcccccagccctggctgctggtgattggccgcttccccagcgagagcccccgctgcccagacaggagccgctggagccccccatctggcaccccacctcctcctggctgcagcagccggcgggccgccccccggctgcggggccaccccccagccctgcggcggcggccctggaacaaccggctggagccctag

SEQ ID NO: 19686 - DNA, 1281 bp, Artificial Sequence
  Description of Artificial Sequence: Synthetic coding sequence
atgtggcccctgacagccctgctgctgctggtgcccagcagcggccaggccgccaccctggagaagcccatcctgagcctgcaccccccctggaccaccatcttcaagggggagcgggtgaccctgaagtgtgatggctaccaccccctgctgctggagctgcagcccatcagcaccctgtggtacctgggccacctgctgctgcccagccacaagaagagcattgaggtgcagaccccaggagtgtaccgctgccagaccaggggggcccctgtgtctgaccccatccacctgtctgtgtccaatgactggctgatcctgcaggtgccctatgcccctgtgtttgaaggagagcccctggtgctgcgctgccggggctggtatgacaaggtggtgtacaagctgcactactaccatgatggccaggccgtgcgctacttccacagcagcgccaactacacagtgctgcaggcccgggccagtgacagcggccgctaccagtgcagcggcaccatgagaattcctgtggagagcgcccccatgttttctgccaaggtggccgtgacagtgcaggagctgttccgggcccctgtgctgcgggtgatgggcccccgggaggcccggggggccgccctgggcggcgtggtgctgcgctgtgacacccggctgcacccccagaagagggacacccccctgcagtttgccttctacaagtacagcagagctgtgagaagatttgactggggcgctgagtacacagtgcctgagcctgaggtggaggagctggagagctactggtgtgaggccgccacagccaccaggtctgtgaggaagaggagcccctggctgcagctgcccggccctggcagccccctggaccctgccagcaccacagccccagccccctgggccgccgccctggcccctggcaaccggcccctgtccttcaggaagccccctgtgagccgctctgtgcccctggtgacctctgtgaggaacaccaccagcacaggcctgcagtttcctgccagcggggcccccacagctggccccccagcctgtgccccacccacccccctggagcagagcgctggggccctgaagccagatgtggacctgctgctgcgggagatgcagctgctgaagggcctgctgagccgggtggtgctggagctgaaggagccccaggccctgcgggagctgcggggcaccccagagacccccaccagccactttgctgtgtccccaggcaccccagagaccacccctgtggagagctag

SEQ ID NO: 19687 - DNA, 369 bp, Artificial Sequence
  Description of Artificial Sequence: Synthetic coding sequence
atggccggcggctgccgggcccccagcagcgcccccaccgtgtccctgcctgagctgcggagcctgctggccagcggccgggcccggctgtttgatgtgcgcagccgggaggaggccgctgctggcaccatccctggggccctgaacatccctgtgtctgagctggagagcgccctgcagatggagcctgctgccttccaggccctgtacagcgctgagaagcccaagctggaggatgagcacctggtgttcttctgccagatgggcaagaggggcctgcaggccacccagctggcccggagcctgggctacacaggagccaggaactatgctggggcctaccgggagtggctggagaaggagagctag

SEQ ID NO: 19688 - DNA, 225 bp, Artificial Sequence
  Description of Artificial Sequence: Synthetic coding sequence
atggccggcgtgtctgagctggagagcgccctgcagatggagcctgctgccttccaggccctgtacagcgctgagaagcccaagctggaggatgagcacctggtgttcttctgccagatgggcaagaggggcctgcaggccacccagctggcccggagcctgggctacacaggagccaggaactatgctggggcctaccgggagtggctggagaaggagagctag

SEQ ID NO: 19689 - DNA, 1794 bp, Artificial Sequence; identical to SEQ ID NO: 19042
  Description of Artificial Sequence: Synthetic coding sequence

SEQ ID NO: 19690 - DNA, 1794 bp, Artificial Sequence; identical to SEQ ID NO: 19042
  Description of Artificial Sequence: Synthetic coding sequence

SEQ ID NO: 19691 - DNA, 453 bp, Artificial Sequence
  Description of Artificial Sequence: Synthetic coding sequence
atgggcgtgcagccccccaacttctcctgggtgctgcccggccgcctggccggcctggccctgccccggctgcctgcccactaccagttcctgctggacctgggcgtgcgccacctggtgtccctgacagagcggggccccccccacagcgacagctgccccggcctgaccctgcaccggctgcgcatcccagacttctgccccccagccccagaccagattgacagatttgtgcagatcgtggatgaggccaatgcccggggggaggccgtgggcgtgcactgtgccctgggctttggaagaacaggcaccatgctggcctgctacctggtgaaggagcggggcctggccgctggagatgccatcgccgagatccggcggctgcggcccggcagcattgagacctatgagcaggagaaggctgtgttccagttctaccagaggaccaagtag

SEQ ID NO: 19692 - DNA, 453 bp, Artificial Sequence; identical to SEQ ID NO: 19691
  Description of Artificial Sequence: Synthetic coding sequence

SEQ ID NO: 19693 - DNA, 453 bp, Artificial Sequence; identical to SEQ ID NO: 19691
  Description of Artificial Sequence: Synthetic coding sequence

SEQ ID NO: 19694 - DNA, 4866 bp, Artificial Sequence
  Description of Artificial Sequence: Synthetic coding sequence
atggagggctgcatgggagaggagagcttccagatgtgggagctgaacagaaggctggaggcctacctggcccgggtgaaggccctggaggagcagaatgagctgctgtctgctgagctgggcggcctgcgggcccagagcgctgacacctcctggagggcccacgcagatgatgagctggccgccctgcgggccctggtggaccagcgctggagggagaagcacgccgctgaggtggcccgggacaacctggccgaggagctggagggcgtggccggccgctgccagcagctgcggctggcccgggagaggaccacagaggaggtggccaggaacagaagagctgtggaggccgagaagtgtgcccgggcctggctgagcagccaggtggccgagctggagcgggagctggaggccctgcgggtggcccacgaggaggagcgggtgggcctgaatgcccaggccgcctgtgccccccgctgcccagccccaccccggggccccccagccccagcccctgaggtggaggagctggcccggcggctgggggaggcctggagaggagctgtgcggggctaccaggagcgggtggcccacatggagaccagcctgggccaggcccgggagcggctgggccgggctgtgcagggcgcccgggagggccgcctggagctgcagcagctgcaggccgagcggggcggcctgctggagcggcgggccgccctggagcagaggctggagggccgctggcaggagcggctgcgggccacagagaagttccagctggccgtggaggccctggagcaggagaagcagggcctgcagagccagatcgcccaggtgctggagggccggcagcagctggcccacctgaagatgagcctgagcctggaggtggccacctaccgcaccctgctggaggccgagaacagccggctgcagacccctgggggcggcagcaagaccagcctgtccttccaggaccccaagctggagctgcagttccccaggaccccagagggccggcggctgggcagcctgctgcctgtgctgagccccaccagcctgcccagccccctgcctgccaccctggagacccctgtgcctgccttcctgaagaaccaggagttcctgcaggcccggacccccaccctggccagcacccccatcccccccaccccccaggcccccagccctgctgtggatgctgagatccgggcccaggatgcccccctgagcctgctgcagacccagggcggcaggaagcaggcccctgagcccctgcgggcagaggcccgggtggccatcccagcctctgtgctgcccggccctgaggagcccggcggccagaggcaggaggccagcacaggccagagcccagaagatcatgccagcctggccccacccctgagcccagaccacagcagcctggaggccaaggatggagagagcggcggcagcagggtcttcagcatctgccgcggggagggggagggccagatctggggcctggtggagaaggagacagccatcgagggcaaggtggtgagcagcctgcagcaggagatctgggaggaggaggacctgaacaggaaggagatccaggacagccaggtgcccctggagaaggagaccctgaagagcctgggggaggagatccaggagagcctgaagaccctggagaaccagagccatgagaccctggagcgggagaaccaggagtgccccaggagcctggaggaggacctggagaccctgaagagcctggagaaggagaacaaggagctgctgaaggatgtggaggtggtgcggcccctggagaaggaggccgtgggccagctgaagcccaccgggaaggaggacacccagaccctgcagagcctgcagaaggagaaccaggagctgatgaagagcctggagggcaacctggagaccttcctgtttcctggaacagagaaccaggagctggtgagcagcctgcaggagaacctggagagcctgacagccctggagaaggagaaccaggagcccctgcggagccctgaggtgggagatgaggaggccctgcggcccctgaccaaggagaaccaggagcccctgcggagcctggaggatgagaacaaggaggccttccgcagcctggagaaggagaaccaggagcccctgaagaccctggaggaggaggaccagagcatcgtgcggcccctggagacagagaaccacaagagcctgcggagcctggaggagcaggaccaggagaccctgcggaccctggagaaggagacccagcagaggcggcgcagcctgggggagcaggaccagatgaccctgcggcccccagagaaggtggacctggagcccctgaagagcctggaccaggagatcgcccggcccctggagaatgaaaaccaggagttcctgaagagcctgaaggaggagagcgtggaggccgtgaagagcctggagacagagatcctggagagcctgaagtctgctggccaggagaacctggagaccctgaagagccctgagacccaggcccccctgtggaccccagaggagatcaaccagggcgccatgaaccccctggagaaggagatccaggagcccctggagagcgtggaggtgaaccaggagaccttccggctgctggaggaggagaaccaggagagcctgcggagcctgggcgcctggaacctggagaacctgcggagccctgaggaggtggacaaggagagccagaggaacctggaggaggaggagaacctgggcaaaggagagtaccaggagagcctgcggagcctggaggaggagggccaggagctgccccagagcgcagatgtgcagcgctgggaggacacagtggagaaggaccaggagctggcccaggagagccccccaggcatggccggcgtggagaatgaagatgaggccgagctgaacctgcgggagcaggacggcttcaccgggaaggaggaggtggtggagcagggcgagctgaatgccacagaggaggtgtggatccctggagagggccaccctgagagccctgagcccaaggagcagaggggcctggtggagggcgcctctgtgaagggcggcgctgagggcctgcaggaccctgagggccagagccagcaggtgggcgcccctggcctgcaggccccccagggcctgcctgaggccatcgagcccctggtggaggatgatgtggcccctggaggagaccaggccagccctgaggtgatgctgggcagcgagcccgccatgggagagagcgctgctggagctgagcccggccctggccagggcgtgggcggcctgggggaccccggccacctgacccgggaggaggtgatggagccccccctggaggaggagagcctggaggccaagagggtgcagggcctggagggccccaggaaggacctggaggaggccggcggcctgggcacagagttcagcgagctgcccgggaagagccgggacccctgggagcccccccgggagggccgggaggagagcgaggccgaggcccccagaggagctgaggaggccttccctgctgagaccctgggccacactggaagtgatgcccccagcccctggcccctgggcagcgaggaggccgaggaggatgtgccccctgtgctggtgagccccagccccacctacacccccatcctggaggatgcccctggcccccagccccaggccgagggcagccaggaggcctcctggggcgtgcagggccgggcagaggccctgggcaaggtggagagcgagcaggaggagctgggcagcggggagatccctgagggcccccaggaggagggggaggagagccgggaggagagcgaggaggatgagctgggggagaccctgcctgacagcacccccctgggcttctacctgcggagccccaccagcccccgctgggaccccaccggggagcagaggcccccaccccagggcgagaccgggaaggagggctgggaccctgctgtgctggccagcgagggcctggaggcccctccttctgagaaggaggagggggaggagggggaggaggagtgtggccgggacagcgacctgtctgaggagtttgaggacctgggcacagaggcccccttcctgcccggggtgcctggagaggtggccgagcccctgggccaggtgccccagctgctgctggaccctgctgcctgggacagagatggagagagtgatggctttgctgatgaggaggagagcggggaggagggggaggaggaccaggaggagggccgggagcccggggccggccgctggggccctggcagctctgtgggcagcctgcaggccctgagcagcagccagagaggagagttcctggagagtgacagcgtgtctgtgtctgtgccctgggatgacagcctgcggggagctgtggccggggcccccaagacagccctggagacagagagccaggacagcgctgagcccagcggcagcgaggaggagagtgaccctgtgtccctggagcgggaggacaaggtgcccggccccctggagatccccagcggcatggaggatgctggccctggagctgacatcattggagtgaatggccagggccccaacctggagggcaagagccagcacgtgaatggaggagtgatgaatggcctggagcagagcgaggaggtgggccagggcatgcccctggtgtctgagggggaccggggcagccccttccaggaggaggagggcagcgccctgaagacctcctgggccggggcccctgtgcacctgggccagggccagttcctgaagttcacccagcgggagggggaccgggagagctggagcagcggggaggactag

SEQ ID NO: 19695 - DNA, 378 bp, Artificial Sequence
  Description of Artificial Sequence: Synthetic coding sequence
atggagcggcacaccagccaccccaacaggaaggtgcctgccaaggaggaggccaatgctgtgcccctgtgccgggccaagcccagccccagctacatcaacctgcaggccagcagccccccagccaccttcctgaacatccagaccaccaagctgcccagcgtggaccacaagcccaaggaatgtctgggcctgctggagtgcatgtatgccaacctgcagctgcagacccagctggcccagcagcagatggctgtgctggagcacctgcaggcctctgtgacccagctggcccctggccggggcagcaacaacagcagcctgcctgccctgagccccaaccccctgctgaaccacctgccccagttcagcaagtag

SEQ ID NO: 19696 - DNA, 378 bp, Artificial Sequence; identical to SEQ ID NO: 19695
  Description of Artificial Sequence: Synthetic coding sequence

SEQ ID NO: 19697 - DNA, 378 bp, Artificial Sequence; identical to SEQ ID NO: 19695
  Description of Artificial Sequence: Synthetic coding sequence

SEQ ID NO: 19698 - DNA, 378 bp, Artificial Sequence; identical to SEQ ID NO: 19695
  Description of Artificial Sequence: Synthetic coding sequence

SEQ ID NO: 19699 - DNA, 378 bp, Artificial Sequence; identical to SEQ ID NO: 19695
  Description of Artificial Sequence: Synthetic coding sequence

SEQ ID NO: 19700 - DNA, 624 bp, Artificial Sequence
  Description of Artificial Sequence: Synthetic coding sequence
atggccgaggccagcagcgccaacctgggcagcggctgtgaggagaagagacatgagggcagcagcagcgagagcgtgcccccaggcaccaccatcagccgggtgaagctgctggacaccatggtggacaccttcctgcagaagctggtggccgccggcagcagccccctgctgcactgggatggcagcgctggcccccggctgcccagcggcggccagagcgtgaagcaggccttctcctgggccgcctgccgcctgccccagggcaggaaggaggagatcagtgacatcaaggaggagggcaacctggaggccgtgctgaatgccctggacaagatcgtggaggagggcaaggtgaggaaggagcccgcctggaggcccagcggcatccctgagaaggacctgcacagcgtgatggccccctacttcctgcagcagagggacaccctgcggagacatgtgcagaagcaggaggccgagaaccagcagctggctgatgctgtgctggccggccggcggcaggtggaggagctgcagctgcaggtgcaggcccagcagcaggcctggcaggccctgcaccgggagcagcgggagctggtggccgtgctgcgggagcctgagtag

SEQ ID NO: 19701 - DNA, 618 bp, Artificial Sequence
  Description of Artificial Sequence: Synthetic coding sequence
atggccgaggccagcagcgccaacctgggcagcggctgtgaggagaagagacatgagggcagcagcagcgagagcgtgcccccaggcaccaccatcagccgggtgaagctgctggacaccatggtggacaccttcctgcagaagctggtggccgccggcagctaccagcgcttcacagactgctacaagtgcttctaccagctgcagcctgccatgacccagcagatctatgacaagttcatcgcccagctgcagaccagcatccgggaggagatcagtgacatcaaggaggagggcaacctggaggccgtgctgaatgccctggacaagatcgtggaggagggcaaggtgaggaaggagcccgcctggaggcccagcggcatccctgagaaggacctgcacagcgtgatggccccctacttcctgcagcagagggacaccctgcggagacatgtgcagaagcaggaggccgagaaccagcagctggctgatgctgtgctggccggccggcggcaggtggaggagctgcagctgcaggtgcaggcccagcagcaggcctggcaggccctgcaccgggagcagcgggagctggtggccgtgctgcgggagcctgagtag

SEQ ID NO: 19702 - DNA, 543 bp, Artificial Sequence
  Description of Artificial Sequence: Synthetic coding sequence
atggccgaggccagcagcgccaacctgggcagcggctgtgaggagaagagacatgagggcagcagcagcgagagcgtgcccccaggcaccaccatcagccgggtgaagctgctggacaccatggtggacaccttcctgcagaagctggtggccgccggcagctaccagcgcttcacagactgctacaagtgcttctaccagctgcagcctgccatgacccagcagatctatgacaagttcatcgcccagctgcagaccagcatccgggaggagatcagtgacatcaaggaggagggcaacctggaggccgtgctgaatgccctggacaagatcgtggaggagggcaaggtgaggaaggagcccgcctgcaatggcaccccctgtggggccatgtgcaggaacagaagacccaggaccagctcctggcagatgcccagctggcagggcggcggccgctggaggagctgcagctaccgcagccggcccagcagccggcccggccgcctgtacacagagaacagaggctcctggctgctgtgctag

SEQ ID NO: 19703 - DNA, 2253 bp, Artificial Sequence; identical to SEQ ID NO: 19350
  Description of Artificial Sequence: Synthetic coding sequence

SEQ ID NO: 19704 - DNA, 2667 bp, Artificial Sequence
  Description of Artificial Sequence: Synthetic coding sequence
atggccggcgtgggccgcagcggcggcccctggggccgcacccggggcggccgcagcggccgcctgggcgtgtccctgggcgccctgagcagcctgcccctggaggagctgccccggcccctgtgctgccgccgctgcagaagacacttcggctttgccctgcggggggagaccatccctgtgtctgtggccggcagcgccagcagccagtttgcccccctggccctgcacctgagcctgctgctgagccgcatcagcgccagccggctgacccgctggcccccaccagacaagcgggagggcagcgctgtggaccccgggaagagaagaagcctggccgccacccccagcagcagcctgccctgcaccctgattgccctgggcctgcggcatgagaaggaggccaatgagctgatggaggacctgtttgagaccttccaggatgagatgggcttcagcaacatggaggatgatggccctgaggaggaggagcgggtggccgagccccaggccaacttcaacaccccccaggccctgcgctttgaggagctgctggccaacctgctgaatgagcagcaccagatcgccaaggagctgtttgagcagctgaagatgaagaagcccagcgccaagcagcagaaggaggtggagaaggtgaagccccagtgcaaggaggtgcaccagaccctcatcctggaccctgcccagaggaagaggctgcagcagcagatgcagcagcacgtgcagctgctgacccagatccacctgctggccacctgcaaccccaacctgaaccctgaggccagcagcacccgcatctgcctgaaggagctgggcacctttgcccagagcagcatcgccctgcaccaccagtacaaccccaagttccagaccctcttccagccctgcaacctgatgggcgccatgcagctgattgaggacttcagcacccacgtgtccattgactgcagcccccacaagacagtgaagaagacagccaatgagttcccctgcctgcccaagcaggtggcctggatcctggccaccagcaaggtgttcatgtacccagagctgctgcctgtgtgcagcctgaaggccaagaacccccaggacaagatcctcttcaccaaggccgaggacaacctgctggccctgggcctgaagcactttgagggcacagagttcctgaaccccctcatcagcaagtacctgctgacctgcaagacagcccggcagctgactgtgcgcatcaagaacctgaacatgaacagagccccagacaacatcatcaagttctacaagaagaccaagcagctgcctgtgctgggcaagtgctgtgaggagatccagccccaccagtggaagccacccatcgagcgggaggagcaccggctgcccttctggctgaaggccagcctgcccagcatccaggaggagctgcggcacatggctgatggagcccgggaggtgggcaacatgacaggcaccacagagatcaacagcgaccagggcctggagaaggacaacagcgagctgggcagcgagacccgctaccccctgctgctgcccaagggcgtggtgctgaagctgaagcctgtggccgaccgcttccccaagaaggcctggaggcagaagaggagctctgtgctgaagcccctgctgatccagcccagccccagcctgcagcccagcttcaaccctgggaagaccccagcccagagcacccacagcgaggccccacccagcaagatggtgctgcgcatcccccaccccatccagcctgccaccgtgctgcagacagtgcctggggtgccccccctgggcgtgtctggaggagagagctttgagagccctgctgccctgcctgccatgcctcctgaggcccggaccagcttccccctgtctgagagccagaccctgctgagcagcgcccctgtgcccaaggtgatgatgcccagccctgccagctccatgttcaggaagccctacgtgagaagaagacccagcaagagaagaggagcccgggccttccgctgcatcaagccagcccctgtgatccacccagccagcgtcatcttcaccgtgcctgccaccaccgtgaagatcgtgtccctgggcggcggctgcaacatgatccagcctgtgaatgctgctgtggcccagagcccccagaccatccccatcgccaccctgctggtgaaccccaccagcttcccctgccccctgaaccagcccctggtggccagctctgtgagccccctgattgtgtctggcaacagcgtgaacctgcccatccccagcaccccagaggacaaggcccacatgaatgtggacatcgcctgtgctgtggctgatggagaaaatgccttccagggcctggagcccaagctggagccccaggagctgagccccctgagcgccaccgtcttccccaaggtggagcacagccctggccccccacctgtggacaagcagtgccaggagggcctgtctgagaacagcgcctaccgctggacagtggtgaagacagaggagggccggcaggccctggagcccctgccccagggcatccaggagagcctgaacaacagcagccctggggacctggaggaggtggtgaagatggagccagaagatgccacagaggagatcagcggcttcctgtag

SEQ ID NO: 19705 - DNA, 2607 bp, Artificial Sequence
  Description of Artificial Sequence: Synthetic coding sequence
atggccggcgtgggccgcagcggcggcccctggggccgcacccggggcggccgcagcggccgcctgggcgtgtccctgggcgccctgagcagcctgcccctggaggagctgccccggcccctgtgctgccgccgctgcagaagacacttcggctttgccctgcggggggagaccatccctgtgtctgtggccggcagcgccagcagccagtttgcccccctggccctgcacctgagcctgctgctgagccgcatcagcgccagccggctgacccgctggcccccaccagacaagcgggagggcagcgctgtggaccccgggaagagaagaagcctggccgccacccccagcagcagcctgccctgcaccctgattgccctgggcctgcggcatgagaaggaggccaatgagctgatggaggacctgtttgagaccttccaggatgagatgggcttcagcaacatggaggatgatggccctgaggaggaggagcgggtggccgagccccaggccaacttcaacaccccccaggccctgcgctttgaggagctgctggccaacctgctgaatgagcagcaccagatcgccaaggagctgtttgagcagctgaagatgaagaagcccagcgccaagcagcagaaggaggtggagaaggtgaagccccagtgcaaggaggtgcaccagaccctcatcctggaccctgcccagaggaagaggctgcagcagcagatgcagcagcacgtgcagctgctgacccagatccacctgctggccacctgcaaccccaacctgaaccctgaggccagcagcacccgcatctgcctgaaggagctgggcacctttgcccagagcagcatcgccctgcaccaccagtacaaccccaagttccagaccctcttccagccctgcaacctgatgggcgccatgcagctgattgaggacttcagcacccacgtgtccattgactgcagcccccacaagacagtgaagaagacagccaatgagttcccctgcctgcccaagcaggtggcctggatcctggccaccagcaaggtgttcatgtacccagagctgctgcctgtgtgcagcctgaaggccaagaacccccaggacaagatcctcttcaccaaggccgaggacaacaagtacctgctgacctgcaagacagcccggcagctgactgtgcgcatcaagaacctgaacatgaacagagccccagacaacatcatcaagttctacaagaagaccaagcagctgcctgtgctgggcaagtgctgtgaggagatccagccccaccagtggaagccacccatcgagcgggaggagcaccggctgcccttctggctgaaggccagcctgcccagcatccaggaggagctgcggcacatggctgatggagcccgggaggtgggcaacatgacaggcaccacagagatcaacagcgaccagggcctggagaaggacaacagcgagctgggcagcgagacccgctaccccctgctgctgcccaagggcgtggtgctgaagctgaagcctgtggccgaccgcttccccaagaaggcctggaggcagaagaggagctctgtgctgaagcccctgctgatccagcccagccccagcctgcagcccagcttcaaccctgggaagaccccagcccagagcacccacagcgaggccccacccagcaagatggtgctgcgcatcccccaccccatccagcctgccaccgtgctgcagacagtgcctggggtgccccccctgggcgtgtctggaggagagagctttgagagccctgctgccctgcctgccatgcctcctgaggcccggaccagcttccccctgtctgagagccagaccctgctgagcagcgcccctgtgcccaaggtgatgatgcccagccctgccagctccatgttcaggaagccctacgtgagaagaagacccagcaagagaagaggagcccgggccttccgctgcatcaagccagcccctgtgatccacccagccagcgtcatcttcaccgtgcctgccaccaccgtgaagatcgtgtccctgggcggcggctgcaacatgatccagcctgtgaatgctgctgtggcccagagcccccagaccatccccatcgccaccctgctggtgaaccccaccagcttcccctgccccctgaaccagcccctggtggccagctctgtgagccccctgattgtgtctggcaacagcgtgaacctgcccatccccagcaccccagaggacaaggcccacatgaatgtggacatcgcctgtgctgtggctgatggagaaaatgccttccagggcctggagcccaagctggagccccaggagctgagccccctgagcgccaccgtcttccccaaggtggagcacagccctggccccccacctgtggacaagcagtgccaggagggcctgtctgagaacagcgcctaccgctggacagtggtgaagacagaggagggccggcaggccctggagcccctgccccagggcatccaggagagcctgaacaacagcagccctggggacctggaggaggtggtgaagatggagccagaagatgccacagaggagatcagcggcttcctgtag

SEQ ID NO: 19706 - DNA, 1575 bp, Artificial Sequence
  Description of Artificial Sequence: Synthetic coding sequence
atggccggcggggcccgggaggtgctgaccctgcagctgggccactttgctggctttgtgggcgcccactggtggaaccagcaggatgctgccctgggccgggccacagacagcaaggagcccccaggagagctgtgcccagatgtgctgtacagaactggaagaaccctgcacggccaggagacctacacccccaggctcatcctgatggacctgaagggcagcctgagcagcctgaaggaggagggcggcctgtacagagacaagcagctggatgctgccatcgcctggcagggcaagctgaccacccacaagggcagcagccccctgcccacagccaccacccccaagcccctcatccccacagaggccagcatccgggtgtggagcgacttcctgcgggtgcacctgcaccccaggagcatctgcatgatccagaagtacaaccatgatggagaggccggccgcctggaggccttcggccagggcgagagcgtgctgaaggagcccaagtaccaggaggagctggaggaccggctgcacttctacgtggaggagtgtgactacctgcagggcttccagatcctgtgtgacctgcatgatggcttcagcggcgtgggcgccaaggctgctgagctgctgcaggatgagtacagcggccggggcatcatcacctggggcctgctgcccggcccctaccacagaggagaggcccagaggaacatctaccgcctgctgaacacagccttcggcctggtgcacctgacagcccacagcagcctggtgtgccccctgagcctgggcggcagcctgggcctgcggcctgagccccctgtgtccttcccctacctgcactatgatgccaccctgcccttccactgcagcgccatcctggccacagccctggacacagtgacagtgccctaccgcctgtgcagcagccctgtgtccatggtgcacctggccgacatgctgtccttctgtgggaagaaggtggtgacagctggggccatcatccccttccccctggcccctggccagagcctgcctgacagcctgatgcagtttggaggagccaccccctggacccccctgagcgcctgtggggagcccagcggcacccgctgctttgcccagagcgtggtgctgcggggcatcgaccgggcctgccacaccagccagctgaccccaggcaccccacctccttctgccctgcacgcctgcaccaccggggaggagatcctggcccagtacctgcagcagcagcagcccggggtgatgagcagcagccacctgctgctgaccccctgccgggtggccccaccctacccccacctgttcagcagctgcagccccccagctgtggagagcatccctgtgtttggagccctgtgcagcagcagcagcctgcaccagaccctggaggccctggcccgggacctgaccaagctggacctgcggcgctgggccagcttcatggatgctggggtggagcatgatgatgtggccgagctgctgcaggagctgcagagcctggcccagtgctaccagggcggggacagcctggtggactag

SEQ ID NO: 19707 - DNA, 1479 bp, Artificial Sequence
  Description of Artificial Sequence: Synthetic coding sequence
atgccacccacctgcagccctggcctgcggcggcaggactgggcccctggccgctgtgccggcctgcacctgcccccccgggcccccagcagccctgccctgcaggccctggccggccaggccggcgtgcgcagctcctggagctttgctggggtgcctggggcccagaggctgtggatggccgaggcccagagcggcaccggccagctgcaggagcagaagaagggcctgctgattgctgtgtctgtgtctgtggacaagatcatcagccactttggagctgccaggaacctggtgcagaaggcccagctgggggacagccggctgagcccagatgtgggccacctggtgctgaccaccctgtgcccagccctgcacgccctggtggctgatggcctgaagcccttcaggaaggacctgatcaccggccagaggaggagcagcccctggagcgtggtggaggcctctgtgaagccaggcagcagcaccaggagcctgggcaccctgtacagccaggtgtcccggctggcccccctgagcagcagccgcagccgcttccacgccttcatcctgggcctgctgaacaccaagcagctggagctgtggttcagcagcctgcaggaggatgctggcctgctgagcctgctgtacctgcccaccggcttcttcagcctggcccggggcggctgccccagcctgagcacagagctgctgctgctgctgcagcccctgtctgtgctgaccttccacctggacctgctgtttgagcaccaccaccacctgcccctgggccccccccaggccccagcccctcctggccccccaccagccctgcagcagaccatgcaggccatgctgcactttggaggccgcctggcccagagcctgcggggcaccagcaaggaggccgccagtgaccccagcgacagccccaacctgcccaccccaggctcctggtgggagcagctgacccaggccagccgggtgtatgccagcggcggcacagagggcttccccctgagccgctgggcccctggccgccacggcacagctgctgaggagggcgcccaggagcggcccctgcccacagatgagatggcccctggccggggcctgtggctgggccgcctgtttggagtgcctgggggccctgcagaaaatgaaaatggagccctgaagagcagaagacccagctcctggctgccccccaccgtgtctgtgctggccctggtgaagagaggagcccctcctgagatgcccagcccccaggagctggaggccagcgcccccaggatggtgcagacccacagagctgtgcgggccctgtgtgaccacacagctgcccggccagaccagctgtccttccggcggggggaggtgctgcgggtcatcaccaccgtggatgaggactggctgcgctgtggcagagatggcatggagggcctggtgcctgtgggctacaccagcctggtgctgtag

SEQ ID NO: 19708 - DNA, 1302 bp, Artificial Sequence; identical to SEQ ID NO: 18678
  Description of Artificial Sequence: Synthetic coding sequence

SEQ ID NO: 19709 - DNA, 2709 bp, Artificial Sequence
  Description of Artificial Sequence: Synthetic coding sequence
atgctgagcccccagagggccctgctgtgcaacctgaaccacatccacctgcagcacgtgtccctgggcctgcacctgagccggcggcctgagctgcaggagggccccctgagcaccccacctcctcctggggacaccggcggcaaggagagccggggcccctgcagcggcaccctggtggatgccaacagcaacagccctgctgtgccctgccgctgctgccaggagcacggccctggcctggagaaccggcaggaccccagccaggaggaggagggcgccgccagccccagcgaccccggctgcagcagcagcctgagcagctgcagcgacctgagcccagatgagagccctgtgtctgtgtacctgcgggacctgcctggagatgaagatgcccacccccagcccagcatcatccccctggagcagggcagccccctggccagcgctggccctggcacctgcagcccagacagcttctgctgcagcccagacagctgcagcggggccagcagcagcccagaccccggcctggacagcaactgcaatgccctgaccacctgccaggatgtgcccagccctggcctggaggaggaggatgaaagagctgagcaggacctgcccaccagcgagctgctggaggctgatgatggcaagattgatgctgggaagacagagcccagctggaagatcaaccccatctggaagattgacacagagaagaccaaggccgagtggaagaccacagagaacaacaacacaggctggaagaacaatggaaatgtgaacagctcctggaagtctgagcctgagaagtttgattctggctggaagaccaacacccgcatcacagacagcggcagcaagacagatgctgggaagattgatggcggctggaggagtgatgtgtctgaggagcctgtgccccacaggaccatcaccagcttccacgagctggcccagaagaggaagaggggccctggcctgcccctggtgccccaggccaagaaggacagaagtgactggctgattgtgttctccccagacacagagctgcccccatctggcagccctgggggcagcagcgccccaccccgggaggtgaccaccttcaaggagctgcggagccgcagccgggccccagcccctcctgtgcccccccgggacccccctgtgggctgggccctggtgccccccaggcctcctcctcctcctgtgccccccaggaggaagaagaacagacctggcctgcagcccatcgccgagggccagagcgaggagggccgggctgtgtccccagctgctggggaggaggccccagctgccaaggagcccggggcccaggccggcctggaggtgcgcagctcctggagctttgctggggtgcctggggcccagaggctgtggatggccgaggcccagagcggcaccggccagctgcaggagcagaagaagggcctgctgattgctgtgtctgtgtctgtggacaagatcatcagccactttggagctgccaggaacctggtgcagaaggcccagctgggggacagccggctgagcccagatgtgggccacctggtgctgaccaccctgtgcccagccctgcacgccctggtggctgatggcctgaagcccttcaggaaggacctgatcaccggccagaggaggagcagcccctggagcgtggtggaggcctctgtgaagccaggcagcagcaccaggagcctgggcaccctgtacagccaggtgtcccggctggcccccctgagcagcagccgcagccgcttccacgccttcatcctgggcctgctgaacaccaagcagctggagctgtggttcagcagcctgcaggaggatgctggcctgctgagcctgctgtacctgcccaccggcttcttcagcctggcccggggcggctgccccagcctgagcacagagctgctgctgctgctgcagcccctgtctgtgctgaccttccacctggacctgctgtttgagcaccaccaccacctgcccctgggccccccccaggccccagcccctcctggccccccaccagccctgcagcagaccatgcaggccatgctgcactttggaggccgcctggcccagagcctgcggggcaccagcaaggaggccgccagtgaccccagcgacagccccaacctgcccaccccaggctcctggtgggagcagctgacccaggccagccgggtgtatgccagcggcggcacagagggcttccccctgagccgctgggcccctggccgccacggcacagctgctgaggagggcgcccaggagcggcccctgcccacagatgagatggcccctggccggggcctgtggctgggccgcctgtttggagtgcctgggggccctgcagaaaatgaaaatggagccctgaagagcagaagacccagctcctggctgccccccaccgtgtctgtgctggccctggtgaagagaggagcccctcctgagatgcccagcccccaggagctggaggccagcgcccccaggatggtgcagacccacagagctgtgcgggccctgtgtgaccacacagctgcccggccagaccagctgtccttccggcggggggaggtgctgcgggtcatcaccaccgtggatgaggactggctgcgctgtggcagagatggcatggagggcctggtgcctgtgggctacaccagcctggtgctgtag

SEQ ID NO: 19710 - DNA, 2391 bp, Artificial Sequence
  Description of Artificial Sequence: Synthetic coding sequence
atgctgagcccccagagggccctgctgtgcaacctgaaccacatccacctgcagcacgtgtccctgggcctgcacctgagccggcggcctgagctgcaggagggccccctgagcaccccacctcctcctggggacaccggcggcaaggagagccggggcccctgcagcggcaccctggtggatgccaacagcaacagccctgctgtgccctgccgctgctgccaggagcacggccctggcctggagaaccggcaggaccccagccaggaggaggagggcgccgccagccccagcgaccccggctgcagcagcagcctgagcagctgcagcgacctgagcccagatgagagccctgtgtctgtgtacctgcgggacctgcctggagatgaagatgcccacccccagcccagcatcatccccctggagcagggcagccccctggccagcgctggccctggcacctgcagcccagacagcttctgctgcagcccagacagctgcagcggggccagcagcagcccagaccccggcctggacagcaactgcaatgccctgaccacctgccaggatgtgcccagccctggcctggaggaggaggatgaaagagctgagcaggacctgcccaccagcgagctgctggaggctgatgatggcaagattgatgctgggaagacagagcccagctggaagatcaaccccatctggaagattgacacagagaagaccaaggccgagtggaagaccacagagaacaacaacacaggctggaagaacaatggaaatgtgaacagctcctggaagtctgagcctgagaagtttgattctggctggaagaccaacacccgcatcacagacagcggcagcaagacagatgctgggaagattgatggcggctggaggagtgatgtgtctgaggagcctgtgccccacaggaccatcaccagcttccacgagctggcccagaagaggaagaggggccctggcctgcccctggtgccccaggccaagaaggacagaagtgactggctgattgtgttctccccagacacagagctgcccccatctggcagccctgggggcagcagcgccccaccccgggaggtgaccaccttcaaggagctgcggagccgcagccgggccccagcccctcctgtgcccccccgggacccccctgtgggctgggccctggtgccccccaggcctcctcctcctcctgtgccccccaggaggaagaagaacagacctggcctgcagcccatcgccgagggccagagcgaggagggccgggctgtgtccccagctgctggggaggaggccccagctgccaaggagcccggggcccaggccggcctggaggtgcgcagctcctggagctttgctggggtgcctggggcccagaggctgtggatggccgaggcccagagcggcaccggccagctgcaggagcagaagaagggcctgctgattgctgtgtctgtgtctgtggacaagatcatcagccactttggagctgccaggaacctggtgcagaaggcccagctgggggacagccggctgagcccagatgtgggccacctggtgctgaccaccctgtgcccagccctgcacgccctggtggctgatggcctgaagcccttcaggaaggacctgatcaccggccagaggaggagcagcccctggagcgtggtggaggcctctgtgaagccaggcagcagcaccaggagcctgggcaccctgtacagccaggtgtcccggctggcccccctgagcagcagccgcagccgcttccacgccttcatcctgggcctgctgaacaccaagcagctggagctgtggttcagcagcctgcaggaggatgctggctcctggtgggagcagctgacccaggccagccgggtgtatgccagcggcggcacagagggcttccccctgagccgctgggcccctggccgccacggcacagctgctgaggagggcgcccaggagcggcccctgcccacagatgagatggcccctggccggggcctgtggctgggccgcctgtttggagtgcctgggggccctgcagaaaatgaaaatggagccctgaagagcagaagacccagctcctggctgccccccaccgtgtctgtgctggccctggtgaagagaggagcccctcctgagatgcccagcccccaggagctggaggccagcgcccccaggatggtgcagacccacagagctgtgcgggccctgtgtgaccacacagctgcccggccagaccagctgtccttccggcggggggaggtgctgcgggtcatcaccaccgtggatgaggactggctgcgctgtggcagagatggcatggagggcctggtgcctgtgggctacaccagcctggtgctgtag

SEQ ID NO: 19711 - DNA, 513 bp, Artificial Sequence
  Description of Artificial Sequence: Synthetic coding sequence
atggcctctgtgagcagcgccaccttcagcggccacggggcccggagcctgctgcagttcctgcggctggtgggccagctgaagagggtgcccaggacaggctgggtgtacagaaatgtgcagaggcctgagagcgtgtctgaccacatgtacaggatggctgtgatggccatggtgatcaaggatgaccggctgaacaaggaccgggaggccatgaagcagatcacccagctgctgcctgaggacctgaggaaggagctgtatgagctgtgggaggagtatgagacccagagcagcgctgaggccaagtttgtgaagcagctggaccagtgtgagatgatcctgcaggcctctgaatatgaggacctggagcacaagccaggccgcctgcaggacttctatgacagcacagctgggaagttcaaccaccctgagatcgtgcagctggtgtctgagctggaggccgagaggagcaccaacattgctgctgctgccagcgagccccacagctag

SEQ ID NO: 19712 - DNA, 396 bp, Artificial Sequence
  Description of Artificial Sequence: Synthetic coding sequence
atggaggcccaggcccagggcctgctggagacagagcccctgcagggcacagatgaagatgctgtggccagcgctgacttcagctccatgctgtctgaggaggagaaggaggagctgaaggccgagctggtgcagctggaggatgagatcaccaccctgcggcaggtgctgagcgccaaggagcggcacctggtggagatcaagcagaagctgggcatgaacctgatgaatgagctgaagcagaacttcagcaagtcctggcatgacatgcagaccaccacagcctacaagaagacccatgagaccctgagccacgccggccagaaggccacagctgccttcagcaatgtgggcacagccatcagcaagaagtttggagacatgaggaggaagtag

SEQ ID NO: 19713 - DNA, 435 bp, Artificial Sequence
  Description of Artificial Sequence: Synthetic coding sequence
atggaggcccaggcccagggcctgctggagacagagcccctgcagggcacagatgaagatgctgtggccagcgctgacttcagctccatgctgtctgaggaggagaaggaggagctgaaggccgagctggtgcagctggaggatgagatcaccaccctgcggcaggtgctgagcgccaaggagcggcacctggtggagatcaagcagaagctgggcatgaacctgatgaatgagctgaagcagaacttcagcaagtcctggcatgacatgcagaccaccacagcctacaagaagacccatgagaccctgagccacgccggccagaaggccacagctgccttcagcaatgtgggcacagccatcagcaagaagtttggagacatgagctacagcatccgccacagcatctccatgcctgccatgaggaggaagtag

SEQ ID NO: 19714 - DNA, 948 bp, Artificial Sequence
  Description of Artificial Sequence: Synthetic coding sequence
atggccagctgcccagacagcgacaacagctgggtgctggccggcagcgagagcctgcctgtggagaccctgggccctgccagcaggatggaccctgagagcgagcgggccctgcaggccccccacagccccagcaagacagatggcaaggagctggccggcaccatggatggagagggcaccctcttccagacagagagcccccagagcggcagcatcctgacagaggagacagaggtgaagggcaccctggagggagatgtgtgtggggtggagcccccaggccctggggacacagtggtgcagggcgacctgcaggagaccaccgtggtgacaggcctgggccctgacacccaggacctggagggccagagccccccccagagcctgcccagcacccccaaggccgcctggatccgggaggagggccgctgcagcagcagtgatgatgacacagatgtggacatggagggcctgcggcggcggcggggccgggaggccggccccccccagcccatggtgcccctggccgtggagaaccaggccggcggcggcctgtctgagagcgagaccggccccatggaggaggtggagcggcaggtgctgcctgaccctgaggtgctggaggccgtgggggaccggcaggacggcctgcgggagcagctgcaggcccctgtgcccccagacagcgtgcccagcctgcagaacatgggcctgctgctggacaagctggccaaggagaaccaggacatccggctgctgcaggcccagctgcaggtgggcaccggccggcggggctgggcccgggtgacccacctgggccaggcctctgtgctggccagcagccccaagagaaatgtgtcctacctgcccacccacccagacccccccctgagccactacagccagggcgtcttccctgtgctgggcagccaccccctgtgctag

SEQ ID NO: 19715 - DNA, 2196 bp, Artificial Sequence
  Description of Artificial Sequence: Synthetic coding sequence
atggccagctgcccagacagcgacaacagctgggtgctggccggcagcgagagcctgcctgtggagaccctgggccctgccagcaggatggaccctgagagcgagcgggccctgcaggccccccacagccccagcaagacagatggcaaggagctggccggcaccatggatggagagggcaccctcttccagacagagagcccccagagcggcagcatcctgacagaggagacagaggtgaagggcaccctggagggagatgtgtgtggggtggagcccccaggccctggggacacagtggtgcagggcgacctgcaggagaccaccgtggtgacaggcctgggccctgacacccaggacctggagggccagagccccccccagagcctgcccagcacccccaaggccgcctggatccgggaggagggccgctgcagcagcagtgatgatgacacagatgtggacatggagggcctgcggcggcggcggggccgggaggccggccccccccagcccatggtgcccctggccgtggagaaccaggccggcggggagggcgccggcggggagctgggcatcagcctgaacatgtgcctgctgggcgccctggtgctgctgggcctgggcgtgctgctcttcagcggcggcctgtctgagagcgagaccggccccatggaggaggtggagcggcaggtgctgcctgaccctgaggtgctggaggccgtgggggaccggcaggacggcctgcgggagcagctgcaggcccctgtgcccccagattctgtgcccagcctgcagaacatgggcctgctgctggacaagctggccaaggagaaccaggacatccggctgctgcaggcccagctgcaggcccagaaggaggagctgcagagcctgatgcaccagcccaagggcctggaggaggagaatgcccagctgcggggggccctgcagcagggcgaggccttccagagggccctggagagcgagctgcagcagctgcgggcccggctgcagggcctggaggccgactgtgtgcggggcccagatggagtgtgcctgagcggcggccggggcccccagggcgacaaggccatccgggagcagggcccccgggagcaggagcctgagctgtccttcctgaagcagaaggagcagctggaggccgaggcccaggccctgcggcaggagctggagcggcagaggcggctgctgggctctgtgcagcaggacctggagaggagcctgcaggatgccagcagaggagaccctgcccatgctggcctggccgagctgggccaccggctggcccagaagctgcagggcctggagaactggggccaggaccccggggtgtctgccaatgccagcaaggcctggcaccagaagagccacttccagaacagccgggagtggagcggcaaggagaagtggtgggatggccagagggacaggaaggccgagcactggaagcacaagaaggaggagagcggccgggagaggaagaagaactggggcggccaggaggaccgggagcccgccggccgctggaaggagggccggccccgggtggaggagagcggcagcaagaaggagggcaagaggcagggccccaaggagccccccaggaagagcggcagcttccacagcagtggagagaagcagaagcagccccgctggagggagggcaccaaggacagccatgaccccctgcccagctgggccgagctgctgcggcccaagtaccgggccccccagggctgcagcggcgtggatgaatgtgcccggcaggagggcctgaccttctttggaacagagctggcccctgtgcggcagcaggagctggccagcctgctgcggacctacctggcccggctgccctgggccggccagctgaccaaggagctgcccctgagccctgccttctttggagaagatggcatcttcagacatgaccggctgcgcttccgggactttgtggatgccctggaggacagcctggaggaggtggccgtgcagcagacaggagatgatgatgaggtggatgactttgaggacttcatcttcagccacttctttggagacaaggccctgaagaagaggtctgggaagaaggacaagcacagccagagccccagggctgctggcccccgggagggccacagccacagccaccaccaccaccaccggggctag

SEQ ID NO: 19716 - DNA, 2109 bp, Artificial Sequence
  Description of Artificial Sequence: Synthetic coding sequence
atggaccctgagagcgagcgggccctgcaggccccccacagccccagcaagacagatggcaaggagctggccggcaccatggatggagagggcaccctcttccagacagagagcccccagagcggcagcatcctgacagaggagacagaggtgaagggcaccctggagggagatgtgtgtggggtggagcccccaggccctggggacacagtggtgcagggcgacctgcaggagaccaccgtggtgacaggcctgggccctgacacccaggacctggagggccagagccccccccagagcctgcccagcacccccaaggccgcctggatccgggaggagggccgctgcagcagcagtgatgatgacacagatgtggacatggagggcctgcggaggagaagaggccgggaggccggccccccccagcccatggtgcccctggccgtggagaaccaggccggcggggagggcgctggaggagagctgggcatcagcctgaacatgtgcctgctgggcgccctggtgctgctgggcctgggcgtgctgctcttcagcggcggcctgtctgagagcgagaccggccccatggaggaggtggagcggcaggtgctgcctgaccctgaggtgctggaggccgtgggggaccggcaggacggcctgcgggagcagctgcaggcccctgtgcccccagacagcgtgcccagcctgcagaacatgggcctgctgctggacaagctggccaaggagaaccaggacatccggctgctgcaggcccagctgcaggcccagaaggaggagctgcagagcctgatgcaccagcccaagggcctggaggaggagaatgcccagctgcggggggccctgcagcagggcgaggccttccagagggccctggagagcgagctgcagcagctgcgggcccggctgcagggcctggaggccgactgtgtgcggggcccagatggagtgtgcctgagcggcggccggggcccccagggcgacaaggccatccgggagcagggcccccgggagcaggagcctgagctgtccttcctgaagcagaaggagcagctggaggccgaggcccaggccctgcggcaggagctggagcggcagaggcggctgctgggctctgtgcagcaggacctggagaggagcctgcaggatgccagcagaggagaccctgcccacgccggcctggccgagctgggccaccggctggcccagaagctgcagggcctggagaactggggccaggaccccggggtgtctgccaatgccagcaaggcctggcaccagaagagccacttccagaacagccgggagtggagcggcaaggagaagtggtgggatggccagagggacaggaaggccgagcactggaagcacaagaaggaggagagcggccgggagaggaagaagaactggggcggccaggaggaccgggagcctgctggccgctggaaggagggccggccccgggtggaggagagcggcagcaagaaggagggcaagaggcagggccccaaggagccccccaggaagagcggcagcttccacagcagcggggagaagcagaagcagccccgctggagggagggcaccaaggacagccatgaccccctgcccagctgggccgagctgctgcggcccaagtaccgggccccccagggctgcagcggcgtggatgaatgtgcccggcaggagggcctgaccttcttcggcacagagctggcccctgtgcggcagcaggagctggccagcctgctgcggacctacctggcccggctgccctgggccggccagctgaccaaggagctgcccctgagccctgccttcttcggggaggatggcatcttcagacatgaccggctgcgcttccgggactttgtggatgccctggaggacagcctggaggaggtggccgtgcagcagacaggagatgatgatgaggtggatgactttgaggacttcatcttcagccacttcttcggggacaaggccctgaagaagaggtctgggaagaaggacaagcacagccagagccccagggctgctggcccccgggagggccacagccacagccaccaccaccaccaccggggctag

SEQ ID NO: 19717 - DNA, 2427 bp, Artificial Sequence
  Description of Artificial Sequence: Synthetic coding sequence
atgatctggaggaacaactggaagagcaccaccggccgcctgaatgtgaagctgcagagcgacaagctgcagcacggctgcggccctgactacagcagcgcctggctgcctgccaatgaaagcctgtggcaggccaccaccgtgcccagcaaccacaggaacaaccacatccgccgccacagcatcgccagtgacagcggggacacaggaattggcaccagctgcagcgacagcgtggaggaccacagcaccagcagcggcaccctgtccttcaagcccagccagagcctcatcaccctgcccacagcccacgtgatgcccagcaacagcagcgccagcatcagcaagctgcgggagagcctgaccccagatggcagcaagtggagcaccagcctgatgcagaccctgggcaaccacagcagaggagagcaggacagcagcctggacatgaaggacttccggcccctgaggaagtggagcagcctgagcaagctgacagccccagacaactgtggccagggcggcaccgtgtgccgggaggagagcagaaatggcctggagaagattggcaaggccaaggccctgaccagccagctgcggaccatcggccccagctgcctgcatgacagcatggagatgctgcggctggaggacaaggagatcaacaagaagaggagcagcaccctggactgcaagtacaagtttgagagctgcagcaaagaagacttccgggccagcagcagcaccctgcggcggcagcctgtggacatgacctacagcgccctgcctgagagcaagcccatcatgaccagcagcgaggcctttgagccccccaagtacctgatgctgggccagcaggccgtgggcggcgtgcccatccagcccagcgtgaggacccagatgtggctgacagagcagctgcggaccaaccccctggagggcaggaacacagaggacagctacagcctggccccctggcagcagcagcagatcgaggacttccggcagggcagcgagacccccatgcaggtgctgaccggcagcagccggcagagctacagccctggctaccaggacttcagcaagtgggagagcatgctgaagatcaaggagggcctgctgcggcagaaggagatcgtgattgaccggcagaagcagcagatcacccacctgcacgagcgcatccgggacaatgagctgcgggcccagcacgccatgctgggccactacgtgaactgtgaggacagctatgtggccagcctgcagccccagtatgagaacaccagcctgcagacccccttcagcgaggagagcgtgagccacagccagcagggcgagtttgagcagaagctggccagcacagagaaggaggtgctgcagctgaatgagttcctgaagcagaggctgagcctcttcagcgaggagaagaagaagctggaggagaagctgaagacccgggaccgctacatcagcagcctgaagaagaagtgccagaaggagagcgagcagaacaaggagaagcagaggagaattgagaccctggagaagtacctggccgacctgcccaccctggatgatgtgcagagccagagcctgcagctgcagatcctggaggagaagaacaagaacctgcaggaggccctgattgacacagagaagaagctggaggagatcaagaagcagtgccaggacaaggagacccagctgatctgccagaagaagaaggagaaggagctggtgaccaccgtgcagagcctgcagcagaaggtggagcgctgcctggaggatggcatccggctgcccatgctggatgccaagcagctgcagaatgaaaatgacaacctgcggcagcagaatgaaacagccagcaagatcatcgacagccagcaggatgaaattgacaggatgatcctggagatccagagcatgcagggcaagctgagcaaggagaagctgaccacccagaagatgatggaggagctggagaagaaggagagaaatgtgcagaggctgaccaaggccctgctggagaaccagaggcagacagatgagacctgcagcctgctggaccagggccaggagccagaccagagccggcagcagacagtgctgagcaagaggcccctgtttgacctgactgtgattgaccagctgttcaaggagatgagctgctgcctgtttgacctgaaggccctgtgcagcatcctgaaccagagggcccagggcaaggagcccaacctgagcctgctgctgggcatccgctccatgaactgcagcgctgaggagacagaaaatgaccacagcacagagaccctgaccaagaagctgagtgatgtgtgccagctgcggcgggacattgatgagctgcggaccaccatcagtgacagatatgcccaggacatgggagacaactgcatcacccagtag

SEQ ID NO: 19718 - DNA, 2418 bp, Artificial Sequence
  Description of Artificial Sequence: Synthetic coding sequence
atgtggggccgcttcctggcccctgaggccagcggccgggacagccctgggggcgcccgctccttccctgctggccctgactacagcagcgcctggctgcctgccaatgaaagcctgtggcaggccaccaccgtgcccagcaaccacaggaacaaccacatcagaagacacagcatcgccagtgacagcggggacaccggcatcggcaccagctgcagcgacagcgtggaggaccacagcaccagcagcggcaccctgtccttcaagcccagccagagcctcatcaccctgcccacagcccacgtgatgcccagcaacagcagcgccagcatcagcaagctgcgggagagcctgaccccagatggcagcaagtggagcaccagcctgatgcagaccctgggcaaccacagcagaggagagcaggacagcagcctggacatgaaggacttccggcccctgaggaagtggagcagcctgagcaagctgacagccccagacaactgtggccagggcggcaccgtgtgccgggaggagagcagaaatggcctggagaagattggcaaggccaaggccctgaccagccagctgcggaccatcggccccagctgcctgcatgacagcatggagatgctgcggctggaggacaaggagatcaacaagaagaggagcagcaccctggactgcaagtacaagtttgagagctgcagcaaggaggacttccgggccagcagcagcaccctgcggcggcagcctgtggacatgacctacagcgccctgcctgagagcaagcccatcatgaccagcagcgaggcctttgagccccccaagtacctgatgctgggccagcaggccgtgggcggcgtgcccatccagcccagcgtgaggacccagatgtggctgacagagcagctgcggaccaaccccctggagggcaggaacacagaagattcctacagcctggccccctggcagcagcagcagatcgaggacttccggcagggcagcgagacccccatgcaggtgctgaccggcagcagccggcagagctacagccctggctaccaggacttcagcaagtgggagagcatgctgaagatcaaggagggcctgctgcggcagaaggagatcgtcatcgaccggcagaagcagcagatcacccacctgcacgagcgcatccgggacaatgagctgcgggcccagcacgccatgctgggccactacgtgaactgtgaagattcctatgtggccagcctgcagccccagtatgagaacaccagcctgcagacccccttcagcgaggagagcgtgagccacagccagcagggcgagtttgagcagaagctggccagcacagagaaggaggtgctgcagctgaatgagttcctgaagcagaggctgagcctcttcagcgaggagaagaagaagctggaggagaagctgaagacccgggaccgctacatcagcagcctgaagaagaagtgccagaaggagagcgagcagaacaaggagaagcagaggcgcatcgagaccctggagaagtacctggccgacctgcccaccctggatgatgtgcagagccagagcctgcagctgcagatcctggaggagaagaacaagaacctgcaggaggccctgattgacacagagaagaagctggaggagatcaagaagcagtgccaggacaaggagacccagctgatctgccagaagaagaaggagaaggagctggtgaccaccgtgcagagcctgcagcagaaggtggagcgctgcctggaggatggcatccggctgcccatgctggatgccaagcagctgcagaatgaaaatgacaacctgcggcagcagaatgaaacagccagcaagatcatcgacagccagcaggatgaaattgacaggatgatcctggagatccagagcatgcagggcaagctgagcaaggagaagctgaccacccagaagatgatggaggagctggagaagaaggagagaaatgtgcagaggctgaccaaggccctgctggagaaccagaggcagacagatgagacctgcagcctgctggaccagggccaggagccagaccagagccggcagcagacagtgctgagcaagaggcccctgtttgacctgaccgtcatcgaccagctgttcaaggagatgagctgctgcctgtttgacctgaaggccctgtgcagcatcctgaaccagagggcccagggcaaggagcccaacctgagcctgctgctgggcatccgctccatgaactgcagcgctgaggagacagaaaatgaccacagcacagagaccctgaccaagaagctgagtgatgtgtgccagctgcggcgggacattgatgagctgcggaccaccatcagtgacagatatgcccaggacatgggagacaactgcatcacccagtag

SEQ ID NO: 19719 - DNA, 1488 bp, Artificial Sequence
  Description of Artificial Sequence: Synthetic coding sequence
atggtggaggagcacgagctgaggaaggagcgcatccaggaggactacaatgacaagtactgggaccagcgctacaccatcgtgcagcagcagatccccagcttcctgcagaagatggctgacaagatcctgagcacaggcaagtacctgaatgtggtgagagaatgtggccatgatgtgacctgccctgtggccaaggagatcatctacaccctgaaggagcgggcctacgtggagcagatcgagaaggccttcaactatgccagcaaggtgctgctggacttcctgatggaggagaaggagctggtggcccacctgcggagcatcaagcgctacttcctgatggaccagggcgacttctttgtgcacttcatggacctggccgaggaggagctgaggaagcctgtggaggacatcaccccaccccggctggaggccctgctggagctggccctgaggatgagcacagccaacacagaccccttcaaggatgacctgaagattgacctgatgcctcatgacctgatcacccagctgctgcgggtgctggccatcgagaccaagcaggagaaggccatggcccacgccgaccccacagagctggccctgagcggcctggaggccttctcctttgactacatcgtgaagtggcccctgagcctcatcatcaacaggaaggccctgacccgctaccagatgctgttccgccacatgttctactgcaagcacgtggagcggcagctgtgcagcgtgtggatcagcaacaagacagccaagcagcacagcctgcacagcgcccagtggtttgctggggccttcaccctgcggcagaggatgctgaactttgtgcagaacatccagtactacatgatgtttgaggtgatggagcccacctggcacatcctggagaagaacctgaagagcgccagcaacattgatgatgtgctgggccaccacacaggcttcctggacacctgcctgaaggactgcatgctgaccaaccctgagctgctgaaggtgttcagcaagctgatgtctgtgtgtgtgatgttcaccaactgcatgcagaagttcacccagagcatgaagctggatggagagctgggcggccagaccctggagcacagcacagtgctgggcctgcctgctggagctgaggagcgggccaggaaggagctggccaggaagcacctggccgagcacgccgacacagtgcagctggtgtctggctttgaggccaccatcaacaagtttgacaagaacttcagcgcccacctgctggacctgctggcccggctgagcatctacagcaccagtgactgtgaacatggcatggccagcgtcatcagccggctggacttcaacggcttctacacagagcggctggagcggctgtctgctgagaggagccagaaggccaccccccaggtgcctgtgctgcggggccccccagccccagccccccgggtggccgtgacagcccagtag

SEQ ID NO: 19720 - DNA, 2709 bp, Artificial Sequence; identical to SEQ ID NO: 18373
  Description of Artificial Sequence: Synthetic coding sequence

SEQ ID NO: 19721 - DNA, 1620 bp, Artificial Sequence; identical to SEQ ID NO: 19445
  Description of Artificial Sequence: Synthetic coding sequence

SEQ ID NO: 19722 - DNA, 453 bp, Artificial Sequence
  Description of Artificial Sequence: Synthetic coding sequence
atgagaggagaccggggccggggccggggcggccgcttcggcagcagaggaggccctgggggcggcttccggccctttgtgccccacatcccctttgacttctacctgtgtgagatggccttcccccgggtgaagccagccccagatgagaccagcttcagcgaggccctgctgaagaggaaccaggacctggcccccaacagcgctgagcaggccagcatcctgagcctggtgaccaagatcaacaacgtgattgacaacctgattgtggcccctggcacctttgaggtgcagatcgaggaggtgcggcaggtgggcagctacaagaagggcaccatgaccaccggccacaacgtggccgacctggtggtgatcctgaagatcctgcccacctgtgaatgtgcctgcttctggagctgggagcagaacatcgccctgggcctgggcgtgtag

SEQ ID NO: 19723 - DNA, 348 bp, Artificial Sequence
  Description of Artificial Sequence: Synthetic coding sequence
atggccttcccccgggtgaagccagccccagatgagaccagcttcagcgaggccctgctgaagaggaaccaggacctggcccccaacagcgctgagcaggccagcatcctgagcctggtgaccaagatcaacaacgtgattgacaacctgattgtggcccctggcacctttgaggtgcagatcgaggaggtgcggcaggtgggcagctacaagaagggcaccatgaccaccggccacaacgtggccgacctggtggtgatcctgaagatcctgcccaccctggaggccgtggccgccctgggcaacaaggtggtggagagcctgcgggcccaggaccccagcgagtag

SEQ ID NO: 19724 - DNA, 312 bp, Artificial Sequence
  Description of Artificial Sequence: Synthetic coding sequence
atgtctgactgctacacagagctggagaaggctgtgattgtgctggtggagaacttctacaagtatgtgtccaagtacagcctggtgaagaacaagatcagcaagagcagcttccgggagatgctgcagaaggagctgaaccacatgctgagtgacaccggcaacaggaaggctgctgacaagctgatccagaacctggatgccaaccatgatggccgcatcagctttgatgagtactggaccctgattggaggcatcaccggccccatcgccaagctgattcatgagcaggagcagcagagcagcagctag

SEQ ID NO: 19725 - DNA, 312 bp, Artificial Sequence; identical to SEQ ID NO: 19724
  Description of Artificial Sequence: Synthetic coding sequence

SEQ ID NO: 19726 - DNA, 312 bp, Artificial Sequence; identical to SEQ ID NO: 19724
  Description of Artificial Sequence: Synthetic coding sequence

SEQ ID NO: 19727 - DNA, 312 bp, Artificial Sequence; identical to SEQ ID NO: 19724
  Description of Artificial Sequence: Synthetic coding sequence

SEQ ID NO: 19728 - DNA, 306 bp, Artificial Sequence; identical to SEQ ID NO: 19073
  Description of Artificial Sequence: Synthetic coding sequence

SEQ ID NO: 19729 - DNA, 306 bp, Artificial Sequence; identical to SEQ ID NO: 19073
  Description of Artificial Sequence: Synthetic coding sequence

SEQ ID NO: 19730 - DNA, 222 bp, Artificial Sequence
  Description of Artificial Sequence: Synthetic coding sequence
atgagctaccagcagcagcagtgcaagcagccctgccagcccccacctgtgtgccccacccccaagtgcccagagccctgccccccacccaagtgcccagagccctacctgcccccaccctgccccccagagcactgccccccaccaccctgccaggacaagtgcccccctgtgcagccctacccaccctgccagcagaagtacccacccaagagcaagtag

SEQ ID NO: 19731 - DNA, 219 bp, Artificial Sequence
  Description of Artificial Sequence: Synthetic coding sequence
atgagctaccagcagcagcagtgcaagcagccctgccagcccccacctgtgtgccccacccccaagtgcccagagccctgccccccacccaagtgcccagagccctgccccccacccaagtgcccccagccctgccccccccagcagtgccagcagaagtgcccccctgtgacccccagccccccctgccagcccaagtgcccccccaagagcaagtag

SEQ ID NO: 19732 - DNA, 219 bp, Artificial Sequence; identical to SEQ ID NO: 19731
  Description of Artificial Sequence: Synthetic coding sequence

SEQ ID NO: 19733 - DNA, 219 bp, Artificial Sequence; identical to SEQ ID NO: 19554
  Description of Artificial Sequence: Synthetic coding sequence

SEQ ID NO: 19734 - DNA, 219 bp, Artificial Sequence; identical to SEQ ID NO: 19554
  Description of Artificial Sequence: Synthetic coding sequence

SEQ ID NO: 19735 - DNA, 219 bp, Artificial Sequence; identical to SEQ ID NO: 19554
  Description of Artificial Sequence: Synthetic coding sequence

SEQ ID NO: 19736 - DNA, 8553 bp, Artificial Sequence
  Description of Artificial Sequence: Synthetic coding sequence
atgcccaagctgctgcagggcgtcatcaccgtgattgatgtgttctaccagtatgccacccagcacggggagtatgacaccctgaacaaggccgagctgaaggagctgctggagaatgagttccaccagatcctgaagaaccccaatgaccctgacacagtggacatcatcctgcagagcctggaccgggaccacaacaagaaggtggacttcacagagtacctgctgatgatcttcaagctggtgcaggccaggaacaagatcatcggcaaggactactgccaggtgtctggcagcaagctgagagatgacacccaccagcaccaggaggagcaggaggagacagagaaggaggagaacaagaggcaggagagcagcttcagccacagctcctggagcgctggggagaatgacagctacagcagaaatgtgcggggcagcctgaagccaggcacagagagcatcagccggcggctgtccttccagagggacttcagcggccagcacaacagctacagcggccagagcagcagctatggagagcagaacagcgacagccaccagagcagcggccggggccagtgtggcagcggcagcggccagagccccaactacggccagcacggcagcggcagcggccagagcagcagcaatgacacccacggcagcggcagcggccagagcagcggcttcagccagcacaagagcagcagcggccagagcagcggctacagccagcacggcagcggcagcggccacagcagcggctacggccagcacggcagccgcagcggccagagcagcagaggagagcggcacaggagcagcagcggcagcagcagcagctatggccagcacggcagcggcagccggcagagcctgggccacggccggcagggcagcggcagccggcagagccccagccacgtgcgccacggcagcggcagcggccacagcagcagccacggccagcacggcagcggcagcagctacagctacagccggggccactatgagagcggcagcggccagaccagcggcttcggccagcatgaaagtggcagcggccagagcagcggctacagcaagcacggcagcggcagcggccacagcagcagccagggccagcacggcagcaccagcggccaggccagcagcagcggccagcacggcagcagcagccggcagagcagcagctatggccagcatgaaagtgccagccgccacagcagcggccggggccagcacagcagcggcagcggccagagccctggccacggccagaggggcagcggcagcggccagagccccagcagcggccagcacggcaccggcttcggccgcagcagcagcagcggcccctacgtgtctggcagcggctacagcagcggcttcggccaccacgagagcagcagcgagcacagcagcggctacacccagcacggcagcggcagcggccacagcagcggccacggccagcacggcagccgcagcggccagagcagcagaggagagcggcagggcagcagcgctggcagcagcagcagctatggccagcacggcagcggcagccggcagagcctgggccacagcagacatggcagcggcagcggccagagccccagccccagccggggcagacatgagagcggcagccggcagagcagcagctatggcccccacggctacggcagcggccgcagcagcagccggggcccctatgagagcggcagcggccacagcagcggcctgggccaccaggagagccgcagcggccagagcagcggctacggccagcacggcagcagcagcggccacagcagcacccacggccagcacggcagcaccagcggccagagcagcagctgtggccagcacggggccaccagcggccagagcagcagccacggccagcacggcagcggcagcagccagagcagccgctatggccagcagggcagcggcagcggccagagccccagccggggcagacatggcagtgactttggccacagcagcagctatggccagcacggcagcggcagcggctggagcagcagcaatggcccccacggctctgtgtctggccagagcagcggcttcggccacaagagcggcagcggccagagcagcggctacagccagcacggcagcggcagcagccacagcagcggctacaggaagcacggcagccgcagcggccagagcagccgctctgagcagcacggcagcagcagcggcctgagcagcagctatggccagcacggcagcggcagccaccagagcagcggccacggccggcagggcagcggcagcggccacagccccagccgggtgagacatggcagcagcagcggccacagcagcagccacggccagcacggcagcggcaccagctgcagcagcagctgtggccactatgaaagtggcagcggccaggccagcggcttcggccagcacgagagcggcagcggccagggctacagccagcacggcagcgccagcggccacttcagcagccagggccgccacggcagcaccagcggccagagcagcagcagcggccagcacgacagcagcagcggccagagcagcagctatggccagcacgagagcgccagccaccacgccagcggccggggcagacatggcagcggcagcggccagagccctggccacggccagaggggcagcggcagcggccagagccccagctatggaagacatggcagcggcagcggccgcagcagcagcagcggccgccacggcagcggcagcggccagagcagcggcttcggccacaagagcagcagcggccagagcagcggctacacccagcacggcagcggcagcggccacagcagcagctatgagcagcacggcagccgcagcggccagagcagccgctctgagcagcacggcagcagcagcggcagcagcagcagctatggccagcacggcagcggcagccggcagagcctgggccacggccagcacggcagcggcagcggccagagccccagccccagccggggccgccacggcagcggcagcggccagagcagcagctatggcccctacagaagtggcagcggctggagcagcagccggggcccctatgagagcggcagcggccacagcagcggcctgggccaccgggagagccgcagcggccagagcagcggctacggccagcacggcagcagcagcggccacagcagcacccacggccagcacggcagcaccagcggccagagcagcagctgtggccagcacggggccagcagcggccagagcagcagccacggccagcacggcagcggcagcagccagagcagcggctacggccggcagggcagcggcagcggccagagccctggccacggccagaggggcagcggcagccggcagagccccagctatggccgccacggcagcggcagcggccgcagcagcagcagcggccagcacggcagcggcctgggggagagcagcggcttcggccaccacgagagcagcagcggccagagcagcagctacagccagcacggcagcggcagcggccacagcagcggctacggccagcacggcagccgcagcggccagagcagcagaggagagagacatggcagcagcagcggcagcagcagccactacggccagcacggcagcggcagccggcagagcagcggccacggccggcagggcagcggcagcggccacagccccagccggggccgccacggcagcggcctgggccacagcagcagccacggccagcacggcagcggcagcggccgcagcagcagccggggcccctatgagagccgcagcggccacagctctgtgtttggccagcatgaaagtggcagcggccacagcagcgcctacagccagcacggcagcggcagcggccacttctgcagccagggccagcacggcagcaccagcggccagagcagcacctttgaccaggagggcagcagcacaggccagagcagcagctatggccaccggggcagcggcagcagccagagcagcggctacggccgccacggggccggcagcggccagagccccagccggggcagacatggcagcggcagcggccacagcagcagctatggccagcacggcagcggcagcggctggagcagcagcagcggcagacatggcagcggcagcggccagagcagcggcttcggccaccacgagagcagctcctggcagagcagcggctgcacccagcacggcagcggcagcggccacagcagcagctatgagcagcacggcagccgcagcggccagagcagcagaggagagagacatggcagcagcagcggcagcagcagcagctatggccagcacggcagcggcagccggcagagcctgggccacggccagcacggcagcggcagcggccagagccccagccccagccggggccgccacggcagcggcagcggccagagcagcagctacagcccctacggcagcggcagcggctggagcagcagccggggcccctatgagagcggcagcagccacagcagcggcctgggccaccgggagagccgcagcggccagagcagcggctacggccagcacggcagcagcagcggccacagcagcacccacggccagcacggcagcaccagcggccagagcagcagctgtggccagcacggggccagcagcggccagagcagcagccacggccagcacggcagcggcagcagccagagcagcggctacggccggcagggcagcggcagcggccagagccctggccacggccagaggggcagcggcagccggcagagccccagctatggccgccacggcagcggcagcggccgcagcagcagcagcggccagcacggcagcggcctgggggagagcagcggcttcggccaccacgagagcagcagcggccagagcagcagctacagccagcacggcagcggcagcggccacagcagcggctacggccagcacggcagccgcagcggccagagcagcagaggagagagacatggcagcagcagccgcagcagcagccgctatggccagcacggcagcggcagccggcagagcagcggccacggccggcagggcagcggcagcggccagagccccagccggggccgccacggcagcggcctgggccacagcagcagccacggccagcacggcagcggcagcggccgcagcagcagccggggcccctatgagagccgcagcggccacagctctgtgtttggccagcatgaaagtggcagcggccacagcagcgcctacagccagcacggcagcggcagcggccacttctgcagccagggccagcacggcagcaccagcggccagagcagcacctttgaccaggagggcagcagcacaggccagagcagcagccacggccagcacggcagcggcagcagccagagcagcagctatggccagcagggcagcggcagcggccagagccccagccggggcagacatggcagcggcagcggccacagcagcagctatggccagcacggcagcggcagcggctggagcagcagcagcggcagacatggcagcggcagcggccagagcagcggcttcggccaccacgagagcagctcctggcagagcagcggctacacccagcacggcagcggcagcggccacagcagcagctatgagcagcacggcagccgcagcggccagagcagcagaggagagcagcacggcagcagcagcggcagcagcagcagctatggccagcacggcagcggcagccggcagagcctgggccacggccagcacggcagcggcagcggccagagccccagccccagccggggccgccacggcagcggcagcggccagagcagcagctatggcccctacggcagcggcagcggctggagcagcagccggggcccctatgagagcggcagcggccacagcagcggcctgggccaccgggagagccgcagcggccagagcagcggctacggccagcacggcagcagcagcggccacagcagcacccacggccagcacggcagcgccagcggccagagcagcagctgtggccagcacggggccagcagcggccagagcagcagccacggccagcacggcagcggcagcagccagagcagcggctacggccggcagggcagcggcagcggccagagccctggccacggccagaggggcagcggcagccggcagagccccagctatggccgccacggcagcggcagcggccgcagcagcagcagcggccagcacggccctggcctgggggagagcagcggcttcggccaccacgagagcagcagcggccagagcagcagctacagccagcacggcagcggcagcggccacagcagcggctacggccagcacggcagccgcagcggccagagcagcagaggagagagacatggcagcagcagcggcagcagcagccgctatggccagcacggcagcggcagccggcagagcagcggccacggccggcagggcagcggcagcggccacagccccagccggggccgccacggcagcggcagcggccacagcagcagccacggccagcacggcagcggcagcggccgcagcagcagccggggcccctatgagagccgcagcggccacagctctgtgtttggccagcatgaaagtggcagcggccacagcagcgcctacagccagcacggcagcggcagcggccacttctgcagccagggccagcacggcagcaccagcggccagagcagcacctttgaccaggagggcagcagcacaggccagagcagcagccacggccagcacggcagcggcagcagccagagcagcagctatggccagcagggcagcggcagcggccagagccccagccggggcagacatggcagcggcagcggccacagcagcagctatggccagcacggcagcggcagcggctggagcagcagcagcggcagacatggcagcggcagcggccagagcagcggcttcggccaccacgagagcagctcctggcagagcagcggctacacccagcacggcagcggcagcggccacagcagcagctatgagcagcacggcagccgcagcggccagagcagcagaggagagagacatggcagcagcagcggcagcagcagcagctatggccagcacggcagcggcagccggcagagcctgggccacggccagcacggcagcggcagcggccagagccccagccccagccggggccgccacggcagcggcagcggccagagcagcagctacagcccctacggcagcggcagcggctggagcagcagccggggcccctatgagagcggcagcggccacagcagcggcctgggccaccgggagagccgcagcggccagagcagcggctacggccagcacggcagcagcagcggccacagcagcacccacggccagcacggcagcaccagcggccagagcagcagctgtggccagcacggggccagcagcggccagagcagcagccacggccagcacggcagcggcagcagccagagcagcggctacggccggcagggcagcggcagcggccagagccctggccacggccagaggggcagcggcagccggcagagccccagctatggccgccacggcagcggcagcggccgcagcagcagcagcggccagcacggcagcggcctgggggagagcagcggcttcggccaccacgagagcagcagcggccagagcagcagctacagccagcacggcagcggcagcggccacagcagcggctacggccagcacggcagccgcagcggccagagcagcagaggagagagacatggcagcagcagcggcagcagcagccactacggccagcacggcagcggcagccggcagagcagcggccacggccggcagggcagcggcagcggccagagccccagccggggccgccacggcagcggcctgggccacagcagcagccacggccagcacggcagcggcagcggccgcagcagcagccggggcccctatgagagccggctgggccacagctctgtgtttggccagcatgaaagtggcagcggccacagcagcgcctacagccagcacggcagcggcagcggccacttctgcagccagggccagcacggcagcaccagcggccagagcagcacctttgaccaggagggcagcagcacaggccagagcagcagctatggccaccggggcagcggcagcagccagagcagcggctacggccgccacggggccggcagcggccagagcctgagccacggcagacatggcagcggcagcggccagagcagcagctatggccagcacggcagcggcagcggccagagcagcggctacagccagcacggcagcggcagcggccaggacggctacagctactgcaagggcggcagcaaccatgatggcggcagcagcggcagctacttcctgtccttccccagcagcaccagcccctatgaatatgtgcaggagcagcgctgctacttctaccagtag

SEQ ID NO: 19737 - DNA, 876 bp, Artificial Sequence
  Description of Artificial Sequence: Synthetic coding sequence
atgagcagtggagcagatggcggcggcggcgctgctgtggccgcccggagtgacaagggcagccctggagaagatggctttgtgcccagcgccctgggcacccgggagcactgggatgctgtgtatgaaagagagctgcagaccttccgggagtatggagacacaggagagatctggtttggagaggagagcatgaacagactcatccgctggatgcagaagcacaagatccccctggatgcctctgtgctggacatcggcactggaaatggagtcttcctggtggagctggccaagtttggcttcagcaacatcaccggcatcgactacagccccagcgccatccagctgagcggcagcatcatcgagaaggagggcctgagcaacatcaagctgaaggtggaggacttcctgaacctgagcacccagctgagcggcttccacatctgcatcgacaagggcacctttgatgccatcagcctgaacccagacaatgccatcgagaagaggaagcagtatgtgaagagcctgagccgggtgctgaaggtgaagggcttcttcctgatcaccagctgcaactggaccaaggaggagctgctgaatgagttcagcgagggctggagcacagtggccggcttctggctgacagctgccctgacctcctgggcccaggccatcttcagcaccagcgccagccgggtgggcggcaccaccggcacccaccaccacgcctggatcatctttgtgttcctggccgagacccgcttctgccacgtggtgcaggccggcctggagctgctgggcagcagtgacagccccacctggccacccaaggtgctgggcctgtaccacgcccggcccagcctggccttctag

SEQ ID NO: 19738 - DNA, 633 bp, Artificial Sequence
  Description of Artificial Sequence: Synthetic coding sequence
atggccccctggggcaagaggctggccggcgtgcggggcgtgctgctggacatctctggagtgctgtatgattctggagctgggggcggcacagccatcgccggctctgtggaggccgtggcccggctgaagaggagccggctgaaggtgcgcttctgcaccaatgaaagccagaagagcagagctgagctggtgggccagctgcagaggctgggctttgacatcagcgagcaggaggtgacagccccagccccagctgcctgccagatcctgaaggagcagggcctgcggccctacctgctgattcatgatggagtgcgctcagaatttgaccagattgacaccagcaaccccaactgtgtggtgattgctgatgctggggagagcttctcctaccagaacatgaacaatgccttccaggtgctgatggagctggagaagcctgtgctgatcagcctgggcaagggccgctactacaaggagaccagcggcctgatgctggatgtgggcccctacatgaaggccctggagtatgcctgtggcatcaaggccgaggtggtgggcaagcccagccctgagttcttcaagagcgccctgcaggccatcggcgtggaggcccaccaggcccagtag

SEQ ID NO: 19739 - DNA, 813 bp, Artificial Sequence
  Description of Artificial Sequence: Synthetic coding sequence
atggccccctggggcaagaggctggccggcgtgcggggcgtgctgctggacatctctggagtgctgtatgattctggagctgggggcggcacagccatcgccggctctgtggaggccgtggcccggctgaagaggagccggctgaaggtgcgcttctgcaccaatgaaagccagaagagcagagctgagctggtgggccagctgcagaggctgggctttgacatcagcgagcaggaggtgacagccccagccccagctgcctgccagatcctgaaggagcagggcctgcggccctacctgctgattcatgatggagtgcgctcagaatttgaccagattgacaccagcaaccccaactgtgtggtgattgctgatgctggggagagcttctcctaccagaacatgaacaatgccttccaggtgctgatggagctggagaagcctgtgctgatcagcctgggcaagggccgctactacaaggagaccagcggcctgatgctggatgtgggcccctacatgaaggccctggagtatgcctgtggcatcaaggccgaggtggtgggcaagcccagccctgagttcttcaagagcgccctgcaggccatcggcgtggaggcccaccaggccgtgatgattggagatgacatcgtgggagatgtgggcggggcccagagatgtggcatgagggccctgcaggtgaggacaggcaagttccggcccagtgatgagcaccaccctgaggtgaaggcagatggctacgtggacaacctggccgaggccgtggacctgctgctgcagcacgccgacaagtag

SEQ ID NO: 19740 - DNA, 3948 bp, Artificial Sequence
  Description of Artificial Sequence: Synthetic coding sequence
atggctgacacagacctcttcatggagtgtgaggaggaggagctggagccctggcagaagatcagtgatgtgattgaggacagcgtggtggaggactacaacagcgtggacaagaccaccaccgtgtctgtgtcccagcagcctgtgtctgcccctgtgcccatcgccgcccacgcctctgtggccggccacctgagcaccagcaccaccgtgagcagcagcggggcccagaacagcgacagcaccaagaagaccctggtgaccctcatcgccaacaacaatgcccctggcacccagtttgtgaagcccaccgtgggcgtgccccaggtgttcagccagatgacccctgtgcggcccggcagcaccatgcctgtgcggcccaccaccaacaccttcaccaccgtcatcccagccaccctgaccatccgcagcacagtgccccagagccagagccagcagaccaagagcacccccagcaccagcaccacccccacagccacccagcccaccagcctgggccagctggccgtgcagagccctggccagagcaaccagaccaccaaccccaagctggcccccagcttccccagccccccagctgtgtccatcgccagctttgtgacagtgaagaggcctggggtgactggagagaacagcaatgaggtggccaagctggtgaacaccctgaacaccatccccagcctgggccagagccctggccctgtggtggtgagcaacaacagcagcgcccacggcagccagaggaccagcggccctgagagctccatgaaggtgaccagcagcatccctgtgtttgacctgcaggacggcggcaggaagatctgcccccgctgcaatgcccagttccgggtgacagaggccctgcggggccacatgtgctactgctgcccagagatggtggagtaccagaagaagggcaagagcctggacagcgagcccagcgtgcccagcgctgccaagccacccagccctgagaagacagcccctgtggccagcacccccagcagcacccccatcccagccctgagcccccccaccaaggtgcctgagcccaatgaaaatgtgggagatgctgtgcagaccaagctgatcatgctggtggatgacttctactacggcagagatggcggcaaggtggcccagctgaccaacttccccaaggtggccaccagcttccgctgcccccactgcaccaagaggctgaagaacaacatccgcttcatgaaccacatgaagcaccacgtggagctggaccagcagaatggagaggtggatggccacaccatctgccagcactgctaccggcagttcagcacccccttccagctgcagtgccacctggagaatgtgcacagcccctatgagagcaccaccaagtgcaagatctgtgagtgggcctttgagagcgagcccctcttcctgcagcacatgaaggacacccacaagccaggagagatgccctacgtgtgccaggtgtgccagtaccgcagcagcctgtacagcgaggtggatgtgcacttcaggatgattcatgaggacaccaggcacctgctgtgcccctactgcctgaaggtgttcaagaatggaaatgccttccagcagcactacatgaggcaccagaagagaaatgtgtaccactgcaacaagtgccgcctgcagttcctgtttgccaaggacaagattgagcacaagctgcagcaccacaagaccttcaggaagcccaagcagctggagggcctgaagccaggcaccaaggtgaccatccgggccagccggggccagcccaggacagtgcctgtgagcagcaatgacaccccaccttctgccctgcaggaggccgcccccctgaccagctccatggaccccctgcctgtgttcctgtacccacctgtgcagaggagcatccagaagagagctgtgaggaagatgtctgtgatgggccggcagacctgcctggagtgcagctttgagatcccagacttccccaaccacttccccacctacgtgcactgcagcctgtgccgctacagcacctgctgcagccgggcctatgccaaccacatgatcaacaaccacgtgcccaggaagagccccaagtacctggccctcttcaagaacagcgtgtctggcatcaagctggcctgcaccagctgcacctttgtgacctctgtgggagatgccatggccaagcacctggtgttcaaccccagccacaggagcagcagcatcctgccccggggcctgacctggatcgcccacagcagacatggccagacccgggacagagtgcatgacagaaatgtgaagaacatgtacccacctccttccttccccaccaacaaggccgccaccgtgaagtctgctggggccaccccagctgagcctgaggagctgctgacccccctggccccagccctgcccagccctgccagcacagccaccccaccacccacccccacccacccccaggccctggccctgccccccctggccacagaaggagcagaatgtctgaatgtggatgaccaggatgagggcagccctgtgacccaggagcctgagctggccagcggcggcggcggcagcggaggagtgggcaagaaggagcagctgtctgtgaagaagctgcgggtggtgctgtttgccctgtgctgcaacacagagcaggccgctgagcacttcaggaacccccagaggcgcatccgccgctggctgcggcgcttccaggccagccagggcgagaacctggagggcaagtacctgagctttgaggccgaggagaagctggccgagtgggtgctgacccagcgggagcagcagctgcctgtgaatgaggagaccctcttccagaaggccaccaagattggccgcagcctggagggcggcttcaagatctcctatgagtgggccgtgcgcttcatgctgcggcaccacctgacccctcatgccaggagagctgtggcccacaccctgcccaaggatgtggccgagaatgccggcctcttcatcgactttgtgcagaggcagatccacaaccaggacctgcccctgtccatgattgtggccattgatgagatcagcctcttcctggacacagaggtgctgagcagtgatgacagaaaagaaaatgccctgcagacagtgggcactggagagccctggtgtgatgtggtgctggccatcctggctgatggcaccgtgctgcccaccctggtgttctaccggggccagatggaccagcctgccaacatgccagacagcatcctgctggaggccaaggagagcggctacagtgatgatgagatcatggagctgtggagcaccagggtgtggcagaagcacacagcctgccagaggagcaagggcatgctggtgatggactgccacaggacccacctgtctgaggaggtgctggccatgctgagcgccagcagcaccctgcctgctgtggtgcctgctggctgcagcagcaagatccagcccctggatgtgtgcatcaagaggacagtgaagaacttcctgcacaagaagtggaaggagcaggcccgggagatggctgacacagcctgtgacagtgatgtgctgctgcagctggtgctggtgtggctgggggaggtgctgggcgtgattggagactgcccagagctggtgcagaggagcttcctggtggcctctgtgctgcccggcccagatggcaacatcaacagccccaccagaaatgctgacatgcaggaggagctgattgccagcctggaggagcagctgaagctgtctggagagcacagcgagagcagcaccccccggcccaggagcagccctgaggagaccatcgagcctgagagcctgcaccagctgtttgaaggagagagcgagacagagagcttctacggctttgaggaggccgacctggacctgatggagatctag

SEQ ID NO: 19741 - DNA, 2406 bp, Artificial Sequence
  Description of Artificial Sequence: Synthetic coding sequence
atgggagacacagtggtggagcccgcccccctgaagcccaccagcgagcccaccagcggccccccaggcaacaatggaggcagcctgctgagcgtcatcacagagggcgtgggggagctgtctgtgattgatcctgaggtggcccagaaggcctgccaggaggtgctggagaaggtgaagctgctgcatggaggagtggccgtgagcagccggggcacccccctggagctggtgaatggagatggagtggacagcgagatccgctgcctggatgatcctccagcccagatccgggaggaggaggatgagatgggcgctgctgtggccagcggcacagccaagggggccaggagaagacggcagaacaacagcgccaagcagagctggctgctgcggctgtttgagagcaagctgtttgacatctccatggccatctcctacctgtacaacagcaaggagcccggggtgcaggcctacatcggcaacagactcttctgcttcagaaatgaagatgtggacttctacctgccccagctgctgaacatgtacatccacatggatgaagatgtgggagatgccatcaagccctacatcgtgcaccgctgccggcagagcatcaacttcagcctgcagtgtgccctgctgctgggcgcctacagcagtgacatgcacatcagcacccagaggcacagccggggcaccaagctgaggaagctgatcctgagtgatgagctgaagccagcccacaggaagcgggagctgcccagcctgagccctgccccagacaccggcctgagccccagcaagaggacccaccagaggagcaagagtgatgccacagccagcatcagcctgagcagcaacctgaagaggacagccagcaaccccaaggtggagaatgaagatgagcctgtgcggctggcccctgagcgggagttcatcaagagcctgatggccatcggcaagaggctggccaccctgcccaccaaggagcagaagacccagaggctcatcagcgagctgagcctgctgaaccacaagctgcctgcccgggtgtggctgcccacagctggctttgaccaccacgtggtgcgggtgccccacacccaggccgtggtgctgaacagcaaggacaaggccccctacctgatctacgtggaggtgctggagtgtgagaactttgacaccacctctgtgcctgcccgcatcccagaaaatcgcatccgcagcaccaggtctgtggagaacctgcctgaatgtggcatcacccatgagcagagagctggcagcttcagcacagtgcccaactatgacaatgatgatgaggcctggagcgtggatgacattggagagctgcaggtggagctgcctgaggtgcacaccaacagctgtgacaacatcagccagttctctgtggacagcatcaccagccaggagagcaaggagcctgtgttcatcgccgccggggacatcagaagaaggctgtctgagcagctggcccacacccccacagccttcaagagggaccctgaggaccccagcgctgtggccctgaaggagccctggcaggagaaggtgcggcgcatccgggagggcagcccctacggccacctgcccaactggaggctgctgtctgtgattgtgaagtgtggagatgacctgcggcaggagctgctggccttccaggtgctgaagcagctgcagagcatctgggagcaggagcgggtgcccctgtggatcaagccctacaagatcctggtgatctctgctgacagcggcatgattgagcctgtggtgaatgctgtgtccatccaccaggtgaagaagcagagccagctgagcctgctggactacttcctgcaggagcacggcagctacaccacagaggccttcctgagcgcccagaggaactttgtgcagagctgtgccggctactgcctggtgtgctacctgctgcaggtgaaggacagacacaatggaaacatcctgctggatgctgagggccacatcatccacatcgactttggcttcatcctgagcagcagccccaggaacctgggctttgagaccagcgccttcaagctgaccacagaatttgtggatgtgatgggcggcctggatggagacatgttcaactactacaagatgctgatgctgcagggcctgattgctgccaggaagcacatggacaaggtggtgcagatcgtggagatcatgcagcagggcagccagctgccctgcttccacggcagcagcaccatccggaacctgaaggagcgcttccacatgtccatgacagaggagcagctgcagctgctggtggagcagatggtggatggctccatgaggagcatcaccaccaagctgtatgatggcttccagtacctgaccaacggcatcatgtag

SEQ ID NO: 19742 - DNA, 2451 bp, Artificial Sequence
  Description of Artificial Sequence: Synthetic coding sequence
atgggagacacagtggtggagcccgcccccctgaagcccaccagcgagcccaccagcggccccccaggcaacaatggaggcagcctgctgagcgtcatcacagagggcgtgggggagctgtctgtgattgatcctgaggtggcccagaaggcctgccaggaggtgctggagaaggtgaagctgctgcatggaggagtggccgtgagcagccggggcacccccctggagctggtgaatggagatggagtggacagcgagatccgctgcctggatgatcctccagcccagatccgggaggaggaggatgagatgggcgctgctgtggccagcggcacagccaagggggccaggagaagacggcagaacaacagcgccaagcagagctggctgctgcggctgtttgagagcaagctgtttgacatctccatggccatctcctacctgtacaacagcaaggagcccggggtgcaggcctacatcggcaacagactcttctgcttcagaaatgaagatgtggacttctacctgccccagctgctgaacatgtacatccacatggatgaagatgtgggagatgccatcaagccctacatcgtgcaccgctgccggcagagcatcaacttcagcctgcagtgtgccctgctgctgggcgcctacagcagtgacatgcacatcagcacccagaggcacagccggggcaccaagctgaggaagctgatcctgagtgatgagctgaagccagcccacaggaagcgggagctgcccagcctgagccctgccccagacaccggcctgagccccagcaagaggacccaccagaggagcaagagtgatgccacagccagcatcagcctgagcagcaacctgaagaggacagccagcaaccccaaggtggagaatgaagatgaggagctgagcagcagcacagagagcattgacaacagcttcagcagccctgtgcggctggcccctgagcgggagttcatcaagagcctgatggccatcggcaagaggctggccaccctgcccaccaaggagcagaagacccagaggctcatcagcgagctgagcctgctgaaccacaagctgcctgcccgggtgtggctgcccacagctggctttgaccaccacgtggtgcgggtgccccacacccaggccgtggtgctgaacagcaaggacaaggccccctacctgatctacgtggaggtgctggagtgtgaaaattttgacaccacctctgtgcctgcccgcatccctgagaaccgcatccgcagcaccaggtctgtggagaacctgcctgaatgtggcatcacccatgagcagagagctggcagcttcagcacagtgcccaactatgacaatgatgatgaggcctggagcgtggatgacatcggggagctgcaggtggagctgcctgaggtgcacaccaacagctgtgacaacatcagccagttctctgtggacagcatcaccagccaggagagcaaggagcccgtcttcatcgctgctggggacatcagaagaaggctgtctgagcagctggcccacacccccacagccttcaagagggaccctgaggaccccagcgctgtggccctgaaggagccctggcaggagaaggtgcggcgcatccgggagggcagcccctacggccacctgcccaactggaggctgctgagcgtcatcgtgaagtgtggagatgacctgcggcaggagctgctggccttccaggtgctgaagcagctgcagagcatctgggagcaggagcgggtgcccctgtggatcaagccctacaagatcctggtgatctctgctgacagcggcatgattgagcctgtggtgaatgctgtgtccatccaccaggtgaagaagcagagccagctgagcctgctggactacttcctgcaggagcacggcagctacaccacagaggccttcctgagcgcccagaggaactttgtgcagagctgtgccggctactgcctggtgtgctacctgctgcaggtgaaggacagacacaacggcaacatcctgctggatgctgagggccacatcatccacatcgactttggcttcatcctgagcagcagccccaggaacctgggctttgagaccagcgccttcaagctgaccacagaatttgtggatgtgatgggcggcctggatggagacatgttcaactactacaagatgctgatgctgcagggcctgattgctgccaggaagcacatggacaaggtggtgcagatcgtggagatcatgcagcagggcagccagctgccctgcttccacggcagcagcaccatccggaacctgaaggagcgcttccacatgtccatgacagaggagcagctgcagctgctggtggagcagatggtggatggctccatgaggagcatcaccaccaagctgtatgatggcttccagtacctgaccaacggcatcatgtag

SEQ ID NO: 19743 - DNA, 2406 bp, Artificial Sequence; identical to SEQ ID NO: 19741
  Description of Artificial Sequence: Synthetic coding sequence

SEQ ID NO: 19744 - DNA, 2487 bp, Artificial Sequence; identical to SEQ ID NO: 18559
  Description of Artificial Sequence: Synthetic coding sequence

SEQ ID NO: 19745 - DNA, 1143 bp, Artificial Sequence
  Description of Artificial Sequence: Synthetic coding sequence
atggtgctggagagcaccatggtgtgtgtggacaacagcgagtacatgagaaatggagacttcctgcccacccggctgcaggcccagcaggatgctgtgaacatcgtgtgccacagcaagaccaggagcaaccctgagaacaacgtgggcctcatcaccctggccaatgactgtgaggtgctgaccaccctgaccccagacaccggccgcatcctgagcaagctgcacacagtgcagcccaagggcaagatcaccttctgcaccggcatccgggtggcccacctggccctgaagcaccggcagggcaagaaccacaagatgaggatcatcgcctttgtgggcagccctgtggaggacaatgagaaggacctggtgaagctggccaagaggctgaagaaggagaaggtgaatgtggacatcatcaactttggagaggaggaggtgaacacagagaagctgacagcctttgtgaacaccctgaatggcaaggatggcaccggcagccacctggtgacagtgcccccaggccccagcctggctgatgccctgatcagcagccccatcctggccggggagggcggggccatgctgggcctgggcgccagtgactttgaatttggagtggaccccagcgctgaccctgagctggccctggccctgcgggtgtccatggaggagcagaggcagaggcaggaggaggaggcccggcgggctgctgctgccagcgctgctgaggccggcatcgccaccactggaacagaaggagagcgggacagtgatgatgccctgctgaagatgaccatcagccagcaggagtttggaagaacaggcctgcctgacctgagctccatgacagaggaggagcagatcgcctatgccatgcagatgagcctgcagggcgctgagtttggccaggccgagagcgctgacattgatgccagcagcgccatggacaccagcgagcccgccaaggaggaggatgattatgatgtgatgcaggaccctgagttcctgcagagcgtgctggagaacctgcccggggtggaccccaacaatgaggccatcagaaatgccatgggcagcctggccagccaggccaccaaggatggcaagaaggacaagaaggaggaggacaagaagtag

SEQ ID NO: 19746 - DNA, 1134 bp, Artificial Sequence
  Description of Artificial Sequence: Synthetic coding sequence
atggtgctggagagcaccatggtgtgtgtggacaacagcgagtacatgagaaatggagacttcctgcccacccggctgcaggcccagcaggatgctgtgaacatcgtgtgccacagcaagaccaggagcaaccctgagaacaacgtgggcctcatcaccctggccaatgactgtgaggtgctgaccaccctgaccccagacaccggccgcatcctgagcaagctgcacacagtgcagcccaagggcaagatcaccttctgcaccggcatccgggtggcccacctggccctgaagcaccggcagggcaagaaccacaagatgaggatcatcgcctttgtgggcagccctgtggaggacaatgagaaggacctggtgaagctggccaagaggctgaagaaggagaaggtgaatgtggacatcatcaactttggagaggaggaggtgaacacagagaagctgacagcctttgtgaacaccctgaatggcaaggatggcaccggcagccacctggtgacagtgcccccaggccccagcctggctgatgccctgatcagcagccccatcctggccggggagggcggggccatgctgggcctgggcgccagtgactttgaatttggagtggaccccagcgctgaccctgagctggccctggccctgcgggtgtccatggaggagcagaggcagaggcaggaggaggaggcccggcgggctgctgctgccagcgctgctgaggccggcatcgccaccactggaacagaggacagtgatgatgccctgctgaagatgaccatcagccagcaggagtttggccgcacaggcctgcctgacctgagctccatgacagaggaggagcagatcgcctatgccatgcagatgagcctgcagggcgctgagtttggccaggccgagagcgctgacattgatgccagcagcgccatggacaccagcgagcccgccaaggaggaggatgattatgatgtgatgcaggaccctgagttcctgcagagcgtgctggagaacctgcccggggtggaccccaacaatgaggccatcagaaatgccatgggcagcctggccagccaggccaccaaggatggcaagaaggacaagaaggaggaggacaagaagtag

SEQ ID NO: 19747 - DNA, 933 bp, Artificial Sequence
  Description of Artificial Sequence: Synthetic coding sequence
atgaggcctgcccggcactgggagaccaggtttggagcccgggactttggaggcttccaggactgcttcttccgggaccggctgatggacacagccagaattgctgtggtgggcgccggcgtggtgggcctgagcacagctgtgtgcatcagcaagctggtgccccgctgcagcgtgaccatcatcagtgacaagttcaccccagacaccaccagtgatgtggccgccggcatgctgatcccccacacctacccagacacccccatccacacccagaagcagtggttccgggagaccttcaaccacctgtttgccatcgccaacagcgctgaggccggagatgctggggtgcacctggtgtctggcatcaagggcagcggcggctggaccctgaccaggagaattgaggacctgtgggagctgcaccccagctttgatattgtggtgaactgcagcggcctgggcagccggcagctggccggggacagcaagatcttccctgtgcggggccaggtgctgcaggtgcaggccccctgggtggagcacttcatcagagatggcagcggcctgacctacatctacccaggcaccagccacgtgaccctgggcggcacccggcagaagggggactggaacctgagcccagatgctgagaacagccgggagatcctgagccgctgctgtgccctggagcccagcctgcatggagcctgcaacatccgggagaaggtgggcctgcggccctacagacctggggtgcggctgcagacagagctgctggccagagatggccagaggctgcctgtggtgcaccactacggccacggcagcggcggcatctctgtgcactggggcacagccctggaggccgcccggctggtgtctgaatgtgtgcacgccctgcggacccccatccccaagagcaacctgtag

SEQ ID NO: 19748 - DNA, 1110 bp, Artificial Sequence
  Description of Artificial Sequence: Synthetic coding sequence
atgaggcctgcccggcactgggagaccaggtttggagcccgggactttggaggcttccaggactgcttcttccgggaccggctgatggacacagccagaattgctgtggtgggcgccggcgtggtgggcctgagcacagctgtgtgcatcagcaagctggtgccccgctgcagcgtgaccatcatcagtgacaagttcaccccagacaccaccagtgatgtggccgccggcatgctgatcccccacacctacccagacacccccatccacacccagaagcagtggttccgggagaccttcaaccacctgtttgccatcgccaacagcgctgaggccggagatgctggggtgcacctggtgtctggctggcagatcttccagagcacccccacagaggaggtgcccttctgggcagatgtggtgctgggcttcaggaagatgacagaggccgagctgaagaagttcccccagtatgtgtttggccaggccttcaccaccctgaagtgtgagtgcccagcctacctgccctggctggagaagaggatcaagggcagcggcggctggaccctgaccaggagaattgaggacctgtgggagctgcaccccagctttgacatcgtggtgaactgcagcggcctgggcagccggcagctggccggggacagcaagatcttccctgtgcggggccaggtgctgcaggtgcaggccccctgggtggagcacttcatcagagatggcagcggcctgacctacatctacccaggcaccagccacgtgaccctgggcggcacccggcagaagggggactggaacctgagcccagatgctgagaacagccgggagatcctgagccgctgctgtgccctggagcccagcctgcacggggcctgcaacatccgggagaaggtgggcctgcggccctacagacctggggtgcggctgcagacagagctgctggccagagatggccagaggctgcctgtggtgcaccactacggccacggcagcggcggcatctctgtgcactggggcacagccctggaggccgcccggctggtgtctgaatgtgtgcacgccctgcggacccccatccccaagagcaacctgtag

SEQ ID NO: 19749 - DNA, 1026 bp, Artificial Sequence
  Description of Artificial Sequence: Synthetic coding sequence
atggacacagccagaattgctgtggtgggcgccggcgtggtgggcctgagcacagctgtgtgcatcagcaagctggtgccccgctgcagcgtgaccatcatcagtgacaagttcaccccagacaccaccagtgatgtggccgccggcatgctgatcccccacacctacccagacacccccatccacacccagaagcagtggttccgggagaccttcaaccacctgtttgccatcgccaacagcgctgaggccggagatgctggggtgcacctggtgtctggctggcagatcttccagagcacccccacagaggaggtgcccttctgggcagatgtggtgctgggcttcaggaagatgacagaggccgagctgaagaagttcccccagtatgtgtttggccaggccttcaccaccctgaagtgtgagtgcccagcctacctgccctggctggagaagaggatcaagggcagcggcggctggaccctgaccaggagaattgaggacctgtgggagctgcaccccagctttgacatcgtggtgaactgcagcggcctgggcagccggcagctggccggggacagcaagatcttccctgtgcggggccaggtgctgcaggtgcaggccccctgggtggagcacttcatcagagatggcagcggcctgacctacatctacccaggcaccagccacgtgaccctgggcggcacccggcagaagggggactggaacctgagcccagatgctgagaacagccgggagatcctgagccgctgctgtgccctggagcccagcctgcacggggcctgcaacatccgggagaaggtgggcctgcggccctacagacctggggtgcggctgcagacagagctgctggccagagatggccagaggctgcctgtggtgcaccactacggccacggcagcggcggcatctctgtgcactggggcacagccctggaggccgcccggctggtgtctgaatgtgtgcacgccctgcggacccccatccccaagagcaacctgtag

SEQ ID NO: 19750 - DNA, 1074 bp, Artificial Sequence
  Description of Artificial Sequence: Synthetic coding sequence
atgggcaccatccaggaggccggcaagaagacagatgtgggcgtgcgggagattgctgaggcccctgagctgggcgccgccctgcggcacggggagctggagctgaaggaggagtggcaggatgaggagttcccccggctgctgcctgaggaggccggcaccagcgaggaccctgaggaccccaagggggacagccaggccgctgctggcacccccagcaccctggccctgtgtggccagaggcccatgaggaagaggctgagcgcccctgagctgcggctgagcctgaccaagggccctggaaatgatggagccagccccacccagagcgcccccagcagcccagatggcagcagtgacctggagattgatgagctggagacccccagcgacagcgagcagctggacagcggccatgaatttgagtgggaggatgagctgcccagggctgagggcctgggcaccagcgagacagctgagcggctgggccggggctgcatgtgggatgtgactggagaagatggccaccactggagggtcttcaggatgggcccccgggagcagagggtggacatgacagtgattgagccctacaagaaggtgctgagccacggcggctaccatggagatggcctgaatgctgtgatcctgtttgccagctgctacctgcccaggagcagcatccccaactacacctacgtgatggagcacctgttccgctacatggtgggcaccctggagctgctggtggccgagaactacctgctggtgcacctgagcggcggcaccagccgggcccaggtgccccccctgtcctggatccggcagtgctaccgcaccctggaccggcggctgaggaagaacctgcgggccctggtggtggtgcacgccacctggtacgtgaaggccttcctggccctgctgcggcccttcatcagcagcaagttcaccaggaagatccgcttcctggacagcctgggggagctggcccagctgatcagcctggaccaggtgcacatccctgaggccgtgcggcagctggaccgggacctgcacggcagcggcggcacctag

SEQ ID NO: 19751 - DNA, 1269 bp, Artificial Sequence
  Description of Artificial Sequence: Synthetic coding sequence
atgctgaagttcctggccaagggggaggtgcccaagggcagctgtgaagatgagcccatggacagcaccatggatgatgctgtggccggggactttgccctgatcaacaagctggacatccagtgtgacctgaagaccctgagtgatgacatcaaggagagcctggagagcgagggcaagaacagcaagaaggaggagccccaggagctgctgcagagccaggactttgtgggggagaagctgggcagcggggagcccagccacagcgtgaaggtgcacacagtgcccaagccaggaaaaggagctgacctgagcaagccaccctgcaggaaggccaaggagatcaggaaggagaggaagaggctgaagctgatgcagcagaacccagctggggagctggagggcttccaggcccagggccacccccccagcctcttcccccccaaggccaagagcaaccagcccaagagcctggaggacctgatctttgagagcctgcctgaaaatgccagccacaagctggaggtgcggctggtgcctgtgtcctttgaggaccctgagttcaagagcagcttcagccagagcttcagcctgtatgtgaagtaccaggtggccatccaccaggaccccccagatgaatgtgggaagacagagttcacccgcttcctgtgcagcagccccctggaggccgagaccccaccaaatggaccagactgtggctacggcagcttccaccagcagtactggctggatggcaagatcatcgctgtgggcgtcatcgacatcctgcccaactgtgtgtcctctgtgtacctgtactatgaccctgactacagcttcctgagcctgggcgtgtacagcgccctgcgggagatcgccttcacccggcagctgcacgagaagaccagccagctgagctactactacatgggcttctacatccacagctgccccaagatgaagtacaagggccagtaccggcccagcgacctgctgtgcccagagacctacgtgtgggtgcccatcgagcagtgcctgcccagcctggagaacagcaagtactgccgcttcaaccaggaccctgaggccgtggatgaggacaggagcacagagccagaccggctgcaggtgttccacaagagggccatcatgccctacggcgtgtacaagaagcagcagaaggaccccagcgaggaggccgctgtgctgcagtatgccagcctggtgggccagaagtgcagcgagaggatgctgctcttcagaaattag

SEQ ID NO: 19752 - DNA, 1557 bp, Artificial Sequence
  Description of Artificial Sequence: Synthetic coding sequence
atggccttctgggccggcggcagccccagcgtggtggactacttccccagcgaggacttctaccgctgtggctactgcaagaatgaaagtggcagccgcagcaatggcatgtgggcccacagcatgacagtgcaggactaccaggacctgattgaccggggctggaggagaagtggcaagtatgtgtacaagcctgtgatgaaccagacctgctgcccccagtacaccatccgctgccggcccctgcagttccagcccagcaagagccacaagaaggtgctgaagaagatgctgaagttcctggccaagggggaggtgcccaagggcagctgtgaagatgagcccatggacagcaccatggatgatgctgtggccggggactttgccctgatcaacaagctggacatccagtgtgacctgaagaccctgagtgatgacatcaaggagagcctggagagcgagggcaagaacagcaagaaggaggagccccaggagctgctgcagagccaggactttgtgggggagaagctgggcagcggggagcccagccacagcgtgaaggtgcacacagtgcccaagccaggaaaaggagctgacctgagcaagccaccctgcaggaaggccaaggagatcaggaaggagaggaagaggctgaagctgatgcagcagaacccagctggggagctggagggcttccaggcccagggccacccccccagcctcttcccccccaaggccaagagcaaccagcccaagagcctggaggacctgatctttgagagcctgcctgaaaatgccagccacaagctggaggtgcggctggtgcctgtgtcctttgaggaccctgagttcaagagcagcttcagccagagcttcagcctgtatgtgaagtaccaggtggccatccaccaggaccccccagatgaatgtgggaagacagagttcacccgcttcctgtgcagcagccccctggaggccgagaccccaccaaatggaccagactgtggctacggcagcttccaccagcagtactggctggatggcaagatcatcgctgtgggcgtcatcgacatcctgcccaactgtgtgtcctctgtgtacctgtactatgaccctgactacagcttcctgagcctgggcgtgtacagcgccctgcgggagatcgccttcacccggcagctgcacgagaagaccagccagctgagctactactacatgggcttctacatccacagctgccccaagatgaagtacaagggccagtaccggcccagcgacctgctgtgcccagagacctacgtgtgggtgcccatcgagcagtgcctgcccagcctggagaacagcaagtactgccgcttcaaccaggaccctgaggccgtggatgaggacaggagcacagagccagaccggctgcaggtgttccacaagagggccatcatgccctacggcgtgtacaagaagcagcagaaggaccccagcgaggaggccgctgtgctgcagtatgccagcctggtgggccagaagtgcagcgagaggatgctgctcttcagaaattag

SEQ ID NO: 19753 - DNA, 3003 bp, Artificial Sequence
  Description of Artificial Sequence: Synthetic coding sequence
atggccgagaggaagcccaatggaggcagcggcggggccagcaccagcagcagcggcaccaacctgctcttcagcagcagcgccacagagttctccttcaacgtgcccttcatccctgtgacccaggccagcgccagccctgccagcctgctgctgcctggagaggacagcacagatgtgggggaggaggacagcttcctgggccagaccagcatccacaccagcgccccccagaccttctcctacttcagccaggtgagcagcagcagtgacccctttggaaacatcggccagagccccctgaccacagctgccacctctgtgggccagagcggcttccccaagcccctgacagccctgcccttcaccaccggcagccaggatgtgtccaatgccttcagccccagcatcagcaaggcccagcccggggccccacccagcagcctgatgggcatcaacagctacctgcccagccagcccagcagcctgccccccagctacttcggcaaccagccccagggcatcccccagcccggctacaacccctaccgccacaccccaggcagcagccgggccaacccctacatcgccccaccccagctgcagcagtgccagaccccaggccccccagcccaccccccacccagcggcccccctgtgcagatgtaccagatgcctcctggcagcctgccccctgtgcccagctctgtgcagagccctgcccagcagcaggtgcctgcccggcctggggcccccagcgtgcaggtgcccagccccttcctgctgcagaaccagtatgagcctgtgcagccccactggttctactgcaaggaggtggagtacaagcagctgtggatgcccttctctgtgtttgacagcctgaacctggaggagatctacaacagcgtgcagcctgaccctgagagcgtggtgctgggcacagatggcggccgctatgatgtgtacctgtatgaccgcatcaggaaggccgcctactgggaggaggagcctgctgaggtgcggcgctgcacctggttctacaagggggacacagacagccgcttcatcccctacacagaggagttcagcgagaagctggaggccgagtacaagaaggctgtgaccaccaaccagtggcaccggcggctggagttccccagcggggagaccatcgtgatgcacaaccccaaggtgattgtgcagttccagcccagctctgtgcctgatgagtggggcaccacccaggacggccagacccggccccgggtggtgaagaggggcattgatgacaacctggatgagatcccagatggagagatgccccaggtggaccacctggtgtttgtggtgcatggaattggccctgtgtgtgacctgcgcttccgcagcatcattgaatgtgtggatgacttccgggtggtgtccctgaagctgctgcggacccacttcaagaagagcctggatgatggcaaggtgtcccgggtggagttcctgcctgtgcactggcacagcagcctgggcggagatgccactggagtggacaggaacatcaagaagatcaccctgcccagcatcggccgcttccgccacttcaccaatgagaccctgctggacatcctcttctacaacagccccacctactgccagaccatcgtggagaaggtgggcatggagatcaaccacctgcacgccctcttcatgagcagaaatccagacttcaagggcggcgtgtctgtggccggccacagcctgggcagcctcatcctgtttgacatcctgagcaaccagaaggacctgaacctgagcaaatgtcctggccccctggccgtggccaacggggtggtgaagcagctgcacttccaggagaagcagatgcctgaggagcccaagctgaccctggatgagagctatgacctggtggtggagaacaaggaggtgctgaccctgcaggagaccctggaggccctgagcctgtctgagtacttcagcacctttgagaaggagaagattgacatggagagcctgctgatgtgcaccgtggatgacctgaaggagatgggcatccccctgggccccaggaagaagatcgccaactttgtggagcacaaggccgccaagctgaagaaggccgccagcgagaagaaggctgtggccgccaccagcaccaagggccaggagcagagcgcccagaagaccaaggacatggccagcctgcccagcgagagcaatgagcccaagaggaagctgcctgtgggcgcctgtgtgtcctctgtgtgtgtgaactatgagagctttgaggtgggcgccggccaggtgtctgtggcctacaacagcctggactttgagcctgagatcttctttgccctgggcagccccatcgccatgttcctgaccatccggggcgtggacagaattgatgagaactacagcctgcccacctgcaagggcttcttcaacatctaccaccccctggaccctgtggcctaccgcctggagcccatgattgtgcctgacctggacctgaaggctgtgctgatcccccaccacaagggcaggaagaggctgcacctggagctgaaggagagcctgagcaggatgggcagtgacctgaagcagggcttcatcagcagcctgaagagcgcctggcagaccctgaatgaatttgcccgggcccacaccagcagcacccagctgcaggaggagctggagaaggtggccaaccagatcaaggaggaggaggagaagcaggtggtggaggccgagaaggtggtggagagcccagacttcagcaaggatgaggactacctgggcaaggtgggcatgctgaatggaggaagaagaattgattatgtgctgcaggagaagcccatcgagagcttcaatgagtacctgtttgccctgcagagccacctgtgctactgggagagcgaggacacagccctgctgctgctgaaggagatctaccgcaccatgaacatcagccctgagcagccccagcactag

SEQ ID NO: 19754 - DNA, 495 bp, Artificial Sequence
  Description of Artificial Sequence: Synthetic coding sequence
atggtgaacagcgtggtgttctttgacatcaccgtggatggcaagcccctgggccgcatcagcatcaagctgtttgctgacaagatcctgaagacagctgagaacttccgggccctgagcactggagagaagggcttccgctacaagggcagctgcttccaccgcatcatccctggcttcatgtgccagggcggggacttcaccaggcacaatggaactggagacaagagcatctatggagagaagtttgatgatgagaacctgatcaggaagcacactggaagtggcatcctgtccatggccaatgccggccccaacaccaacggcagccagttcttcatctgtgccgccaagacagagtggctggatggcaagcacgtggccttcggcaaggtgaaggagcgggtgaacatcgtggaggccatggagcacttcggctacagaaacagcaagaccagcaagaagatcaccatcgctgactgtggccagttctag

SEQ ID NO: 19755 - DNA, 426 bp, Artificial Sequence
  Description of Artificial Sequence: Synthetic coding sequence
atgaagatcctggatgtgggctgcggcggcggcctgctgacagagcccggcggcagcctcttcatcaccaccatcaacaagacccagctgtcctatgccctgggcatcgtgttttctgagcagatcgccagcatcgtgcccaagggcacccacacctgggagaagtttgtgtccccagagaccctggagagcatcctggagagcaatggcctgtctgtgcagacagtggtgggcatgctgtacaaccccttcagcggctactggcactggagcgagaacaccagcctgaactatgctgcctatgctgtgaagagccgggtgcaggagcacccagccagcgctgagtttgtgctgaagggggagacagaggagctgcaggccaatgcctgcaccaacccagctgtgcatgagaagctgaagaagtag

SEQ ID NO: 19756 - DNA, 426 bp, Artificial Sequence; identical to SEQ ID NO: 19755
  Description of Artificial Sequence: Synthetic coding sequence

SEQ ID NO: 19757 - DNA, 2157 bp, Artificial Sequence
  Description of Artificial Sequence: Synthetic coding sequence
atgctgatgaccctggagatgacagagctgacagacccccaccacaccatgggagactacaaggtggcccacccccaggacccccaccaccccagcgagaagcctgtgatccactgccacaagtgtggggagccctgcaagggggaggtgctgcgggtgcagaccaagcacttccacatcaagtgcttcacctgcaaggtgtgtggctgtgacctggcccagggcggcttcttcatcaagaatggagagtacctgtgcaccctggactaccagaggatgtatggcacccgctgccacggctgtggggagtttgtggagggggaggtggtgacagccctgggcaagacctaccaccccaactgctttgcctgcaccatctgcaagaggcccttccccccaggggacagagtgaccttcaacggccgggactgcctgtgccagctgtgtgcccagcccatgagcagcagccccaaggagaccaccttcagcagcaactgtgccggctgcggccgggacatcaagaatggccaggccctgctggccctggacaagcagtggcacctgggctgcttcaagtgcaagagctgtgggaaggtgctgactggagagtacatcagcaaggatggagccccctactgtgagaaggactaccagggcctgtttggagtgaagtgtgaggcctgccaccagttcatcaccgggaaggtgctggaggccggggacaagcactaccaccccagctgtgcccgctgcagccgctgcaaccagatgttcacagaaggagaggagatgtacctgcagggcagcacagtgtggcacccagactgcaagcagagcaccaagacagaggagaagctgcggcccaccaggaccagcagcgagagcatctacagccggcccggcagcagcatccctggcagccctggccacaccatctatgccaaggtggacaatgagatcctggactacaaggacctggccgccatccccaaggtgaaggccatctatgacatcgagaggccagacctgatcacctatgagcccttctacaccagcggctatgatgacaagcaggagcggcagagcctgggggagagccccaggaccctgagccccaccccatctgctgagggctaccaggatgtgcgggacaggatgatccacaggagcaccagccagggcagcatcaacagccctgtgtacagccgccacagctacacccccaccaccagccgcagcccccagcacttccacaggcctggaaatgagcccagcagcggcaggaacagccccctgccctacagaccagacagccggcccctgacccccacctacgcccaggcccccaagcacttccacgtgcctgaccagggcatcaacatctacaggaagccacccatctacaagcagcacgccgccctggccgcccagagcaagagcagcgaggacatcatcaagttcagcaagtttcctgctgcccaggccccagaccccagcgagacccccaagattgaaacagaccactggccaggcccccccagctttgctgtggtgggccctgacatgaagaggaggagcagcggccgggaggaggatgatgaggagctgctgcggcggcggcagctgcaggaggagcagctgatgaagctgaacagcggcctgggccagctgatcctgaaggaggagatggagaaggagagccgggagaggagcagcctgctggccagccgctatgacagccccatcaacagcgccagccacatccccagcagcaagacagccagcctgcccggctatggaagaaatggcctgcacaggcctgtgtccacagactttgcccagtacaacagctatggagatgtgtctgggggcgtgcgggactaccagaccctgcctgatggccacatgcctgccatgaggatggaccggggcgtgtccatgcccaacatgctggagcccaagatcttcccctatgagatgctgatggtgaccaacagaggaagaaacaagatcctgcgggaggtggacaggacccggctggagcggcacctggcccctgaggtgttccgggagatcttcggcatgagcatccaggagtttgaccggctgcccctgtggaggagaaatgacatgaagaagaaggccaagctgttctag

SEQ ID NO: 19758 - DNA, 1593 bp, Artificial Sequence
  Description of Artificial Sequence: Synthetic coding sequence
atgttcacagaaggagaggagatgtacctgcagggcagcacagtgtggcacccagactgcaagcagagcaccaagacagaggagaagctgcggctgcccaacatccgccgcagcagcagtgacttcttctacagcaagagcctcatccggaggacaggccgcagccccagcctgcagcccaccaggaccagcagcgagagcatctacagccggcccggcagcagcatccctggcagccctggccacaccatctatgccaaggtggacaatgagatcctggactacaaggacctggccgccatccccaaggtgaaggccatctatgacatcgagaggccagacctgatcacctatgagcccttctacaccagcggctatgatgacaagcaggagcggcagagcctgggggagagccccaggaccctgagccccaccccatctgctgagggctaccaggatgtgcgggacaggatgatccacaggagcaccagccagggcagcatcaacagccctgtgtacagccgccacagctacacccccaccaccagccgcagcccccagcacttccacaggcctgagctgctgagccctggggtgcagaggctgagctacctgcggaccagcagcctgagccccacccacagcgacagccggcccaacccccccttccgccaccacttcatcccccacatcaagggaaatgagcccagcagcggcaggaacagccccctgccctacagaccagacagccggcccctgacccccacctacgcccaggcccccaagcacttccacgtgcctgaccagggcatcaacatctacaggaagccacccatctacaagcagcacgccgccctggccgcccagagcaagagcagcgaggacatcatcaagttcagcaagtttcctgctgcccaggccccagaccccagcgagacccccaagattgaaacagaccactggccaggcccccccagctttgctgtggtgggccctgacatgaagaggaggagcagcggccgggaggaggatgatgaggagctgctgcggcggcggcagctgcaggaggagcagctgatgaagctgaacagcggcctgggccagctgatcctgaaggaggagatggagaaggagagccgggagaggagcagcctgctggccagccgctatgacagccccatcaacagcgccagccacatccccagcagcaagacagccagcctgcccggctatggaagaaatggcctgcacaggcctgtgtccacagactttgcccagtacaacagctatggagatgtgtctgggggcgtgcgggactaccagaccctgcctgatggccacatgcctgccatgaggatggaccggggcgtgtccatgcccaacatgctggagcccaagatcttcccctatgagatgctgatggtgaccaacagaggaagaaacaagatcctgcgggaggtggacaggacccggctggagcggcacctggcccctgaggtgttccgggagatcttcggcatgagcatccaggagtttgaccggctgcccctgtggaggagaaatgacatgaagaagaaggccaagctgttctag

SEQ ID NO: 19759 - DNA, 2109 bp, Artificial Sequence
  Description of Artificial Sequence: Synthetic coding sequence
atggtgaaggagaaggtggcccacccccaggacccccaccaccccagcgagaagcctgtgatccactgccacaagtgtggggagccctgcaagggggaggtgctgcgggtgcagaccaagcacttccacatcaagtgcttcacctgcaaggtgtgtggctgtgacctggcccagggcggcttcttcatcaagaatggagagtacctgtgcaccctggactaccagaggatgtatggcacccgctgccacggctgtggggagtttgtggagggggaggtggtgacagccctgggcaagacctaccaccccaactgctttgcctgcaccatctgcaagaggcccttccccccaggggacagagtgaccttcaacggccgggactgcctgtgccagctgtgtgcccagcccatgagcagcagccccaaggagaccaccttcagcagcaactgtgccggctgcggccgggacatcaagaatggccaggccctgctggccctggacaagcagtggcacctgggctgcttcaagtgcaagagctgtgggaaggtgctgactggagagtacatcagcaaggatggagccccctactgtgagaaggactaccagggcctgtttggagtgaagtgtgaggcctgccaccagttcatcaccgggaaggtgctggaggccggggacaagcactaccaccccagctgtgcccgctgcagccgctgcaaccagatgttcacagaaggagaggagatgtacctgcagggcagcacagtgtggcacccagactgcaagcagagcaccaagacagaggagaagctgcggcccaccaggaccagcagcgagagcatctacagccggcccggcagcagcatccctggcagccctggccacaccatctatgccaaggtggacaatgagatcctggactacaaggacctggccgccatccccaaggtgaaggccatctatgacatcgagaggccagacctgatcacctatgagcccttctacaccagcggctatgatgacaagcaggagcggcagagcctgggggagagccccaggaccctgagccccaccccatctgctgagggctaccaggatgtgcgggacaggatgatccacaggagcaccagccagggcagcatcaacagccctgtgtacagccgccacagctacacccccaccaccagccgcagcccccagcacttccacaggcctggaaatgagcccagcagcggcaggaacagccccctgccctacagaccagacagccggcccctgacccccacctacgcccaggcccccaagcacttccacgtgcctgaccagggcatcaacatctacaggaagccacccatctacaagcagcacgccgccctggccgcccagagcaagagcagcgaggacatcatcaagttcagcaagtttcctgctgcccaggccccagaccccagcgagacccccaagattgaaacagaccactggccaggcccccccagctttgctgtggtgggccctgacatgaagaggaggagcagcggccgggaggaggatgatgaggagctgctgcggcggcggcagctgcaggaggagcagctgatgaagctgaacagcggcctgggccagctgatcctgaaggaggagatggagaaggagagccgggagaggagcagcctgctggccagccgctatgacagccccatcaacagcgccagccacatccccagcagcaagacagccagcctgcccggctatggaagaaatggcctgcacaggcctgtgtccacagactttgcccagtacaacagctatggagatgtgtctgggggcgtgcgggactaccagaccctgcctgatggccacatgcctgccatgaggatggaccggggcgtgtccatgcccaacatgctggagcccaagatcttcccctatgagatgctgatggtgaccaacagaggaagaaacaagatcctgcgggaggtggacaggacccggctggagcggcacctggcccctgaggtgttccgggagatcttcggcatgagcatccaggagtttgaccggctgcccctgtggaggagaaatgacatgaagaagaaggccaagctgttctag

SEQ ID NO: 19760 - DNA, 1206 bp, Artificial Sequence
  Description of Artificial Sequence: Synthetic coding sequence
atgttcacagaaggagaggagatgtacctgcagggcagcacagtgtggcacccagactgcaagcagagcaccaagacagaggagaagctgcgggccaaggtggacaatgagatcctggactacaaggacctggccgccatccccaaggtgaaggccatctatgacatcgagaggccagacctgatcacctatgagcccttctacaccagcggctatgatgacaagcaggagcggcagagcctgggggagagccccaggaccctgagccccaccccatctgctgagggctaccaggatgtgcgggacaggatgatccacaggagcaccagccagggcagcatcaacagccctgtgtacagccgccacagctacacccccaccaccagccgcagcccccagcacttccacaggccagaccagggcatcaacatctacaggaagccacccatctacaagcagcacgccgccctggccgcccagagcaagagcagcgaggacatcatcaagttcagcaagtttcctgctgcccaggccccagaccccagcgagacccccaagattgaaacagaccactggccaggccccccatcctttgctgtggtgggccctgacatgaagagaagaagcagcggccgggaggaggatgatgaggagctgctgcggcggcggcagctgcaggaggagcagctgatgaagctgaacagcggcctgggccagctgatcctgaaggaggagatggagaaggagagccgggagaggagcagcctgctggccagccgctatgacagccccatcaacagcgccagccacatccccagcagcaagacagccagcctgcccggctacggcagaaatggcctgcacaggcctgtgtccacagactttgcccagtacaacagctatggagatgtgtctggaggagtgcgggactaccagaccctgcctgatggccacatgcctgccatgaggatggacagaggagtgtccatgcccaacatgctggagcccaagatcttcccctatgagatgctgatggtgaccaacagaggaagaaacaagatcctgcgggaggtggacaggacccggctggagcggcacctggcccctgaggtgttccgggagatcttcggcatgagcatccaggagtttgaccggctgcccctgtggaggagaaatgacatgaagaagaaggccaagctgttctag

SEQ ID NO: 19761 - DNA, 1968 bp, Artificial Sequence
  Description of Artificial Sequence: Synthetic coding sequence
atggtgaaggagaaggtggcccacccccaggacccccaccaccccagcgagaagcctgtgatccactgccacaagtgtggggagccctgcaagggggaggtgctgcgggtgcagaccaagcacttccacatcaagtgcttcacctgcaaggtgtgtggctgtgacctggcccagggcggcttcttcatcaagaatggagagtacctgtgcaccctggactaccagaggatgtatggcacccgctgccacggctgtggggagtttgtggagggggaggtggtgacagccctgggcaagacctaccaccccaactgctttgcctgcaccatctgcaagaggcccttccccccaggggacagagtgaccttcaacggccgggactgcctgtgccagctgtgtgcccagcccatgagcagcagccccaaggagaccaccttcagcagcaactgtgccggctgcggccgggacatcaagaatggccaggccctgctggccctggacaagcagtggcacctgggctgcttcaagtgcaagagctgtgggaaggtgctgactggagagtacatcagcaaggatggagccccctactgtgagaaggactaccagggcctgtttggagtgaagtgtgaggcctgccaccagttcatcaccgggaaggtgctggaggccggggacaagcactaccaccccagctgtgcccgctgcagccgctgcaaccagatgttcacagaaggagaggagatgtacctgcagggcagcacagtgtggcacccagactgcaagcagagcaccaagacagaggagaagctgcggcccaccaggaccagcagcgagagcatctacagccggcccggcagcagcatccctggcagccctggccacaccatctatgccaaggtggacaatgagatcctggactacaaggacctggccgccatccccaaggtgaaggccatctatgacatcgagaggccagacctgatcacctatgagcccttctacaccagcggctatgatgacaagcaggagcggcagagcctgggggagagccccaggaccctgagccccaccccatctgctgagggctaccaggatgtgcgggacaggatgatccacaggagcaccagccagggcagcatcaacagccctgtgtacagccgccacagctacacccccaccaccagccgcagcccccagcacttccacaggcctggaaatgagcccagcagcggcaggaacagccccctgccctacagaccagacagccggcccctgacccccacctacgcccaggcccccaagcacttccacgtgcctgaccagggcatcaacatctacaggaagccacccatctacaagcagcacggccctgacatgaagagaagaagcagcggccgggaggaggatgatgaggagctgctgcggcggcggcagctgcaggaggagcagctgatgaagctgaacagcggcctgggccagctgatcctgaaggaggagatggagaaggagagccgggagaggagcagcctgctggccagccgctatgacagccccatcaacagcgccagccacatccccagcagcaagacagccagcctgcccggctacggcagaaatggcctgcacaggcctgtgtccacagactttgcccagtacaacagctatggagatgtgtctggaggagtgcgggacttccagaccctgcctgatggccacatgcctgccatgaggatggacagaggagtgtccatgcccaacatgctggagcccaagatcttcccctatgagatgctgatggtgaccaacagaggaagaaacaagatcctgcgggaggtggacaggacccggctggagcggcacctggcccctgaggtgttccgggagatcttcggcatgagcatccaggagtttgaccggctgcccctgtggaggagaaatgacatgaagaagaaggccaagctgttctag

SEQ ID NO: 19762 - DNA, 2541 bp, Artificial Sequence
  Description of Artificial Sequence: Synthetic coding sequence
atgcctgccttcctgggcctgaagtgcctgggcaagctgtgcagcagcgagaagagcaaggtgaccagcagcgagaggaccagcgcccggggcagcaacaggaagaggctcatcgtggaggaccggcgggtgtctggcaccagcttcaccgcccacagaagagccaccatcacccacctgctgtacctgtgccccaaggactactgcccccggggccgggtgtgcaacagcgtggacccctttgtggcccacccccaggacccccaccaccccagcgagaagcctgtgatccactgccacaagtgtggggagccctgcaagggggaggtgctgcgggtgcagaccaagcacttccacatcaagtgcttcacctgcaaggtgtgtggctgtgacctggcccagggcggcttcttcatcaagaatggagagtacctgtgcaccctggactaccagaggatgtatggcacccgctgccacggctgtggggagtttgtggagggggaggtggtgacagccctgggcaagacctaccaccccaactgctttgcctgcaccatctgcaagaggcccttccccccaggggacagagtgaccttcaacggccgggactgcctgtgccagctgtgtgcccagcccatgagcagcagccccaaggagaccaccttcagcagcaactgtgccggctgcggccgggacatcaagaatggccaggccctgctggccctggacaagcagtggcacctgggctgcttcaagtgcaagagctgtgggaaggtgctgactggagagtacatcagcaaggatggagccccctactgtgagaaggactaccagggcctgtttggagtgaagtgtgaggcctgccaccagttcatcaccgggaaggtgctggaggccggggacaagcactaccaccccagctgtgcccgctgcagccgctgcaaccagatgttcacagaaggagaggagatgtacctgcagggcagcacagtgtggcacccagactgcaagcagagcaccaagacagaggagaagctgcggctgcccaacatccgccgcagcagcagtgacttcttctacagcaagagcctcatccggaggacaggccgcagccccagcctgcagcccaccaggaccagcagcgagagcatctacagccggcccggcagcagcatccctggcagccctggccacaccatctatgccaaggtggacaatgagatcctggactacaaggacctggccgccatccccaaggtgaaggccatctatgacatcgagaggccagacctgatcacctatgagcccttctacaccagcggctatgatgacaagcaggagcggcagagcctgggggagagccccaggaccctgagccccaccccatctgctgagggctaccaggatgtgcgggacaggatgatccacaggagcaccagccagggcagcatcaacagccctgtgtacagccgccacagctacacccccaccaccagccgcagcccccagcacttccacaggcctgagctgctgagccctggggtgcagaggctgagctacctgcggaccagcagcctgagccccacccacagcgacagccggcccaacccccccttccgccaccacttcatcccccacatcaagggaaatgagcccagcagcggcaggaacagccccctgccctacagaccagacagccggcccctgacccccacctacgcccaggcccccaagcacttccacgtgcctgaccagggcatcaacatctacaggaagccacccatctacaagcagcacgccgccctggccgcccagagcaagagcagcgaggacatcatcaagttcagcaagtttcctgctgcccaggccccagaccccagcgagacccccaagattgaaacagaccactggccaggcccccccagctttgctgtggtgggccctgacatgaagaggaggagcagcggccgggaggaggatgatgaggagctgctgcggcggcggcagctgcaggaggagcagctgatgaagctgaacagcggcctgggccagctgatcctgaaggaggagatggagaaggagagccgggagaggagcagcctgctggccagccgctatgacagccccatcaacagcgccagccacatccccagcagcaagacagccagcctgcccggctatggaagaaatggcctgcacaggcctgtgtccacagactttgcccagtacaacagctatggagatgtgtctgggggcgtgcgggagtaccagaccctgcctgatggccacatgcctgccatgaggatggaccggggcgtgtccatgcccaacatgctggagcccaagatcttcccctatgagatgctgatggtgaccaacagaggaagaaacaagatcctgcgggaggtggacaggacccggctggagcggcacctggcccctgaggtgttccgggagatcttcggcatgagcatccaggagtttgaccggctgcccctgtggaggagaaatgacatgaagaagaaggccaagctgttctag

SEQ ID NO: 19763 - DNA, 2109 bp, Artificial Sequence
  Description of Artificial Sequence: Synthetic coding sequence
atggtgcctgaccctgtggcccacccccaggacccccaccaccccagcgagaagcctgtgatccactgccacaagtgtggggagccctgcaagggggaggtgctgcgggtgcagaccaagcacttccacatcaagtgcttcacctgcaaggtgtgtggctgtgacctggcccagggcggcttcttcatcaagaatggagagtacctgtgcaccctggactaccagaggatgtatggcacccgctgccacggctgtggggagtttgtggagggggaggtggtgacagccctgggcaagacctaccaccccaactgctttgcctgcaccatctgcaagaggcccttccccccaggggacagagtgaccttcaacggccgggactgcctgtgccagctgtgtgcccagcccatgagcagcagccccaaggagaccaccttcagcagcaactgtgccggctgcggccgggacatcaagaatggccaggccctgctggccctggacaagcagtggcacctgggctgcttcaagtgcaagagctgtgggaaggtgctgactggagagtacatcagcaaggatggagccccctactgtgagaaggactaccagggcctgtttggagtgaagtgtgaggcctgccaccagttcatcaccgggaaggtgctggaggccggggacaagcactaccaccccagctgtgcccgctgcagccgctgcaaccagatgttcacagaaggagaggagatgtacctgcagggcagcacagtgtggcacccagactgcaagcagagcaccaagacagaggagaagctgcggcccaccaggaccagcagcgagagcatctacagccggcccggcagcagcatccctggcagccctggccacaccatctatgccaaggtggacaatgagatcctggactacaaggacctggccgccatccccaaggtgaaggccatctatgacatcgagaggccagacctgatcacctatgagcccttctacaccagcggctatgatgacaagcaggagcggcagagcctgggggagagccccaggaccctgagccccaccccatctgctgagggctaccaggatgtgcgggacaggatgatccacaggagcaccagccagggcagcatcaacagccctgtgtacagccgccacagctacacccccaccaccagccgcagcccccagcacttccacaggcctggaaatgagcccagcagcggcaggaacagccccctgccctacagaccagacagccggcccctgacccccacctacgcccaggcccccaagcacttccacgtgcctgaccagggcatcaacatctacaggaagccacccatctacaagcagcacgccgccctggccgcccagagcaagagcagcgaggacatcatcaagttcagcaagtttcctgctgcccaggccccagaccccagcgagacccccaagattgaaacagaccactggccaggcccccccagctttgctgtggtgggccctgacatgaagaggaggagcagcggccgggaggaggatgatgaggagctgctgcggcggcggcagctgcaggaggagcagctgatgaagctgaacagcggcctgggccagctgatcctgaaggaggagatggagaaggagagccgggagaggagcagcctgctggccagccgctatgacagccccatcaacagcgccagccacatccccagcagcaagacagccagcctgcccggctatggaagaaatggcctgcacaggcctgtgtccacagactttgcccagtacaacagctatggagatgtgtctgggggcgtgcgggagtaccagaccctgcctgatggccacatgcctgccatgaggatggaccggggcgtgtccatgcccaacatgctggagcccaagatcttcccctatgagatgctgatggtgaccaacagaggaagaaacaagatcctgcgggaggtggacaggacccggctggagcggcacctggcccctgaggtgttccgggagatcttcggcatgagcatccaggagtttgaccggctgcccctgtggaggagaaatgacatgaagaagaaggccaagctgttctag

SEQ ID NO: 19764 - DNA, 1368 bp, Artificial Sequence
  Description of Artificial Sequence: Synthetic coding sequence
atgttcacagaaggagaggagatgtacctgcagggcagcacagtgtggcacccagactgcaagcagagcaccaagacagaggagaagctgcggctgcccaacatccgccgcagcagcagtgacttcttctacagcaagagcctcatccggaggacaggccgcagccccagcctgcagcccaccaggaccagcagcgagagcatctacagccggcccggcagcagcatccctggcagccctggccacaccatctatgccaaggtggacaatgagatcctggactacaaggacctggccgccatccccaaggtgaaggccatctatgacatcgagaggccagacctgatcacctatgagcccttctacaccagcggctatgatgacaagcaggagcggcagagcctgggggagagccccaggaccctgagccccaccccatctgctgagggctaccaggatgtgcgggacaggatgatccacaggagcaccagccagggcagcatcaacagccctgtgtacagccgccacagctacacccccaccaccagccgcagcccccagcacttccacaggccagaccagggcatcaacatctacaggaagccacccatctacaagcagcacgccgccctggccgcccagagcaagagcagcgaggacatcatcaagttcagcaagtttcctgctgcccaggccccagaccccagcgagacccccaagattgaaacagaccactggccaggccccccatcctttgctgtggtgggccctgacatgaagagaagaagcagcggccgggaggaggatgatgaggagctgctgcggcggcggcagctgcaggaggagcagctgatgaagctgaacagcggcctgggccagctgatcctgaaggaggagatggagaaggagagccgggagaggagcagcctgctggccagccgctatgacagccccatcaacagcgccagccacatccccagcagcaagacagccagcctgcccggctacggcagaaatggcctgcacaggcctgtgtccacagactttgcccagtacaacagctatggagatgtgtctggaggagtgcgggacttccagaccctgcctgatggccacatgcctgccatgaggatggacagaggagtgtccatgcccaacatgctggagcccaagatcttcccctatgagatgctgatggtgaccaacagaggaagaaacaagatcctgcgggaggtggacaggacccggctggagcggcacctggcccctgaggtgttccgggagatcttcggcatgagcatccaggagtttgaccggctgcccctgtggaggagaaatgacatgaagaagaaggccaagctgttctag

SEQ ID NO: 19765 - DNA, 2241 bp, Artificial Sequence
  Description of Artificial Sequence: Synthetic coding sequence
atgctgatgaccctggagatgacagagctgacagacccccaccacaccatgggagactacaaggtggcccacccccaggacccccaccaccccagcgagaagcctgtgatccactgccacaagtgtggggagccctgcaagggggaggtgctgcgggtgcagaccaagcacttccacatcaagtgcttcacctgcaaggtgtgtggctgtgacctggcccagggcggcttcttcatcaagaatggagagtacctgtgcaccctggactaccagaggatgtatggcacccgctgccacggctgtggggagtttgtggagggggaggtggtgacagccctgggcaagacctaccaccccaactgctttgcctgcaccatctgcaagaggcccttccccccaggggacagagtgaccttcaacggccgggactgcctgtgccagctgtgtgcccagcccatgagcagcagccccaaggagaccaccttcagcagcaactgtgccggctgcggccgggacatcaagaatggccaggccctgctggccctggacaagcagtggcacctgggctgcttcaagtgcaagagctgtgggaaggtgctgactggagagtacatcagcaaggatggagccccctactgtgagaaggactaccagggcctgtttggagtgaagtgtgaggcctgccaccagttcatcaccgggaaggtgctggaggccggggacaagcactaccaccccagctgtgcccgctgcagccgctgcaaccagatgttcacagaaggagaggagatgtacctgcagggcagcacagtgtggcacccagactgcaagcagagcaccaagacagaggagaagctgcggctgcccaacatccgccgcagcagcagtgacttcttctacagcaagagcctcatccggaggacaggccgcagccccagcctgcagcccaccaggaccagcagcgagagcatctacagccggcccggcagcagcatccctggcagccctggccacaccatctatgccaaggtggacaatgagatcctggactacaaggacctggccgccatccccaaggtgaaggccatctatgacatcgagaggccagacctgatcacctatgagcccttctacaccagcggctatgatgacaagcaggagcggcagagcctgggggagagccccaggaccctgagccccaccccatctgctgagggctaccaggatgtgcgggacaggatgatccacaggagcaccagccagggcagcatcaacagccctgtgtacagccgccacagctacacccccaccaccagccgcagcccccagcacttccacaggcctggaaatgagcccagcagcggcaggaacagccccctgccctacagaccagacagccggcccctgacccccacctacgcccaggcccccaagcacttccacgtgcctgaccagggcatcaacatctacaggaagccacccatctacaagcagcacgccgccctggccgcccagagcaagagcagcgaggacatcatcaagttcagcaagtttcctgctgcccaggccccagaccccagcgagacccccaagattgaaacagaccactggccaggcccccccagctttgctgtggtgggccctgacatgaagaggaggagcagcggccgggaggaggatgatgaggagctgctgcggcggcggcagctgcaggaggagcagctgatgaagctgaacagcggcctgggccagctgatcctgaaggaggagatggagaaggagagccgggagaggagcagcctgctggccagccgctatgacagccccatcaacagcgccagccacatccccagcagcaagacagccagcctgcccggctatggaagaaatggcctgcacaggcctgtgtccacagactttgcccagtacaacagctatggagatgtgtctgggggcgtgcgggacttccagaccctgcctgatggccacatgcctgccatgaggatggaccggggcgtgtccatgcccaacatgctggagcccaagatcttcccctatgagatgctgatggtgaccaacagaggaagaaacaagatcctgcgggaggtggacaggacccggctggagcggcacctggcccctgaggtgttccgggagatcttcggcatgagcatccaggagtttgaccggctgcccctgtggaggagaaatgacatgaagaagaaggccaagctgttctag

SEQ ID NO: 19766 - DNA, 915 bp, Artificial Sequence
  Description of Artificial Sequence: Synthetic coding sequence
atggccgaggccagcgctgctggagctgacagcggggctgctgtggccgcccaccgcttcttctgccacttctgcaagggggaggtgagccccaagctgcctgagtacatctgcccccgctgtgagagcggcttcatcgaggaggtgacagatgacagcagcttcctgggcggcggcggcagcagaattgacaacaccaccaccacccactttgctgagctgtggggccacctggaccacaccatgttcttccaggacttccggcccttcctgagcagcagccccctggaccaggacaacagagccaatgaaagaggccaccagacccacacagacttctggggcgcccggcccccccggctgcccctgggccgccgctaccgcagccggggcagcagcaggccagacaggagccctgccatcgagggcatcctgcagcacatctttgctggcttctttgccaacagcgccatccctggcagcccccaccccttctcctggagcggcatgctgcacagcaaccctggggactatgcctggggccagacaggcctggatgccatcgtgacccagctgctgggccagctggagaacacaggccccccacctgctgacaaggagaagatcaccagcctgcccaccgtgacagtgacccaggagcaggtggacatgggcctggagtgccctgtgtgcaaggaggactacacagtggaggaggaggtgcggcagctgccctgcaaccacttcttccacagcagctgcatcgtgccctggctggagctgcatgacacctgccctgtgtgcaggaagagcctgaatggagaggacagcacccggcagagccagagcacagaggccagcgccagcaaccgcttcagcaatgacagccagctgcatgaccgctggaccttctag

SEQ ID NO: 19767 - DNA, 636 bp, Artificial Sequence
  Description of Artificial Sequence: Synthetic coding sequence
atgagctgcaccatcgagaagatcctgacagatgccaagaccctgctggagcggctgcgggagcatgatgctgctgctgagagcctggtggaccagagcgctgccctgcaccggcgggtggccgccatgagggaggccggcacagccctgcctgaccaggtgcggcagcgctaccaggaggatgccagtgacatgaaggacatgagcaagtacaagccccacatcctgctgagccaggagaacacccagatccgggacctgcagcaggagaaccgggagctgtggatcagcctggaggagcaccaggatgccctggagctgatcatgagcaagtacaggaagcagatgctgcagctgatggtggccaagaaggctgtggatgctgagcctgtgctgaaggcccaccagagccacagcgctgagattgagagccagattgaccgcatctgtgagatgggagaggtgatgaggaaggctgtgcaggtggatgatgaccagttctgcaagatccaggagaagctggcccagctggagctggagaacaaggagctgcgggagctgctgagcatcagcagcgagagcctgcaggccaggaaggagaacagcatggacacagccagccaggccatcaagtag

SEQ ID NO: 19768 - DNA, 2451 bp, Artificial Sequence
  Description of Artificial Sequence: Synthetic coding sequence
atggtgctgatgttccagatccgctacatcagccagacccagggcctgcctgctgagtacctgctgtctgctggcaccaagaccacccgcttcttcaacagagaccccaacctgggctaccccctgtggaggctgaagaccccagaggagcacgagctggagaccggcatcaagagcaaggaggccaggaagtacatcttcaactgcctggatgacatggcccaggtgaacatgagcacagacctggagggcacagacatgctggccgagaaggctgaccggcgggagtacatcgacctgctgaagaagatgctgaccattgatgctgacaagaggatcacccccctgaagaccctgaaccaccagtttgtgaccatgacccacctgctggacttcccccacagcaaccacgtgaagagctgcttccagaacatggagatctgcaagagaagagtgcacatgtatgacacagtgtcccagatcaagagccccttcaccacccacgtggcccccaacaccagcaccaacctgaccatgtccttcagcaaccagctgaacacagtgcacaaccaggcctctgtgctggccagcagcagcacagctgctgctgccaccctgagcctggccaacagtgatgtgtccctgctgaactaccagagcgccctgtaccccagcagcgctgcccctgtgcctggggtggcccagcagggcgtgtccctgcagcccggcaccacccagatctgcacccagacagaccccttccagcagaccttcatcgtgtgccccccagccttccagacaggcctgcaggccaccaccaagcacagcggcttccctgtgaggatggacaatgctgtgcccatcgtgccccaggccccagctgcccagcccctgcagatccagagcggcgtgctgacccagggcagctgcacccccctgatggtggccaccctgcacccccaggtggccaccatcaccccccagtatgctgtgcccttcaccctgagctgtgccgccggccggcctgccctggtggagcagacagctgctgtgctgcaggcctggccaggcggcacccagcagatcctgctgcccagcacctggcagcagctgcccggggtggccctgcacaacagcgtgcagcccacagccatgatccctgaggccatgggcagcggccagcagctggccgactggagaaatgcccacagccacggcaaccagtacagcaccatcatgcagcagcccagcctgctgaccaaccacgtgaccctggccacagcccagcccctgaatgtgggcgtggcccacgtggtgcggcagcagcagagcagcagcctgcccagcaagaagaacaagcagagcgcccctgtgagcagcaagagcagcctggatgtgctgcccagccaggtgtacagcctggtgggcagcagccccctgcggaccaccagcagctacaacagcctggtgcctgtgcaggaccagcaccagcccatcatcatcccagacacccccagcccccctgtgtctgtcatcaccatccgcagtgacacagatgaggaggaggacaacaagtacaagcccagcagcagcggcctgaagcccaggagcaatgtcatctcctatgtgacagtgaatgacagcccagacagcgacagcagcctgagcagcccctacagcacagacaccctgagcgccctgcggggcaacagcggctctgtgctggagggccctggccgggtggtggctgatggcaccggcaccaggaccatcatcgtgccccccctgaagacccagctgggggactgcaccgtggccacccaggccagcggcctgctgagcaacaagaccaagcctgtggcctctgtgtctggccagagcagcggctgctgcatcacccccaccggctaccgggcccagaggggcggcaccagcgctgcccagcccctgaacctgagccagaaccagcagagcagcgctgcccccaccagccaggagaggagcagcaacccagccccccggcggcagcaggcctttgtggcccccctgagccaggccccctacaccttccagcacggcagccccctgcacagcacaggccacccccacctggccccagccccagcccacctgcccagccaggcccacctgtacacctatgctgcccccaccagcgctgctgccctgggcagcaccagcagcatcgcccacctgttcagcccccagggcagcagcagacatgctgctgcctacaccacccaccccagcaccctggtgcaccaggtgcctgtgtctgtgggccccagcctgctgaccagcgcctctgtggccccagcccagtaccagcaccagtttgccacccagagctacatcggcagcagccggggcagcaccatctacacaggctaccccctgagccccaccaagatcagccagtacagctacctgtag

SEQ ID NO: 19769 - DNA, 3498 bp, Artificial Sequence
  Description of Artificial Sequence: Synthetic coding sequence
atggccagccagctgcaggtgttcagcccccccagcgtgagcagcagcgccttctgcagcgccaagaagctgaagattgagcccagcggctgggatgtgtctggccagagcagcaatgacaagtactacacccacagcaagaccctgcctgccacccagggccaggccaacagcagccaccaggtggccaacttcaacatcccagcctatgaccagggcctgctgctgcctgccccagctgtggagcacatcgtggtgacagctgctgacagcagcggcagcgctgccaccagcaccttccagagcagccagaccctgacccacaggagcaatgtgtccctgctggagccctaccagaagtgtggcctgaagaggaagtctgaggaggtggacagcaatggatctgtgcagatcatcgaggagcacccccccctgatgctgcagaacagaacagtggtgggcgccgccgccaccaccaccaccgtgaccaccaagagcagcagcagcagcggggagggggactaccagctggtgcagcacgagatcctgtgcagcatgaccaacagctatgaggtgctggagttcctgggccggggcaccttcggccaggtggccaagtgctggaagaggagcaccaaggagatcgtggccatcaagatcctgaagaaccaccccagctatgcccggcagggccagatcgaggtgtccatcctgagccggctgagcagtgaaaatgctgatgagtacaactttgtgcgctcctatgagtgcttccagcacaagaaccacacctgcctggtgtttgagatgctggagcagaacctgtatgacttcctgaagcagaacaagttcagccccctgcccctgaagtacatccggcccatcctgcagcaggtggccacagccctgatgaagctgaagagcctgggcctcatccacgccgacctgaagccagagaacatcatgctggtggaccctgtgcggcagccctacagagtgaaggtgattgactttggcagcgccagccacgtgtccaaggctgtgtgcagcacctacctgcagagccgctactaccgggcccctgagatcatcctgggcctgcccttctgtgaggccatcgacatgtggagcctgggctgtgtgattgctgagctgttcctgggctggcccctgtacccaggggcctctgaatatgaccagatccgctacatcagccagacccagggcctgcctgctgagtacctgctgtctgctggcaccaagaccacccgcttcttcaacagagaccccaacctgggctaccccctgtggaggctgaagaccccagaggagcacgagctggagaccggcatcaagagcaaggaggccaggaagtacatcttcaactgcctggatgacatggcccaggtgaacatgagcacagacctggagggcacagacatgctggccgagaaggctgaccggcgggagtacatcgacctgctgaagaagatgctgaccattgatgctgacaagaggatcacccccctgaagaccctgaaccaccagtttgtgaccatgacccacctgctggacttcccccacagcaaccacgtgaagagctgcttccagaacatggagatctgcaagagaagagtgcacatgtatgacacagtgtcccagatcaagagccccttcaccacccacgtggcccccaacaccagcaccaacctgaccatgtccttcagcaaccagctgaacacagtgcacaaccaggcctctgtgctggccagcagcagcacagctgctgctgccaccctgagcctggccaacagtgatgtgtccctgctgaactaccagagcgccctgtaccccagcagcgctgcccctgtgcctggggtggcccagcagggcgtgtccctgcagcccggcaccacccagatctgcacccagacagaccccttccagcagaccttcatcgtgtgccccccagccttccagacaggcctgcaggccaccaccaagcacagcggcttccctgtgaggatggacaatgctgtgcccatcgtgccccaggccccagctgcccagcccctgcagatccagagcggcgtgctgacccagcaggcctggccaggcggcacccagcagatcctgctgcccagcacctggcagcagctgcccggggtggccctgcacaacagcgtgcagcccacagccatgatccctgaggccatgggcagcggccagcagctggccgactggagaaatgcccacagccacggcaaccagtacagcaccatcatgcagcagcccagcctgctgaccaaccacgtgaccctggccacagcccagcccctgaatgtgggcgtggcccacgtggtgcggcagcagcagagcagcagcctgcccagcaagaagaacaagcagagcgcccctgtgagcagcaagagcagcctggatgtgctgcccagccaggtgtacagcctggtgggcagcagccccctgcggaccaccagcagctacaacagcctggtgcctgtgcaggaccagcaccagcccatcatcatcccagacacccccagcccccctgtgtctgtcatcaccatccgcagtgacacagatgaggaggaggacaacaagtacaagcccagcagcagcggcctgaagcccaggagcaatgtcatctcctatgtgacagtgaatgacagcccagacagcgacagcagcctgagcagcccctacagcacagacaccctgagcgccctgcggggcaacagcggctctgtgctggagggccctggccgggtggtggctgatggcaccggcaccaggaccatcatcgtgccccccctgaagacccagctgggggactgcaccgtggccacccaggccagcggcctgctgagcaacaagaccaagcctgtggcctctgtgtctggccagagcagcggctgctgcatcacccccaccggctaccgggcccagagaggaggcaccagcgctgcccagcccctgaacctgagccagaaccagcagagcagcgctgcccccaccagccaggagaggagcagcaacccagccccccggcggcagcaggcctttgtggcccccctgagccaggccccctacaccttccagcacggcagccccctgcacagcacaggccacccccacctggccccagccccagcccacctgcccagccaggcccacctgtacacctacgccgcccccaccagcgctgctgccctgggcagcaccagcagcatcgcccacctgttcagcccccagggcagcagcagacatgctgctgcctacaccacccaccccagcaccctggtgcaccaggtgcctgtgtctgtgggccccagcctgctgaccagcgcctctgtggccccagcccagtaccagcaccagtttgccacccagagctacatcggcagcagccggggcagcaccatctacacaggctaccccctgagccccaccaagatcagccagtacagctacctgtag

SEQ ID NO: 19770 - DNA, 3498 bp, Artificial Sequence; identical to SEQ ID NO: 19769
  Description of Artificial Sequence: Synthetic coding sequence

SEQ ID NO: 19771 - DNA, 3633 bp, Artificial Sequence
  Description of Artificial Sequence: Synthetic coding sequence
atggccagccagctgcaggtgttcagcccccccagcgtgagcagcagcgccttctgcagcgccaagaagctgaagattgagcccagcggctgggatgtgtctggccagagcagcaatgacaagtactacacccacagcaagaccctgcctgccacccagggccaggccaacagcagccaccaggtggccaacttcaacatcccagcctatgaccagggcctgctgctgcctgccccagctgtggagcacatcgtggtgacagctgctgacagcagcggcagcgctgccaccagcaccttccagagcagccagaccctgacccacaggagcaatgtgtccctgctggagccctaccagaagtgtggcctgaagaggaagtctgaggaggtggacagcaatggatctgtgcagatcatcgaggagcacccccccctgatgctgcagaacagaacagtggtgggcgccgccgccaccaccaccaccgtgaccaccaagagcagcagcagcagcggggagggggactaccagctggtgcagcacgagatcctgtgcagcatgaccaacagctatgaggtgctggagttcctgggccggggcaccttcggccaggtggccaagtgctggaagaggagcaccaaggagatcgtggccatcaagatcctgaagaaccaccccagctatgcccggcagggccagatcgaggtgtccatcctgagccggctgagcagtgaaaatgctgatgagtacaactttgtgcgctcctatgagtgcttccagcacaagaaccacacctgcctggtgtttgagatgctggagcagaacctgtatgacttcctgaagcagaacaagttcagccccctgcccctgaagtacatccggcccatcctgcagcaggtggccacagccctgatgaagctgaagagcctgggcctcatccacgccgacctgaagccagagaacatcatgctggtggaccctgtgcggcagccctacagagtgaaggtgattgactttggcagcgccagccacgtgtccaaggctgtgtgcagcacctacctgcagagccgctactaccgggcccctgagatcatcctgggcctgcccttctgtgaggccatcgacatgtggagcctgggctgtgtgattgctgagctgttcctgggctggcccctgtacccaggggcctctgaatatgaccagatccgctacatcagccagacccagggcctgcctgctgagtacctgctgtctgctggcaccaagaccacccgcttcttcaacagagaccccaacctgggctaccccctgtggaggctgaagaccccagaggagcacgagctggagaccggcatcaagagcaaggaggccaggaagtacatcttcaactgcctggatgacatggcccaggtgaacatgagcacagacctggagggcacagacatgctggccgagaaggctgaccggcgggagtacatcgacctgctgaagaagatgctgaccattgatgctgacaagaggatcacccccctgaagaccctgaaccaccagtttgtgaccatgacccacctgctggacttcccccacagcaaccacgtgaagagctgcttccagaacatggagatctgcaagagaagagtgcacatgtatgacacagtgtcccagatcaagagccccttcaccacccacgtggcccccaacaccagcaccaacctgaccatgtccttcagcaaccagctgaacacagtgcacaaccaggcctctgtgctggccagcagcagcacagctgctgctgccaccctgagcctggccaacagtgatgtgtccctgctgaactaccagagcgccctgtaccccagcagcgctgcccctgtgcctggggtggcccagcagggcgtgtccctgcagcccggcaccacccagatctgcacccagacagaccccttccagcagaccttcatcgtgtgccccccagccttccagacaggcctgcaggccaccaccaagcacagcggcttccctgtgaggatggacaatgctgtgcccatcgtgccccaggccccagctgcccagcccctgcagatccagagcggcgtgctgacccagggcagctgcacccccctgatggtggccaccctgcacccccaggtggccaccatcaccccccagtatgctgtgcccttcaccctgagctgtgccgccggccggcctgccctggtggagcagacagctgctgtgctgcaggcctggccaggcggcacccagcagatcctgctgcccagcacctggcagcagctgcccggggtggccctgcacaacagcgtgcagcccacagccatgatccctgaggccatgggcagcggccagcagctggccgactggagaaatgcccacagccacggcaaccagtacagcaccatcatgcagcagcccagcctgctgaccaaccacgtgaccctggccacagcccagcccctgaatgtgggcgtggcccacgtggtgcggcagcagcagagcagcagcctgcccagcaagaagaacaagcagagcgcccctgtgagcagcaagagcagcctggatgtgctgcccagccaggtgtacagcctggtgggcagcagccccctgcggaccaccagcagctacaacagcctggtgcctgtgcaggaccagcaccagcccatcatcatcccagacacccccagcccccctgtgtctgtcatcaccatccgcagtgacacagatgaggaggaggacaacaagtacaagcccagcagcagcggcctgaagcccaggagcaatgtcatctcctatgtgacagtgaatgacagcccagacagcgacagcagcctgagcagcccctacagcacagacaccctgagcgccctgcggggcaacagcggctctgtgctggagggccctggccgggtggtggctgatggcaccggcaccaggaccatcatcgtgccccccctgaagacccagctgggggactgcaccgtggccacccaggccagcggcctgctgagcaacaagaccaagcctgtggcctctgtgtctggccagagcagcggctgctgcatcacccccaccggctaccgggcccagaggggcggcaccagcgctgcccagcccctgaacctgagccagaaccagcagagcagcgctgcccccaccagccaggagaggagcagcaacccagccccccggcggcagcaggcctttgtggcccccctgagccaggccccctacaccttccagcacggcagccccctgcacagcacaggccacccccacctggccccagccccagcccacctgcccagccaggcccacctgtacacctatgctgcccccaccagcgctgctgccctgggcagcaccagcagcatcgcccacctgttcagcccccagggcagcagcagacatgctgctgcctacaccacccaccccagcaccctggtgcaccaggtgcctgtgtctgtgggccccagcctgctgaccagcgcctctgtggccccagcccagtaccagcaccagtttgccacccagagctacatcggcagcagccggggcagcaccatctacacaggctaccccctgagccccaccaagatcagccagtacagctacctgtag

SEQ ID NO: 19772 - DNA, 3228 bp, Artificial Sequence
  Description of Artificial Sequence: Synthetic coding sequence
atggccagccagctgcaggtgttcagcccccccagcgtgagcagcagcgccttctgcagcgccaagaagctgaagattgagcccagcggctgggatgtgtctggccagagcagcaatgacaagtactacacccacagcaagaccctgcctgccacccagggccaggccaacagcagccaccaggtggccaacttcaacatcccagcctatgaccagggcctgctgctgcctgccccagctgtggagcacatcgtggtgacagctgctgacagcagcggcagcgctgccaccagcaccttccagagcagccagaccctgacccacaggagcaatgtgtccctgctggagccctaccagaagtgtggcctgaagaggaagtctgaggaggtggacagcaatggatctgtgcagatcatcgaggagcacccccccctgatgctgcagaacagaacagtggtgggcgccgccgccaccaccaccaccgtgaccaccaagagcagcagcagcagcggggagggggactaccagctggtgcagcacgagatcctgtgcagcatgaccaacagctatgaggtgctggagttcctgggccggggcaccttcggccaggtggccaagtgctggaagaggagcaccaaggagatcgtggccatcaagatcctgaagaaccaccccagctatgcccggcagggccagatcgaggtgtccatcctgagccggctgagcagtgaaaatgctgatgagtacaactttgtgcgctcctatgagtgcttccagcacaagaaccacacctgcctggtgtttgagatgctggagcagaacctgtatgacttcctgaagcagaacaagttcagccccctgcccctgaagtacatccggcccatcctgcagcaggtggccacagccctgatgaagctgaagagcctgggcctcatccacgccgacctgaagccagagaacatcatgctggtggaccctgtgcggcagccctacagagtgaaggtgattgactttggcagcgccagccacgtgtccaaggctgtgtgcagcacctacctgcagagccgctactaccgggcccctgagatcatcctgggcctgcccttctgtgaggccatcgacatgtggagcctgggctgtgtgattgctgagctgttcctgggctggcccctgtacccaggggcctctgaatatgaccagatccgctacatcagccagacccagggcctgcctgctgagtacctgctgtctgctggcaccaagaccacccgcttcttcaacagagaccccaacctgggctaccccctgtggaggctgaagaccccagaggagcacgagctggagaccggcatcaagagcaaggaggccaggaagtacatcttcaactgcctggatgacatggcccaggtgaacatgagcacagacctggagggcacagacatgctggccgagaaggctgaccggcgggagtacatcgacctgctgaagaagatgctgaccattgatgctgacaagaggatcacccccctgaagaccctgaaccaccagtttgtgaccatgacccacctgctggacttcccccacagcaaccacgtgaagagctgcttccagaacatggagatctgcaagagaagagtgcacatgtatgacacagtgtcccagatcaagagccccttcaccacccacgtggcccccaacaccagcaccaacctgaccatgtccttcagcaaccagctgaacacagtgcacaaccaggcctctgtgctggccagcagcagcacagctgctgctgccaccctgagcctggccaacagtgatgtgtccctgctgaactaccagagcgccctgtaccccagcagcgctgcccctgtgcctggggtggcccagcagggcgtgtccctgcagcccggcaccacccagatctgcacccagacagaccccttccagcagaccttcatcgtgtgccccccagccttccagacaggcctgcaggccaccaccaagcacagcggcttccctgtgaggatggacaatgctgtgcccatcgtgccccaggccccagctgcccagcccctgcagatccagagcggcgtgctgacccagggcagctgcacccccctgatggtggccaccctgcacccccaggtggccaccatcaccccccagtatgctgtgcccttcaccctgagctgtgccgccggccggcctgccctggtggagcagacagctgctgtgctgcaggcctggccaggcggcacccagcagatcctgctgcccagcacctggcagcagctgcccggggtggccctgcacaacagcgtgcagcccacagccatgatccctgaggccatgggcagcggccagcagctggccgactggagaaatgcccacagccacggcaaccagtacagcaccatcatgcagcagcccagcctgctgaccaaccacgtgaccctggccacagcccagcccctgaatgtgggcgtggcccacgtggtgcggcagcagcagagcagcagcctgcccagcaagaagaacaagcagagcgcccctgtgagcagcaagagcagcctggatgtgctgcccagccaggtgtacagcctggtgggcagcagccccctgcggaccaccagcagctacaacagcctggtgcctgtgcaggaccagcaccagcccatcatcatcccagacacccccagcccccctgtgtctgtcatcaccatccgcagtgacacagatgaggaggaggacaacaagtacaagcccagcagcagcggcctgaagcccaggagcaatgtcatctcctatgtgacagtgaatgacagcccagacagcgacagcagcctgagcagcccctacagcacagacaccctgagcgccctgcggggcaacagcggctctgtgctggagggccctggccgggtggtggctgatggcaccggcaccaggaccatcatcgtgccccccctgaagacccagctgggggactgcaccgtggccacccaggccagcggcctgctgagcaacaagaccaagcctgtggcctctgtgtctggccagagcagcggctgctgcatcacccccaccggctaccgggcccagaggggcggcaccagcgctgcccagcccctgaacctgagccaggtgtctgccatgggctactgcctgctgtttggcccctgcaccgtggtgaccttctggaggaccctgctgctggccggctgctag

SEQ ID NO: 19773 - DNA, 543 bp, Artificial Sequence
  Description of Artificial Sequence: Synthetic coding sequence
atgcaggccgagggccagggcaccggcggcagcactggagatgctgatggccctgggggccctggcatcccagatggccctggaggaaatgccggcggccctggagaggccggggccaccggcggccggggccccaggggggccggggccgcccgggccagcggcccccggggcggggccccccggggcccccatggaggagctgccagcgcccaggacggccgctgcccctgtggggcccggcggccagacagccggctgctgcagctgcacatcaccatgcccttcagcagccccatggaggccgagctggtgcggcgcatcctgagcagagatgctgcccccctgcccaggcctggagctgtgctgaaggacttcaccgtgtctggcaacctgctcttcatccggctgacagctgctgaccaccggcagctgcagctgagcatcagcagctgcctgcagcagctgagcctgctgatgtggatcacccagtgcttcctgcccgtcttcctggcccaggcccccagcggccagaggaggtag

SEQ ID NO: 19774 - DNA, 717 bp, Artificial Sequence
  Description of Artificial Sequence: Synthetic coding sequence
atgtctgaggacctggccaagcagctggccagctacaaggcccagctgcagcaggtggaggccgccctgtctggaaatggagaaaatgaagacctgctgaagctgaagaaggacctgcaggaggtgattgagctgaccaaggacctgctgagcacccagcccagcgagaccctggccagcagtgacagctttgccagcacccagcccacccacagctggaaggtgggggacaagtgcatggctgtgtggagcgaagatggccagtgctatgaggccgagattgaggagattgatgaggagaatggaacagctgccatcacctttgctggctatggaaatgctgaggtgacccccctgctgaacctgaagcctgtggaggagggcaggaaggccaaggaggacagcggcaacaagcccatgagcaagaaggagatgattgcccagcagcgggagtacaagaagaagaaggccctgaagaaggcccagaggatcaaggagctggagcaggagcgggaggaccagaaggtgaagtggcagcagttcaacaacagagcctacagcaagaacaagaagggccaggtgaagaggagcatctttgccagccctgagagcgtgacaggcaaggtgggcgtgggcacctgtggcattgctgacaagcccatgacccagtaccaggacaccagcaagtacaacgtgcgccacctgatgccccagtag

SEQ ID NO: 19775 - DNA, 717 bp, Artificial Sequence; identical to SEQ ID NO: 19774
  Description of Artificial Sequence: Synthetic coding sequence

SEQ ID NO: 19776 - DNA, 2229 bp, Artificial Sequence
  Description of Artificial Sequence: Synthetic coding sequence
gacctgagcagcggcggcggcatcgagccccagtgcagcagcgaggtgtacttccgggcccgggagcggggctgtgaaaatgtggcctggagcctgggcctgcggagccactgcttcctggaggccgagctgcaccccctgccctggttcctgcccaccaacgtgtgcagccccctgcccggggccgcccacaagctggtgtgctacttcaccaactgggcccacagccggcccggccctgccagcatcctgccccatgacctggaccccttcctgtgcacccacctgatctttgcctttgcctccatgaacaacaaccagatcgtggccaaggacctgcaggatgagaagatcctgtacccagagttcaacaagctgaaggagaggatgtggcagcagctgcccaccggggtgaagaacccagcccaccagcccagcctgagccaccacaggaaccgggagctgaagaccctgctgagcattggaggctggaactttggcaccagccgcttcaccaccatgctgagcacctttgccaaccgggagaagttcatcgccagcgtcatcagcctgctgcggacccatgactttgatggcctggacctcttcttcctgtacccaggcctgcggggcagccccatgcatgaccgctggaccttcctgttcctgattgaggagctgctgtttgccttcaggaaggaggccctgctgaccatgaggccccggctgctgctgtctgctgctgtgtctggagtgccccacatcgtgcagaccagctatgatgtgcgcttcctgggccgcctgctggacttcatcaacgtgctgtcctatgacctgcacggctcctgggagcgcttcaccggccacaacagccccctcttcagcctgcctgaggaccccaagagcagcgcctatgccatgaactactggaggaagctgggcgcccccagcgagaagctgatcatgggcatccccacctacggccgcaccttccggctgctgaaggccagcaagaatggcctgcaggcccgggccatcggccctgccagccctgggaagtacaccaagcaggagggcttcctggcctactttgagatctgcagctttgtgtggggcgccaagaagcactggattgactaccagtatgtgccctatgccaacaagggcaaggagtgggtgggctatgacaatgccatctccttctcctacaaggcctggttcatcagaagagagcactttggaggagccatggtgtggaccctggacatggatgatgtgcggggcaccttctgtggcaccggccccttccccctggtgtatgtgctgaatgacatcctggtgcgggcagagttcagcagcaccagcctgccccagttctggctgagcagcgctgtgaacagcagcagcacagatcctgagcggctggccgtgaccacagcctggaccacagacagcaagatcctgcccccaggaggagaggccggcgtgacagagatccacggcaaatgtgagaacatgaccatcaccccccggggcaccaccgtgacccccaccaaggagaccgtgtccctgggcaagcacacagtggccctgggggagaagacagagatcaccggggccatgaccatgacctctgtgggccaccagagcatgaccccaggagagaaggccctgacccctgtgggccaccagagcgtgaccaccggccagaagaccctgacctctgtgggctaccagagcgtgaccccaggagagaagaccctgacccctgtgggccaccagagcgtgacccctgtgagccaccagagcgtgtcccctgggggcaccaccatgacccctgtgcacttccagacagagaccctgcggcagaacacagtggcccccaggaggaaggctgtggcccgggagaaggtgacagtgcccagcaggaacatctctgtgaccccagagggccagaccatgcccctgcggggggagaacctgaccagcgaggtgggcacccaccccaggatgggcaacctgggcctgcagatggaggctgaaaataggatgatgctgagcagcagccctgtgatccagctgcctgagcagacccccctggcctttgacaacagatttgtgcccatctacggcaaccacagctctgtgaacagcgtgaccccccagaccagccccctgagcctgaagaaggagatccctgagaacagcgctgtggatgaggaggcctag

SEQ ID NO: 19777 - DNA, 2037 bp, Artificial Sequence
  Description of Artificial Sequence: Synthetic coding sequence
atgtggaagctgctgctgtgggtgggcctggtgctggtgctgaagcaccatgatggagctgcccacaagctggtgtgctacttcaccaactgggcccacagccggcccggccctgccagcatcctgccccatgacctggaccccttcctgtgcacccacctgatctttgcctttgcctccatgaacaacaaccagatcgtggccaaggacctgcaggatgagaagatcctgtacccagagttcaacaagctgaaggagaggaaccgggagctgaagaccctgctgagcattggaggctggaactttggcaccagccgcttcaccaccatgctgagcacctttgccaaccgggagaagttcatcgccagcgtcatcagcctgctgcggacccatgactttgatggcctggacctcttcttcctgtacccaggcctgcggggcagccccatgcatgaccgctggaccttcctgttcctgattgaggagctgctgtttgccttcaggaaggaggccctgctgaccatgaggccccggctgctgctgtctgctgctgtgtctggagtgccccacatcgtgcagaccagctatgatgtgcgcttcctgggccgcctgctggacttcatcaacgtgctgtcctatgacctgcacggctcctgggagcgcttcaccggccacaacagccccctcttcagcctgcctgaggaccccaagagcagcgcctatgccatgaactactggaggaagctgggcgcccccagcgagaagctgatcatgggcatccccacctacggccgcaccttccggctgctgaaggccagcaagaatggcctgcaggcccgggccatcggccctgccagccctgggaagtacaccaagcaggagggcttcctggcctactttgagatctgcagctttgtgtggggcgccaagaagcactggattgactaccagtatgtgccctatgccaacaagggcaaggagtgggtgggctatgacaatgccatctccttctcctacaaggcctggttcatcagaagagagcactttggaggagccatggtgtggaccctggacatggatgatgtgcggggcaccttctgtggcaccggccccttccccctggtgtatgtgctgaatgacatcctggtgcgggcagagttcagcagcaccagcctgccccagttctggctgagcagcgctgtgaacagcagcagcacagatcctgagcggctggccgtgaccacagcctggaccacagacagcaagatcctgcccccaggaggagaggccggcgtgacagagatccacggcaaatgtgagaacatgaccatcaccccccggggcaccaccgtgacccccaccaaggagaccgtgtccctgggcaagcacacagtggccctgggggagaagacagagatcaccggggccatgaccatgacctctgtgggccaccagagcatgaccccaggagagaaggccctgacccctgtgggccaccagagcgtgaccaccggccagaagaccctgacctctgtgggctaccagagcgtgaccccaggagagaagaccctgacccctgtgggccaccagagcgtgacccctgtgagccaccagagcgtgtcccctgggggcaccaccatgacccctgtgcacttccagacagagaccctgcggcagaacacagtggcccccaggaggaaggctgtggcccgggagaaggtgacagtgcccagcaggaacatctctgtgaccccagagggccagaccatgcccctgcggggggagaacctgaccagcgaggtgggcacccaccccaggatgggcaacctgggcctgcagatggaggctgaaaataggatgatgctgagcagcagccctgtgatccagctgcctgagcagacccccctggcctttgacaacagatttgtgcccatctacggcaaccacagctctgtgaacagcgtgaccccccagaccagccccctgagcctgaagaaggagatccctgagaacagcgctgtggatgaggaggcctag

SEQ ID NO: 19778 - DNA, 1005 bp, Artificial Sequence
  Description of Artificial Sequence: Synthetic coding sequence
atgggcggcgctgtgtctgctggagaagataatgatgagctgattgacaacctgaaggaggcccagtacatcagaacagagctggtggagcaggccttccgggccatcgacagagctgactactacctggaggagttcaaggaaaatgcctacaaggacctggcctggaagcacggcaacatccacctgagcgccccctgcatctacagcgaggtgatggaggccctggacctgcagcccggcctgtccttcctgaacctgggcagcggcaccggctacctgagctccatggtgggcctcatcctgggcccctttggagtgaaccacggcgtggagctgcacagtgatgtgattgaatatgccaagcagaagctggacttcttcatccgcaccagtgacagctttgacaagtttgacttctgtgagcccagctttgtgactggaaactgcctggagatcagcccagactgcagccagtatgacagagtgtactgtggggccggcgtgcagaaggagcacgaggagtacatgaagaacctgctgaaggtgggcggcatcctggtgatgcccctggaggagaagccctgccacagcgagagcggcaagagccggctggtgcagctgccccctgtggccgtgcgcagcctgcaggacctggcccgcatcgccatccggggcaccatcaagaagatcatccaccaggagaccgtgtccaagaatggaaatggcctgaagaacaccccccgcttcaagagaagaagagtgagaagaagaaggatggagaccatcgtgttcctggacaaggaggtgtttgccagccgcatcagcaaccccagtgatgacaacagctgtgaggacctggaggaggagcggcgggaggaggaggagaagaccccacctgagaccaagccagacccccctgtgaacttcctgcggcagaaggtgctgagcctgcccctgcctgaccccctgaagtactacctgctgtactaccgggagaagtag

SEQ ID NO: 19779 - DNA, 1785 bp, Artificial Sequence
  Description of Artificial Sequence: Synthetic coding sequence
atgagccggcccagcagccgggccatctacctgcacaggaaggagtacagccagaacctgaccagcgagcccaccctgctgcagcaccgggtggagcacctgatgacctgcaagcagggcagccagagggtgcagggcccagaagatgccctgcagaagctgtttgagatggatgcccagggccgggtgtggagccaggacctgatcctgcaggtgagagatggctggctgcagctgctggacatcgagaccaaggaggagctggacagctaccgcctggacagcatccaggccatgaatgtggccctgaacacctgcagctacaacagcatcctgagcatcaccgtgcaggagcccggcctgcccggcaccagcaccctgctcttccagtgccaggaggtgggcgctgagcggctgaagaccagcctgcagaaggccctggaggaggagctggagcagagccggccccggctgggcggcctgcagcccggccaggaccgctggaggggccctgccatggagcggcccctgcccatggagcaggcccgctacctggagcccggcatccccccagagcagccccaccagaggaccctggagcacagcctgccccccagcccccggcccctgcccaggcacaccagcgcccgggagcccagcgccttcaccctgcccccaccccggcgcagcagcagccctgaggaccctgagagagatgaggaggtgctgaaccacgtgctgcgggacatcgagctgttcatgggcaagctggagaaggcccaggccaagaccagcaggaagaagaagtttgggaagaagaacaaggaccagggcggcctgacccaggcccagtacatcgactgcttccagaagatcaagcacagcttcaacctgctgggccgcctggccacctggctgaaggagaccagcgcccctgagctggtgcacatcctcttcaagagcctgaacttcatcctggcccgctgcccagaggccggcctggccgcccaggtgatcagccccctgctgacccccaaggccatcaacctgctgcagagctgcctgagccccccagagagcaacctgtggatgggcctgggccctgcctggaccaccagcagagctgactggacaggagatgagcccctgccctaccagcccaccttcagtgatgactggcagctgcctgagcccagcagccaggcccccctgggctaccaggaccctgtgtccctgcggcggggcagccaccggctgggcagcaccagccacttcccccaggagaagacccacaaccacgacccccagcccggggaccccaacagccggcccagcagccccaagccagcccagcctgccctgaagatgcaggtgctgtatgaatttgaggccaggaacccccgggagctgactgtggtgcagggcgagaagctggaggtgctggaccacagcaagcgctggtggctggtgaagaatgaggccggccgcagcggctacatccccagcaacatcctggagcccctgcagcccggcaccccaggcacccagggccagagccccagccgggtgcccatgctgcggctgagcagcaggcctgaggaggtgacagactggctgcaggccgagaacttcagcacagccaccgtgaggaccctgggcagcctgaccggcagccagctgctgcgcatccggcctggagagctgcagatgctgtgcccccaggaggccccccgcatcctgagccggctggaggccgtgcggaggatgctgggcatcagcccctag

SEQ ID NO: 19780 - DNA, 1500 bp, Artificial Sequence
  Description of Artificial Sequence: Synthetic coding sequence
atgagctttggaagtgagcactacctgtgcagcagcagcagctacaggaaggtgtttggagatggcagccggctgagcgcccggctgagcggggccggcggggccggcggcttccgcagccagagcctgagccgcagcaatgtggccagcagcgctgcctgcagcagcgccagcagcctgggcctgggcctggcctacagaagacctccagccagtgatggcctggacctgagccaggccgccgcccggaccaatgagtacaagatcatccgcaccaatgagaaggagcagctgcagggcctgaatgacagatttgctgtgttcatcgagaaggtgcaccagctggagacccagaacagagccctggaggccgagctggccgccctgcggcagagacatgctgagcccagccgggtgggggagctgttccagcgggagctgcgggacctgcgggcccagctggaggaggccagcagcgcccggagccaggccctgctggagagagatggcctggccgaggaggtgcagaggctgcgggcccgctgtgaggaggagagccggggccgggagggcgctgagcgggccctgaaggcccagcagagagatgtggatggagccaccctggcccggctggacctggagaagaaggtggagagcctgctggatgagctggcctttgtgcggcaggtgcatgatgaggaggtggccgagctgctggccaccctgcaggccagcagccaggccgctgctgaggtggatgtgacagtggccaagccagacctgaccagcgccctgcgggagatccgggcccagtatgagagcctggccgccaagaacctgcagagcgctgaggagtggtacaagagcaagtttgccaacctgaatgagcaggccgcccggagcacagaggccatccgggccagccgggaggagatccacgagtaccgccggcagctgcaggcccggaccatcgagattgagggcctgcggggggccaatgaaagcctggagcggcagatcctggagctggaggagcggcacagcgctgaggtggccggctaccaggacagcatcggccagctggagaatgacctgaggaacaccaagtctgagatggcccggcacctgcgggagtaccaggacctgctgaatgtgaagatggccctggacattgaaattgctgcctacaggaagctgctggagggggaggagacccgcttcagcaccagcggcctgagcatcagcggcctgaaccccctgcccaaccccagctacctgctgcccccacgcatcctgagcgccaccaccagcaaggtgagcagcacaggcctgagcctgaagaaggaggaggaggaggaggaggccagcaaggtggccagcaagaagaccagccagatcggggagagctttgaggagatcctggaggagaccgtcatcagcaccaagaagacagagaagagcaacatcgaggagaccaccatcagcagccagaagatctag

SEQ ID NO: 19781 - DNA, 1131 bp, Artificial Sequence
  Description of Artificial Sequence: Synthetic coding sequence
atggagagctatgatgtgattgccaaccagcctgtggtgattgacaatggcagcggggtcatcaaggccggctttgctggggaccagatccccaagtactgcttccccaactacgtgggccggcccaagcacgtgcgggtgatggccggggccctggagggggacatcttcatcggccccaaggccgaggagcaccggggcctgctgagcatccgctaccccatggagcacggcatcgtgaaggactggaatgacatggagcgcatctggcagtatgtgtacagcaaggaccagctgcagaccttcagcgaggagcaccctgtgctgctgacagaggcccccctgaaccccaggaagaaccgggagagagctgctgaggtgttctttgagaccttcaacgtgcctgccctcttcatctccatgcaggccgtgctgagcctgtatgccaccggccgcaccaccggggtggtgctggacagcggagatggagtgacccatgctgtgcccatctatgagggctttgccatgccccacagcatcatgagaattgatattgctggaagagatgtgagccgcttcctgcggctgtacctgaggaaggagggctatgacttccacagcagcagcgagtttgaaattgtgaaggccatcaaggagcgggcctgctacctgagcatcaacccccagaaggatgagaccctggagacagagaaggcccagtactacctgcctgatggcagcaccattgaaattggccccagccgcttccgggcccctgagctgctcttccggccagacctgattggagaggagagcgagggcatccacgaggtgctggtgtttgccatccagaagagtgacatggacctgcggaggaccctcttcagcaacatcgtgctgagcggcggcagcaccctcttcaagggctttggagaccggctgctgtctgaggtgaagaagctggcccccaaggatgtgaagatccgcatcagcgccccccaggagcggctgtacagcacctggattggaggcagcatcctggccagcctggacaccttcaagaagatgtgggtgtccaagaaggagtatgaagaagatggagcccggagcatccacaggaagaccttctag

SEQ ID NO: 19782 - DNA, 783 bp, Artificial Sequence
  Description of Artificial Sequence: Synthetic coding sequence
atgagcctgcagaagaccccacccaccagggtgtttgtggagctggtgccctgggccgacaggagccgggagaacaacctggccagcggccgggagaccctgcccggcctgcggcaccccctgagcagcacccaggcccagacagccacccgggaggtgcaggtgtctggcaccagcgaggtgtctgctggccctgaccgggcccaggtggtggtgcgggtgagcagcaccaaggaggccgctgctgaggccaagaagtctgtgtgccggcggctggactacatcacccagagcctgcagcagcagggcgtgcaggccgagaacatcaccgtgaccaaggacttccggcgggtggagaatgcctaccacatggaggccgaggtgtgcatcaccttcacagaatttgggaagatgcagaacatctgcaacttcctggtggagaagctggacagctctgtggtgatcagccccccccagttctaccacaccccaggctctgtggagaacctgcggcggcaggcctgcctggtggccgtggagaatgcctggaggaaggcccaggaggtgtgcaacctggtgggccagaccctgggcaagcccctgctgatcaaggaggaggagaccaaggagtgggagggccagattgatgaccaccagagcagccggctgagcagcagcctgactgtgcagcagaagatcaagagcgccaccatccacgccgccagcaaggtgttcatcacctttgaggtgaagggcaaggagaagaggaagaagcacctgtag

SEQ ID NO: 19783 - DNA, 891 bp, Artificial Sequence
  Description of Artificial Sequence: Synthetic coding sequence
atggagcccagcggcggggagcaggagcccggggctgtgcgcttcctggacctgccctgggaggatgtgctgctgccccacgtgctgaacagagtgcccctgcggcagctgctgcggctgcagagggtgtcccgggccttccgcagcctggtgcagctgcacctggccggcctgcggagatttgatgctgcccaggtgggcccccagatccccagggctgccctggcccggctgctgagagatgctgagggcctgcaggagctggccctggccccctgccacgagtggctgagtgatgaggacctggtgcctgtgctggccaggaacccccagctgcggtctgtggccctgggcggctgcggccagctgagcagaagagccctgggcgccctggccgagggctgcccccggctgcagaggctgagcctggcccactgtgactgggtggatggcctggccctgcggggcctggccgaccgctgcccagccctggaggagctggacctgacagcctgccggcagctgaaggatgaggccatcgtgtacctggcccagaggagaggagctggcctgcggagcctgagcctggccgtgaatgccaacgtgggagatgctgctgtgcaggagctggccaggaactgcccagagctgcaccacctggacctgaccggctgcctgcgggtgggcagtgatggagtgaggaccctggccgagtactgccctgtgctgcggagcctgcgggtgcgccactgccaccacgtggccgagagcagcctgagccggctgaggaagaggggcgtggacattgatgtggagccccccctgcaccaggccctggtgctgctgcaggacatggccggctttgccccctttgtgaacctgcaggtgtag

SEQ ID NO: 19784 - DNA, 2100 bp, Artificial Sequence
  Description of Artificial Sequence: Synthetic coding sequence
atggctgatgctggcatcagaagagtggtgcccagcgacctgtaccccctggtgctgggcttcctgcgggacaaccagctgtctgaggtggccaacaagtttgccaaggccaccggggccacccagcaggatgccaatgccagcagcctgctggacatctacagcttctggctgaagagcgccaaggtgcctgagaggaagctgcaggccaatggacctgtggccaagaaggccaagaagaaggccagcagcagtgacagcgaggacagcagcgaggaggaggaggaggtgcagggccccccagccaagaaggctgctgtgcctgccaagagggtgggcctgcccccaggcaaggccgccgccaaggccagcgagagcagcagcagcgaggagagcagtgatgatgatgatgaggaggaccagaagaagcagcctgtgcagaagggcgtgaagccccaggccaaggccgccaaggccccacccaagaaggccaagagcagtgacagcgacagcgacagcagcagtgaagatgagccccccaagaaccagaagcccaagatcacccctgtgacagtgaaggcccagaccaaggccccacccaagccagcccgggccgcccccaagatcgccaacgggaaggccgccagcagcagcagcagcagcagcagcagcagcagcagtgatgacagcgaggaggagaaggccgccgccacccccaagaagacagtgcccaagaagcaggtggtggccaaggcccctgtgaaggccgccaccacccccaccaggaagagcagcagcagcgaggacagcagcagtgatgaggaggaggagcagaagaagcccatgaagaacaagccaggcccctacagctctgtgcccccacccagcgcccccccacccaagaagagcctgggcacccagccccccaagaaggctgtggagaagcagcagcctgtggagagcagcgaggacagcagtgatgaaagtgacagcagcagcgaggaggagaagaagccacccaccaaggctgtggtgtccaaggccaccaccaagcccccaccagccaagaaggctgctgagagcagcagtgacagcagtgacagcgacagcagtgaagatgatgaggcccccagcaagccagctggcaccaccaagaacagcagcaacaagccagctgtgaccaccaagagccctgctgtgaagccagctgctgcccccaagcagcctgtgggcggcggccagaagctgctgaccaggaaggctgacagcagcagcagcgaggaggagagcagcagcagcgaggaggagaagaccaagaagatggtggccaccaccaagcccaaggccacagccaaggccgccctgagcctgcctgccaagcaggccccccagggcagccgggacagcagcagtgacagcgacagcagcagcagcgaggaggaggaggagaagaccagcaagtctgctgtgaagaagaagccccagaaggtggccggcggggccgcccccagcaagccagccagcgccaagaagggcaaggccgagagcagcaacagcagcagcagtgatgacagcagcgaggaggaggaggagaagctgaagggcaagggcagcccccggccccaggcccccaaggccaacggcaccagcgccctgacagcccagaatggcaaggccgccaagaacagcgaggaggaggaggaggagaagaagaaggctgctgtggtggtgtccaagagcggcagcctgaagaagaggaagcagaatgaagctgccaaggaggccgagaccccccaggccaagaagatcaagctgcagacccccaacaccttccccaagaggaagaagggggagaagagggccagcagccccttccggcgggtgcgggaggaggagattgaggtggacagccgggtggccgacaacagctttgatgccaagagaggagctgctggggactggggcgagcgggccaaccaggtgctgaagttcaccaagggcaagagcttcagacatgagaagaccaagaagaagaggggcagctaccggggcggcagcatctctgtgcaggtgaacagcatcaagtttgacagcgagtag

SEQ ID NO: 19785 - DNA, 1275 bp, Artificial Sequence
  Description of Artificial Sequence: Synthetic coding sequence
atggaggagaacaacctgcagtgcagctctgtggtggatggcaactttgaggaggtgccccgggagacagccatccagttcaagccacccctgtaccggcagcgctaccagtttgtgaagaacctggtggaccagcacgagcccaagaaggtggccgacctgggctgtggggacaccagcctgctgcggctgctgaaggtgaacccctgcatcgagctgctggtgggcgtggacatcaatgaagacaagctgcgctggaggggggacagcctggcccccttcctgggggacttcctgaagccccgggacctgaacctgaccatcaccctgtaccacggctctgtggtggagcgggacagccggctgctgggctttgacctgatcacctgcatcgagctgattgagcacctggacagcggggacctggcccgcttccctgaggtggtgtttggctacctgagccccagcatgatcgtcatcagcacccccaacagcgagttcaaccccctcttccccagcgtgaccctgcgggacagcgaccacaagtttgagtggaccaggatggagttccagacctgggccctgtatgtggccaacagatatgactacagcgtggagttcaccggggtgggggagcccccagctggagcagaaaatgtgggctactgcacccagatcggcatcttcaggaagaatggaggcaaggccacagagagctgcctgtctgagcagcacgaccagcacgtgtacaaggcccggcagggcctgaccatgctgccccggctggtgctgaacttccacccccaggccatcctgctgccccacctgcccaagatgctgcggctgcaggtgttcaccaccagctaccccagcctgcagcaggagcgcttcttcaagctggtgctggtgaatgaggtgtcccagcaggtggagagcctgcgggtgagccacctgcccaggaggaaggagcaggccggggagcggggggacaagcccaaggacattggaggcagcaaggcccctgtgccctgctttggacctgtgttcacagaggtggagaaggccaagattgagaacagccccacccccttctgtgtgggggacaagttctttgtgcccctgcagaggctgctggcctaccccaagctgaaccggctgtgtgccaatgaggagatgatgaggtctgtgattgctgacagcatccccctgagcagtgatggcagcgctgtggtggccgacctgaggaactactttgatgagcagtttgagttctag

SEQ ID NO: 19786 - DNA, 1182 bp, Artificial Sequence
  Description of Artificial Sequence: Synthetic coding sequence
atggaggagaacaacctgcagtgcagctctgtggtggatggcaactttgaggaggtgccccgggagacagccatccagttcaagccacccctgtaccggcagcgctaccagtttgtgaagaacctggtggaccagcacgagcccaagaaggtggccgacctgggctgtggggacaccagcctgctgcggctgctgaaggtgaacccctgcatcgagctgctggtgggcgtggacatcaatgaagacaagctgcgctggaggggggacagcctggcccccttcctgggggacttcctgaagccccgggacctgaacctgaccatcaccctgtaccacggctctgtggtggagcgggacagccggctgctgggctttgacctgatcacctgcatcgagctgattgagcacctggacagcggggacctggcccgcttccctgaggtggtgtttggctacctgagccccagcatgatcgtcatcagcacccccaacagcgagttcaaccccctcttccccagcgtgaccctgcgggacagcgaccacaagtttgagtggaccaggatggagttccagacctgggccctgtatgtggccaacagatatgactacagcgtggagttcaccggggtgggggagcccccagctggagcagaaaatgtgggctactgcacccagatcggcatcttcaggaagaatggaggcaaggccacagagagctgcctgtctgagcagcacgaccagcacgtgtacaaggctgtgttcaccaccagctaccccagcctgcagcaggagcgcttcttcaagctggtgctggtgaatgaggtgtcccagcaggtggagagcctgcgggtgagccacctgcccaggaggaaggagcaggccggggagcggggggacaagcccaaggacatcggcggcagcaaggcccctgtgccctgcttcggccctgtgttcacagaggtggagaaggccaagattgagaacagccccacccccttctgtgtgggggacaagttctttgtgcccctgcagaggctgctggcctaccccaagctgaaccggctgtgtgccaatgaggagatgatgaggtctgtgattgctgacagcatccccctgagcagtgatggcagcgctgtggtggccgacctgaggaactactttgatgagcagtttgagttctag

SEQ ID NO: 19787 - DNA, 1701 bp, Artificial Sequence
  Description of Artificial Sequence: Synthetic coding sequence
atgtctgccagcactggaggcggcggggacagcggcggcagcggcggcagcagcagcagcagccaggccagctgtggccctgagagcagcggcagcgagctggccctggccacccctgtgccccagatgctgcagggcctgctgggcagtgatgatgaggagcaggaggaccccaaggactactgcaagggcggctaccaccctgtgaagattggagatgtgttcaacggccgctaccacgtggtgaggaagctgggctggggccacttcagcacagtgtggctgtgctgggacatccagaggaagagatttgtggccctgaaggtggtgaagtctgctggccactacacagaaacagctgtggatgagatcaagctgctgaagtgtgtgcgggacagcgaccccagcgaccccaagcgggagaccatcgtgcagctgattgatgacttccgcatctctggagtgaatggagtgcacgtgtgcatggtgctggaggtgctgggccaccagctgctgaagtggatcatcaagagcaactaccagggcctgcctgtgccctgtgtgaagagcatcgtgcggcaggtgctgcacggcctggactacctgcacaccaagtgcaagatcatccacacagacatcaagccagagaacatcctgctgtgtgtgggagatgcctacatccggcggctggccgctgaggccacagagtggcagcaggccggggcccccccacccagccgcagcatcgtgtccacagccccccaggaggtgctgaccgggaagctgagcaagaacaagaggaagaagatgaggaggaagaggaagcagcagaagaggctgctggaggagcggctgcgggacctgcagaggctggaggccatggaggccgccacccaggctgaagattctggcctgcggctggatggcggcagcggcagcaccagcagcagcggctgccaccctggaggagcccgggccggccccagccctgccagcagcagccctgcccctgggggcggccgcagcctgtctgctggcagccagaccagcggcttcagcggcagcctcttctccccagccagctgcagcatcctgagcggcagcagcaaccagcgggagaccggcggcctgctgagccccagcaccccatttggagccagcaacctgctggtgaaccccctggagccccagaatgctgacaagatcaagatcaagattgctgacctgggcaatgcctgctgggtgcacaagcacttcacagaggacatccagacccggcagtacagagctgtggaggtgctgattggagcagaatatggccccccagctgacatctggagcacagcctgcatggcctttgagctggccactggagactacctgtttgagccccacagcggggaggactacagcagagatgaggaccacatcgcccacatcgtggagctgctgggggacatccccccagcctttgccctgagcggccgctacagccgggagttcttcaacagaagaggagagctgcggcacatccacaacctgaagcactggggcctgtatgaggtgctgatggagaagtatgagtggcccctggagcaggccacccagttcagcgccttcctgctgcccatgatggagtacatccctgagaagagggccagcgctgctgactgcctgcagcacccctggctgaacccctag

SEQ ID NO: 19788 - DNA, 150 bp, Artificial Sequence
  Description of Artificial Sequence: Synthetic coding sequence
atggccggcccccgggtggaggtggatggcagcatcatggagggcggcggccagatcctgcgggtgtccacagccctgagctgcctgctgggcctgcccctgcgggtgcagaagatccgggccggccgcagcaccccaggcctgaggtag

SEQ ID NO: 19789 - DNA, 1101 bp, Artificial Sequence
  Description of Artificial Sequence: Synthetic coding sequence
atggccggcccccgggtggaggtggatggcagcatcatggagggcggcggccagatcctgcgggtgtccacagccctgagctgcctgctgggcctgcccctgcgggtgcagaagatccgggccggccgcagcaccccaggcctgcggccccagcacctgagcggcctggagatgatccgggacctgtgtgatggccagctggagggcgctgagatcggcagcacagagatcaccttcaccccagagaagatcaagggcggcatccacacagctgacaccaagacagctggctctgtgtgcctgctgatgcaggtgtccatgccctgtgtgctgtttgctgccagccccagcgagctgcacctgaagggcggcaccaatgctgagatggccccccagattgactacacagtgatggtgttcaagcccatcgtggagaagtttggcttcatcttcaactgtgacatcaagacccggggctactaccccaagggcggcggggaggtgattgtgaggatgagccctgtgaagcagctgaaccccatcaacctgacagagcggggctgtgtgaccaagatctacggccgggcctttgtggccggcgtgctgcccttcaaggtggccaaggacatggctgctgctgctgtgcgctgcatcaggaaggagatccgggacctgtatgtgaacatccagcctgtgcaggagcccaaggaccaggcctttggaaatggaaatggcatcatcatcatcgccgagaccagcacaggctgcctgtttgctggcagcagcctgggcaagaggggcgtgaatgctgacaaggtgggcattgaagctgctgagatgctgctggccaacctgcggcatggaggcaccgtggatgagtacctgcaggaccagctgattgtgttcatggccctggccaatggagtgagccgcatcaagacaggccctgtgaccctgcacacccagacagccatccactttgctgagcagatcgccaaggccaagttcatcgtgaagaagtcagaagatgaagaagatgctgccaaggacacctacatcatcgagtgccagggcatcggcatgaccaaccccaacctgtag

SEQ ID NO: 19790 - DNA, 1155 bp, Artificial Sequence; identical to SEQ ID NO: 19296
  Description of Artificial Sequence: Synthetic coding sequence

SEQ ID NO: 19791 - DNA, 804 bp, Artificial Sequence
  Description of Artificial Sequence: Synthetic coding sequence
atggccgagcctgtgcaggaggagctgtctgtgctggccgccatcttctgccggccccatgagtgggaggtgctgagccgctcagaaacagatggcaccgtcttccgcatccacaccaaggccgagggcttcatggatgtggacatccccctggagctggtgttccacctgcctgtgaactaccccagctgcctgcccggcatcagcatcaacagcgagcagctgacccgggcccagtgtgtgacagtgaaggagaacctgctggagcaggccgagagcctgctgtctgagcccatggtgcatgagctggtgctgtggatccagcagaacctgcggcacatcctgagccagcctgagaccggcagcggcagcgagaagtgcaccttcagcaccagcaccaccatggatgatggcctgtggatcaccctgctgcacctggaccacatgagggccaagaccaagtatgtgaagatcgtggagaagtgggccagtgacctgcggctgaccggccgcctgatgttcatgggcaagatcatcctgatcctgctgcagggcgacaggaacaacctgaaggagtacctgatcctgcagaagaccagcaaggtggatgtggacagcagcggcaagaagtgcaaggagaagatgatctctgtgctgtttgagaccaaggtgcagacagagcacaagcgcttcctggcctttgaggtgaaggagtacagcgccctggatgagctgcagaaggagtttgaaacagctggcctgaagaagctgttcagcgagtttgtgctggccctggtgaagtag

SEQ ID NO: 19792 - DNA, 2010 bp, Artificial Sequence
  Description of Artificial Sequence: Synthetic coding sequence
atggccatcgtgcagaccctgcctgtgcccctggagcccgcccctgaggccgccacagccccccaggcccctgtgatgggctctgtgagcagcctcatcagcggccggccctgccctgggggccctgccccacccaggcaccacggccccccaggccccaccttcttccggcagcaggacggcctgctgcggggcggctatgaggcccaggagcccctgtgcccagctgtgccccccaggaaggctgtgcctgtgaccagcttcacctacatcaatgaagacttcagaacagagagcccccccagccccagcagtgatgtggaggatgcccgggagcagagggcccacaatgcccacctgcggggccccccacccaagctgatccctgtgtctgggaagctggagaagaacatggagaagatcctgatccggcccacagccttcaagcctgtgctgcccaagcccaggggggcccccagcctgcccagcttcatgggcccccgggccaccggcctgagcggcagccagggcagcctgacccagctgtttggaggccctgccagcagcagcagcagcagcagcagcagcagcgctgctgacaagcccctggccttcagcggctgggccagcggctgccccagcggcaccctgagtgacagcggcaggaacagcctgagcagcctgcccacctacagcactggaggagctgagcccaccaccagcagccctgggggccacctgcccagccacggcagcggccgcggggccctgcccggccctgcccggggcgtgcccaccggccccagccacagcgacagcggccgcagcagcagcagcaagagcacaggcagcctgggcggccgggtggccggcggcctgctgggcagcggcacccgggccagcccagacagcagcagctgtggggagaggagccccccacctcctcctcctccacccagtgatgaggccctgctgcactgtgtgctggagggcaagctgcgggaccgggaggccgagctgcagcagctgcgggacagcctggatgaaaatgaggccaccatgtgccaggcctatgaggagcggcagaggcactggcagcgggagcgggaggccctgcgggaggactgtgccgcccaggcccagagggcccagagggcccagcagctgctgcagctgcaggtgttccagctgcagcaggagaagaggcagctgcaggatgactttgcccagctgctgcaggagcgggagcagctggagcggcgctgtgccaccctggagcgggagcagcgggagctgggcccccggctggaggagaccaagtgggaggtgtgccagaagtctggagagatcagcctgctgaagcagcagctgaaggagagccaggccgagctggtgcagaagggcagcgagctggtggccctgcgggtggccctgcgggaggcccgggccaccctgcgggtgtctgagggccgggcccggggcctgcaggaggccgcccgggcccgggagctggagctggaggcctgcagccaggagctgcagaggcaccggcaggaggccgagcagctgcgggagaaggccggccagctggatgctgaggccgccggcctgcgggagccccctgtgcccccagccacagctgaccccttcctgctggccgagagtgatgaggccaaggtgcagagagctgctgctggggtgggcggcagcctgcgggcccaggtggagcggctgcgggtggagctgcagcgggagaggagaagaggagaggagcagagggacagctttgaaggagagcggctggcctggcaggccgagaaggagcaggtgatccgctaccagaagcagctgcagcacaactacatccagatgtacagaagaaaccggcagctggagcaggagctgcagcagctgagcctggagctggaggcccgggagctggccgacctgggcctggccgagcaggccccctgcatctgcctggaggagatcacagccacagagatctag

SEQ ID NO: 19793 - DNA, 2010 bp, Artificial Sequence; identical to SEQ ID NO: 19792
  Description of Artificial Sequence: Synthetic coding sequence

SEQ ID NO: 19794 - DNA, 1059 bp, Artificial Sequence
  Description of Artificial Sequence: Synthetic coding sequence
atgaagctgaaggagctggagaggcctgctgtgcaggcctggagccctgccagccagtaccccctgtacctggccaccggcaccagcgcccagcagctggacagcagcttcagcaccaacggcaccctggagatctttgaggtggacttccgggaccccagcctggacctgaagcacagaggagtgctgagcgccctgagccgcttccacaagctggtgtggggcagctttggaagtggcctgctggagagcagtggagtcatcgtgggcggcggggacaatggcatgctgatcctgtacaacgtgacccacatcctgagcagcggcaaggagcccgtcatcgcccagaagcagaagcacactggagctgtgcgggccctggacctgaaccccttccagggcaacctgctggccagcggggccagtgacagcgagatcttcatctgggacctgaacaacctgaatgtgcccatgaccctgggcagcaagagccagtaccacgagcagcccccagaggacatcaaggccctgtcctggaaccggcaggcccagcacatcctgagcagcgcccaccccagcggcaaggctgtggtgtgggacctgaggaagaatgagcccatcatcaaggtgtctgaccacagcaacaggatgcactgcagcggcctggcctggcacccagacatcgccacccagctggtgctgtgcagtgaagatgaccggctgcccgtcatccagctgtgggacctgcgctttgccagcagccccctgaaggtgctggagagccacagccggggcatcctgtctgtgtcctggagccaggctgatgctgagctgctgctgaccagcgccaaggacagccagatcctgtgcaggaacctgggcagcagcgaggtggtgtacaagctgcccacccagagctcctggtgctttgatgtgcagtggtgcccccgggaccccagcgtcttctctgctgccagcttcaacggctggatcagcctgtacagcgtgatgggccgctcctgggaggtgcagcacatgaggcaggccgacaaggtgtag

SEQ ID NO: 19795 - DNA, 3540 bp, Artificial Sequence
  Description of Artificial Sequence: Synthetic coding sequence
atgaagctgaaggagctggagaggcctgctgtgcaggcctggagccctgccagccagtaccccctgtacctggccaccggcaccagcgcccagcagctggacagcagcttcagcaccaacggcaccctggagatctttgaggtggacttccgggaccccagcctggacctgaagcacagaggagtgctgagcgccctgagccgcttccacaagctggtgtggggcagctttggaagtggcctgctggagagcagtggagtcatcgtgggcggcggggacaatggcatgctgatcctgtacaacgtgacccacatcctgagcagcggcaaggagcccgtcatcgcccagaagcagaagcacactggagctgtgcgggccctggacctgaaccccttccagggcaacctgctggccagcggggccagtgacagcgagatcttcatctgggacctgaacaacctgaatgtgcccatgaccctgggcagcaagagccagcagcccccagaggacatcaaggccctgtcctggaaccggcaggcccagcacatcctgagcagcgcccaccccagcggcaaggctgtggtgtgggacctgaggaagaatgagcccatcatcaaggtgtctgaccacagcaacaggatgcactgcagcggcctggcctggcacccagacatcgccacccagctggtgctgtgcagtgaagatgaccggctgcctgtgatccagctgtgggacctgcgctttgccagcagccccctgaaggtgctggagagccacagccggggcatcctgtctgtgtcctggagccaggctgatgctgagctgctgctgaccagcgccaaggacagccagatcctgtgcaggaacctgggcagcagcgaggtggtgtacaagctgcccacccagagctcctggtgctttgatgtgcagtggtgcccccgggaccccagcgtcttctctgctgccagcttcaacggctggatcagcctgtacagcgtgatgggccgctcctgggaggtgcagcacatgaggcaggccgacaagatcagcagcagcttcagcaagggccagcccctgccccccctgcaggtgcctgagcaggtggcccaggcccccctcatcccccccctgaagaagccacccaagtggatcagaagacccaccggggtgtcctttgccttcggcggcaagctggtgaccttcggcctgcccagcaccccagcccacctggtgccccagccctgcccccggctggtgttcatcagccaggtgaccacagagagcgagttcctgatgaggtctgctgagctgcaggaggccctgggcagcggcaacctgctgaactactgccagaacaagagccagcaggccctgctgcagagcgagaagatgctgtggcagttcctgaaggtgaccctggagcaggacagcaggatgaagttcctgaagctgctgggctacagcaaggatgagctgcagaagaaggtggccacctggctgaagagtgatgtgggcctgggggagagcccccagcccaagggaaatgacctgaacagcgaccggcagcaggccttctgcagccaggccagcaagcacaccaccaaggaggccagcgccagcagcgccttctttgatgagctggtgccccagaacatgaccccctgggagatccccatcaccaaggacattgatggcctgctgagccaggccctgctgctgggggagctgggccctgctgtggagctgtgcctgaaggaggagagatttgctgatgccatcatcctggcccaggccggcggcacagacctgctgaagcagacccaggagcgctacctggccaagaagaagaccaagatcagcagcctgctggcctgtgtggtgcagaagaactggaaggatgtggtgtgcacctgcagcctgaagaactggagggaggccctggccctgctgctgacctacagcggcacagagaagtttcctgagctgtgtgacatgctgggcaccaggatggagcaggagggcagccgggccctgaccagcgaggcccggctgtgctacgtgtgcagcggctctgtggagcggctggtggagtgctgggccaagtgccaccaggccctgagccccatggccctgcaggacctgatggagaaggtgatggtgctgaacagaagcctggagcagctgcggggcccccacggcgtgtccccaggccctgccaccacctacagagtgacccagtatgccaacctgctggccgcccagggcagcctggccacagccatgtccttcctgccccgggactgtgcccagccccctgtgcagcagctgcgggacaggctcttccacgcccagggcagcgctgtgctgggccagcagagcccccccttccccttccccagaattgtggtgggcgccaccctgcacagcaaggagaccagcagctaccgcctgggcagccagcccagccaccaggtgcccacccccagcccccggcccagggtcttcaccccccagagcagccctgccatgcccctggcccccagccaccccagcccctaccagggccccaggacccagaacatcagtgactaccgggcccctggcccccaggccatccagcccctgcccctgagccctggggtgcggcctgccagcagccagccccagctgctgggcggccagagggtgcaggtgcccaaccctgtgggcttccctggcacctggcccctgcccggcagccccctgcccatggcctgccccggcatcatgaggcctggcagcaccagcctgcctgagacccccaggctcttccccctgctgcccctgcggcccctgggccctggccgcatggtgagccacaccccagcccccccagccagcttccctgtgccctacctgcccggggaccccggggccccctgcagctctgtgctgcccaccaccggcatcctgaccccccaccctggcccccaggacagctggaaggaggccccagccccccggggcaacctgcagaggaacaagctgcctgagaccttcatgcccccagcccccatcacagcccctgtgatgagcctgaccccagagctgcagggcatcctgcccagccagccccctgtgtcctctgtgtcccatgcccctcctggggtgcctggagagctgagcctgcagctgcagcacctgcccccagagaagatggagaggaaggagctgcccccagagcaccagagcctgaagagcagctttgaggccctgctgcagcgctgcagcctgagcgccacagacctgaagaccaagaggaagctggaggaggccgcccagaggctggagtacctgtatgagaagctgtgtgagggcaccctgagcccccacgtggtggccggcctgcacgaggtggcccgctgtgtggatgctggcagctttgagcagggcctggccgtgcacgcccaggtggccggctgcagcagcttcagcgaggtgagcagcttcatgcccatcctgaaggctgtgctgatcatcgcccacaagctgctggtgtag

SEQ ID NO: 19796 - DNA, 1635 bp, Artificial Sequence; identical to SEQ ID NO: 18531
  Description of Artificial Sequence: Synthetic coding sequence

SEQ ID NO: 19797 - DNA, 1689 bp, Artificial Sequence; identical to SEQ ID NO: 19406
  Description of Artificial Sequence: Synthetic coding sequence

SEQ ID NO: 19798 - DNA, 1689 bp, Artificial Sequence; identical to SEQ ID NO: 19406
  Description of Artificial Sequence: Synthetic coding sequence

SEQ ID NO: 19799 - DNA, 1272 bp, Artificial Sequence
  Description of Artificial Sequence: Synthetic coding sequence
atggaggacaagaggagcctgtccatggcccgctgtgaggagaggaacagccggggccaggaccacggcctggagcgggtgcccttccccccccagctgcagagcgagacctacctgcaccctgctgaccccagccctgcctgggatgatcctggcagcacaggcagccccaacctgcggctgctgacagaggagatcgccttccagcccctggccgaggaggccagcttccggcggccccacccagatggagatgtgcccccccagggcgaggacaacctgctgagcctgcccttcccccagaagctgtggaggctggtgagcagcaaccagttcagcagcatctggtgggatgacagcggggcctgcagggtcatcaaccagaagctgtttgagaaggagatcctgaagagagatgtggcccacaaggtgtttgccaccaccagcatcaagagcttcttccggcagctgaacctgtatggcttcaggaagaggcggcagtgcaccttccgcaccttcacccgcatcttcagcgccaagaggctggtgtccatcctgaacaagctggagttctactgccacccctacttccagagggacagcccccacctgctggtgaggatgaagagaagagtgggcgtgaagagcgcccccaggcaccaggaggaggacaagccagaggccgccggcagctgcctggccccagctgacacagagcagcaggaccacaccagccccaatgaaaatgaccaggtgaccccccagcaccgggagcccgccggccccaacacccagatccgcagcggcagcgcccccccagccacccctgtgatggtgcctgacagcgctgtggccagtgacaacagccctgtgacccagcctgctggggagtggagcgagggcagccaggcccacgtgacccctgtggccgctgtgcccggccctgctgccctgcccttcctgtatgtgcccggcagccccacccagatgaacagctatggccctgtggtggccctgcccacagccagccgcagcaccctggccatggacaccaccggcctgcctgcccctggcatgctgcccttctgccacctgtgggtgcctgtgaccctggtggccgccggggccgcccagcctgctgcctccatggtgatgttcccccacctgcctgccctgcaccaccactgcccccacagccacaggaccagccagtacatgcctgccagtgatggcccccaggcctacccagactatgctgaccagagcacctag

SEQ ID NO: 19800 - DNA, 675 bp, Artificial Sequence
  Description of Artificial Sequence: Synthetic coding sequence
atgcccaccctcttcaagggcgtgtggggcgtggtggagcacagccgggccctgggccgcttctgcccagcctgcctgcccagcggcccccacctgcacacccagcctgccctgggcacagctgagatgaccctgctgagcagccagagcagcagcctggtggcccccagcggctctgtgtctgcagaaaatcctgagcagaggatgctggagaagagggccaaggtgattgaggagctgctgcagacagagcgggactacatccgggacctggagatgtgcatcgagcgcatcatggtgcccatgcagcaggcccaggtgcccaacatcgactttgagggcctgtttggaaacatgcagatggtgatcaaggtgtccaagcagctgctggccgccctggagatcagtgatgctgtgggccctgtgttcctgggccacagagatgagctggagggcacctacaagatctactgccagaaccatgatgaggccatcgccctgctggagatctatgagaaggatgagaagatccagaagcacctgcaggacagcctggccgacctgaacagcctggtgctgaagaagggctgcaccaactacatcaacctgggcagcttcctgatcaagcctgtgcagagggtgatgagataccccctgctgctgatggagctgtag

SEQ ID NO: 19801 - DNA, 1878 bp, Artificial Sequence
  Description of Artificial Sequence: Synthetic coding sequence
atgaggctgcctgagagacatggaggcccccagggcagcctgtgcctgatggacccctgctgccccctgagcctggccctgcaggacctggtggagcgggactgcaatggagacacccccaacctgtccttctacagaaatgagatccgcttcctgcccaacggctgcttcatcgaggacatcctgcagaactggacagacaactatgacctgctggaggacaaccacagctacatccagtggctgttccccctgcgggagcccggggtgaactggcacgccaagcccctgaccctgcgggaggtggaggtgttcaagagcagccaggagatccaggagcggctggtgcgggcctatgagctgatgctgggcttctacggcatccggctggaggaccggggcactggaacagtgggccgggcccagaactaccagaagcgcttccagaacctgaactggaggagccacaacaacctgcgcatcacccgcatcctgaagagcctgggggagctgggcctggagcacttccaggcccccctggtgcgcttcttcctggaggagaccctggtgagaagagagctgcccggggtgcggcagagcgccctggactacttcatgtttgctgtgcgctgccgccaccagaggcggcagctggtgcactttgcctgggagcacttccggccccgctgcaagtttgtgtggggcccccaggacaagctgcggcgcttcaagcccagcagcctgccccaccccctggagggcagcaggaaggtggaggaggagggcagccctggggaccctgaccacgaggccagcacccagggccgcacctgtggccctgagcacagcaagggcggcggccgggtggatgagggcccccagcccaggtctgtggagccccaggatgctggccccctggagaggagccagggagatgaggccggcggccatggagaagatagacctgagcccctgagccccaaggagagcaagaagaggaagctggagctgagcagaagagagcagcccccaacagagcccggcccccagagcgccagcgaggtggagaagatcgccctgaacctggagggctgtgccctgagccagggcagcctgaggacaggcacccaggaggtgggcggccaggaccccggggaggccgtgcagccctgccggcagcccctgggcgcccgggtggccgacaaggtgaggaagaggaggaaggtggatgagggcgctggggacagcgctgctgtggccagcggcggggcccagaccctggccctggccggcagccctgcccccagcggccaccccaaggccggccacagtgaaaatggagtggaggaggacacagagggccgcacaggccccaaggagggcaccccaggcagccccagcgagaccccaggccccagccctgctggccctgctggagatgagcctgctgagagccccagcgagaccccaggccccaggcctgctggccctgctggagatgagcctgctgagagccccagcgagaccccaggccccaggcctgctggccctgctggagatgagcctgctgagagccccagcgagaccccaggccccagccctgctggccccaccagagatgagcctgctgagagccccagcgagaccccaggccccaggcctgctggccctgctggagatgagcctgctgagagccccagcgagaccccaggccccaggcctgctggccctgctggagatgagcctgctgagagccccagcgagaccccaggccccagccctgctggccccaccagagatgagcccgccaaggccggggaggccgctgagctgcaggatgctgaggtggagagcagcgccaagagcggcaagccctag

SEQ ID NO: 19802 - DNA, 1386 bp, Artificial Sequence
  Description of Artificial Sequence: Synthetic coding sequence
atggatgatcctgactgtgacagcacctgggaggaggatgaagaagatgctgaagatgctgaagatgaggactgtgaagatggagaggccgccggggccagagatgctgatgctggagatgaagatgaggagagcgaggagccccgggccgcccggcccagcagcttccagagcaggatgacaggcagcaggaactggagggccacccgggacatgtgccgctaccgccacaactacccagacctggtggagcgggactgcaatggagacacccccaacctgtccttctacagaaatgagatccgcttcctgcccaacggctgcttcatcgaggacatcctgcagaactggacagacaactatgacctgctggaggacaaccacagctacatccagtggctgttccccctgcgggagcccggggtgaactggcacgccaagcccctgaccctgcgggaggtggaggtgttcaagagcagccaggagatccaggagcggctggtgcgggcctatgagctgatgctgggcttctacggcatccggctggaggaccggggcactggaacagtgggccgggcccagaactaccagaagcgcttccagaacctgaactggaggagccacaacaacctgcgcatcacccgcatcctgaagagcctgggggagctgggcctggagcacttccaggcccccctggtgcgcttcttcctggaggagaccctggtgagaagagagctgcccggggtgcggcagagcgccctggactacttcatgtttgctgtgcgctgccgccaccagaggcggcagctggtgcactttgcctgggagcacttccggccccgctgcaagtttgtgtggggcccccaggacaagctgcggcgcttcaagcccagcagcctgccccaccccctggagggcagcaggaaggtggaggaggagggcagccctggggaccctgaccacgaggccagcacccagggccgcacctgtggccctgagcacagcaagggcggcggccgggtggatgagggcccccagcccaggtctgtggagccccaggatgctggccccctggagaggagccagggagatgaggccggcggccatggagaagatagacctgagcccctgagccccaaggagagcaagaagaggaagctggagctgagcagaagagagcagcccccaacagagcccggcccccagagcgccagcgaggtggagaagatcgccctgaacctggagggctgtgccctgagccagggcagcctgaggacaggcacccaggaggtgggcggccaggaccccggggagagcagctgcccctgctgccggggctggggcctgcggagctgctgcggcctgcccagcggcagcgccagctag

SEQ ID NO: 19803 - DNA, 1539 bp, Artificial Sequence
  Description of Artificial Sequence: Synthetic coding sequence
atgcccagccccagccgcagcggccgcagccgctgcctgaaggcccccaggaggagccgcagcggcctgagcggccccaccagcagctgctgggccagcaccatccggctggaggaccggggcaccggcaccgtgggccgggcccagaactaccagaagcgcttccagaacctgaactggaggagccacaacaacctgcgcatcacccgcatcctgaagagcctgggggagctgggcctggagcacttccaggcccccctggtgcgcttcttcctggaggagaccctggtgcggcgggagctgcccggggtgcggcagagcgccctggactacttcatgtttgctgtgcgctgccgccaccagaggcggcagctggtgcactttgcctgggagcacttccggccccgctgcaagtttgtgtggggcccccaggacaagctgcggcgcttcaagcccagcagcctgccccaccccctggagggcagcaggaaggtggaggaggagggcagccctggggaccctgaccacgaggccagcacccagggccgcacctgtggccctgagcacagcaaaggaggcggccgggtggatgagggcccccagcccaggtctgtggagccccaggatgctggccccctggagaggagccagggagatgaagctgggggccacggggaggacaggcctgagcccctgagccccaaggagagcaagaagaggaagctggagctgagccggcgggagcagcccccaacagagcccggcccccagagcgccagcgaggtggagaagatcgccctgaacctggagggctgtgccctgagccagggcagcctgaggacaggcacccaggaggtgggcggccaggaccctggagaggccgtgcagccctgccggcagcccctgggcgcccgggtggccgacaaggtgaggaagaggaggaaggtggatgaaggagctggggacagcgctgctgtggccagcggcggggcccagaccctggccctggccggcagccctgcccccagcggccaccccaaggccggccacagtgaaaatggagtggaggaggacacagagggccgcacaggccccaaggagggcaccccaggcagccccagcgagaccccaggccccagccctgctggccctgctggagatgagcctgctgagagccccagcgagaccccaggccccaggcctgctggccctgctggagatgagcctgctgagagccccagcgagaccccaggccccagccctgctggccccaccagagatgagcctgctgagagccccagcgagaccccaggccccaggcctgctggccctgctggagatgagcctgctgagagccccagcgagaccccaggccccaggcctgctggccctgctggagatgagcctgctgagagccccagcgagaccccaggccccagccctgctggccccaccagagatgagcccgccaaggccggggaggccgctgagctgcaggatgctgaggtggagagcagcgccaagagcggcaagccctag

SEQ ID NO: 19804 - DNA, 312 bp, Artificial Sequence
  Description of Artificial Sequence: Synthetic coding sequence
atgggccagcagagctctgtgcggcggctgaagaggtctgtgccctgtgagagcaatgaggccaatgaggccaatgaggccaacaagaccatgcctgagacccccaccggggacagcgacccccagcctgcccccaagaagatgaagaccagcgagagcagcaccatcctggtggtgcgctacagaagaaatgtgaagaggaccagccctgaggagctggtgaatgaccacgcccgggagaaccgcatcaacccagaccagatggaggaggaggagttcatcgagatcaccacagagcggcccaagaagtag

SEQ ID NO: 19805 - DNA, 1776 bp, Artificial Sequence
  Description of Artificial Sequence: Synthetic coding sequence
atggagaaggctgtgaatgatggcagccacagcgaggagctgttctgccacctgaagaccatcagcgagaaggaggacctgccccgctgcaccagcgagagccacctgagctgcctgaagcaggacatcctgaatgagaagacagagctggaggccaccctgaaggaggccgagctggtgacccacagcgtggagctgctgctgcccctcttcaaggacaccatcgagaagatcaactttgaaaatgccaacctgagcgccctgaacctgaagatcagcgagcagaaggagatcctgatcaaggagctggacaccttcaagtctgtgaagctggccctggagcacctgctgaggaagagggactacaagcagacaggagacaacctgagctccatgctgctggagaacctgacagacaatgaaagtgagaacaccaacctgaagaagaaggtgtttgagaaggaggcccacatccaggagctgagctgcctcttccagagcgagaaggccaacaccctgaaggccaaccgcttcagccagagcgtgaaggtggtgcatgagcggctgcagatccagatccacaagcgggaggctgaaaatgacaagctgaaggagtatgtgaagagcctggagaccaagatcgccaagtggaacctgcagagcaggatgaacaagaatgaggccatcgtgatgaaggaggccagccggcagaagacagtggccctgaagaaggccagcaaggtgtacaagcagaggctggaccacttcaccggggccatcgagaagctgaccagccagatccgggaccaggaggccaagctgtctgagaccatcagcgccagcaatgcctggaagagccactatgagaagatcgtgattgagaagacagagctggaggtgcagatcgagaccatgaagaagcagatcatcaacctgctggaggacctgaagaagatggaggaccacggcaagaacagctgtgaggagatcctgaggaaggtgcacagcattgaatatgaaaatgagaccctgaacctggagaacaccaagctgaagaccaccctggccgccctgaaggatgaggtggtgtctgtggagaatgagctgtctgagctgcaggaggtggagaagaagcagaagaccctgattgagatgtacaagacccaggtgcagaagctgcaggaggccgctgagatcgtgaagagccgctgtgagaacctgctgcacaagaacaaccagatcaccaagaccaagaacaagaatgtggagaaggtggatggcaaccacaacctgctgaccaagctgagcctggaggaggagaactgcctgatccagctgaagtgtgagaacctgcagcagaagctggagcagatggatgctgagaacaaggagctggagaagaagctggccaaccaggaggagtgcctgaagcacagcaacctgaagttcaaggagaagtctgctgagtacacagccctggcccggcagctggaggccgccctggaggagggccggcagaaggtggccgaggagattgagaagatgagcagccgggagagcgccctgcagatcaagatcctggacctggagacagagctgaggaagaagaatgaggagcagaaccagctggtgtgcaagatgaacagcaaggcccagcaccaggaggtgtgcctgaaggaggtgcagaacagcctggagaagtctgagaaccagaatgaaagcatcaagaactacctgcagttcctgaagaccagctatgtgaccatgtttgaatag

SEQ ID NO: 19806 - DNA, 1935 bp, Artificial Sequence
  Description of Artificial Sequence: Synthetic coding sequence
atggagaaggctgtgaatgatggcagccacagcgaggagctgttctgccacctgaagaccatcagcgagaaggaggacctgccccgctgcaccagcgagagccacctgagctgcctgaagcaggacatcctgaatgagaagacagagctggaggccaccctgaaggaggccgagctggtgacccacagcgtggagctgctgctgcccctcttcaaggacaccatcgagaagatcaactttgaaaatgccaacctgagcgccctgaacctgaagatcagcgagcagaaggagatcctgatcaaggagctggacaccttcaagtctgtgaagctggccctggagcacctgctgaggaagagggactacaagcagacaggagacaacctgagctccatgctgctggagaacctgacagacaatgaaagtgagaacaccaacctgaagaagaaggtgtttgagaaggaggcccacatccaggagctgagctgcctcttccagagcgagaaggccaacaccctgaaggccaaccgcttcagccagagcgtgaaggtggtgcatgagcggctgcagatccagatccacaagcgggaggctgaaaatgacaagctgaaggagtatgtgaagagcctggagaccaagatcgccaagtggaacctgcagagcaggatgaacaagaatgaggccatcgtgatgaaggaggccagccggcagaagacagtggccctgaagaaggccagcaaggtgtacaagcagaggctggaccacttcaccggggccatcgagaagctgaccagccagatccgggaccaggaggccaagctgtctgagaccatcagcgccagcaatgcctggaagagccactatgagaagatcgtgattgagaagacagagctggaggtgcagatcgagaccatgaagaagcagatcatcaacctgctggaggacctgaagaagatggaggaccacggcaagaacagctgtgaggagatcctgaggaaggtgcacagcattgaatatgaaaatgagaccctgaacctggagaacaccaagctgaagaccaccctggccgccctgaaggatgaggtggtgtctgtggagaatgagctgtctgagctgcaggaggtggagaagaagcagaagaccctgattgagatgtacaagacccaggtgcagaagctgcaggaggccgctgagatcgtgaagagccgctgtgagaacctgctgcacaagaacaaccagatcaccaagaccaagaacaagaatgtggagaagatgaggggccagatggagagccacctgaaggagctggagcgggtgtgtgacagcctgacagctgctgagcggcggctgcacgagtgccaggagagcctgcagtgctgcaagggcaaatgtgccgaccaggagcacaccatccgggagctgcagggccaggtggatggcaaccacaacctgctgaccaagctgagcctggaggaggagaactgcctgatccagctgaagtgtgagaacctgcagcagaagctggagcagatggatgctgagaacaaggagctggagaagaagctggccaaccaggaggagtgcctgaagcacagcaacctgaagttcaaggagaagtctgctgagtacacagccctggcccggcagctggaggccgccctggaggagggccggcagaaggtggccgaggagattgagaagatgagcagccgggagagcgccctgcagatcaagatcctggacctggagacagagctgaggaagaagaatgaggagcagaaccagctggtgtgcaagatgaacagcaaggcccagcaccaggaggtgtgcctgaaggaggtgcagaacagcctggagaagtctgagaaccagaatgaaagcatcaagaactacctgcagttcctgaagaccagctatgtgaccatgtttgaatag

SEQ ID NO: 19807 - DNA, 2526 bp, Artificial Sequence
  Description of Artificial Sequence: Synthetic coding sequence
atgatggctgatggagctgctgctggggccggcggcagccccagcctgcgggagctgcgggccaggatggtggccgccgccaatgagatcgccaaggagaggaggaagcaggatgtggtgaacagagtggccacccacagcagcaacatccgcagcaccttcaagcctgtgattgatggctccatgctgaagaatgacatcaagcagaggctggcccgggagcggcgggaggagaagaggcggcagcaggatgccaacaaggagacccagctgctggagaaggagaggaagaccaagctgcagtatgagaagcagatggaggagcggcagaggaagctgaaggagaggaaggagaaggaggagcagaggagaattgctgctgaggagaagaggcaccagaaggatgaggcccagaaggagaagttcaccgccatcctgtaccgcaccctggagcggcggcggctggctgatgactaccagcagaagcgctggagctggggcggcagcgccatggccaacagcgagagcaagacaggcaagacagacaaggagaggagcagcagcctgaacagaagagacagcaacctgcacagcagcacagacaaggagcaggccgagaggaagccccgggtgactggagtgaccaactacgtgatgcagtatgtgacagtgcccctgaggaagtgcaccagtgatgagctgcgggctgtgatgttccccatgagcaccatgaagatccccccccagaccaaggtggaggagagccccctggagaaggtggagaccccacccaaggcctctgtggatgccccaccccaggtgaatgtggaggtgttctgcaacacctccatggaggccagccccaaggccggcgtgggcatggcccctgaggtgtccacagacagcttccctgtggtgtctgtggatgtgtcccctgtggtgtccacctatgattctgagatgtccatggatgccagccctgagctgagcattgaggccctgcccaaggtggacctggagaccgtgcccaaggtgtccatcgtggccagccctgaggccagcctggaggcccctcctgaggtgtccctggaggccctgcctgaggtgtctgtggaggccgcccctgagggcagcctggaggccccacccaagggcagcgctgaggtggcccccaaggagagcgtgaagggcagccccaaggagagcatggaggccagccctgaggccatggtgaaggccagccccaagaccagcctggaggcctccatggaggccagccccaaggccaaggccagagatgcccccaagaagtctgagatggacaagcaggccctgatccccatcgccaagaagaggctgagcagctacacagagtgctacaagtggagcagcagcccagaaaatgcctgtggcctgcccagccccatcagcaccaaccggcagatccagaagaactgcccccccagccccctgcccctcatcagcaagcagagcccccagaccagcttcccctacaagatcatgcccatccagcacaccctgtctgtgcagagcgccagcagcacagtgaagaagaagaaggagaccgtgtccaagaccaccaacagatgtgaggccctgagccagaggcacatgatctatgaggagagcggcaacaagagcacagctggcatcatgaatgctgaggccgccaccaagatcctgacagagctgcggcggctggcccgggagcagcgggagaaggaggaggaggagcggcagcgggaggagatgcagcagagggtcatcaagaagagcaaggacatggccaaggaggccgtgggcggccaggccgaggaccacctgaagctgaaggatggccagcagcagaatgagaccaagaagaagaagggctggctggaccaggaggaccaggaggcccccctgcagaagggagatgccaagatcaaggcccaggaggaggccgacaagaggaagaaggagcacgagcgcatcatgctgcagaacctgcaggagcggctggagaggaagaagagaattgaggagatcatgaagaggaccaggaagacagatgtgaatgccagcaaggtgacagagaccagcagccatgacatctatgaggaggccgaggccgacaatgaggagagtgacaaggacagcctgaatgagatgttccccagcgccatcctgaatggaacaggcagccccaccaagttcaagatgcccttcaacaatgccaagaagatgacccacaagctggtgttcctggaggatggcaccagccaggtgaggaaggagcccaagacctacttcaacggggacctgaagaacttccggcagaagtccatgaaggacaccagcatccaggaggtggtgtcccggcccagcagcaagaggatgaccagccacaccaccaagaccaggaaggcagatgagaccaacaccaccagccgcagcagcgcccagaccaagtctgagggcttccatgacatcctgcccaagagcagtgacaccttccggcagtag

SEQ ID NO: 19808 - DNA, 2577 bp, Artificial Sequence
  Description of Artificial Sequence: Synthetic coding sequence
atgaccagcccccgggtggccgccgccaatgagatcgccaaggagaggaggaagcaggatgtggtgaacagagtggccacccacagcagcaacatccgcagcaccttcaagcctgtgattgatggctccatgctgaagaatgacatcaagcagaggctggcccgggagcggcgggaggagaagaggcggcagcaggatgccaacaaggagacccagctgctggagaaggagaggaagaccaagctgcagtatgagaagcagatggaggagcggcagaggaagctgaaggagaggaaggagaaggaggagcagaggagaattgctgctgaggagaagaggcaccagaaggatgaggcccagaaggagaagttcaccgccatcctgtaccgcaccctggagcggcggcggctggctgatgactaccagcagaagcgctggagctggggcggcagcgccatggccaacagcgagagcaagacagccaacaagaggtctgccagcacagagaagctggagcagggcaccagcgccctgatccggcagatgcccctgagcagcgctggcctgcagaacagcgtggccaagaggaagacagacaaggagaggagcagcagcctgaacagaagagacagcaacctgcacagcagcacagacaaggagcaggccgagaggaagccccgggtgactggagtgaccaactacgtgatgcagtatgtgacagtgcccctgaggaagtgcaccagtgatgagctgcgggctgtgatgttccccatgagcaccatgaagatccccccccagaccaaggtggaggagagccccctggagaaggtggagaccccacccaaggcctctgtggatgccccaccccaggtgaatgtggaggtgttctgcaacacctccatggaggccagccccaaggccggcgtgggcatggcccctgaggtgtccacagacagcttccctgtggtgtctgtggatgtgtcccctgtggtgtccacctatgacagcgagatgtccatggatgccagccctgagctgagcattgaggccctgcccaaggtggacctggagaccgtgcccaaggtgtccatcgtggccagccctgaggccagcctggaggcccctcctgaggtgtccctggaggccctgcctgaggtgtctgtggaggccgcccctgagggcagcctggaggccccacccaagggcagcgctgaggtggcccccaaggagagcgtgaagggcagccccaaggagagcatggaggccagccctgaggccatggtgaaggccagccccaagaccagcctggaggcctccatggaggccagccccaaggccaaggccagagatgcccccaagaagtctgagatggacaagcaggccctgatccccatcgccaagaagaggctgagcagctacacagagtgctacaagtggagcagcagcccagaaaatgcctgtggcctgcccagccccatcagcaccaaccggcagatccagaagaactgcccccccagccccctgcccctcatcagcaagcagagcccccagaccagcttcccctacaagatcatgcccatccagcacaccctgtctgtgcagagcgccagcagcacagtgaagaagaagaaggagaccgtgtccaagaccaccaacagatgtgaggccctgagccagaggcacatgatctatgaggagagcggcaacaagagcacagctggcatcatgaatgctgaggccgccaccaagatcctgacagagctgcggcggctggcccgggagcagcgggagaaggaggaggaggagcggcagcgggaggagatgcagcagagggtcatcaagaagagcaaggacatggccaaggaggccgtgggcggccaggccgaggaccacctgaagctgaaggatggccagcagcagaatgagaccaagaagaagaagggctggctggaccaggaggaccaggaggcccccctgcagaagggagatgccaagatcaaggcccaggaggaggccgacaagaggaagaaggagcacgagcgcatcatgctgcagaacctgcaggagcggctggagaggaagaagagaattgaggagatcatgaagaggaccaggaagacagatgtgaatgccagcaaggtgacagagaccagcagccatgacatctatgaggaggccgaggccgacaatgaggagagtgacaaggacagcctgaatgagatgttccccagcgccatcctgaatggcaccggcagccccaccaagttcaagatgcccttcaacaatgccaagaagatgacccacaagctggtgttcctggaggatggcaccagccaggtgaggaaggagcccaagacctacttcaatggagacctgaagaacttccggcagaagtccatgaaggacaccagcatccaggaggtggtgtcccggcccagcagcaagaggatgaccagccacaccaccaagaccaggaaggcagatgagaccaacaccaccagccgcagcagcgcccagaccaagtctgagggcttccatgacatcctgcccaagagcagtgacaccttccggcagtag

SEQ ID NO: 19809 - DNA, 948 bp, Artificial Sequence
  Description of Artificial Sequence: Synthetic coding sequence
atgcccctgaagctgcggggcaagaagaaggccaagagcaaggagacagctggcctggtggagggggagcccactggagctgggggcggcagcctgagcgccagccgggccccagcccggcggctggtgttccacgcccagctggcccacggcagcgccaccggccgggtggagggcttcagcagcatccaggagctgtatgcccagattgctggggcctttgagatcagccccagcgagatcctgtactgcaccctgaacacccccaagattgacatggagcggctgctgggcggccagctgggcctggaggacttcatctttgcccacgtgaagggcatcgagaaggaggtgaatgtgtacaagtctgaggacagcctgggcctgaccatcacagacaacggggtgggctacgccttcatcaagaggatcaaggatggcggcgtcatcgacagcgtgaagaccatctgtgtgggggaccacatcgagagcatcaacggggagaacatcgtgggctggaggcactatgatgtggccaagaagctgaaggagctgaagaaggaggagctgttcaccatgaagctgattgagcccaagaaggcctttgaaattgagctgcggagcaaggccggcaagagcagcggggagaagattggctgcggccgggccaccctgcggctgcggagcaagggccctgccaccgtggaggagatgcccagcgagaccaaggccaaggccatcgagaagattgatgatgtgctggagctgtacatgggcatccgggacatcgacctggccaccaccatgtttgaggccggcaaggacaaggtgaacccagatgaatttgctgtggccctggatgagaccctgggggactttgccttcccagatgaatttgtgtttgatgtgtggggcgtgattggagatgccaagaggcggggcctgtag

SEQ ID NO: 19810 - DNA, 2487 bp, Artificial Sequence
  Description of Artificial Sequence: Synthetic coding sequence
atgacaggcagcaacagccacatcaccatcctgaccctgaaggtgctgccccactttgagagcctgggcaagcaggagaagatccccaacaagatgtctgccttcaggaaccactgcccccacctggacagcgtgggggagatcaccaaggaggacctgatccagaagagcctgggcacctgccaggactgcaaggtgcagggccccaacctgtgggcctgcctggagaaccgctgcagctatgtgggctgtggggagagccaggtggaccacagcaccatccacagccaggagaccaagcactacctgactgtgaacctgaccaccctgcgggtgtggtgctacgcctgcagcaaggaggtgttcctggacaggaagctgggcacccagcccagcctgccccacgtgcggcagccccaccagatccaggagaacagcgtgcaggacttcaagatccccagcaacaccaccctgaagacccccctggtggccgtgtttgatgacctggacattgaagcagatgaggaggatgagctgcgggcccggggcctgaccggcctgaagaacatcggcaacacctgctacatgaatgctgccctgcaggccctgagcaactgcccccccctgacccagttcttcctggactgtggcggcctggccaggacagacaagaagccagccatctgcaagagctacctgaagctgatgacagagctgtggcacaagagcaggcctggctctgtggtgcccaccaccctcttccagggcatcaagacagtgaaccccaccttccggggctacagccagcaggatgcccaggagttcctgcgctgcctgatggacctgctgcacgaggagctgaaggagcaggtgatggaggtggaggaggacccccagaccatcaccacagaggagaccatggaggaggacaagagccagagtgatgtggacttccagagctgtgagagctgcagcaacagcgacagagcagaaaatgaaaatggcagccgctgcttcagcgaggacaacaatgagaccaccatgctgatccaggatgatgagaacaacagcgagatgagcaaggactggcagaaggagaagatgtgcaacaagatcaacaaggtgaacagcgagggggagtttgacaaggaccgggacagcatcagcgagaccgtggacctgaacaaccaggagaccgtgaaggtgcagatccacagccgggccagcgagtacatcacagatgtgcacagcaatgacctgagcaccccccagatcctgcccagcaatgaaggagtgaacccccggctgagcgccagcccccccaagagcggcaacctgtggccaggcctggccccaccccacaagaaggcccagagcgccagccccaagaggaagaagcagcacaagaagtacagaagtgtcatcagtgacatctttgatggcaccatcatcagctctgtgcagtgcctgacctgtgacagagtgtctgtgaccctggagaccttccaggacctgagcctgcccatccctgggaaggaggacctggccaagctgcacagcagcagccaccccaccagcatcgtgaaggccggcagctgtggggaggcctatgccccccagggctggatcgccttcttcatggagtatgtgaagtcctggttctggggccctgtggtgaccctgcaggactgcctggccgccttctttgccagagatgagctgaagggggacaacatgtacagctgtgagaagtgcaagaagctgagaaatggagtgaagttctgcaaggtgcagaacttccctgagatcctgtgcatccacctgaagcgcttcagacatgagctgatgttcagcaccaagatcagcacccacgtgtccttccccctggagggcctggacctgcagcccttcctggccaaggacagccctgcccagatcgtgacctatgacctgctgagcgtcatctgccaccacggcacagccagcagcggccactacatcgcctactgcaggaacaacctgaacaacctgtggtatgaatttgatgaccagagcgtgacagaggtgtctgagagcacagtgcagaatgctgaggcctacgtgctcttctacaggaagagcagcgaggaggcccagaaggagcggcggcgcatcagcaacctgctgaacatcatggagcccagcctgctgcagttctacatcagccggcagtggctgaacaagttcaagacctttgctgagcccggccccatcagcaacaatgacttcctgtgcatccacggcggcgtgccccccaggaaggccggctacatcgaggacctggtgctgatgctgccccagaacatctgggacaacctgtacagccgctatggaggcggccctgctgtgaaccacctgtacatctgccacacctgccagattgaagctgagaagattgagaagaggaggaagacagagctggagatcttcatccgggtgaagaagtag

SEQ ID NO: 19811 - DNA, 2829 bp, Artificial Sequence; identical to SEQ ID NO: 19479
  Description of Artificial Sequence: Synthetic coding sequence

SEQ ID NO: 19812 - DNA, 2736 bp, Artificial Sequence
  Description of Artificial Sequence: Synthetic coding sequence
atgtctgccttcaggaaccactgcccccacctggacagcgtgggggagatcaccaaggaggacctgatccagaagagcctgggcacctgccaggactgcaaggtgcagggccccaacctgtgggcctgcctggagaaccgctgcagctatgtgggctgtggggagagccaggtggaccacagcaccatccacagccaggagaccaagcactacctgactgtgaacctgaccaccctgcgggtgtggtgctacgcctgcagcaaggaggtgttcctggacaggaagctgggcacccagcccagcctgccccacgtgcggcagccccaccagatccaggagaacagcgtgcaggacttcaagatccccagcaacaccaccctgaagacccccctggtggccgtgtttgatgacctggacatcgaggctgatgaagaagatgagctgcgggcccggggcctgaccggcctgaagaacatcggcaacacctgctacatgaatgctgccctgcaggccctgagcaactgcccccccctgacccagttcttcctggactgtggcggcctggccaggacagacaagaagccagccatctgcaagagctacctgaagctgatgacagagctgtggcacaagagccggcccggctctgtggtgcccaccaccctcttccagggcatcaagacagtgaaccccaccttccggggctacagccagcaggatgcccaggagttcctgcgctgcctgatggacctgctgcacgaggagctgaaggagcaggtgatggaggtggaggaggacccccagaccatcaccacagaggagaccatggaggaggacaagagccagagtgatgtggacttccagagctgtgagagctgcagcaacagcgacagagcagaaaatgaaaatggcagccgctgcttcagcgaggacaacaatgagaccaccatgctgatccaggatgatgagaacaacagcgagatgagcaaggactggcagaaggagaagatgtgcaacaagatcaacaaggtgaacagcgagggggagtttgacaaggaccgggacagcatcagcgagaccgtggacctgaacaaccaggagaccgtgaaggtgcagatccacagccgggccagcgagtacatcacagatgtgcacagcaatgacctgagcaccccccagatcctgcccagcaatgaaggagtgaacccccggctgagcgccagcccccccaagagcggcaacctgtggccaggcctggccccaccccacaagaaggcccagagcgccagccccaagaggaagaagcagcacaagaagtaccgcagcgtcatcagtgacatctttgatggcaccatcatcagctctgtgcagtgcctgacctgtgacagagtgtctgtgaccctggagaccttccaggacctgagcctgcccatccctgggaaggaggacctggccaagctgcacagcagcagccaccccaccagcatcgtgaaggccggcagctgtggggaggcctatgccccccagggctggatcgccttcttcatggagtatgtgaagagatttgtggtgtcctgtgtgcccagctggttctggggccctgtggtgaccctgcaggactgcctggccgccttctttgccagagatgagctgaagggggacaacatgtacagctgtgagaagtgcaagaagctgagaaatggagtgaagttctgcaaggtgcagaacttccctgagatcctgtgcatccacctgaagcgcttcagacatgagctgatgttcagcaccaagatcagcacccacgtgtccttccccctggagggcctggacctgcagcccttcctggccaaggacagccctgcccagatcgtgacctatgacctgctgagcgtcatctgccaccacggcacagccagcagcggccactacatcgcctactgcaggaacaacctgaacaacctgtggtatgaatttgatgaccagagcgtgacagaggtgtctgagagcacagtgcagaatgctgaggcctacgtgctcttctacaggaagagcagcgaggaggcccagaaggagcggcggcgcatcagcaacctgctgaacatcatggagcccagcctgctgcagttctacatcagccggcagtggctgaacaagttcaagacctttgctgagcccggccccatcagcaacaatgacttcctgtgcatccatggaggagtgccccccaggaaggccggctacatcgaggacctggtgctgatgctgccccagaacatctgggacaacctgtacagccgctatggaggcggccctgctgtgaaccacctgtacatctgccacacctgccagatcgaggccgagaagattgagaagaggaggaagacagagctggagatcttcatccggctgaacagagccttccagaaggaggacagccctgccaccttctactgcatctccatgcagtggttccgggagtgggagagctttgtgaagggcaaggatggagaccccccaggccccatcgacaacaccaagattgctgtgaccaagtgtggaaatgtgatgctgcggcagggcgctgacagcggccagatcagcgaggagacctggaacttcctgcagagcatctacggcggcggccctgaggtgatcctgcggccccctgtggtgcacgtggaccctgacatcctgcaggccgaggagaagattgaggtggagaccaggagcctgtag

SEQ ID NO: 19813 - DNA, 465 bp, Artificial Sequence
  Description of Artificial Sequence: Synthetic coding sequence
atggcccctcctgtgcgctactgcatccctggagagcggctgtgcaacctggaggagggcagccctggcagcggcacctacaccaggcatggctacatcttcagcagcctggccggctgcctgatgaagagcagtgaaaatggagccctgcctgtggtgtctgtggtgcgggagacagagagccagctgctgcctgatgtgggcgccatcgtgacctgcaaggtggagatctacaagagcttccggcctggggacatcgtgctggccaaggtgatcagcctgggagatgcccagagcaactacctgctgaccacagcagaaaatgagctgggcgtggtggtggcccacagcgagagcggcatccagatggtgcccatctcctggtgtgagatgcagtgccccaagacccacaccaaggagttcaggaaggtggcccgggtgcagcctgagttcctgcagacctag

SEQ ID NO: 19814 - DNA, 513 bp, Artificial Sequence
  Description of Artificial Sequence: Synthetic coding sequence
atggcccctcctgtgcgctactgcatccctggagagcggctgtgcaacctggaggagggcagccctggcagcggcacctacaccaggcatggctacatcttcagcagcctggccggctgcctgatgaagagcagtgaaaatggagctgtgagcagcatcaacagcagatttgccaaggtgcacatcctgtatgtgggctccatgcccctgaagaacagcttccggggcaccatcagaaaagaagatgtgcgggccacagagaaggacaaggtggagatctacaagagcttccggcctggggacatcgtgctggccaaggtgatcagcctgggagatgcccagagcaactacctgctgaccacagcagaaaatgagctgggcgtggtggtggcccacagcgagagcggcatccagatggtgcccatctcctggtgtgagatgcagtgccccaagacccacaccaaggagttcaggaaggtggcccgggtgcagcctgagttcctgcagacctag

SEQ ID NO: 19815 - DNA, 537 bp, Artificial Sequence
  Description of Artificial Sequence: Synthetic coding sequence
atggcccctcctgtgcgctactgcatccctggagagcggctgtgcaacctggaggagggcagccctggcagcggcacctacaccaggcatggctacatcttcagcagcctggccggctgcctgatgaagagcagtgaaaatggagccctgcctgtggtgtctgtggtgcgggagacagagagccagctgctgcctgatgtgggcgccatcgtgacctgcaaggtgagcagcatcaacagcagatttgccaaggtgcacatcctgtatgtgggctccatgcccctgaagaacagcttccggggcaccatcaggaaggaggatgtgcgggccacagagaaggacaagatcagcctgggagatgcccagagcaactacctgctgaccacagcagaaaatgagctgggcgtggtggtggcccacagcgagagcggcatccagatggtgcccatctcctggtgtgagatgcagtgccccaagacccacaccaaggagttcaggaaggtggcccgggtgcagcctgagttcctgcagacctag

SEQ ID NO: 19816 - DNA, 2811 bp, Artificial Sequence
  Description of Artificial Sequence: Synthetic coding sequence
atggctgctgcccgggaccccccagaggtgtccctgcgggaggccacccagaggaagctgcggcgcttcagcgagctgcggggcaagctggtggcccggggggagttctgggacatcgtggccatcacagctgctgatgagaagcaggagctggcctacaaccagcagctgtctgagaagctgaagaggaaggagctgcccctgggcgtgcagtaccacgtgtttgtggaccctgctggggccaagattggaaatggaggcagcaccctgtgtgccctgcagtgcctggagaagctgtatggagacaagtggaacagcttcaccatcctgctgatccacagtgatgagtggaagaagaaggtgtctgagagctatgtgatcaccatcgagcggctggaggatgacctgcagatcaaggagaaggagctgacagagctgaggaacatcttcggcagtgatgaggccttcagcaaggtgaacctgaactacagaacagaaaatggcctgagcctgctgcacctgtgctgcatctgtggcggcaagaagagccacatccgcaccctgatgctgaagggcctgcggcccagccggctgaccagaaatggcttcaccgccctgcacctggccgtgtacaaggacaatgctgagctgatcaccagcctgctgcacagcggggctgacatccagcaggtgggctatggaggcctgacagccctgcacatcgccaccatcgccggccacctggaggccgcagatgtgctgctgcagcacggggccaacgtgaacatccaggatgctgtgttcttcacccccctgcacatcgccgcctactacggccacgagcaggtgacccggctgctgctgaagtttggagcagatgtgaatgtgtctggagaggtgggggaccggcccctgcacctggccagcgccaagggcttcctgaacatcgccaagctgctgatggaggagggcagcaaggcagatgtgaatgcccaggacaatgaagatcatgtgcccctgcacttctgcagccgcttcggccaccacgacatcgtgaagtacctgctgcagagcgacctggaggtgcagccccacgtggtgaacatctacggggacacccccctgcacctggcctgctacaacgggaagtttgaggtggccaaggagatcatccagatcagcggcacagagagcctgaccaaggagaacatcttcagcgagacagccttccacagcgcctgcacctacggcaagagcattgacctggtgaagttcctgctggaccagaatgtcatcaacatcaaccaccagggcagagatggccacacaggcctgcacagcgcctgctaccacggccacatccggctggtgcagttcctgctggacaatggagctgacatgaacctggtggcctgtgaccccagccgcagcagcggggagaaggatgagcagacctgcctgatgtgggcctatgaaaaaggacatgatgccatcgtgaccctgctgaagcactacaagaggccccaggatgagctgccctgcaatgagtacagccagcctggaggagatggcagctatgtgtctgtgcccagccccctgggcaagatcaagtccatgaccaaggagaaggctgacatcctgctgctgcgggccggcctgcccagccacttccacctgcagctgtctgaaattgagttccacgagatcatcggcagcggcagctttgggaaggtgtacaagggccgctgcaggaacaagatcgtggccatcaagcgctaccgggccaacacctactgcagcaagagtgatgtggacatgttctgccgggaggtgtccatcctgtgccagctgaaccacccctgtgtgatccagtttgtgggcgcctgcctgaatgaccccagccagtttgccatcgtgacccagtacatcagcggcggcagcctcttcagcctgctgcacgagcagaagaggatcctggacctgcagagcaagctgatcatcgctgtggatgtggccaagggcatggagtacctgcacaacctgacccagcccatcatccaccgggacctgaacagccacaacatcctgctgtatgaagatggccatgctgtggtggccgactttggagagagccgcttcctgcagagcctggatgaggacaacatgaccaagcagcccggcaacctgcgctggatggcccctgaggtgttcacccagtgcacccgctacaccatcaaggcagatgtgttctcctatgccctgtgcctgtgggagatcctgactggagagatcccctttgcccacctgaagccagctgctgctgctgctgacatggcctaccaccacatccggccccccatcggctacagcatccccaagcccatcagcagcctgctgatccggggctggaatgcctgcccagagggccggcctgagttcagcgaggtggtgatgaagctggaggagtgcctgtgcaacatcgagctgatgagccctgccagcagcaacagcagcggcagcctgagccccagcagcagcagtgactgcctggtgaacagaggaggccctggccgcagccacgtggccgccctgcggagcagatttgagctggagtatgccctgaatgcccggagctatgctgccctgagccagagcgctggccagtacagcagccagggcctgagcctggaggagatgaagaggagcctgcagtacacccccatcgacaagtatggctacgtgtctgaccccatgagctccatgcacttccacagctgcaggaacagcagcagctttgaggacagcagctag

SEQ ID NO: 19817 - DNA, 510 bp, Artificial Sequence
  Description of Artificial Sequence: Synthetic coding sequence
atggctgctgcccgggaccccccagaggtgtccctgcgggaggccacccagaggaagctgcggcgcttcagcgagctgcggggcaagctggtggcccggggggagttctgggacatcgtggccatcacagctgctgatgagaagcaggagctggcctacaaccagcagctgtctgagaagctgaagaggaaggagctgcccctgggcgtgcagtaccacgtgtttgtggaccctgctggggccaagattggaaatggaggcagcaccctgtgtgccctgcagtgcctggagaagctgtatggagacaagtggaacagcttcaccatcctgctgatccacagcgtgtccttccagatctaccagaatgccctggccaagcaccctgtgtccttcaaggcctactggatccaggatgtgctgtggcacctggcccagctgtggagcatcccagactggggcctgatgttccagctgggcaagacagccctgctggtggtgctgaccagctag

SEQ ID NO: 19818 - DNA, 1785 bp, Artificial Sequence
  Description of Artificial Sequence: Synthetic coding sequence
atggctgctgcccgggaccccccagaggtgtccctgcgggaggccacccagaggaagctgcggcgcttcagcgagctgcggggcaagctggtggcccggggggagttctgggacatcgtggccatcacagctgctgatgagaagcaggagctggcctacaaccagcagctgtctgagaagctgaagaggaaggagctgcccctgggcgtgcagtaccacgtgtttgtggaccctgctggggccaagattggaaatggaggcagcaccctgtgtgccctgcagtgcctggagaagctgtatggagacaagtggaacagcttcaccatcctgctgatccacagcggcggctacagccagaggctgcccaatgccagcgccctgggcaagatcttcaccgccctgcccctgggcaaccccatctaccagatgctggagctgaagctggccatgtacatcgacttccccctgaacatgaaccctggcatcctggtgacctgtgctgatgacatcgagctgtacagcattggagaatttgagttcatccgctttgacaagccaggcttcaccgccctggcccaccccagcagcctgaccatcggcaccacccatggagtgtttgtgctggacccctttgatgacctgaagcaccgggacctggagtaccgcagctgccaccgcttcctgcacaagcccagcattgagaagatgtaccagttcaatgctgtgtgcaggcctggcaacttctgccagcaggactttgctggaggagacattgctgacctgaagctggacagcgactatgtgtacacagacagcctcttctacatggaccacaagagcgccaagatgctgctggccttctatgagaagattggcaccctgagctgtgaaattgatgcctatggagacttcctgcaggccctgggccctggggccaccgtggagtacaccaggaacaccagcaatgtcatcaaggaggagagcgagctggtggagatgaggcagaggatcttccacctgctgaagggcaccagcctgaatgtggtggtgctgaacaacagcaagttctaccacatcggcaccacagaggagtacctgttctacttcaccagtgacaacagcctgaagtctgagctgggcctgcagagcatcaccttcagcatcttcccagacatccctgagtgcagcggcaagaccagctgcatcatccagagcatcctggacagccgctgcagcgtggcccctggctctgtggtggagtacagccggctgggcccagatgtgtctgtgggggagaactgcatcatcagcggcagctacatcctgaccaaggccgccctgcctgcccacagctttgtgtgcagcctgagcctgaagatgaaccgctgcctgaagtatgccaccatggcctttggagtgcaggacaacctgaagaagtctgtgaagaccctgagtgacatcaagctgctgcagttctttggagtgtgcttcctgagctgcctggatgtgtggaacctgaaggtgacagaggagctgttcagcggcaacaagacctgcctgagcctgtggacagcccgcatcttccctgtgtgcagcagcctgagtgacagcgtcatcaccagcctgaagatgctgaatgctgtgaagaacaagagcgccttcagcctgaacagctacaagctgctgagcattgaggagatgctgatctacaaggatgtggaggacatgatcacctaccgggagcagatcttcctggagatcagcctgaagagcagcctgatgtag

SEQ ID NO: 19819 - DNA, 588 bp, Artificial Sequence
  Description of Artificial Sequence: Synthetic coding sequence
atggcccctcctgtgcgctactgcatccctggagagcggctgtgcaacctggaggagggcagccctggcagcggcacctacaccaggcatggctacatcttcagcagcctggccggctgcctgatgaagagcagtgaaaatggagccctgcctgtggtgtctgtggtgcgggagacagagagccagctgctgcctgatgtgggcgccatcgtgacctgcaaggtgagcagcatcaacagcagatttgccaaggtgcacatcctgtatgtgggctccatgcccctgaagaacagcttccggggcaccatcaggaaggaggatgtgcgggccacagagaaggacaaggtggagatctacaagagcttccggcctggggacatcgtgctggccaaggtgatcagcctgggagatgcccagagcaactacctgctgaccacagcagaaaatgagctgggcgtggtggtggcccacagcgagagcggcatccagatggtgcccatctcctggtgtgagatgcagtgccccaagacccacaccaaggagttcaggaaggtggcccgggtgcagcctgagttcctgcagacctag

SEQ ID NO: 19820 - DNA, 1626 bp, Artificial Sequence
  Description of Artificial Sequence: Synthetic coding sequence
atgaccggggagaagatccgcagcctgcggcgggaccacaagcccagcaaggaggagggggacctgctggagcctggagatgaggaggccgccgccgccctgggcggcaccttcaccaggagcagaattggaaaaggaggcaaggcctgccacaagatcttcagcaaccaccaccaccggctgcagctgaaggccgccccagccagcagcaaccccccaggggccccagccctgcccctgcacaacagctctgtgacagccaacagccagagccctgccctgctggccggcaccaaccctgtggccgtggtggctgatggcggcagctgcccagcccactaccctgtgcatgaatgtgtgttcaagggagatgtgcggcggctgagcagcctcatccgcacccacaacatcggccagaaggacaaccacggcaacacccccctgcacctggccgtgatgctgggcaacaaggaatgtgcccacctgctgctggcccacaatgcccctgtgaaggtgaagaatgcccagggctggagccccctggccgaggccatctcctatggagaccggcagatgatcacagccctgctgaggaagctgaagcagcagagccgggagagcgtggaggagaagaggccccggctgctgaaggccctgaaggagctgggggacttctacctggagctgcactgggacttccagagctgggtgcccctgctgagccgcatcctgcccagtgatgcctgcaagatctacaagcagggcatcaacatccggctggacaccaccctgattgacttcacagacatgaagtgccagagaggagacctgtccttcatcttcaatggagatgctgcccccagcgagagctttgtggtgctggacaatgagcagaaggtgtaccagaggatccaccacgaggagagcgagatggagacagaggaggaggtggacatcctgatgagcagtgacatctacagcgccaccctgagcaccaagagcatctccttcacccgggcccagacaggctggctgttccgggaggacaagacagagcgggtgggcaacttcctggccgacttctacctggtgaatggcctggtgctggagagcaggaagaggcgggagcacctgtctgaggaggacatcctgaggaacaaggccatcatggagagcctgagcaaaggaggcaacatcatggagcagaactttgagcccatccggcggcagagcctgaccccaccaccccagaacaccatcacctgggaggagtacatctctgcagaaaatggcaaggccccccacctgggccgggagctggtgtgcaaggagagcaagaagaccttcaaggccaccatcgccatgagccaggagttccccctgggcatcgagctgctgctgaatgtgctggaggtggtggcccccttcaagcacttcaacaagctgcgggagtttgtgcagatgaagctgcccccaggcttccctgtgaagctggacatccctgtgttccccaccatcacagccaccgtgaccttccaggagttccgctatgatgaatttgatggcagcatcttcaccatcccagatgactacaaggaggaccccagccgcttcccagacctgtag

SEQ ID NO: 19821 - DNA, 840 bp, Artificial Sequence
  Description of Artificial Sequence: Synthetic coding sequence
atgccctgccggcgggaggaggaggaggaggccggggaggaggccgagggggaggaggaggaggaggacagcttcctgctgctgcagcagagcgtggccctgggcagcagtggagaggtggaccggctggtggcccagattggagagaccctgcagctggatgctgcccagcacagccctgccagcccctgtggccccccaggggcccccctgcgggcccctggccccctggccgctgctgtgcctgctgacaaggcccggagccctgctgtgcccctgctgctgcccccagccctggccgagaccgtgggccctgcccctcctggggtgctgcgctgtgccctgggggaccggggccgggtgcggggccgggccgccccctactgtgtggccgagctggccaccggccccagcgccctgagccccctgcccccccaggccgacctggatggccccccaggagctgggaagcagggcatcccccagcccctgagcggcccctgcagaagaggctggctgcggggagctgctgccagccggcggctgcagcagaggcggggcagccagcctgagaccaggactggagatgatgacccccaccggctgctgcagcagctggtgctgagcggcaacctgatcaaggaggccgtgcggcggctgcacagccggcggctgcagctgcgggccaagctgccccagaggcccctgctgggccccctgagcgcccctgtgcatgagccccccagccccaggagccccagggctgcctgcagcgaccccggggccagcggccgggcccagctgaggactggagatggagtgctggtgcccggcagctag

SEQ ID NO: 19822 - DNA, 1209 bp, Artificial Sequence
  Description of Artificial Sequence: Synthetic coding sequence
atgcccctgcacagcagcctgggcaacaagtctgagaccctgagccagaagaagaacaacaacaacaaggagaagaccaagaggaacagcagaaatccacccaggacagccctgaaggagggcaagatggaggagctgagccaggccctggccagcagcttctctgtgtcccaggacctgaacagcacagctgccccccacccccggctgagccagtacaagagcaagtacagcagcctggagcagagcgagaggagaagaaggctgctggagctgcagaagagcaagaggctggactatgtgaaccacgcccggcggctggctgaagatgactggacaggcatggagagcgaggaggagaacaagaaggatgatgaggagatggacatcgacacagtgaagaagctgcccaagcactacgccaaccagctgatgctgtctgagtggctgattgatgtgcccagcgacctgggccaggagtggatcgtggtggtgtgccctgtgggcaagagggccctgattgtggccagccggggcagcaccagcgcctacaccaagagcggctactgtgtgaaccgcttcagcagcctgctgcccggcggcaacagaagaaacagcacagccaaggactacaccatcctggactgcatctacaatgaggtgaaccagacctactacgtgctggatgtgatgtgctggaggggccaccccttctatgactgccagacagacttccgcttctactggatgcacagcaagctgcctgaggaggagggcctgggggagaagaccaagctgaaccccttcaagtttgtgggcctgaagaacttcccctgcaccccagagagcctgtgtgatgtgctgtccatggacttcccctttgaggtggatggcctgctcttctaccacaagcagacccactacagccctggcagcacccccctggtgggctggctgcggccctacatggtgtctgatgtgctgggcgtggccgtgcctgctggccccctgaccaccaagccagactatgccggccaccagctgcagcagatcatggagcacaagaagagccagaaggagggcatgaaggagaagctgacccacaaggcctctgaaaatggccactatgagctggagcacctgagcacccccaagctgaagggcagcagccacagcccagaccaccctggctgcctgatggagaactag

SEQ ID NO: 19823 - DNA, 1107 bp, Artificial Sequence
  Description of Artificial Sequence: Synthetic coding sequence
atgagcctgtttggcaccaccagcggcttcggcaccagcggcacctccatgtttggcagcgccaccacagacaaccacaaccccatgaaggacatcgaggtgaccagcagcccagatgacagcatcggctgcctgtccttcagcccccccaccctgcccggcaacttcctgattgctggctcctgggccaatgatgtgcgctgctgggaggtgcaggacagcggccagaccatccccaaggcccagcagatgcacacaggccctgtgctggatgtgtgctggagcgatgatggcagcaaggtgttcaccgccagctgtgacaagacagccaagatgtgggacctgagcagcaaccaggccatccagatcgcccagcatgatgcccctgtgaagaccatccactggatcaaggcccccaactacagctgtgtgatgacaggctcctgggacaagaccctgaagttctgggacaccaggagcagcaaccccatgatggtgctgcagctgcctgagcgctgctactgtgctgatgtgatctaccccatggctgtggtggccacagctgagcggggcctgattgtgtaccagctggagaaccagcccagcgagttcagaagaattgagagccccctgaagcaccagcaccgctgtgtggccatcttcaaggacaagcagaacaagcccactggatttgccctgggcagcattgagggccgggtggccatccactacatcaacccccccaacccagccaaggacaacttcaccttcaagtgccacaggagcaatggcaccaacaccagcgccccccaggacatctatgctgtgaatggaattgccttccaccctgtgcacggcaccctggccaccgtgggcagtgatggccgcttctccttctgggacaaggatgcccggaccaagctgaagaccagcgagcagctggaccagcccatcagcgcctgctgcttcaaccacaacggcaacatctttgcctatgccagcagctatgactggagcaagggccacgagttctacaacccccagaagaagaactacatcttcctgagaaatgctgctgaggagctgaagcccaggaacaagaagtag

SEQ ID NO: 19824 - DNA, 552 bp, Artificial Sequence
  Description of Artificial Sequence: Synthetic coding sequence
atgaggaagagcagctgtgtggagagctttgatgaccagaggaggatgagcctgcacctgcatggagctgactgtgaccccaagacccagaatgagatgaacatctgtgaggaggagtttgtggagtacaagaacagagatgccatcagcgccctgatgcccctcttcagcgaggaggagagcagtgatggcagcaagcacaacaacggcctgcctgaccacatcagcgcccagctgcagaacacctacaccctgaaggccttcaccgtgggcagcaaatgtgtggtgtggagcagcctgaggaacacctggagcaaatgtgagatcctggagacagctgaggagggcaccagggtgctgaacctgagcaatggcatggaggagatcgtgaacccagaaaatgtgtggaatggcatccccaagctggacaagagccccccagaggccgtgtcccagagggtgggcaaggacctgtacttcatgtctgtgggggacaccaccatcaaggagaagggctttggaggagatggagacctgactgtggacctgtag

SEQ ID NO: 19825 - DNA, 1821 bp, Artificial Sequence
  Description of Artificial Sequence: Synthetic coding sequence
atgcccagcccccagctgctggtgctgtttggcagccagacaggaacagcccaggatgtgtctgagcggctgggccgggaggccaggagaagaaggctgggctgccgggtgcaggccctggacagctaccctgtggtgaacctgatcaatgagcccctggtgatctttgtgtgtgccaccaccggccagggcgaccccccagacaacatgaagaacttctggaggttcatcttcaggaagaacctgcccagcacagccctgtgccagatggactttgctgtgctgggcctgggggacagcagctatgccaagttcaactttgtggccaagaagctgcaccggcggctgctgcagctgggcggcagcgccctgctgcctgtgtgcctgggagatgaccagcacgagctgggcccagatgctgctgtggacccctggctgcgggacctgtgggacagagtgctgggcctgtacccacctcctcctggcctgacagagatccccccaggagtgcccctgcccagcaagttcaccctgctcttcctgcaggaggcccccagcactggaagtgagggccagagggtggcccaccctggcagccaggagccccccagcgagagcaagcccttcctggcccccatgatcagcaaccagagggtgacaggccccagccacttccaggatgtgcggctgattgaatttgacatcctgggcagcggcatcagctttgctgctggagatgtggtgctgatccagcccagcaacagcgctgcccacgtgcagcgcttctgccaggtgctgggcctggaccctgaccagctgttcatgctgcagccccgggagccagatgtgagcagccccacccggctgccccagccctgcagcatgaggcacctggtgagccactacctggacatcgcctctgtgccccggcgctccttctttgagctgctggcctgcctgagcctgcacgagctggagcgggagaagctgctggagttcagcagcgcccagggccaggaggagctgtttgagtactgcaaccggcccaggaggaccatcctggaggtgctgtgtgacttcccccacacagctgctgccatccccccagactacctgctggacctgatccctgtgatccggccccgggccttcagcatcgccagcagcctgctgacccaccccagccggctgcagatcctggtggccgtggtgcagttccagacccggctgaaggagccccggcggggcctgtgcagctcctggctggccagcctggaccccggccagggccctgtgcgggtgcccctgtgggtgcggcccggcagcctggccttccctgagaccccagacacccctgtgatcatggtgggccctggcaccggggtggcccccttccgggccgccatccaggagcgggtggcccagggccagacaggcaacttcctgttcttcggctgccgctggagggaccaggacttctactgggaggccgagtggcaggagctggagaagagggactgcctgaccctcatcccagccttcagccgggagcagcccccagccctcttcagcgccctgcaggagcagaaggtgtatgtgcagcaccggctgcgggagctgggcagcctggtgtgggagctgctggaccggcagggcgcctacttctacctggccggaaatgccaagtccatgccagcagatgtgtctgaggccctgatgagcatcttccaggaggagggcggcctgtgcagcccagatgctgctgcctacctggcccggctgcagcagacccggcgcttccagacagagacctgggcctag

SEQ ID NO: 19826 - DNA, 420 bp, Artificial Sequence
  Description of Artificial Sequence: Synthetic coding sequence
atggccgagagtgactgggacacagtgacagtgctgaggaagaagggccccacagctgcccaggccaagagcaagcaggccatcctggccgcccagaggagaggagaagatgtggagaccagcaagaagtgggccgccggccagaacaagcagcacagcatcaccaagaacacagccaagctggaccgggagacagaggagctgcaccacgacagagtgaccctggaggtgggcaaggtgatccagcagggccggcagagcaagggcctgacccagaaggacctggccaccaagatcaatgagaagccccaggtgattgctgactatgaaagtggccgggccatccccaacaaccaggtgctgggcaagattgaaagagccatcggggagtgccccagcaccctgcggcgggtgaggtag

SEQ ID NO: 19827 - DNA, 426 bp, Artificial Sequence
  Description of Artificial Sequence: Synthetic coding sequence
atggccgagagtgactgggacacagtgacagtgctgaggaagaagggccccacagctgcccaggccaagagcaagcaggccatcctggccgcccagaggagaggagaagatgtggagaccagcaagaagtgggccgccggccagaacaagcagcacagcatcaccaagaacacagccaagctggaccgggagacagaggagctgcaccacgacagagtgaccctggaggtgggcaaggtgatccagcagggccggcagagcaagggcctgacccagaaggacctggccaccaagatcaatgagaagccccaggtgattgctgactatgaaagtggccgggccatccccaacaaccaggtgctgggcaagattgaaagagccattgatgtgggcaccaggtctgcccgggtgctgcgggcccagtag

SEQ ID NO: 19828 - DNA, 150 bp, Artificial Sequence
  Description of Artificial Sequence: Synthetic coding sequence
atggccacccagaggaagcacctggtgaaggacttcaacccctacatcacctgctacatctgcaagggctacctgatcaagcccaccaccgtgacagaatgtctgcacaccagcgctgagagctactggatgagcacctggatgtcctag

SEQ ID NO: 19829 - DNA, 960 bp, Artificial Sequence
  Description of Artificial Sequence: Synthetic coding sequence
atgatggtgctgaaggtggaggagctggtgacaggcaagaagaatggaaatggagaggccggggagttcctgcctgaggacttcagagatggagaatatgaagctgctgtgaccctggagaagcaggaggacctgaagaccctgctggcccaccctgtgaccctgggggagcagcagtggaagtctgagaagcagcgggaggccgagctgaagaagaagaagctggagcagaggagcaagctggagaacctggaggacctggagatcatcatccagctgaagaagaggaagaagtacaggaagaccaaggtgcctgtggtgaaggagcctgagcctgagatcatcacagagcctgtggatgtgcccaccttcctgaaggccgccctggagaacaagctgcctgtggtggagaagttcctgagtgacaagaacaacccagatgtgtgtgatgagtacaagaggacagccctgcaccgggcctgcctggagggccacctggccatcgtggagaagctgatggaggccggggcccagatcgagttccgggacatgctggagagcacagccatccactgggccagccggggcggcaacctggatgtgctgaagctgctgctgaacaagggggccaagatcagcgcccgggacaagctgctgagcacagccctgcacgtggccgtgaggacaggccactatgaatgtgccgagcacctgattgcctgtgaggccgacctgaatgccaaggaccgggagggggacacccccctgcatgatgctgtgcggctgaaccgctacaagatgatccggctgctgatcatgtacggggctgacctgaacatcaagaactgtgccggcaagacccccatggacctggtgctgcactggcagaatggcaccaaggccatctttgacagcctgcgggagaacagctacaagaccagccgcatcgccaccttctag

SEQ ID NO: 19830 - DNA, 1089 bp, Artificial Sequence
  Description of Artificial Sequence: Synthetic coding sequence
atgagcggctaccagaggaggcctggggccacccccctgagccgggcccggagcctggccatcccagatgatgacagatttgaggacctggaggaggccaaccccttctccttccgggagttcctgaagaccaagaacctgggcctgagcaaggaggaccctgccagccgcatctatgccaaggaggccagccgccacagcctgggcctggaccacaacagcccccccagccagacaggaggctacggcctggagtaccagcagcccttctttgaggaccccactggagctggggacctgctggatgaggaggaggatgaggacaccggctggagcggggcctacctgcccagcgccatcgagcagacccaccctgagcgggtgcctgctggcaccagcccctgcagcacctacctgtccttcttcagcacccccagcgagctggccggccctgagagcctgcccagctgggccctgagtgacacagacagccgggtgtccccagccagccctgctggcagccccagcgctgactttgctgtgcacggggagagcctgggggacagacacctgcggaccctgcagatctcctatgatgccctgaaggatgagaacagcaagctgcggaggaagctgaatgaggtgcagagcttcagcgaggcccagacagagatggtgaggaccctggagaggaagctggaggccaagatgatcaaggaggagagtgactaccatgacctggagagcgtggtgcagcaggtggagcagaacctggagctgatgaccaagagagctgtgaaggcagaaaatcatgtggtgaagctgaagcaggagatcagcctgctgcaggcccaggtgagcaacttccagcgggagaatgaggccctgcgctgtggccagggcgccagcctgactgtggtgaagcagaatgctgatgtggccctgcagaacctgcgggtggtgatgaacagcgcccaggccagcatcaagcagctggtgtctggagctgagaccctgaacctggtggccgagatcctgaagagcattgaccgcatcagcgaggtgaaggatgaggaggaggacagctag

SEQ ID NO: 19831 - DNA, 5463 bp, Artificial Sequence
  Description of Artificial Sequence: Synthetic coding sequence
atggagagcaacttcaaccaggagggcgtgccccggcccagctatgtgttttctgctgaccccatcgcccggcccagcgagatcaactttgatggcatcaagctggacctgagccatgagttcagcctggtggcccccaacacagaggccaacagctttgagagcaaggactacctgcaggtgtgcctgcgcatccggcccttcacccagagcgagaaggagctggagagcgagggctgtgtgcacatcctggacagccagacagtggtgctgaaggagccccagtgcatcctgggccgcctgtctgagaagagcagcggccagatggcccagaagttctccttcagcaaggtgtttggacctgccaccacccagaaggagttcttccagggctgcatcatgcagcctgtgaaggacctgctgaagggccagagccgcctcatcttcacctacggcctgaccaacagcggcaagacctacaccttccagggcacagaagaaaatattggcatcctgcccaggaccctgaatgtgctgtttgacagcctgcaggagcggctgtacaccaagatgaacctgaagccccacaggagccgggagtacctgcggctgagcagcgagcaggagaaggaggagatcgccagcaagagcgccctgctgcggcagatcaaggaggtgacagtgcacaatgacagtgatgacaccctgtatggcagcctgaccaacagcctgaacatcagcgagtttgaggagagcatcaaggactatgagcaggccaacctgaacatggccaacagcatcaagttctctgtgtgggtgtccttctttgagatctacaatgagtacatctatgacctgtttgtgcctgtgagcagcaagttccagaagaggaagatgctgcggctgagccaggatgtgaagggctacagcttcatcaaggacctgcagtggatccaggtgtctgacagcaaggaggcctaccgcctgctgaagctgggcatcaagcaccagagcgtggccttcaccaagctgaacaatgccagcagccgcagccacagcatcttcaccgtgaagatcctgcagattgaagattctgagatgagcagggtcatccgggtgtctgagctgagcctgtgtgacctggccggcagcgagaggaccatgaagacccagaatgaaggagagcggctgcgggagaccggcaacatcaacaccagcctgctgaccctgggcaagtgcatcaacgtgctgaagaacagcgagaagagcaagttccagcagcacgtgcccttccgggagagcaagctgacccactacttccagagcttcttcaacgggaagggcaagatctgcatgattgtgaacatcagccagtgctacctggcctatgatgagaccctgaatgtgctgaagttcagcgccatcgcccagaaggtgtgtgtgcctgacaccctgaacagcagccaggagaagctgtttggacctgtgaagagcagccaggatgtgtccctggacagcaacagcaacagcaagatcctgaatgtgaagagggccaccatctcctgggagaacagcctggaggacctgatggaggatgaggacctggtggaggagctggagaatgctgaggagacccagaatgtggagaccaagctgctggatgaggacctggacaagaccctggaggagaacaaggccttcatcagccatgaggagaagaggaagctgctggacctgattgaggacctgaagaagaagctgatcaatgagaagaaggagaagctgaccctggagttcaagatccgggaggaggtgacccaggagttcacccagtactgggcccagcgggaggccgacttcaaggagaccctgctgcaggagcgggagatcctggaggagaatgctgagcggcggctggccatcttcaaggacctggtgggcaaatgtgacacccgggaggaggccgccaaggacatctgtgccaccaaggtggagacagaggagacccacaactacgtgggctttgaggacatcatcgacagcctgcaggacaacgtggccgacatcaagaagcaggccgagatcgcccacctgtacatcgccagcctgcctgacccccaggaggccacagcctgcctggagctgaagttcaaccagatcaaggccgagctggccaagaccaagggggagctgatcaagaccaaggaggagctgaagaagcgggagaatgaaagtgacagcctcatccaggagctggagaccagcaacaagaagatcatcacccagaaccagaggatcaaggagctgatcaacatcatcgaccagaaggaggacaccatcaatgagttccagaacctgaagagccacatggagaacaccttcaagtgcaatgacaaggctgacaccagcagcctcatcatcaacaacaagctgatctgcaatgagaccgtggaggtgcccaaggacagcaagagcaagatctgcagcgagaggaagagggtgaatgaaaatgagctgcagcaggatgagcccccagccaagaagggcagcatccacgtgtcctctgccatcacagaggaccagaagaagtctgaggaggtgcggcccaacattgctgagattgaggacatccgggtgctgcaggagaacaatgaaggcctgcgggccttcctgctgaccattgaaaatgagctgaagaatgagaaggaggagaaggccgagctgaacaagcagatcgtgcacttccagcaggagctgagcctgtctgagaagaagaacctgaccctgagcaaggaggtgcagcagatccagagcaactatgacatcgccatcgccgagctgcacgtgcagaagagcaagaaccaggagcaggaggagaagatcatgaagctgagcaatgaaattgaaacagccaccaggagcatcaccaacaacgtgtcccagatcaagctgatgcacaccaagattgatgagctgcggaccctggacagcgtgtcccagatcagcaacatcgacctgctgaacctgcgggacctgagcaatggcagcgaggaggacaacctgcccaacacccagctggacctgctgggcaatgactacctggtgtccaagcaggtgaaggagtaccgcatccaggagcccaaccgggagaacagcttccacagcagcattgaggccatctgggaggagtgcaaggagatcgtgaaggccagcagcaagaagagccaccagatcgaggagctggagcagcagatcgagaagctgcaggccgaggtgaagggctacaaggatgagaacaaccggctgaaggagaaggagcacaagaaccaggatgacctgctgaaggagaaggagaccctcatccagcagctgaaggaggagctgcaggagaagaatgtgaccctggatgtgcagatccagcacgtggtggagggcaagagggccctgtctgagctgacccagggcgtgacctgctacaaggccaagatcaaggagctggagaccatcctggagacccagaaggtggagtgcagccacagcgccaagctggagcaggacatcctggagaaggagagcatcatcctgaagctggagaggaacctgaaggagttccaggagcacctgcaggacagcgtgaagaacaccaaggacctgaatgtgaaggagctgaagctgaaggaggagatcacccagctgaccaacaacctgcaggacatgaagcacctgctgcagctgaaggaggaggaggaggagaccaaccggcaggagacagagaagctgaaggaggagctgagcgccagcagcgcccggacccagaacctgaaggctgacctgcagaggaaggaggaggactatgctgacctgaaggagaagctgacagatgccaagaagcagatcaagcaggtgcagaaggaggtgtctgtgatgagagatgaggacaagctgctgcgcatcaagatcaatgagctggagaagaagaagaaccagtgcagccaggagctggacatgaagcagaggaccatccagcagctgaaggagcagctgaacaaccagaaggtggaggaggccatccagcagtatgaaagagcctgcaaggacctgaatgtgaaggagaagatcatcgaggacatgaggatgaccctggaggagcaggagcagacccaggtggagcaggaccaggtgctggaggccaagctggaggaggtggagcggctggccacagagctggagaagtggaaggagaagtgcaatgacctggagaccaagaacaaccagaggagcaacaaggagcacgagaacaacacagatgtgctgggcaagctgaccaacctgcaggatgagctgcaggagagcgagcagaagtacaatgctgacaggaagaagtggctggaggagaagatgatgctgatcacccaggccaaggaggccgagaacatccggaacaaggagatgaagaagtatgcagaagatcgggagcgcttcttcaagcagcagaatgagatggagatcctgacagcccagctgacagagaaggacagcgacctgcagaagtggagggaggagcgggaccagctggtggccgccctggagatccagctgaaggccctgatcagcagcaatgtgcagaaggacaatgaaattgagcagctgaagaggatcatcagcgagaccagcaagattgagacccagatcatggacatcaagcccaagaggatcagcagcgctgaccctgacaagctgcagacagagcccctgagcaccagctttgagatcagcaggaacaagattgaagatggctctgtggtgctggacagctgtgaggtgtccacagaaaatgaccagagcacccgcttccccaagccagagctggagatccagttcacccccctgcagcccaacaagatggctgtgaagcaccctggctgcaccacccctgtgacagtgaagatccccaaggccaggaagaggaagagcaatgagatggaggaggacctggtgaagtgtgagaacaagaagaatgccacccccaggaccaacctgaagttccccatcagtgatgacaggaacagctctgtgaagaaggagcagaaggtggccatccggcccagcagcaagaagacctacagcctgcggagccaggccagcatcattggagtgaacctggccaccaagaagaaggagggcaccctgcagaagtttggagacttcctgcagcacagccccagcatcctgcagagcaaggccaagaagatcatcgagaccatgagcagcagcaagctgagcaatgtggaggccagcaaagaaaatgtgtcccagcccaagagggccaagaggaagctgtacaccagcgagatcagcagccccatcgacatcagcggccaggtgatcctgatggaccagaagatgaaggagagtgaccaccagatcatcaagaggcggctgcggaccaagacagccaagtag

SEQ ID NO: 19832 - DNA, 1485 bp, Artificial Sequence
  Description of Artificial Sequence: Synthetic coding sequence
atgaagctgggcaagaagcccatgtacaagcctgtggacccctacagcaggatgcagagcacctacaactacaacatgaggggcggggcctacccaccccgctacttctaccccttccctgtgccccccctgctgtaccaggtggagctgtctgtgggcggccagcagttcaacgggaagggcaagacccggcaggccgccaagcatgatgctgctgccaaggccctgcgcatcctgcagaatgagcccctgcctgagcggctggaggtgaatggccgggagagcgaggaggagaacctgaacaagtctgagatcagccaggtgtttgaaattgccctgaagaggaacctgcctgtgaactttgaggtggcccgggagagcggccccccccacatgaagaactttgtgaccaaggtgtctgtgggggagtttgtgggggagggggagggcaagagcaagaagatcagcaagaagaatgctgccatcgctgtgctggaggagctgaagaagctgccccccctgcctgctgtggagcgggtgaagccccgcatcaagaagaagaccaagcccatcgtgaagaccagcccagaatatggccagggcatcaaccccatcagccggctggcccagatccagcaggccaagaaggagaaggagcctgagtacaccctgctgacagagcggggcctgcccaggagaagagaatttgtgatgcaggtgaaggtgggcaaccacacagctgagggcaccggcaccaacaagaaggtggccaagagaaatgctgctgagaacatgctggagatcctgggcttcaaggtgccccaggcccagcccaccaagccagccctgaagtctgaggagaagacccccatcaagaagccaggagatggcaggaaggtgaccttctttgagcccggcagcggagatgaaaatggcaccagcaacaaggaggatgagttcaggatgccctacctgagccaccagcagctgcctgctggcatcctgcccatggtgcctgaggtggcccaggccgtgggcgtgtcccagggccaccacaccaaggacttcaccagggctgcccccaacccagccaaggccaccgtgacagccatgattgcccgggagctgctgtatggaggcaccagccccacagctgagaccatcctgaagaacaacatcagcagcggccacgtgccccacggccccctgacccggcccagcgagcagctggactacctgagccgggtgcagggcttccaggtggagtacaaggacttccccaagaacaacaagaatgaatttgtgtccctcatcaactgcagcagccagcccccactcatcagccatggaattggcaaggatgtggagagctgccacgacatggccgccctgaacatcctgaagctgctgtctgagctggaccagcagagcacagagatgcccaggactggaaatggccccatgtctgtgtgtggccgctgctag

SEQ ID NO: 19833 - DNA, 1509 bp, Artificial Sequence
  Description of Artificial Sequence: Synthetic coding sequence
atgaagctgggcaagaagcccatgtacaagcctgtggacccctacagcaggatgcagagcacctacaactacaacatgaggggcggggcctacccaccccgctacttctaccccttccctgtgccccccctgctgtaccaggtggagctgtctgtgggcggccagcagttcaacgggaagggcaagacccggcaggccgccaagcatgatgctgctgccaaggccctgcgcatcctgcagaatgagcccctgcctgagcggctggaggtgaatggccgggagagcgaggaggagaacctgaacaagtctgagatcagccaggtgtttgaaattgccctgaagaggaacctgcctgtgaactttgagagcttccccctgaagcaggtggcccgggagagcggccccccccacatgaagaactttgtgaccaaggtgtctgtgggggagtttgtgggggagggggagggcaagagcaagaagatcagcaagaagaatgctgccatcgctgtgctggaggagctgaagaagctgccccccctgcctgctgtggagcgggtgaagccccgcatcaagaagaagaccaagcccatcgtgaagccccagaccagcccagaatatggccagggcatcaaccccatcagccggctggcccagatccagcaggccaagaaggagaaggagcctgagtacaccctgctgacagagcggggcctgcccaggagaagagaatttgtgatgcaggtgaaggtgggcaaccacacagctgagggcaccggcaccaacaagaaggtggccaagagaaatgctgctgagaacatgctggagatcctgggcttcaaggtgccccaggcccagcccaccaagccagccctgaagtctgaggagaagacccccatcaagaagccaggagatggcaggaaggtgaccttctttgagcccggcagcggagatgaaaatggcaccagcaacaaggaggatgagttcaggatgccctacctgagccaccagcagctgcctgctggcatcctgcccatggtgcctgaggtggcccaggccgtgggcgtgtcccagggccaccacaccaaggacttcaccagggctgcccccaacccagccaaggccaccgtgacagccatgattgcccgggagctgctgtatggaggcaccagccccacagctgagaccatcctgaagaacaacatcagcagcggccacgtgccccacggccccctgacccggcccagcgagcagctggactacctgagccgggtgcagggcttccaggtggagtacaaggacttccccaagaacaacaagaatgaatttgtgtccctcatcaactgcagcagccagcccccactcatcagccatggaattggcaaggatgtggagagctgccacgacatggccgccctgaacatcctgaagctgctgtctgagctggaccagcagagcacagagatgcccaggactggaaatggccccatgtctgtgtgtggccgctgctag

SEQ ID NO: 19834 - DNA, 1491 bp, Artificial Sequence; identical to SEQ ID NO: 19263
  Description of Artificial Sequence: Synthetic coding sequence

SEQ ID NO: 19835 - DNA, 1473 bp, Artificial Sequence
  Description of Artificial Sequence: Synthetic coding sequence
atgtctgaggtgaccaagaacagcctggagaagatcctgccccagctgaagtgccacttcacctggaacctcttcaaggaggacagcgtgtcccgggacctggaggacagagtgtgcaaccagatcgagttcctgaacacagagttcaaggccaccatgtacaacctgctggcctacatcaagcacctggatggcaacaatgaagctgccctggagtgcctgcggcaggccgaggagctgatccagcaggagcacgccgaccaggccgagatccgcagcctggtgacctggggcaactatgcctgggtgtactaccacctgggccgcctgagtgatgcccagatctacgtggacaaggtgaagcagacctgcaagaagttcagcaacccctacagcattgagtacagcgagctggactgtgaggagggctggacccagctgaagtgtggcagaaatgaaagagccaaggtgtgctttgagaaggccctggaggagaagcccaacaaccctgagttcagcagcggcctggccatcgccatgtaccacctggacaaccaccctgagaagcagttcagcacagatgtgctgaagcaggccatcgagctgagcccagacaaccagtatgtgaaggtgctgctgggcctgaagctgcagaagatgaacaaggaggccgagggggagcagtttgtggaggaggccctggagaagagcccctgccagacagatgtgctgcggtctgctgccaagttctacagaaggaagggggacctggacaaggccatcgagctgttccagagggtgctggagagcacccccaacaacggctacctgtaccaccagatcggctgctgctacaaggccaaggtgcggcagatgcagaacacaggagagagcgaggccagcggcaacaaggagatgattgaggccctgaagcagtatgccatggactacagcaacaaggccctggagaagggcctgaaccccctgaatgcctacagcgacctggccgagttcctggagacagagtgctaccagacccccttcaacaaggaggtgcctgatgctgagaagcagcagagccaccagcgctactgcaacctgcagaagtacaacgggaagtctgaggacacagctgtgcagcacggcctggagggcctgagcatcagcaagaagagcacagacaaggaggagatcaaggaccagccccagaatgtgtctgagaacctgctgccccagaatgcccccaactactggtacctgcagggcctcatccacaagcagaatggagacctgctgcaggccgccaagtgctatgagaaggagctgggccgcctgctgagagatgcccccagcggcatcggcagcatcttcctgagcgccagcgagctggaggatggcagcgaggagatgggccagggcgctgtgagcagcagcccccgggagctgctgagcaacagcgagcagctgaactag

SEQ ID NO: 19836 - DNA, 1473 bp, Artificial Sequence; identical to SEQ ID NO: 19835
  Description of Artificial Sequence: Synthetic coding sequence

SEQ ID NO: 19837 - DNA, 1509 bp, Artificial Sequence; identical to SEQ ID NO: 19833
  Description of Artificial Sequence: Synthetic coding sequence

SEQ ID NO: 19838 - DNA, 654 bp, Artificial Sequence
  Description of Artificial Sequence: Synthetic coding sequence
atggccgagggcagccagagcgcccctgaggccggaaatgacatgggaaatgatgatgccatcggcggcaatgtgtccaagtacatcgtgctgcccaccggctactgcggccagcccaagaagggccacctgatctttgatgcctgctttgagagcggcaacctgggccgggtggaccaggtgtctgaatttgaatatgacctcttcatccggccagacacctgcaacccccgcttccgggtgtggttcaacttcaccgtggagaatgtgaaggagagccagagggtcatcttcaacatcgtgaacttcagcaagaccaagagcctgtacagagatggcatggcccccatggtgaagagcaccagccggcccaagtggcagaggctgccccccaagaatgtgtactactaccgctgcccagaccacaggaagaactacgtgatgagctttgccttctgctttgaccgggaggaggacatctaccagtttgcctactgctacccctacacctacacccgcttccagcactacctggacagcctgcagaagaggaacatggactacttcttccgggagcagctgggccagagcgtgcagcagaggaagctggacctgctgaccatcaccagccctgctggccgctggagctggtag

SEQ ID NO: 19839 - DNA, 963 bp, Artificial Sequence
  Description of Artificial Sequence: Synthetic coding sequence
atggccgagggcagccagagcgcccctgaggccggaaatgacatgggaaatgatgatgccatcggcggcaatgtgtccaagtacatcgtgctgcccaccggctactgcggccagcccaagaagggccacctgatctttgatgcctgctttgagagcggcaacctgggccgggtggaccaggtgtctgaatttgaatatgacctcttcatccggccagacacctgcaacccccgcttccgggtgtggttcaacttcaccgtggagaatgtgaaggagagccagagggtcatcttcaacatcgtgaacttcagcaagaccaagagcctgtacagagatggcatggcccccatggtgaagagcaccagccggcccaagtggcagaggctgccccccaagaatgtgtactactaccgctgcccagaccacaggaagaactacgtgatgagctttgccttctgctttgaccgggaggaggacatctaccagtttgcctactgctacccctacacctacacccgcttccagcactacctggacagcctgcagaagaggaacatggactacttcttccgggagcagctgggccagagcgtgcagcagaggaagctggacctgctgaccatcaccagcccagacaacctgcgggagggcgctgagcagaaggtggtgttcatcaccggccgggtgcaccctggagagacccccagcagctttgtgtgccagggcatcatcgacttcctggtgtcccagcaccccatcgcctgtgtgctgcgggagtacctggtgttcaagatcgcccccatgctgaacccagatggagtgtacctgggcaactaccgctgcagcctgatgggctttgacctgaacagacactggctggaccccagcccctgggtgcaccccaccctgcacggcgtgaagcagctgattgtgcagatgtacaatgaccctgtgagcaactag

SEQ ID NO: 19840 - DNA, 1512 bp, Artificial Sequence
  Description of Artificial Sequence: Synthetic coding sequence
atggccgagggcagccagagcgcccctgaggccggaaatgacatgggaaatgatgatgccatcggcggcaatgtgtccaagtacatcgtgctgcccaccggctactgcggccagcccaagaagggccacctgatctttgatgcctgctttgagagcggcaacctgggccgggtggaccaggtgtctgaatttgaatatgacctcttcatccggccagacacctgcaacccccgcttccgggtgtggttcaacttcaccgtggagaatgtgaaggagagccagagggtcatcttcaacatcgtgaacttcagcaagaccaagagcctgtacagagatggcatggcccccatggtgaagagcaccagccggcccaagtggcagaggctgccccccaagaatgtgtactactaccgctgcccagaccacaggaagaactacgtgatgagctttgccttctgctttgaccgggaggaggacatctaccagtttgcctactgctacccctacacctacacccgcttccagcactacctggacagcctgcagaagaggaacatggactacttcttccgggagcagctgggccagagcgtgcagcagaggaagctggacctgctgaccatcaccagcccagacaacctgcgggagggcgctgagcagaaggtggtgttcatcaccggccgggtgcaccctggagagacccccagcagctttgtgtgccagggcatcatcgacttcctggtgtcccagcaccccatcgcctgtgtgctgcgggagtacctggtgttcaagatcgcccccatgctgaacccagatggagtgtacctgggcaactaccgctgcagcctgatgggctttgacctgaacagacactggctggaccccagcccctgggtgcaccccaccctgcacggcgtgaagcagctgattgtgcagatgtacaatgaccccaagaccagcctggagttctacatcgacatccacgcccacagcaccatgatgaatggcttcatgtatggcaacatctttgaagatgaggagcgcttccagaggcaggccatcttccccaagctgctgtgccagaatgctgaggacttctcctacagcagcaccagcttcaacagagatgctgtgaaggccggcaccggccgccgcttcctgggcggcctgctggaccacaccagctactgctacaccctggaggtgtccttctacagctacatcatcagcggcaccacagctgctgtgccctacacagaggaggcctacatgaagctgggcagaaatgtggcccggaccttcctggactactaccgcctgaaccctgtggtggagaaggtggccatccccatgccccggctgaggaacaaggagattgaggtgcagaggaggaaggagaagagccccccctacaagcaccccctgctgcggggccctgccagcaactaccccaacagcaaaggagacaagaagagctctgtgaaccacaaggaccccagcacccccttctag

SEQ ID NO: 19841 - DNA, 1734 bp, Artificial Sequence
  Description of Artificial Sequence: Synthetic coding sequence
atgagccaggtgcaggtgcaggtgcagaaccccagcgctgccctgagcggcagccagatcctgaacaagaaccagagcctgctgagccagcccctgatgagcatccccagcaccaccagcagcctgcccagtgaaaatgccggccggcccatccagaacagcgccctgcccagcgccagcatcaccagcaccagcgctgctgctgagagcatcacccccaccgtggagctgaatgccctgtgcatgaagctgggcaagaagcccatgtacaagcctgtggacccctacagcaggatgcagagcacctacaactacaacatgagaggaggagcctacccaccccgctacttctaccccttccctgtgccccccctgctgtaccaggtggagctgtctgtgggcggccagcagttcaacgggaagggcaagacccggcaggccgccaagcatgatgctgctgccaaggccctgcgcatcctgcagaatgagcccctgcctgagcggctggaggtgaatggccgggagagcgaggaggagaacctgaacaagtctgagatcagccaggtgtttgagatcgccctgaagaggaacctgcctgtgaactttgaggtggcccgggagagcggccccccccacatgaagaactttgtgaccaaggtgtctgtgggggagtttgtgggggagggggagggcaagagcaagaagatcagcaagaagaatgctgccatcgctgtgctggaggagctgaagaagctgccccccctgcctgctgtggagcgggtgaagccccgcatcaagaagaagaccaagcccatcgtgaagccccagaccagcccagaatatggccagggcatcaaccccatcagccggctggcccagatccagcaggccaagaaggagaaggagcctgagtacaccctgctgacagagcggggcctgccccggcggcgggagtttgtgatgcaggtgaaggtgggcaaccacacagctgagggcaccggcaccaacaagaaggtggccaagagaaatgctgctgagaacatgctggagatcctgggcttcaaggtgccccaggcccagcccaccaagccagccctgaagtctgaggagaagacccccatcaagaagccaggagatggcaggaaggtgaccttctttgagcccggcagcggagatgaaaatggcaccagcaacaaggaggatgagttcaggatgccctacctgagccaccagcagctgcctgctggcatcctgcccatggtgcctgaggtggcccaggccgtgggcgtgtcccagggccaccacaccaaggacttcacccgggccgcccccaacccagccaaggccaccgtgacagccatgattgcccgggagctgctgtatggaggcaccagccccacagctgagaccatcctgaagaacaacatcagcagcggccacgtgccccacggccccctgacccggcccagcgagcagctggactacctgagccgggtgcagggcttccaggtggagtacaaggacttccccaagaacaacaagaatgaatttgtgtccctcatcaactgcagcagccagcccccactcatcagccacggcatcggcaaggatgtggagagctgccacgacatggccgccctgaacatcctgaagctgctgtctgagctggaccagcagagcacagagatgcccaggactggaaatggccccatgtctgtgtgtggccgctgctag

SEQ ID NO: 19842 - DNA, 852 bp, Artificial Sequence
  Description of Artificial Sequence: Synthetic coding sequence
atgtctggagctgtgctgctggagcgggagcggctgaccagcggcaccacctggcacacagctggcctgctgtggcagctgcggcccagtgatgtggaggtggagctgctggcccacaccaggagagtggtgtcccgggagctggaggaggagaccggcctgcacacaggctggatccagaatggaggcctcttcatcgccagcaaccggcagaggctggatgagtacaagaggctgatgagcctgggcaaggcctacggcgtggagagccacgtgctgagccctgctgagaccaagaccctgtaccccctgatgaatgtggatgacctgtatggcaccctgtatgtgccccatgatggcaccatggaccctgctggcacctgcaccaccctggcccgggccgccagcgcccggggggcccaggtgattgagaactgccctgtgacaggcatccgggtgtggacagatgactttggagtgagaagagtggccggcgtggagacccagcacggcagcatccagaccccctgtgtggtgaactgtgccggcgtgtgggccagcgctgtgggccgcatggccggcgtgaaggtgcccctggtggccatgcaccacgcctacgtggtgacagagcgcatcgagggcatccagaacatgcccaacgtgcgggaccatgatgcctctgtgtacctgcggctgcagggagatgccctgtctgtgggcggctatgaggccaaccccatcttctgggaggaggccgtgaagtaccggcccagggctgctgggggcctgtgcctgaagaccagcacagagaaggtgtgtgctgtgtggagcgatgacctgcggcgggcctag

SEQ ID NO: 19843 - DNA, 1107 bp, Artificial Sequence
  Description of Artificial Sequence: Synthetic coding sequence
atgagctactttgggaagttctacctggtgggcctggatgccaggaaggctgctgactggctgttcagcgcagatgtgtccaggcctcctggcagcacagtgtacacctgcatgctgaaccacagaggaggaacagaaagtgacctgactgtgtcccggctggcccccagccaccaggccagccccctggccccagcctttgaaggagatggctactacctggccatgggcggcgctgtggcccagcacaactggagccacatcaccaccgtgctgcaggaccagaagagccagtgccagctgattgacagcagcgaggacctgggcatgatcagcatccagggccctgccagccgggccatcctgcaggaggtgctggatgctgacctgagcaatgaggccttccccttcagcacccacaagctgctgcgggccgccggccacctggtgcgggccatgaggctgagctttgtgggggagctgggctgggagctgcacatccccaaggccagctgtgtgcctgtgtacagagctgtgatggccgccggggccaagcacggcctcatcaatgccggctaccgggccatcgacagcctgagcattgagaagggctaccgccactggcacgccgacctgcggccagatgacagccccctggaggccggcctggccttcacctgcaagctgaagagccctgtgcccttcctgggccgggaggccctggagcagcagagagctgctggcctgcggcggcggctggtgtgcttcaccatggaggagcccctgtggacccggccccaccctgctgtgtctggggccccagccttcagcacagccagcagcagcaaggtgcccatgtttggcctggaggccatctggagaaatggccaggtggtgggccacgtgagaagagctgactttggatttgccatcgacaagaccatcgcctacggctacatccatgaccccagcggcggccctgtgtccctggactttgtgaagagcggggactatgccctggagaggatgggcgtgacctatggagcccaggcccacctgaagagcccctttgaccccaacaacaagagggtgaagggcatctactag

SEQ ID NO: 19844 - DNA, 2757 bp, Artificial Sequence
  Description of Artificial Sequence: Synthetic coding sequence
atggccagcctgagccgggccctgcgggtggccgccgcccacccccggcagagccccacccggggcatgggcccctgcaacctgagcagcgctgctggccccacagctgagaagtctgtgccctaccagaggaccctgaaggagggccagggcacctctgtggtggcccagggccccagccggcccctgcccagcacagccaacgtggtggtgattggaggcggcagcctgggctgccagaccctgtaccacctggccaagctgggcatgtctggagctgtgctgctggagcgggagcggctgaccagcggcaccacctggcacacagctggcctgctgtggcagctgcggcccagtgatgtggaggtggagctgctggcccacacccggcgggtggtgtcccgggagctggaggaggagaccggcctgcacacaggctggatccagaatggaggcctcttcatcgccagcaaccggcagaggctggatgagtacaagaggctgatgagcctgggcaaggcctatggagtggagagccacgtgctgagccctgctgagaccaagaccctgtaccccctgatgaatgtggatgacctgtatggcaccctgtatgtgccccatgatggcaccatggaccctgctggcacctgcaccaccctggcccgggccgccagcgcccggggggcccaggtgattgagaactgccctgtgacaggcatccgggtgtggacagatgactttggagtgcggcgggtggccggcgtggagacccagcacggcagcatccagaccccctgtgtggtgaactgtgccggcgtgtgggccagcgctgtgggccgcatggccggcgtgaaggtgcccctggtggccatgcaccacgcctacgtggtgacagaaagaattgagggcatccagaacatgcccaacgtgcgggaccatgatgcctctgtgtacctgcggctgcagggagatgccctgtctgtgggcggctatgaggccaaccccatcttctgggaggaggtgtctgacaagtttgccttcggcctgtttgacctggactgggaggtgttcacccagcacattgaaggagccatcaacagagtgcctgtgctggagaagacaggcatcaagagcacagtgtgtggccctgagagcttcaccccagaccacaagcccctgatgggagaggcccctgagctgcggggcttcttcctgggctgcggcttcaacagcgctggcatgatgctgggcggcggctgcggccaggagctggcccactggatcatccacggccggcctgagaaggacatgcacggctatgacatccgccgcttccaccacagcctgacagaccacccccgctggatccgggagaggagccatgagagctatgccaagaactacagcgtggtgttcccccatgatgagcccctggccggcaggaacatgaggcgggaccccctgcacgaggagctgctgggccagggctgtgtgttccaggagagacatggctgggagcggcccggctggttccacccccggggccctgcccctgtgctggagtatgactactatggagcctacggcagccgggcccacgaggactatgcctacagaaggctgctggctgatgagtacacctttgccttccccccccaccacgacaccatcaagaaggagtgcctggcctgcagaggagctgctgctgtgtttgacatgagctactttgggaagttctacctggtgggcctggatgccaggaaggctgctgactggctgttcagcgcagatgtgtccaggcctcctggcagcacagtgtacacctgcatgctgaaccacagaggaggaacagaaagtgacctgactgtgtcccggctggcccccagccaccaggccagccccctggccccagcctttgaaggagatggctactacctggccatgggcggcgctgtggcccagcacaactggagccacatcaccaccgtgctgcaggaccagaagagccagtgccagctgattgacagcagcgaggacctgggcatgatcagcatccagggccctgccagccgggccatcctgcaggaggtgctggatgctgacctgagcaatgaggccttccccttcagcacccacaagctgctgcgggccgccggccacctggtgcgggccatgaggctgagctttgtgggggagctgggctgggagctgcacatccccaaggccagctgtgtgcctgtgtacagagctgtgatggccgccggggccaagcacggcctcatcaatgccggctaccgggccatcgacagcctgagcattgagaagggctaccgccactggcacgccgacctgcggccagatgacagccccctggaggccggcctggccttcacctgcaagctgaagagccctgtgcccttcctgggccgggaggccctggagcagcagagagctgctggcctgcggcggcggctggtgtgcttcaccatggaggacaaggtgcccatgtttggcctggaggccatctggagaaatggccaggtggtgggccacgtgagaagagctgactttggatttgccatcgacaagaccatcgcctacggctacatccatgaccccagcggcggccctgtgtccctggactttgtgaagagcggggactatgccctggagaggatgggcgtgacctatggagcccaggcccacctgaagagcccctttgaccccaacaacaagagggtgaagggcatctactag

SEQ ID NO: 19845 - DNA, 720 bp, Artificial Sequence
  Description of Artificial Sequence: Synthetic coding sequence
atggagggcaccgtggagagccagaccccagacctgagagatgtggagggcaaggtgggcaggaagaccccagagggcctgctgcggggcctgcggggggagtgtgagctgggcaccagcggggccctgctgctgcccggggccagcagcactggacatgacctgggggacaagatcatggccctgaagatggagctggcctacctgcgggccattgatgtgaagatcctgcagcagctggtgaccctgaatgaaggaattgaagctgtgcgctggctgctggaggagcggggcaccctgaccagccactgcagcagcctgaccagcagccagtacagcctgactggaggcagccctggccgcagcagaagaggctcctgggacagcctgcctgacaccagcaccacagaccggctggacagcgtgtccatcggcagcttcctggacacagtggcccccagcgagctggatgagcagggccccccaggggcccccaggtctgagatggactgggccaaggtgattgctggaggagagcgggccaggacagaggtggatgtggccgccacccggctgggcagcctgcgggctgtgtggaagcccccaggagagcggctgcagggcggccccccagagagcccagaagatgagagcgccaagctgggctttgaggcccactggttctgggagcagtgccaggatgatgtgaccttcctgtag

SEQ ID NO: 19846 - DNA, 294 bp, Artificial Sequence
  Description of Artificial Sequence: Synthetic coding sequence
atgagcagtggaaatgccaagattggccacccagcccccaacttcaaggccacagcagatgagggcatctccttccggggcctcttcatcattgatgacaagggcatcctgcggcagatcaccgtgaatgacctgcctgtgggccgctctgtggatgagaccctgcggctggtgcaggccttccagttcacagacaagcatggagaggtgtgcccagctggctggaagccaggcagtgacaccatcaagccagatgtgcagaagagcaaggagtacttcagcaagcagaagtag

SEQ ID NO: 19847 - DNA, 1668 bp, Artificial Sequence
  Description of Artificial Sequence: Synthetic coding sequence
atggacaggagcaagaggaacagcattgctggcttccccccccgggtggagcggctggaggagtttgagggcggcggcggcggggagggcaatgtgtcccaggtgggccgggtgtggcccagcagctaccgggccctgatcagcgccttcagccggctgacccggctggatgacttcacctgtgagaagattggcagcggcttcttcagcgaggtgttcaaggtgcgccaccgggccagcggccaggtgatggccctgaagatgaacaccctgagcagcaacagagccaacatgctgaaggaggtgcagctgatgaaccggctgagccaccccaacatcctgcgctacatcaacagcggcaacctggagcagctgctggacagcaacctgcacctgccctggacagtgcgggtgaagctggcctatgacattgctgtgggcctgagctacctgcacttcaagggcatcttccaccgggacctgaccagcaagaactgcctgatcaagagagatgaaaatggctacagcgctgtggtggccgactttggcctggccgagaagatcccagatgtgtccatgggcagcgagaagctggccgtggtgggcagccccttctggatggcccctgaggtgctgagagatgagccctacaatgagaaggcagatgtgttctcctatggcatcatcctgtgtgagatcatcgcccgcatccaggccgaccctgactacctgcccaggacagagaactttggcctggactatgatgccttccagcacatggtgggggactgccccccagacttcctgcagctgaccttcaactgctgcaacatggaccccaagctgcggcccagctttgtggagatcggcaagaccctggaggagatcctgagccggctgcaggaggaggagcaggagcgggacaggaagctgcagcccacagcccggggcctgctggagaaggcccctggggtgaagaggctgagcagcctggatgacaagatcccccacaagagcccctgccccaggaggaccatctggctgagccgcagccagagcgacatcttcagcaggaagccacccaggacagtgtctgtgctggacccctactaccggcccagagatggagctgcccggacccccaaggtgaaccccttcagcgcccggcaggacctgatgggcggcaagatcaagttctttgacctgcccagcaagagcgtcatcagcctggtgtttgacctggatgcccctggccctggcaccatgcccctggccgactggcaggagcccctggccccacccatccgccgctggaggagcctgcccggcagccctgagttcctgcaccaggaggcctgcccctttgtgggccgggaggagagcctgagtgatggccccccaccccggctgagcagcctgaagtacagagtgaaggagatcccccccttccgggccagcgccctgcctgctgcccaggcccacgaggccatggactgcagcatcctgcaggaggagaatggcttcggcagccggccccagggcaccagcccctgcccagctggggccagcgaggagatggaggtggaggagaggcctgctggcagcaccccagccaccttcagcaccagcggcatcggcctgcagacccagggcaagcaggacggctag

SEQ ID NO: 19848 - DNA, 1629 bp, Artificial Sequence; identical to SEQ ID NO: 19274
  Description of Artificial Sequence: Synthetic coding sequence

SEQ ID NO: 19849 - DNA, 1716 bp, Artificial Sequence
  Description of Artificial Sequence: Synthetic coding sequence
atggacaggagcaagaggaacagcattgctggcttccccccccgggtggagcggctggaggagtttgagggcggcggcggcggggagggcaatgtgtcccaggtgggccgggtgtggcccagcagctaccgggccctgatcagcgccttcagccggctgacccggctggatgacttcacctgtgagaagattggcagcggcttcttcagcgaggtgttcaaggtgcgccaccgggccagcggccaggtgatggccctgaagatgaacaccctgagcagcaacagagccaacatgctgaaggaggtgcagctgatgaaccggctgagccaccccaacatcctgcgcttcatgggcgtgtgtgtgcaccagggccagctgcacgccctgacagagtacatcaacagcggcaacctggagcagctgctggacagcaacctgcacctgccctggacagtgcgggtgaagctggcctatgacattgctgtgggcctgagctacctgcacttcaagggcatcttccaccgggacctgaccagcaagaactgcctgatcaagagagatgaaaatggctacagcgctgtggtggccgactttggcctggccgagaagatcccagatgtgtccatgggcagcgagaagctggccgtggtgggcagccccttctggatggcccctgaggtgctgagagatgagccctacaatgagaaggcagatgtgttctcctatggcatcatcctgtgtgagatcatcgcccgcatccaggccgaccctgactacctgcccaggacagagaactttggcctggactatgatgccttccagcacatggtgggggactgccccccagacttcctgcagctgaccttcaactgctgcaacatggaccccaagctgcggcccagctttgtggagatcggcaagaccctggaggagatcctgagccggctgcaggaggaggagcaggagcgggacaggaagctgcagcccacagcccggggcctgctggagaaggcccctggggtgaagaggctgagcagcctggatgacaagatcccccacaagagcccctgccccaggaggaccatctggctgagccgcagccagagcgacatcttcagcaggaagccacccaggacagtgtctgtgctggacccctactaccggcccagagatggagctgcccggacccccaaggtgaaccccttcagcgcccggcaggacctgatgggcggcaagatcaagttctttgacctgcccagcaagagcgtcatcagcctggtgtttgacctggatgcccctggccctggcaccatgcccctggccgactggcaggagcccctggccccacccatccgccgctggaggagcctgcccggcagccctgagttcctgcaccaggaggcctgcccctttgtgggccgggaggagagcctgagtgatggccccccaccccggctgagcagcctgaagtacagagtgaaggagatcccccccttccgggccagcgccctgcctgctgcccaggcccacgaggccatggactgcagcatcctgcaggaggagaatggcttcggcagccggccccagggcaccagcccctgcccagctggggccagcgaggagatggaggtggaggagaggcctgctggcagcaccccagccaccttcagcaccagcggcatcggcctgcagacccagggcaagcaggacggctag

SEQ ID NO: 19850 - DNA, 1416 bp, Artificial Sequence
  Description of Artificial Sequence: Synthetic coding sequence
atgctgggctcctggggctgctaccgctatgccaagctgttcagctgcagcctgagcacccacgcccgcttcatcaagatcctggacagcgtgctgcaccacctggtgcctgcctgggaccacaccctgggcaccttcagcgagatcaagcaggtgaagcagttcctgctgctgagccggcagaggcctggcctggtggcccagtgcctgcgggacagcgagagcagcaagcccagcttcatgccccggctgtacatcaacagaaggctggccatggagcaccgggcctgccccagccgggaccctgcctgcaagaatgctgtgttcacccaggtgtatgagggcctgaagcccagcgacaagtatgagaagcccctggactaccgctggcccatgagatatgaccagtggtgggagtgcaagttcatcgccgagggcatcatcgaccagggcggcggcttccgggacagcctggccgacatgtctgaggagctgtgccccagcagcgctgacacccctgtgcccctgcccttctttgtgaggacagccaaccagggcaatggaactggagaggcccgggacatgtatgtgcccaaccccagctgccgggactttgccaagtatgagtggattggccagctgatgggcgccgccctgcggggcaaggagttcctggtgctggccctgcccggctttgtgtggaagcagctgagcggggaggaggtgtcctggagcaaggacttccctgctgtggacagcgtgctggtgaagctgctggaggtgatggagggcatggacaaggagacctttgagttcaagtttgggaaggagctgaccttcaccaccgtgctgagtgaccagcaggtggtggagctgatccctgggggcgccggcatcgtggtgggctatggagacaggagccgcttcatccagctggtgcagaaggcccggctggaggagagcaaggagcaggtggccgccatgcaggccggcctgctgaaggtggtgccccaggccgtgctggacctgctgacctggcaggagctggagaagaaggtgtgtggggaccctgaggtgacagtggatgccctgaggaagctgaccaggtttgaagattttgagcccagcgacagccgggtgcagtacttctgggaggccctgaacaacttcaccaatgaagatagaagccgcttcctgcgctttgtgacaggccgcagccggctgcctgcccgcatctacatctacccagacaagctgggctatgagaccacagatgccctgcctgagagcagcacctgcagcagcaccctcttcctgccccactacgccagcgccaaggtgtgtgaggagaagctgcgctatgctgcctacaactgtgtggccatcgacacagacatgagcccctgggaggagtag

SEQ ID NO: 19851 - DNA, 825 bp, Artificial Sequence
  Description of Artificial Sequence: Synthetic coding sequence
atggccgcccctgaggccgaggtgctgagcagcgctgctgtgcctgacctggagtggtatgagaagtctgaggagacccacgccagccagatcgagctgctggagaccagcagcacccaggagcccctgaatgccagcgaggccttctgcccccgggactgcatggtgcctgtggtgtttcctggccctgtgtcccaggagggctgctgccagttcacctgtgagctgctgaagcacatcatgtaccagaggcagcagctgcccctgccctatgagcagctgaagcacttctacaggaagcccagcccccaggccgaggagatgctgaagaagaagccccgggccaccacagaggtgagcagcaggaagtgccagcaggccctggccgagctggagagcgtgctgagccacctggaggacttctttgcccggaccctggtgccccgggtgctgatcctgctgggcggcaatgccctgagccccaaggagttctatgagctggacctgagcctgctggccccctacagcgtggaccagagcctgagcacagctgcctgcctgcggcggctcttccgggccatcttcatggctgatgccttcagcgagctgcaggccccacccctgatgggcaccgtggtgatggcccagggccacaggaactgtggggaggactggttccggcccaagctgaactacagagtgcccagccggggccacaagctgactgtgaccctgagctgtggccggcccagcatccgcaccacagcctgggaggactacatctggttccaggcccctgtgaccttcaagggcttccgggagtag

SEQ ID NO: 19852 - DNA, 2586 bp, Artificial Sequence
  Description of Artificial Sequence: Synthetic coding sequence
atggccggccctggccctggagctgtgctggagagcccccggcagctgctgggccgggtgcgcttcctggccgaggccgcccggagcctgcgggccggccggcccctgcctgctgccctggcctttgtgccccgggaggtgctgtacaagctgtacaaggaccctgctggccccagccgggtgctgctgcctgtgtgggaggccgagggcctgggcctgcgggtgggcgccgccggccctgcccctggcaccggcagcggccccctgcgggccgcccgggacagcattgagctgcggcggggggcctgtgtgaggaccactggagaggagctgtgcaatggacatggcctgtgggtgaagctgaccaaggagcagctggccgagcacctgggggactgtggcctgcaggagggctggctgctggtgtgcaggcctgctgagggcggggcccggctggtgcccatcgacacccccaaccacctgcagaggcagcagcagctgtttggagtggactacagacctgtgctgcgctgggagcaggtggtggacctgacctacagccaccggctgggcagccggccccagcctgctgaggcctatgcagaggccgtgcagaggctgctgtatgtgccccccacctggacctatgaatgtgatgaggacctgatccacttcctgtatgaccacctgggcaaggaggatgagaacctgggctctgtgaagcagtatgtggagagcattgatgtgtcctcctacacagaggagttcaacgtgtcctgcctgacagacagcaatgctgacacctactgggagagtgatggcagccagtgccagcactgggtgcggctgaccatgaagaagggcaccatcgtgaagaagctgctgctgactgtggacaccacagatgacaacttcatgcccaagagggtggtggtgtatggaggagagggggacaacctgaagaagctgagtgatgtgtccattgatgagaccctgattggagatgtgtgtgtgctggaggacatgacagtgcacctgcccatcatcgagatcagaattgtggagtgcagagatgatggcattgatgtgcggctgcggggcgtgaagatcaagagcagccggcagcgggagctgggcctgaatgctgacctcttccagcccaccagcctggtgcgctacccccggctggagggcacagatcctgaggtgctgtaccgccgggctgtgctgctgcagcgcttcatcaagatcctggacagcgtgctgcaccacctggtgcctgcctgggaccacaccctgggcaccttcagcgagatcaagcaggtgaagcagttcctgctgctgagccggcagaggcctggcctggtggcccagtgcctgcgggacagcgagagcagcaagcccagcttcatgccccggctgtacatcaacagaaggctggccatggagcaccgggcctgccccagccgggaccctgcctgcaagaatgctgtgttcacccaggtgtatgagggcctgaagcccagcgacaagtatgagaagcccctggactaccgctggcccatgagatatgaccagtggtgggagtgcaagttcatcgccgagggcatcatcgaccagggcggcggcttccgggacagcctggccgacatgtctgaggagctgtgccccagcagcgctgacacccctgtgcccctgcccttctttgtgaggacagccaaccagggcaatggaactggagaggcccgggacatgtatgtgcccaaccccagctgccgggactttgccaagtatgagtggattggccagctgatgggcgccgccctgcggggcaaggagttcctggtgctggccctgcccggctttgtgtggaagcagctgagcggggaggaggtgtcctggagcaaggacttccctgctgtggacagcgtgctggtgaagctgctggaggtgatggagggcatggacaaggagacctttgagttcaagtttgggaaggagctgaccttcaccaccgtgctgagtgaccagcaggtggtggagctgatccctgggggcgccggcatcgtggtgggctatggagacaggagccgcttcatccagctggtgcagaaggcccggctggaggagagcaaggagcaggtggccgccatgcaggccggcctgctgaaggtggtgccccaggccgtgctggacctgctgacctggcaggagctggagaagaaggtgtgtggggaccctgaggtgacagtggatgccctgaggaagctgaccaggtttgaagattttgagcccagcgacagccgggtgcagtacttctgggaggccctgaacaacttcaccaatgaagatagaagccgcttcctgcgctttgtgacaggccgcagccggctgcctgcccgcatctacatctacccagacaagctgggctatgagaccacagatgccctgcctgagagcagcacctgcagcagcaccctcttcctgccccactacgccagcgccaaggtgtgtgaggagaagctgcgctatgctgcctacaactgtgtggccatcgacacagacatgagcccctgggaggagtag

SEQ ID NO: 19853 - DNA, 1197 bp, Artificial Sequence
  Description of Artificial Sequence: Synthetic coding sequence
atggagagcgtgctgagcaaatatgaggaccagatcaccatcttcacagactacctggaggagtacccagacacagatgagctggtgtggatcctgggcaagcagcacctgctgaagacagagaagagcaagctgctgagtgacatcagcgcccggctgtggttcacctacagaaggaagttcagccccatcggcggcaccggccccagcagtgatgctggctggggctgcatgctgcgctgtggccagatgatgctggcccaggccctgatctgccgccacctgggccgggactggagctgggagaagcagaaggagcagcccaaggagtaccagaggatcctgcagtgcttcctggacaggaaggactgctgctacagcatccaccagatggcccagatgggcgtgggggagggcaagagcatcggggagtggtttggccccaacacagtggcccaggtgctgaagaagctggccctgtttgatgagtggaacagcctggccgtgtatgtgtccatggacaacacagtggtgattgaggacatcaagaagatgtgccgggtgctgcccctgtctgctgacacagctggggaccggcccccagacagcctgacagccagcaaccagagcaagggcaccagcgcctactgcagcgcctggaagcccctgctgctgattgtgcccctgcggctgggcatcaaccagatcaaccctgtgtatgtggatgccttcaaggagtgcttcaagatgccccagagcctgggcgccctgggcggcaagcccaacaatgcctactacttcatcggcttcctgggagatgagctgatcttcctggacccccacaccacccagacctttgtggacacagaagaaaatggcaccgtgaatgaccagaccttccactgcctgcagagcccccagaggatgaacatcctgaacctggaccccagcgtggccctgggcttcttctgcaaggaggagaaggactttgacaactggtgcagcctggtgcagaaggagatcctgaaggagaacctgaggatgtttgagctggtgcagaagcaccccagccactggcccccatttgtgcccccagccaagccagaggtgaccaccactggagctgagttcatcgacagcacagagcagctggaggagtttgacctggaggaggactttgagatcctgtctgtgtag

SEQ ID NO: 19854 - DNA, 1701 bp, Artificial Sequence; identical to SEQ ID NO: 19423
  Description of Artificial Sequence: Synthetic coding sequence

SEQ ID NO: 19855 - DNA, 930 bp, Artificial Sequence
  Description of Artificial Sequence: Synthetic coding sequence
atgccccgggcccggagcggccgccgcagcagaggagctgggggccgggaggagaccttcctgcgggtgcgggccaaccggcagacccggctgaatgccagaattggcaagatgaagaggaggaagcaggatgagggccaggtgtgccccctgtgcaaccggcccctggccggcagcgagcaggagatgagccgccacgtggagcactgcctgagcaagcgggagggcagctgcatggctgaagatgatgctgtggacattgaacatgagaacaacaacagatttgaggagtatgagtggtgtggccagaagaggatccgggccaccaccctgctggagggcggcttccggggcagcggcttcatcatgtgcagcggcaaggagaacccagacagtgatgctgacctggatgtggatggagatgacaccctggagtatggcaagccccagtacacagaagcagatgtgatcccctgcaccggggaggagcccggggaggccaaggagcgggaggccctgcggggagctgtgctgaatggaggcccccccagcacccgcatcaccccagagttcagcaagtgggccagtgatgctgagatgcccagcaccagcaatggagagagcagcaagcaggaggccatgcagaagacctgcaagaacagcgacatcgagaagatcacagaggacagcgctgtgaccacctttgaggccctgaaggcccgggtgcgggagctggagcggcagctgagcagaggagaccgctacaagtgcctgatctgcatggacagctacagcatgcccctgaccagcatccagtgctggcacgtgcactgtgaggagtgctggctgcggaccctgggcgccaagaagctgtgcccccagtgcaacaccatcacagcccctggggacctgcggcgcatctacctgtag

SEQ ID NO: 19856 - DNA, 1125 bp, Artificial Sequence
  Description of Artificial Sequence: Synthetic coding sequence
atggagagcgtgctgagcaaatatgaggaccagatcaccatcttcacagactacctggaggagtacccagacacagatgagctggtgtggatcctgggcaagcagcacctgctgaagacaggaggcaccggccccagcagtgatgctggctggggctgcatgctgcgctgtggccagatgatgctggcccaggccctgatctgccgccacctgggccgggactggagctgggagaagcagaaggagcagcccaaggagtaccagaggatcctgcagtgcttcctggacaggaaggactgctgctacagcatccaccagatggcccagatgggcgtgggggagggcaagagcatcggggagtggtttggccccaacacagtggcccaggtgctgaagaagctggccctgtttgatgagtggaacagcctggccgtgtatgtgtccatggacaacacagtggtgattgaggacatcaagaagatgtgccgggtgctgcccctgtctgctgacacagctggggaccggcccccagacagcctgacagccagcaaccagagcaagggcaccagcgcctactgcagcgcctggaagcccctgctgctgattgtgcccctgcggctgggcatcaaccagatcaaccctgtgtatgtggatgccttcaaggagtgcttcaagatgccccagagcctgggcgccctgggcggcaagcccaacaatgcctactacttcatcggcttcctgggagatgagctgatcttcctggacccccacaccacccagacctttgtggacacagaagaaaatggcaccgtgaatgaccagaccttccactgcctgcagagcccccagaggatgaacatcctgaacctggaccccagcgtggccctgggcttcttctgcaaggaggagaaggactttgacaactggtgcagcctggtgcagaaggagatcctgaaggagaacctgaggatgtttgagctggtgcagaagcaccccagccactggcccccatttgtgcccccagccaagccagaggtgaccaccactggagctgagttcatcgacagcacagagcagctggaggagtttgacctggaggaggactttgagatcctgtctgtgtag

SEQ ID NO: 19857 - DNA, 558 bp, Artificial Sequence
  Description of Artificial Sequence: Synthetic coding sequence
atggagggctgtgtgagcaacctgatggtgtgcaacctggcctacagcggcaagctggaggagctgaaggagagcatcctggccgacaagagcctggccaccaggacagaccaggacagcaggacagccctgcactgggcctgcagcgctggccacacagaaattgtggagttcctgctgcagctgggcgtgcctgtgaatgacaaggatgatgctgccagcaagaacagacatgaaattgctgtgatgctgctggagggcggggccaacccagatgccaaggaccactatgaggccacagccatgcacagagctgctgccaagggcaacctgaagatgatccacatcctgctgtactacaaggccagcaccaacatccaggacacagagggcaacacccccctgcacctggcctgtgatgaggagcgggtggaggaggccaagctgctggtgtcccagggcgccagcatctacatcgagaacaaggaggagaagacccccctgcaggtggccaagggcggcctgggcctcatcctgaagaggatggtggagggctag

SEQ ID NO: 19858 - DNA, 333 bp, Artificial Sequence
  Description of Artificial Sequence: Synthetic coding sequence
atggagggctgtgtgagcaacctgatggtgtgcaacctggcctacagcggcaagctggaggagctgaaggagagcatcctggccgacaagagcctggccaccaggacagaccaggacagcaggacagccctgcactgggcctgcagcgctggccacacagaaattgtggagttcctgctgcagctgggcgtgcctgtgaatgacaaggatgatgctgccagcaagaacagacatgaaattgctgtgatgctgctggagggcggggccaacccagatgccaaggaccactatgaggccacagccatgcacagagctgctgccaaggacacctag

SEQ ID NO: 19859 - DNA, 546 bp, Artificial Sequence
  Description of Artificial Sequence: Synthetic coding sequence
atggtgctgggcgccggctggggctgggcctaccagctgcacctgctgcaggccctgaagaggaagccagacctcttcctgtgtgagcggctggatgtgaaggctgtgttccagtgtgctgtgctggccctgaagtttcctgaggcccccaccgtgaaggccagctgtggcttcttcacagagctgctgccccgctgtggggaggtggagagcgtgggcaaggtggtgcaggaggatggccgcatgctgctgattgctgtgctggaggccatcggcggccaggccagccgcagcctgatggactgctttgctgacatcctgtttgccctgaacaagcactgcttcagcctgctgtccatgtggatcaaggaggccctgcagcccccaggcttccccagcgcccggctgagccctgagcagaaggacaccttcagccagcagatcctgcgggagcgggtgaacaagagaagagtgaaggagatggtgaaggagttcaccctgctgtgccggggcctgcatggaacagactacacagctgactactag

SEQ ID NO: 19860 - DNA, 2892 bp, Artificial Sequence
  Description of Artificial Sequence: Synthetic coding sequence
atggagcggcgggaggagcagcccggggctgctggagctggagctgccccagccctggacttcaccgtggagaatgtggagaaggccctgcaccagctgtactatgaccccaacatcgagaacaagaacctggcccagaagtggctgatgcaggcccaggtgagcccccaggcctggcacttctcctggcagctgctgcagcctgacaaggtgcctgagatccagtactttggagccagcgccctgcacatcaagatcagccgctactggagcgacatccccacagaccagtatgagagcctgaaggcccagctgttcacccagatcaccaggtttgccagcggcagcaagatcgtgctgacccggctgtgtgtggccctggccagcctggccctgtccatgatgccagatgcctggccctgtgctgtggccgacatggtgcggctcttccaggccgaggacagccctgtggatggccagggccgctgcctggccctgctggagctgctgactgtgctgcctgaggagttccagaccagccggctgccccagtacaggaagggcctggtgaggaccagcctggccgtggagtgtggggctgtgttccccctgctggagcagctgctgcagcagcccagcagccccagctgtgtgcggcagaaggtgctgaagtgcttcagctcctgggtgcagctggaggtgcccctgcaggactgtgaggccctgatccaggccgcctttgctgccctgcaggacagcgagctgtttgacagctctgtggaggccatcgtgaatgccatcagccagccagatgcccagagatatgtgaacaccctgctgaagctgatccccctggtgctgggcctgcaggagcagctgcggcaggccgtgcagaatggagacatggagaccagccacggcatctgcagaattgctgtggccctgggggagaaccacagccgggccctgctggaccaggtggagcactggcagagcttcctggccctggtgaacatgatcatgttctgcaccggcatccctggccactaccctgtgaatgagaccaccagcagcctgaccctgaccttctggtacaccctgcaggatgacatcctgagctttgaggccgagaagcaggccgtgtaccagcaggtgtacagacctgtgtacttccagctggtggatgtgctgctgcacaaggcccagttccccagtgatgaggagtatggcttctggagcagtgatgagaaggagcagttccgcatctacagagtggacatcagtgacaccctgatgtatgtgtatgagatgctgggcgctgagctgctgagcaacctgtatgacaagctgggccgcctgctgaccagcagcgaggagccctacagctggcagcacacagaggccctgctgtatggcttccagagcattgctgagaccattgatgtgaactacagtgatgtggtgcccggcctcatcggcctcatcccccgcatcagcatcagcaatgtgcagctggccgacacagtgatgttcaccatcggggccctgtctgagtggctggccgaccaccctgtgatgatcaacagcgtgctgcccctggtgctgcacgccctgggcaaccctgagctgtctgtgtcctctgtgtccaccctgaagaagatctgccgggagtgcaagtatgacctgcccccctatgctgccaacatcgtggccgtgtcccaggatgtgctgatgaagcagatccacaagaccagccagtgcatgtggctgatgcaggccctgggcttcctgctgagcgccctgcaggtggaggagatcctgaagaacctgcacagcctcatcagcccctacatccagcagctggagaagctggccgaggagatccccaaccccagcaacaagctggccatcgtgcacatcctgggcctgctgagcaacctcttcaccaccctggacatcagccaccatgaagatgaccacgagggccctgagctgaggaagctgcctgtgccccagggccccaaccctgtggtggtggtgctgcagcaggtgttccagctgatccagaaggtgctgagcaagtggctgaatgatgcccaggtggtggaggccgtgtgtgccatctttgagaagtctgtgaagaccctgctggatgactttgcccccatggtgccccagctgtgtgagatgctgggccgcatgtacagcaccatcccccaggccagcgccctggacctgacccggcagctggtgcacatctttgcccacgagcccgcccacttcccccccatcgaggccctcttcctgctggtgacctctgtgaccctgaccctcttccagcagggcccccgggaccacccagacatcgtggacagcttcatgcagctgctggcccaggccctgaagaggaagccagacctcttcctgtgtgagcggctggatgtgaaggctgtgttccagtgtgctgtgctggccctgaagtttcctgaggcccccaccgtgaaggccagctgtggcttcttcacagagctgctgccccgctgtggggaggtggagagcgtgggcaaggtggtgcaggaggatggccgcatgctgctgattgctgtgctggaggccatcggcggccaggccagccgcagcctgatggactgctttgctgacatcctgtttgccctgaacaagcactgcttcagcctgctgtccatgtggatcaaggaggccctgcagcccccaggcttccccagcgcccggctgagccctgagcagaaggacaccttcagccagcagatcctgcgggagcgggtgaacaagagaagagtgaaggagatggtgaaggagttcaccctgctgtgccggggcctgcatggaacagactacacagctgactactag

SEQ ID NO: 19861 - DNA, 2907 bp, Artificial Sequence
  Description of Artificial Sequence: Synthetic coding sequence
atgaggctgctgcggcacacagaaagtgagcagtggttccaccgcttccccctgtgccccagcctgaccttctgggcccctgtggccatgtggccccagacccactgtgtgggcggccgcagcagcggcctgaccaagtggacctacagcttcagcgccagcctgcaggacggcagcttcccctatgacagcgtgccctggcagcagaacaccaaccagcccccaggcagcctgtctgtggtgaccaccgtgtggggcgtgaccaacaccagccagagccaggctgatgtgctgatcccccacgccacctgccggcccggccccctgctgatcacagcctgggagccctacggccagtgccagcagccccatgagagccggcggcagccccatggagtgggccatgaccaccagcagccccggccccagctgcccaccgtgtgtggggctgctgctgctgtgctgagccagggctggcccaggtctgccctgcaccctgctgagcacgtgtggccagcccagctgccccggcagaggggcctgtggggccagcctgctgctgctgctgctgctgctgctgtggccgctgctgctgccacagccacagccacagccacagccaccgtggccgccctgcaggagacccagaacaaggacatcaaccagtatggccctgcccctgtgctgctgcctgacctgctgaaggatggcctgggagatgaggagcggggggcccccatcggcatgcagaacagcatgaacccagcctccatggccgccggcatgaccccatctggcatgagcggcccccccatgggcatgaaccagcccaggcctcctggcatcagccccttcggcacccacggccagaggatgccccagcagacctacccaggcccccggccccagagcctgcccatccagaacatcaagaggccctacccaggagagcccaactacggcaaccagcagtatggccccaacagccagttccccacccagcccggccagtacccagcccccaaccccccccggcccctgaccagccccaactacccaggccagaggatgcccagccagcccagcagcggccagtaccccccacccaccgtgaacatgggccagtactacaagccagagcagttcaacggccagaacaacaccttcagcggcagcagctacagcaactacagccagggcaatgtgaacagaccacccaggcctgtgcctgtggccaactacccccacagccctgtgcccggcaaccccaccccacccatgaccccaggcagcagcatccccccctacctgagccccagccaggatgtgaagccacccttccccccagacatcaagcccaacatgtctgccctgcccccacctccagaccacaatgatgagctgcggctgaccttccctgtgagagatggagtggtgctggagcccttccggctggagcacaacctggccgtgagcaaccacgtgttccacctgcggcccaccgtgcaccagaccctgatgtggagcgacctggagctgcagttcaagtgctaccaccatgaagatcggcagatgaacaccaactggccagcctctgtgcaggtgtctgtgaatgccacccccctgaccatcgagcggggggacaacaagaccagccacaagcccctgcacctgaagcacgtgtgccagcccggcaggaacaccatccagatcaccgtgacagcctgctgctgcagccacctgtttgtgctgcagctggtgcaccggcccagcgtgcgctctgtgctgcagggcctgctgaagaagaggctgctgcctgctgagcactgcatcaccaagaagaggaacttcagctctgtggccgccagcagcggcaacaccaccctgaatggagaagatggagtggagcagacagccatcaaggtgtccctgaagtgccccatcaccttccgccgcatccagctgcctgcccggggccatgactgcaagcacgtgcagtgctttgacctggagagctacctgcagctgaactgtgagcggggcacctggcgctgccctgtgtgcaagacagccctgctggagggcctggaggtggaccagtacatgtggggcatcctgaatgccatccacagcgagtttgaggaggtgaccatcgaccccacctgctcctggaggcctgtgcccatcaagagtgacctgcacatcaaggatgatcctgatggcatccccagcaagcgcttcaagaccatgagccccagccagatgatcatgcccaacgtgatggagatgattgctgccctgggccctggccccagcccctaccccctgcccccacctcctgggggcaccaacagcaatgactacagcagccagaacaactaccagggccacggcaactttgacttcccccacggcaaccctgggggcacctccatgaatgacttcatgcacggccccccccagctgagccaccccccagacatgcccaacaacatggccgccctggagaagcccctgagccaccccatgcaggagaccatgcctcatgctggcagcagtgaccagccccaccccagcatccagcagggcctgcacgtgccccaccccagcagccagagcggcccccccctgcaccacagcggggcccctcctcctccacccagccagcccccccggcagcccccccaggccgcccccagcagccacccccacagcgacctgaccttcaaccccagcagcgccctggagggccaggccggggcccagggcgccagtgacatgcctgagcccagcctggacctgctgcctgagctgaccaacccagatgagctgctgagctacctggaccccccagacctgcccagcaacagcaatgatgacctgctgagcctgtttgagaacaactag

SEQ ID NO: 19862 - DNA, 603 bp, Artificial Sequence
  Description of Artificial Sequence: Synthetic coding sequence
atggccatggagatgaggctgcctgtggccaggaagcccctgtctgagcggctgggccgggacaccaagaagcacctggtggtgcctggggacaccatcaccacagacaccggcttcatgaggggccacggcacctacatgggagaggagaagctgattgcctctgtggccggctctgtggagcgggtgaacaagctgatctgtgtgaaggccctgaagacccgctacatcggggaggtgggggacatcgtggtgggccgcatcacagaggtgcagcagaagcgctggaaggtggagaccaacagccggctggacagcgtgctgctgctgagctccatgaacctgcccggcggggagctgcggcggcgctctgcagaagatgagctggccatgaggggcttcctgcaggagggggacctgatctctgctgaggtgcaggccgtgttcagtgatggagctgtgtccctgcacaccaggagcctgaagtatggcaagacccacttccatgacctgccctgtggggccagcgtcatcctgggcaacaacggcttcatctggatctaccccaccccagagcacaaggaggaggaggccggcggctag

SEQ ID NO: 19863 - DNA, 792 bp, Artificial Sequence
  Description of Artificial Sequence: Synthetic coding sequence
atggccatggagatgaggctgcctgtggccaggaagcccctgtctgagcggctgggccgggacaccaagaagcacctggtggtgcctggggacaccatcaccacagacaccggcttcatgaggggccacggcacctacatgggagaggagaagctgattgcctctgtggccggctctgtggagcgggtgaacaagctgatctgtgtgaaggccctgaagacccgctacatcggggaggtgggggacatcgtggtgggccgcatcacagaaagaagaagatctgcagaagatgagctggccatgaggggcttcctgcaggagggggacctgatctctgctgaggtgcaggccgtgttcagtgatggagctgtgtccctgcacaccaggagcctgaagtatggcaagctgggccagggcgtgctggtgcaggtgagccccagcctggtgaagaggcagaagacccacttccatgacctgccctgtggggccagcgtcatcctgggcaacaacggcttcatctggatctaccccaccccagagcacaaggaggaggaggccggcggcttcatcgccaacctggagcctgtgtccctggccgaccgggaggtgatcagccggctgaggaactgcatcatcagcctggtgacccagaggatgatgctgtatgacaccagcatcctgtactgctatgaggccagcctgccccaccagatcaaggacatcctgaagccagagatcatggaggagatcgtgatggagacccggcagaggctgctggagcaggagggctag

SEQ ID NO: 19864 - DNA, 858 bp, Artificial Sequence
  Description of Artificial Sequence: Synthetic coding sequence
atggccatggagatgaggctgcctgtggccaggaagcccctgtctgagcggctgggccgggacaccaagaagcacctggtggtgcctggggacaccatcaccacagacaccggcttcatgaggggccacggcacctacatgggagaggagaagctgattgcctctgtggccggctctgtggagcgggtgaacaagctgatctgtgtgaaggccctgaagacccgctacatcggggaggtgggggacatcgtggtgggccgcatcacagaggtgcagcagaagcgctggaaggtggagaccaacagccggctggacagcgtgctgctgctgagctccatgaacctgcccggcggggagctgcggcggcgctctgcagaagatgagctggccatgaggggcttcctgcaggagggggacctgatctctgctgaggtgcaggccgtgttcagtgatggagctgtgtccctgcacaccaggagcctgaagtatggcaaggtgagccccagcctggtgaagaggcagaagacccacttccatgacctgccctgtggggccagcgtcatcctgggcaacaacggcttcatctggatctaccccaccccagagcacaaggaggaggaggccggcggcttcatcgccaacctggagcctgtgtccctggccgaccgggaggtgatcagccggctgaggaactgcatcatcagcctggtgacccagaggatgatgctgtatgacaccagcatcctgtactgctatgaggccagcctgccccaccagatcaaggacatcctgaagccagagatcatggaggagatcgtgatggagacccggcagaggctgctggagcaggagggctag

SEQ ID NO: 19865 - DNA, 882 bp, Artificial Sequence
  Description of Artificial Sequence: Synthetic coding sequence
atggccatggagatgaggctgcctgtggccaggaagcccctgtctgagcggctgggccgggacaccaagaagcacctggtggtgcctggggacaccatcaccacagacaccggcttcatgaggggccacggcacctacatgggagaggagaagctgattgcctctgtggccggctctgtggagcgggtgaacaagctgatctgtgtgaaggccctgaagacccgctacatcggggaggtgggggacatcgtggtgggccgcatcacagaggtgcagcagaagcgctggaaggtggagaccaacagccggctggacagcgtgctgctgctgagctccatgaacctgcccggcggggagctgcggcggcgctctgcagaagatgagctggccatgaggggcttcctgcaggagggggacctgatctctgctgaggtgcaggccgtgttcagtgatggagctgtgtccctgcacaccaggagcctgaagtatggcaagctgggccagggcgtgctggtgcaggtgagccccagcctggtgaagaggcagaagacccacttccatgacctgccctgtggggccagcgtcatcctgggcaacaacggcttcatctggatctaccccaccccagagcacaaggaggaggaggccggcggcttcatcgccaacctggagcctgtgtccctggccgaccgggaggtgatcagccggctgaggaactgcatcatcagcctggtgacccagaggatgatgctgtatgacaccagcatcctgtactgctatgaggccagcctgccccaccagatcaaggacatcctgaagccagagatcatggaggagatcgtgatggagacccggcagaggctgctggagcaggagggctag

SEQ ID NO: 19866 - DNA, 3195 bp, Artificial Sequence
  Description of Artificial Sequence: Synthetic coding sequence
atggccagcgagagcgagaccctgaaccccagcgcccgcatcatgaccttctaccccaccatggaggagttcaggaacttcagccgctacatcgcctacatcgagagccagggcgcccaccgggccggcctggccaaggtggtgccccccaaggagtggaagccccgggccagctatgatgacattgatgacctggtgatcccagcccccatccagcagctggtgacaggccagagcggcctcttcacccagtacaacatccagaagaaggccatgacagtgcgggagttcaggaagatcgccaacagcgacaagtactgcaccccccgctacagcgagtttgaggagctggagaggaagtactggaagaacctgaccttcaacccccccatctacggggctgatgtgaatggcaccctgtatgagaagcacgtggatgagtggaacatcggccgcctgcggaccatcctggacctggtggagaaggagagcggcatcaccatcgagggcgtgaacaccccctacctgtacttcggcatgtggaagaccagctttgcctggcacacagaggacatggacctgtacagcatcaactacctgcactttggagagcccaagtcctggtacagcgtgcccccagagcacggcaagaggctggagcggctggccaagggcttcttccctggcagcgcccagagctgtgaggccttcctgcggcacaagatgaccctcatcagccccctgatgctgaagaagtatggcatcccctttgacaaggtgacccaggaggccggggagttcatgatcaccttcccctacggctaccacgccggcttcaaccacggcttcaactgtgccgagagcaccaactttgccacccggcgctggattgaatatggcaagcaggccgtgctgtgcagctgcaggaaggacatggtgaagatctccatggatgtgtttgtgaggaagttccagcctgagcgctacaagctgtggaaggccggcaaggacaacacagtgattgaccacaccctgcccaccccagaggccgctgagttcctgaaggagagcgagctgccccccagggctggaaatgaggaggagtgcccagaggaggacatggagggcgtggaggatggagaggagggggacctgaagaccagcctggccaagcaccgcatcggcaccaagaggcaccgggtgtgcctggagatcccccaggaggtgtcccagagcgagctgttccccaaggaggacctgagcagcgagcagtatgagatgacagaatgtcctgctgccctggcccctgtgcggcccacccacagctctgtgcggcaggtggaggatggcctgaccttcccagactacagcgacagcacagaggtgaagtttgaggagctgaagaatgtgaagctggaggaggaggatgaggaggaggagcaggccgccgccgccctggacctgtctgtgaacccagcctctgtgggcggccgcctggtgttcagcggcagcaagaagaagagcagcagcagcctgggcagcggcagcagccgggacagcatcagcagtgacagcgagaccagcgagcccctgagctgccgggcccagggccagacaggagtgctgactgtgcacagctatgccaagggagatggccgggtgacagtgggggagccctgcaccaggaagaagggcagcgctgcccggagcttcagcgagcgggagctggccgaggtggctgatgagtacatgttcagcctggaggagaacaagaagagcaagggccggcggcagcccctgagcaagctgcccaggcaccaccccctggtgctgcaggagtgtgtgtctgatgatgagaccagcgagcagctgaccccagaggaggaggccgaggagacagaggcctgggccaagcccctgagccagctgtggcagaaccggccccccaactttgaagctgagaaggagttcaatgagaccatggcccagcaggccccccactgtgctgtgtgcatgatcttccagacctaccaccaggtggagtttggaggcttcaaccagaactgtggaaatgccagtgacctggccccccagaagcagaggaccaagcccctcatccctgagatgtgcttcaccagcacaggctgcagcacagacatcaacctgagcaccccctacctggaggaggatggcaccagcatcctggtgtcctgcaagaagtgcagcgtgcgggtgcacgccagctgctacggcgtgcccccagccaaggccagcgaggactggatgtgcagccgctgcagcgccaatgccctggaggaggactgctgcctgtgcagcctgcggggcggggccctgcagagggccaatgatgaccgctgggtgcacgtgtcctgtgctgtggccatcctggaggccaggtttgtgaacattgctgagaggagccctgtggatgtgtccaagatccccctgccccgcttcaagctgaagtgcatcttctgcaagaagaggaggaagaggacagctggctgctgcgtgcagtgcagccacggccgctgccccacagccttccacgtgtcctgtgcccaggccgccggcgtgatgatgcagccagatgactggccctttgtggtgttcatcacctgcttccgccacaagatccccaacctggagcgggccaagggggccctgcagagcatcacagctggccagaaggtgatcagcaagcacaagaatggccgcttctaccagtgtgaggtggtgcggctgaccacagagaccttctatgaggtgaactttgatgatggcagcttcagtgacaacctgtacccagaggacatcgtgtcccaggactgcctgcagtttggccccccagctgagggggaggtggtgcaggtgcgctggacagatggccaggtgtatggagccaagtttgtggccagccaccccatccagatgtaccaggtggagtttgaagatggcagccagctggtggtgaagagagatgatgtgtacaccctggatgaggagctgcccaagagggtgaagagccggctgtctgtggccagtgacatgaggttcaatgagatcttcacagagaaggaggtgaagcaggagaagaagaggcagagggtcatcaacagccgctaccgggaggactacatcgagcccgccctgtaccgggccatcatggagtag

SEQ ID NO: 19867 - DNA, 2745 bp, Artificial Sequence; identical to SEQ ID NO: 18914
  Description of Artificial Sequence: Synthetic coding sequence

SEQ ID NO: 19868 - DNA, 1215 bp, Artificial Sequence
  Description of Artificial Sequence: Synthetic coding sequence
atggacttcaacatgaagaagctggccagtgatgctggcatcttcttcaccagggctgtgcagttcacagaggagaagtttggccaggccgagaagacagagctggatgcccactttgagaacctgctggcccgggctgacagcaccaagaactggacagagaagatcctgcggcagacagaggtgctgctgcagcccaaccccagcgcccgggtggaggagttcctgtatgagaagctggacaggaaggtgcccagccgggtgaccaacggggagctgctggcccagtacatggctgatgctgccagcgagctgggccccaccaccccctacggcaagaccctcatcaaggtggccgaggccgagaagcagctgggcgctgctgagcgggacttcatccacacagccagcatctccttcctgacccccctgaggaacttcctggagggggactggaagaccatcagcaaggagcggcggctgctgcagaacagaaggctggacctggatgcctgcaaggcccggctgaagaaggccaaggctgctgaggccaaggccacctgtgagggggacacagtgcctgacttccaggagacccggcccaggaactacatcctgagcgccagcgccagcgccctgtggaatgatgaggtggacaaggccgagcaggagctgcgggtggcccagacagaatttgaccggcaggccgaggtgacccggctgctgctggagggcatcagcagcacccacgtgaaccacctgcgctgcctgcacgagtttgtgaagagccagaccacctactatgcccagtgctaccgccacatgctggacctgcagaagcagctgggcagcagccagggcgccatcttccctggcacctttgtgggcaccacagagcccgccagcccccccctgagcagcaccagccccaccacagctgctgccaccatgcctgtggtgcccagcgtggccagcctggcccctcctggagaggccagcctgtgcctggaggaggtggcccccccagccagcggcaccaggaaggcccgggtgctgtatgactatgaagctgctgacagcagcgagctggccctgctggctgatgagctgatcaccgtgtacagcctgcccggcatggaccctgactggctgattggagagcggggcaacaagaagggcaaggtgcctgtgacctacctggagctgctgtcctag

SEQ ID NO: 19869 - DNA, 1188 bp, Artificial Sequence
  Description of Artificial Sequence: Synthetic coding sequence
atggacttcaacatgaagaagctggccagtgatgctggcatcttcttcaccagggctgtgcagttcacagaggagaagtttggccaggccgagaagacagagctggatgcccactttgagaacctgctggcccgggctgacagcaccaagaactggacagagaagatcctgcggcagacagaggtgctgctgcagcccaaccccagcgcccgggtggaggagttcctgtatgagaagctggacaggaaggtgcccagccgggtgaccaacggggagctgctggcccagtacatggctgatgctgccagcgagctgggccccaccaccccctacggcaagaccctcatcaaggtggccgaggccgagaagcagctgggcgctgctgagcgggacttcatccacacagccagcatctccttcctgacccccctgaggaacttcctggagggggactggaagaccatcagcaaggagcggcggctgctgcagaacagaaggctggacctggatgcctgcaaggcccggctgaagaaggccaaggctgctgaggccaaggccaccaccgtgcctgacttccaggagacccggcccaggaactacatcctgagcgccagcgccagcgccctgtggaatgatgaggtggacaaggccgagcaggagctgcgggtggcccagacagaatttgaccggcaggccgaggtgacccggctgctgctggagggcatcagcagcacccacgtgaaccacctgcgctgcctgcacgagtttgtgaagagccagaccacctactatgcccagtgctaccgccacatgctggacctgcagaagcagctgggccgcttccctggcacctttgtgggcaccacagagcccgccagcccccccctgagcagcaccagccccaccacagctgctgccaccatgcctgtggtgcccagcgtggccagcctggcccctcctggagaggccagcctgtgcctggaggaggtggcccccccagccagcggcaccaggaaggcccgggtgctgtatgactatgaggccgctgacagcagcgagctggccctgctggctgatgagctgatcaccgtgtacagcctgcccggcatggaccctgactggctgattggagagcggggcaacaagaagggcaaggtgcctgtgacctacctggagctgctgtcctag

SEQ ID NO: 19870 - DNA, 1188 bp, Artificial Sequence; identical to SEQ ID NO: 19869
  Description of Artificial Sequence: Synthetic coding sequence

SEQ ID NO: 19871 - DNA, 615 bp, Artificial Sequence
  Description of Artificial Sequence: Synthetic coding sequence
atgtcctggacctgcccccgctgccagcagcctgtgttctttgctgagaaggtgagcagcctgggcaagaactggcaccgcttctgcctgaagtgtgagcgctgccacagcatcctgagccctgggggccatgctgagcacaacggccggccctactgccacaagccctgctacggggccctgtttggcccccggggcgtgaacattggaggagtgggcagctacctgtacaacccccccacccccagccctggctgcaccacccccctgagccccagcagcttcagccccccccggcccaggacaggcctgccccagggcaagaagagccccccccacatgaagaccttcaccggggagaccagcctgtgccccggctgtggggagcctgtgtactttgctgagaaggtgatgagcctgggcaggaactggcaccggccctgcctgcgctgccagcgctgccacaagaccctgacagctggcagccacgccgagcatgatggagtgccctactgccacgtgccctgctacggctacctgtttggccccaagggcgtgaacattggagatgtgggctgctacatctatgaccctgtgaagatcaagttcaagtag

SEQ ID NO: 19872 - DNA, 1221 bp, Artificial Sequence
  Description of Artificial Sequence: Synthetic coding sequence
atggagagcctgcggggctacacccacagcgacatcggctaccgcagcctggccgtgggagaagatattgaggaggtgaatgatgagaagctgactgtgaccagcctgatggcccggggcggggaggatgaggagaacaccaggagcaagccagaatatggaacagaagctgagaacaacgtgggcacagagggctctgtgcccagtgatgaccaggaccgggagggcggcggcggccacgagcctgagcagcagcaggaggagccccccctgaccaagccagagcagcagcaggaggagccccccctgctggagctgaagcaggagcaggaggagcccccccagaccaccgtggagggcccccagcctgctgagggcccccagacagctgagggcccccagcccccagagaggaagagaagaagaagaacagccttcacccagttccagctgcaggagctggagaacttctttgatgagagccagtacccagatgtggtggcccgggagcggctggccgcccggctgaacctgacagaggacagagtgcaggtgtggttccagaacagaagagccaagtggaagaggaaccagagggtgctgatgctgaggaacacagccacagctgacctggcccaccccctggacatgttcctgggcggggcctactatgctgccccagccctggaccctgccctgtgtgtgcacctggtgccccagctgccccggccccctgtgctgcctgtgccccccatgccaccccggccccccatggtgcccatgccacccaggcctcccatcgcccccatgccacccatggcccctgtgcccccaggcagcaggatggcccctgtgcccccaggccccaggatggcccctgtgcccccctggccacccatggcccctgtgcccccctggccacccatggcccctgtgcccaccggcccccccatggcccctgtgcccccaggcccccccatggcccgggtgcccccaggcccccccatggcccgggtgcccccaggcccccccatggcccccctgcccccaggcccccccatggcccccctgcccccaggcccccccatggcccccctgcccccaggcccccccatggcccccctgccccccaggagccacgtgccccacacaggcctggcccctgtgcacatcacctgggcccctgtgatcaacagctactatgcctgccccttcttctag

SEQ ID NO: 19873 - DNA, 873 bp, Artificial Sequence
  Description of Artificial Sequence: Synthetic coding sequence
atgagccccagcgccaagaagaggcccaagaacagccgggtgtccaagatgcaggatgagaagctgagagatgaaacagagcagcctgtgtccaaggtgattgaaagaaaccggctgaggacagtgctgaagaacctgagcctgctgaagctgctgaagagcagcaacagacgcatccaggagctgcacaagctggccaagcgctgctggcacagcctgctgtctgtgcccaagatcctgcgcatcagcagcggggagaacagcgcctgcaacaagaccaagcagaacaatgaggagttccaggagatcggctgcagcgagaaggagctgaagagcaagaagctggagagcactggagaccccaagaagaaggagtacaaggagtggaagagccaggtgcagagcggcatgaggaacaaggagaagaccagcctggccgccatgcccaggaaggagaagcacatcgagcctgaggtgcccaggaccagcagagatgacagcctgaaccctggggtgcagggccggcagcccctgacagagggccccagggtcatcttcatcaagccctacagaaacagaacacccatgggccacatgaagcagctggatgtggccgaccagtggatctggtttgagggcctgcccacccgcatccacctgcctgccccccgggtgatgtgccgcagcagcaccctgcgctgggtgaagaggcgctgcacccgcttctgcagcgccagcctggagatgcccatgtggcacccctacaaggtggatgtgacctggacccgggcccggggggccagccggggctggaggagccgccaccagctgaagggcagaaatggctggaggaacagccgggtgtacaagtag

SEQ ID NO: 19874 - DNA, 1644 bp, Artificial Sequence; identical to SEQ ID NO: 19587
  Description of Artificial Sequence: Synthetic coding sequence

SEQ ID NO: 19875 - DNA, 1881 bp, Artificial Sequence
  Description of Artificial Sequence: Synthetic coding sequence
atgtgcagcaccctgaagaagtgtggcacctacagaacagaggtggctgaatgtcatgaccacggcagcaccttccagggcaggaagaagggcggcagcagcttccgggacaactttgacaagaggagctgccactatgagcacggcggctatgagcggccccccagccactgccaggagaatgatggctctgtggagatgagagatgtgcacaaggaccagcagctgcggcacaccccctacagcatccgctgtgaaagaaggatgaagtggcacagtgaagatgagatccgcatcaccacctggaggaacaggaagcccccagagaggaagatgagccagaacacccaggacggctacaccaggaactggttcaaggtgaccatcccctacggcatcaagtatgacaaggcctggctgatgaacagcatccagagccactgcagcgaccgcttcacccctgtggacttccactacgtgaggaacagagcctgcttctttgtgcaggatgccagcgctgccagcgccctgaaggatgtgtcctacaagatctatgatgatgagaaccagaagatctgcatctttgtgaaccacagcacagccccctacagcgtgaagaacaagctgaagccaggccagatggagatgctgaagctgaccatgaacaagcgctacaacgtgtcccagcaggccctggacctgcagaacctgcgctttgatcctgacctgatgggccgggacatcgacatcatcctgaacagaagaaactgcatggccgccaccctgaagatcattgaaagaaacttccctgagctgctgagcctgaacctgtgcaacaacaagctgtaccagctggatggcctgagtgacatcacagagaaggcccccaaggtgaagaccctgaacctgagcaagaacaagctggagagcgcctgggagctgggcaaggtgaagggcctgaagctggaggagctgtggctggagggcaaccccctgtgcagcaccttcagtgaccagagcgcctacgtgtctgccatccgggactgcttccccaagctgctgcggctggatggccgggagctgagcgcccctgtgattgtggacatcgacagcagcgagaccatgaagccctgcaaggagaacttcaccggcagcgagaccctgaagcacctggtgctgcagttcctgcagcagtactacagcatctatgattctggggaccggcagggcctgctgggcgcctaccatgatgaggcctgcttcagcctggccatcccctttgaccccaaggacagcgcccccagcagcctgtgcaagtactttgaggacagcaggaacatgaagaccctgaaggacccctacctgaagggggagctgctgcggaggaccaagagggacatcgtggacagcctgagcgccctgcccaagacccagcacgacctgagcagcatcctggtggatgtgtggtgccagacagagaggatgctgtgcttctctgtgaatggagtcttcaaggaggtggagggccagagccagggctctgtgctggccttcaccaggaccttcatcgccaccccaggcagcagcagcagcctgtgcatcgtgaatgatgagctgtttgtgagagatgccagcccccaggagacccagagcgccttcagcatccctgtgtccaccctgagcagcagcagcgagcccagcctgagccaggagcagcaggagatggtgcaggccttcagcgcccagagcggcatgaagctggagtggagccagaagtgcctgcaggacaatgagtggaactacacccgggccggccaggccttcaccatgctgcagacagagggcaagatcccagctgaggccttcaagcagatctcctag

SEQ ID NO: 19876 - DNA, 1881 bp, Artificial Sequence; identical to SEQ ID NO: 19875
  Description of Artificial Sequence: Synthetic coding sequence

SEQ ID NO: 19877 - DNA, 1230 bp, Artificial Sequence
  Description of Artificial Sequence: Synthetic coding sequence
atgaagtggcacagtgaagatgagatccgcatcaccacctggaggaacaggaagcccccagagaggaagatgagccagaacacccaggacggctacaccaggaactggttcaaggtgaccatcccctacggcatcaagtatgacaaggcctggctgatgaacagcatccagagccactgcagcgaccgcttcacccctgtggacttccactacgtgaggaacagagcctgcttctttgtgcaggatgccagcgctgccagcgccctgaaggatgtgtcctacaagatctatgatgatgagaaccagaagatctgcatctttgtgaaccacagcacagccccctacagcgtgaagaacaagctgaagccaggccagatggagatgctgaagctgaccatgaacaagcgctacaacgtgtcccagcaggccctggacctgcagaacctgcgctttgatcctgacctgatgggccgggacatcgacatcatcctgaacagaagaaactgcatggccgccaccctgaagatcattgaaagaaacttccctgagctgctgagcctgaacctgtgcaacaacaagctgtaccagctggatggcctgagtgacatcacagagaaggcccccaaggtgaagaccctgaacctgagcaagaacaagctggagagcgcctgggagctgggcaaggtgaagggcctgaagctggaggagctgtggctggagggcaaccccctgtgcagcaccttcagtgaccagagcgcctacgtgtctgccatccgggactgcttccccaagctgctgcggctggatggccgggagctgagcgcccctgtgattgtggacatcgacagcagcgagaccatgaagccctgcaaggagaacttcaccggcagcgagaccctgaagcacctggtgctgcagttcctgcagcagtactacagcatctatgattctggggaccggcagggcctgctgggcgcctaccatgatgaggcctgcttcagcctggccatcccctttgaccccaaggacagcgcccccagcagcctgtgcaagtactttgaggacagcaggaacatgaagaccctgaaggacccctacctgaagggggagctgctgcggaggaccaagagggacatcgtggacagcctgagcgccctgcccaagacccagcacgacctgagcagcatcctggtggatgtgtggtgccagacagtgcccagcggccagtag

SEQ ID NO: 19878 - DNA, 1326 bp, Artificial Sequence; identical to SEQ ID NO: 18228
  Description of Artificial Sequence: Synthetic coding sequence

SEQ ID NO: 19879 - DNA, 1158 bp, Artificial Sequence
  Description of Artificial Sequence: Synthetic coding sequence
atggcctctgtggccgccgcccgggctgtgcctgtgggcagcggcctgcggggcctgcagaggaccctgcccctggtggtgatcctgggcgccaccggcaccgggaagagcaccctggccctgcagctgggccagaggctgggcggggagatcgtgtctgctgacagcatgcagccccaggagatgggcacagagaaggtgattgacaggaaggtggagctggagaaggaggatggcctggtgctgcacaagaggctgagccaggtggaccctgagatggccgccaagctgcacccccatgacaagaggaaggtggcccggagcctgcaggtgtttgaggagaccggcatcagccacagcgagttcctgcaccggcagcacacagaggagggcggcggccccctgggcggccccctgaagttcagcaacccctgcatcctgtggctgcatgctgaccaggctgatgagcggctggacaagagggtggatgacatgctggccgccggcctgctggaggagctgcgggacttccaccggcgctacaaccagaagaatgtgtctgagaacagccaggactaccagcacggcatcttccagagcatcggcttcaaggagttccacgagtacctgatcacagagggcaagtgcaccctggagaccagcaaccagctgctgaagaagggcatcgaggccctgaagcaggtgaccaagagatatgccaggaagcagaaccgctgggtgaagaaccgcttcctgagcaggcctggccccatcgtgccccctgtgtatggcctggaggtgtctgatgtgtccaagtgggaggagagcgtgctggagcccgccctggagatcgtgcagagcttcatccagggccacaagcccacagccacccccatcaagatgccctacaatgaagctgagaacaagaggagctaccacctgtgtgacctgtgtgaccgcatcatcattggagaccgggagtgggccgcccacatcaagagcaagagccacctgaaccagctgaagaagagaagaaggctggacagtgatgctgtgaacaccatcgagagccagagcgtgtccccagaccacaacaaggagcccaaggagaagggcagccctggccagaatgaccaggagctgaagtgcagcgtgtag

SEQ ID NO: 19880 - DNA, 987 bp, Artificial Sequence
  Description of Artificial Sequence: Synthetic coding sequence
atgaagaggcccaaggagcccagcggcagtgatggagagagtgatggccccattgatgtgggccaggagggccagctgagccagatggcccggcccctgagcacccccagcagcagccagatgcaggccaggaagaagcaccggggcatcatcgagaagagaagaagagaccgcatcaacagcagcctgtctgagctgcggcggctggtgcccacagcctttgagaagcagggcagcagcaagctggagaaggccgaggtgctgcagatgacagtggaccacctgaagatgctgcacgccactggaggcaccggcttctttgatgcccgggccctggccgtggacttccgcagcatcggcttcagagaatgtctgacagaggtgatccgctacctgggcgtgctggagggccccagcagcagagctgaccctgtgcgcatccggctgctgagccacctgaacagctatgctgctgagatggagcccagccccacccccaccggccccctggccttccctgcctggccctggagcttcttccacagctgccccggcctgcctgccctgagcaaccagctggccatcctgggccgggtgcccagccctgtgctgcccggggtgagcagccctgcctaccccatcccagccctgaggacagcccccctgcggcgggccaccggcatcatcctgcctgccaggagaaatgtgctgcccagcagaggagccagcagcacccggcgggcccggcccctggagaggcctgccacccctgtgcctgtggcccccagcagccgggccgcccggagcagccacatcgcccccctgctgcagagcagcagccccaccccacctggccccactggatctgctgcctacgtggccgtgcccacccccaacagcagcagccctggccctgctggccggcctgctggggccatgctgtaccacagctgggtgtctgagatcacagaaattggagccttctag

SEQ ID NO: 19881 - DNA, 2262 bp, Artificial Sequence
  Description of Artificial Sequence: Synthetic coding sequence
atggagacctttgagcccatcagccaggagcccctgagccaggccagctatgacaaggccccagaccctgtgcctgagctgcaggacagcttctatgcagagctgcagagagctgagagcctgcaggagaagagcatcaaggaggccaagaccaagtgcaggaccatcgccagcctgctgacagctgcccccaacccccacagcaaaggagtgctgatgttcaagaagaggcggcagagggccaagaagtacaccctggtgtcctttggagctgctgctggcactggagctgaggaggaggatggagtgccccccaccagcgagagcgagctggatgaggaggccttcagtgatgcccggagcctgaccaaccagagcgactgggacagcccctacctggacatggagctggcccgggccggcagccgggccagcgagggccagggcagcggcctgggcggccagctgtctgaggtgtctggccggggcgtgcagctgtttgagcagcagaggcagagagctgacagcagcacccaggagctggcccgggtggagcctgctgccatgctgaatggagagggcctgcagagccccccccgggcccagagcgcccctcctgaggccgctgtgctgccccccagccccctgcctgcccctgtggccagcccccggcccttccagcccggcggcggggcccccaccccagcccccagcatcttcaacagaagtgcccggcccttcaccccaggcctgcagggccagaggcccaccaccaccagcgtcatcttccggcccctggcccccaagagggccaatgacagcctgggcggcctgagccctgcccccccacccttcctgagcagccagggccccacccccctgcccagcttcaccagcggcgtgcccagccacgcccctgtgtctggcagccccagcacccccaggagcagcggccctgtgacagccaccagcagcctgtacatcccagcccccagcaggcctgtgaccccaggaggagcccctgagcccccagccccacccagcgctgctgccatgaccagcacagccagcatcttcctgagcgcccccctgcggcccagcgcccggcctgaggccccagcccctggccctggggcccctgagccccccagcgcccgggagcagaggatctctgtgcctgctgccaggacaggcatcctgcaggaggccaggagaagaggcaccaggaagcagatgttccggcctgggaaggaggagaccaagaacagccccaaccctgagctgctgagcctggtgcagaacctggatgagaagcccagggctggaggagctgagagcggccctgaggaggatgccctgagcctgggcgctgaggcctgcaacttcatgcagcctgtgggcgcccggagctacaagaccctgccccacgtgacccccaagaccccaccacccatggcccccaagaccccaccacccatgacccccaagaccccacctcctgtggcccccaagccacccagccggggcctgctggatggcctggtgaatggagctgccagcagcgctggcatccctgagcccccccggctgcagggccggggcggggagctgtttgccaagaggcagagcagagctgaccgctacgtggtggagggcaccccaggccctggcctgggcccccggcccaggagccccagccccacccccagcctgccccccagctggaagtacagccccaacatccgggcccccccacccatcgcctacaaccccctgctgagccccttcttcccccaggccgcccggaccctgcccaaggcccagagccagggcccccgggccacccccaagcagggcatcaaggccctggacttcatgaggcaccagccctaccagctgaagacagccatgttctgctttgatgaggtgccccccaccccaggccccatcgccagcggcagccccaagacagcccgggtgcaggagatccgccgcttcagcaccccagccccccagcccacagctgagcccctggcccccaccgtgctggcccccagggctgccaccaccctggatgagcccatctggaggacagagctggccagcgcccctgtgcccagccctgcccctcctcctgaggccccccggggcctgggcgccagccccagcagctgtggcttccaggtggcccggccccgcttcagcgccaccaggacaggcctgcaggcccacgtgtggaggcctggggccggccaccagtag

SEQ ID NO: 19882 - DNA, 1041 bp, Artificial Sequence; identical to SEQ ID NO: 18335
  Description of Artificial Sequence: Synthetic coding sequence

SEQ ID NO: 19883 - DNA, 1569 bp, Artificial Sequence
  Description of Artificial Sequence: Synthetic coding sequence
atgagcccccagaagagggtgaagaatgtgcaggcccagaacagaaccagccagggcagcagcagcttccagaccaccctgagcgcctggaaggtgaagcaggaccccagcaacagcaagaacatcagcaagcacggccagaacaaccctgtgggggactatgagcacgcagatgaccaggccgaggaggatgccctgcagatggctgtgggctactttgagaagggccccatcaaggccagccagaacaaggacaagaccctggagaagcacctgaagacagtggagaatgtggcctggaagaatggcctggccagcgaggagattgacatcctgctgaacatcgccctgagcggcaagtttggaaatgctgtgaacacccgcatcctgaagtgcatgatcccagccaccgtcatcagtgaagattctgtggtgaaggctgtgtcctggctgtgtgtgggcaaatgttctggcagcaccaaggtgctcttctaccgctggctggtggccatgtttgacttcatcgacaggaaggagcagatcaacctgctgtatggcttcttctttgccagcctgcaggatgatgccctgtgcccctacgtgtgccacctgctgtacctgctgaccaagaaggaaaatgtgaagcccttccgggtgaggaagctgctggacctgcaggccaagatgggcatgcagccccacctgcaggccctgctgagcctgtacaagttctttgccccagccctgatctctgtgtccctgcctgtgaggaagaagatctacttcaagaacagcgagaacctgtggaagacagccctgctggccgtgaagcagaggaacagaggccccagccctgagcccctgaagctgatgctgggccctgccaacgtgcggcccctgaagaggaagtggaacagcctgagcgtcatccctgtgctgaacagcagcagctacaccaaggaatgtgggaagaaggagatgagcctgagtgactgcctgaacagaagtggcagcttccccctggagcagctgcagagcttcccccagctgctgcagaacatccactgcctggagctgcccagccagatgggctctgtgctgaacaacagcctgctgctgcactacatcaactgtgtgagagatgagcctgtgctgctgcgcttctactactggctgagccagaccctgcaggaggagtgcatctggtacaaggtgaacaactatgagcacggcaaggagttcaccaacttcctggacaccatcatccgggcagagtgcttcctgcaggagggcttctacagctgtgaggccttcctgtacaagagcctgcccctgtgggatggcctgtgctgccgcagccagttcctgcagctggtgtcctggatccccttcagcagcttcagcgaggtgaagcccctgctgtttgaccacctggcccagctgttcttcaccagcaccatctacttcaagtgcagcgtgctgcagagcctgaaggagctgctgcagaactggctgctgtggctgtccatggacatccacatgaagcctgtgaccaacagccccctgtag

SEQ ID NO: 19884 - DNA, 2271 bp, Artificial Sequence
  Description of Artificial Sequence: Synthetic coding sequence
atgagcccccagaagagggtgaagaatgtgcaggcccagaacagaaccagccagggcagcagcagcttccagaccaccctgagcgcctggaaggtgaagcaggaccccagcaacagcaagaacatcagcaagcacggccagaacaaccctgtgggggactatgagcacgcagatgaccaggccgaggaggatgccctgcagatggctgtgggctactttgagaagggccccatcaaggccagccagaacaaggacaagaccctggagaagcacctgaagacagtggagaatgtggcctggaagaatggcctggccagcgaggagattgacatcctgctgaacatcgccctgagcggcaagtttggaaatgctgtgaacacccgcatcctgaagtgcatgatcccagccaccgtcatcagtgaagattctgtggtgaaggctgtgtcctggctgtgtgtgggcaaatgttctggcagcaccaaggtgctcttctaccgctggctggtggccatgtttgacttcatcgacaggaaggagcagatcaacctgctgtatggcttcttctttgccagcctgcaggatgatgccctgtgcccctacgtgtgccacctgctgtacctgctgaccaagaaggaaaatgtgaagcccttccgggtgaggaagctgctggacctgcaggccaagatgggcatgcagccccacctgcaggccctgctgagcctgtacaagttctttgccccagccctgatctctgtgtccctgcctgtgaggaagaagatctacttcaagaacagcgagaacctgtggaagacagccctgctggccgtgaagcagaggaacagaggccccagccctgagcccctgaagctgatgctgggccctgccaacgtgcggcccctgaagaggaagtggaacagcctgagcgtcatccctgtgctgaacagcagcagctacaccaaggaatgtgggaagaaggagatgagcctgagtgactgcctgaacagaagtggcagcttccccctggagcagctgcagagcttcccccagctgctgcagaacatccactgcctggagctgcccagccagatgggctctgtgctgaacaacagcctgctgctgcactacatcaactgtgtgagagatgagcctgtgctgctgcgcttctactactggctgagccagaccctgcaggaggagtgcatctggtacaaggtgaacaactatgagcacggcaaggagttcaccaacttcctggacaccatcatccgggcagagtgcttcctgcaggagggcttctacagctgtgaggccttcctgtacaagagcctgcccctgtgggatggcctgtgctgccgcagccagttcctgcagctggtgtcctggatccccttcagcagcttcagcgaggtgaagcccctgctgtttgaccacctggcccagctgttcttcaccagcaccatctacttcaagtgcagcgtgctgcagagcctgaaggagctgctgcagaactggctgctgtggctgtccatggacatccacatgaagcctgtgaccaacagccccctggagaccaccctgggcggctccatgaacagcgtgtccaagctgatccactacgtgggctggctgagcaccacagccatgaggctggagagcaacaacaccttcctgctgcacttcatcctggacttctatgagaaggtgtgtgacatctacatcaactacaacctgcccctggtggtgctcttccccccaggcatcttctacagcgccctgctgagcctggacaccagcatcctgaaccagctgtgcttcatcatgcaccgctacaggaagaacctgacagctgccaagaagaatgagctggtgcagaagaccaagtctgagttcaacttcagcagcaagacctaccaggagttcaaccactacctgacctccatggtgggctgcctgtggaccagcaagccctttgggaagggcatctacattgatcctgagatcctggagaagacaggagtggccgagtacaagaacagcctgaatgtggtgcaccaccccagcttcctgtcctatgctgtgtccttcctgctgcaggagagccctgaggagaggacagtgaatgtgagcagcatccggggcaagaagtggagctggtacctggactacctgttcagccagggcctgcagggcctgaagctgttcatccgcagctctgtgcaccacagcagcatccccagggctgagggcatcaactgcaacaaccagtactag

SEQ ID NO: 19885 - DNA, 933 bp, Artificial Sequence
  Description of Artificial Sequence: Synthetic coding sequence
atggctgatgctgctgccacagctggggccggcggcagcggcaccaggagcggcagcaagcagagcaccaacccagctgacaactaccacctggcccggcggaggaccctgcaggtggtggtgagcagcctgctgacagaggccggctttgagagcgctgagaaggcctctgtggagaccctgacagagatgctgcagagctacatcagcgagatcggccgcagcgccaagagctactgtgagcacacagcccggacccagcccaccctgagtgacatcgtggtgaccctggtggagatgggcttcaacgtggacaccctgcctgcctatgccaagaggagccagaggatggtgatcacagcccctcctgtgaccaaccagcctgtgacccccaaggccctgacagctggccagaaccggccccaccccccccacatccccagccacttccctgagttcccagacccccacacctacatcaagacccccacctaccgggagcctgtgtctgactaccaggtgctgcgggagaaggccgccagccagaggagagatgtggagcgggccctgacccgcttcatggccaagacaggagagacccagagcctcttcaaggatgatgtgtccaccttccccctgattgctgcccggcccttcaccatcccctacctgacagccctgctgcccagcgagctggagatgcagcagatggaggagacagacagcagcgagcaggatgagcagacagacacagagaacctggccctgcacatctccatggaggacagcggggctgagaaggagaacacctctgtgctgcagcagaaccccagcctgagcggcagcagaaatggagaggagaacatcatcgacaacccctacctgcggcctgtgaagaagcccaagatccggaggaagaagagcctgtcctag

SEQ ID NO: 19886 - DNA, 1935 bp, Artificial Sequence
  Description of Artificial Sequence: Synthetic coding sequence
atggaggagaccatgaagctggccaccatggaggacacagtggagtactgcctcttcctgatcccagatgagagccgggacagcgacaagcacaaggagatcctgcagaagtacatcgagcgcatcatcaccaggtttgcccccatgctggtgccctacatctggcagaaccagcccttcaacctgaagtacaagccaggcaagggcggcgtgcctgcccacatgtttggagtgaccaagtttggagacaacattgaagatgagtggttcatcgtgtatgtgatcaagcagatcaccaaggagttccctgagctggtggccagaattgaggacaatgatggagagttcctgctgattgaagctgctgacttcctgcccaagtggctggaccctgagaacagcaccaacagagtcttcttctgccacggggagctgtgcatcatcccagcccccaggaagagcggggctgagagctggctgcccaccaccccacccaccatcccccaggccctgaacatcatcacagcccacagcgagaagatcctggccagcgagagcatccgggctgctgtgaacagacgcatccggggctacccagagaagatccaggccagcctgcaccgggcccactgcttcctgcctgctggcatcgtggccgtgctgaagcagaggccccggctggtggccgctgctgtgcaggccttctacctgcgggaccccatcgacctgcgggcctgcagggtcttcaagaccttcctgcctgagacccgcatcatgacctctgtgaccttcaccaagtgcctgtatgcccagctggtgcagcagagatttgtgcctgacagaagaagtggctaccgcctgcccccacccagcgacccccagtaccgggcccacgagctgggcatgaagctggcccacggctttgagatcctgtgcagcaagtgcagcccccacttcagtgactgcaagaagagcctggtgacagccagccccctgtgggccagcttcctggagagcctgaagaagaatgactacttcaagggcctcatcgagggcagcgcccagtaccgggagcggctggagatggccgagaactacttccagctgtctgtggactggccagagagcagcctggccatgagccctggagaggagatcctgaccctgctgcagaccatcccctttgatattgaggacctgaagaaggaggccgccaacctgcccccagaagatgatgaccagtggctggacctgagcccagaccagctggaccagctgctgcaggaggccgtgggcaagaaggagagcgagagcgtgtccaaggaggagaaggagcagaactatgacctgacagaggtgtctgagagcatgaaggccttcatcagcaaggtgtccacccacaagggagctgagctgccccgggagcccagcgaggcccccatcacctttgatgctgacagcttcctgaactactttgacaagatcctgggcccccggcccaatgaaagtgacagtgatgacctggatgatgaagattttgagtgcctggacagtgatgatgacctggactttgagacccatgagcctggagaggaggccagcctgaagggcaccctggacaacctgaagagctacatggcccagatggaccaggagctggcccacacctgcatcagcaagagcttcaccaccaggaaccaggtggagcctgtgtcccagaccacagacaacaacagtgatgaggaggacagcggcaccggggagagcgtgatggcccctgtggatgtggacctgaacctggtgagcaacatcctggagagctacagcagccaggccggcctggccggccctgccagcaacctgctgcagagcatgggcgtgcagctgcctgacaacacagaccaccggcccaccagcaagcccaccaagaactag

SEQ ID NO: 19887 - DNA, 2163 bp, Artificial Sequence
  Description of Artificial Sequence: Synthetic coding sequence
atgtctgtgtctgggaagaaggagtttgatgtgaagcagatcctgcggctgcgctggcgctggttcagccaccccttccagggcagcaccaacacaggcagctgcctgcagcaggagggctatgagcaccggggcacccctgtgcagggccgcctgaagagccacagccgggacagaaatggcctgaagaagagcaacagccctgtgcaccacaacatcctggcccctgtgcccggccctgccccagcccaccagagagctgtgcagaacctgcagcagcacaacctgattgtgcacttccaggccaatgaagacacccccaagtctgtgcctgagaagaacctcttcaaggaggcctgtgagaagagggcccaggacctggagatgatggctgatgacaacatcgaggacagcacagcccggctggacacccagcacagcgaggacatgaatgccaccaggtctgaggagcagttccacgtgatcaaccacgccgagcagaccctgaggaagatggagaactacctgaaggagaagcagctgtgtgatgtgctgctgattgctggccacctgcgcatcccagcccaccggctggtgctgtctgctgtgtctgactactttgctgccatgttcaccaatgatgtgctggaggccaagcaggaggaggtgaggatggagggcgtggaccccaatgccctgaacagcctggtgcagtatgcctacacaggagtgctgcagctgaaggaggacaccatcgagagcctgctggccgccgcctgcctgctgcagctgacccaggtgattgatgtgtgcagcaacttcctgatcaagcagctgcaccccagcaactgcctgggcatccgcagctttggagatgcccagggctgcacagagctgctgaatgtggcccacaagtacaccatggagcacttcatcgaggtgatcaagaaccaggagttcctgctgctgcctgccaatgagatcagcaagctgctgtgcagtgatgacatcaacgtgcctgatgaggagaccatcttccacgccctgatgcagtgggtgggccatgatgtgcagaaccggcagggcgagctgggcatgctgctgagctacatccggctgcccctgctgcccccccagctgctggccgacctggagaccagctccatgttcaccggggacctggagtgccagaagctgctgatggaggccatgaagtaccacctgctgcctgagcggcgctccatgatgcagagccccaggaccaagcccaggaagagcacagtgggcgccctgtatgctgtgggcggcatggatgccatgaagggcaccaccaccatcgagaagtatgacctgcggaccaacagctggctgcacatcggcaccatgaatggaagaaggctgcagtttggagtggccgtcatcgacaacaagctgtatgtggtgggcggcagagatggcctgaagaccctgaacacagtggagtgcttcaaccctgtgggcaagatctggacagtgatgccacccatgagcacccaccgccacggcctgggcgtggccaccctggagggccccatgtatgctgtgggcggccatgatggctggagctacctgaacacagtggagcgctgggaccctgagggccggcagtggaactacgtggcctccatgagcacccccaggagcacagtgggcgtggtggccctgaacaacaagctgtatgccatcggcggcagagatggcagcagctgcctgaagtccatggagtactttgacccccacaccaacaagtggagcctgtgtgcccccatgagcaagaggcggggcggcgtgggcgtggccacctacaacggcttcctgtatgtggtgggcggccatgatgccccagccagcaaccactgcagccggctgagtgactgtgtggagagatatgaccccaagggggacagctggagcacagtggcccccctgtctgtgcccagagatgctgtggccgtgtgccccctgggggacaagctgtatgtggtgggcggctatgatggccacacctacctgaacacagtggagagctatgatgcccagagaaatgagtggaaggagagcatgcaggagctgctgcagaacttctacaccacccagaagctgaaggagaccctgggccactag

SEQ ID NO: 19888 - DNA, 2157 bp, Artificial Sequence
  Description of Artificial Sequence: Synthetic coding sequence
atgtctgtgtctgggaagaaggagtttgatgtgaagcagatcctgcggctgcgctggcgctggttcagccaccccttccagggcagcaccaacacaggcagctgcctgcagcaggagggctatgagcaccggggcacccctgtgcagggccgcctgaagagccacagccgggacagaaatggcctgaagaagagcaacagccctgtgcaccacaacatcctggcccctgtgcccggccctgccccagcccaccagagagctgtgcagaacctgcagcagcacaacctgattgtgcacttccaggccaatgaagacacccccaagtctgtgcctgagaagaacctcttcaaggaggcctgtgagaagagggcccaggacctggagatgatggctgatgacaacatcgaggacagcacagcccggctggacacccagcacagcgaggacatgaatgccaccaggtctgaggagcagttccacgtgatcaaccacgccgagcagaccctgaggaagatggagaactacctgaaggagaagcagctgtgtgatgtgctgctgattgctggccacctgcgcatcccagcccaccggctggtgctgtctgctgtgtctgactactttgctgccatgttcaccaatgatgtgctggaggccaagcaggaggaggtgaggatggagggcgtggaccccaatgccctgaacagcctggtgcagtatgcctacacaggagtgctgcagctgaaggaggacaccatcgagagcctgctggccgccgcctgcctgctgcagctgacccaggtgattgatgtgtgcagcaacttcctgatcaagcagctgcaccccagcaactgcctgggcatccgcagctttggagatgcccagggctgcacagagctgctgaatgtggcccacaagtacaccatggagcacttcatcgaggtgatcaagaaccaggagttcctgctgctgcctgccaatgagatcagcaagctgctgtgcagtgatgacatcaacgtgcctgatgaggagaccatcttccacgccctgatgcagtgggtgggccatgatgtgcagaaccggcagggcgagctgggcatgctgctgagctacatccggctgcccctgctgcccccccagctgctggccgacctggagaccagctccatgttcaccggggacctggagtgccagaagctgctgatggaggccatgaagtaccacctgctgcctgagcggcgctccatgatgcagagccccaggaccaagcccaggaagagcacagtgggcgccctgtatgctgtgggcggcatggatgccatgaagggcaccaccaccatcgagaagtatgacctgcggaccaacagctggctgcacatcggcaccatgaatggaagaaggctgcagtttggagtggccgtcatcgacaacaagctgtatgtggtgggcggcagagatggcctgaagaccctgaacacagtggagtgcttcaaccctgtgggcaagatctggacagtgatgccacccatgagcacccaccgccacggcctgggcgtggccaccctggagggccccatgtatgctgtgggcggccatgatggctggagctacctgaacacagtggagcgctgggaccctgagggccggcagtggaactacgtggcctccatgagcacccccaggagcacagtgggcgtggtggccctgaacaacaagctgtatgccatcggcggcagagatggcagcagctgcctgaagtccatggagtactttgacccccacaccaacaagtggagcctgtgtgcccccatgagcaagaggcggggcggcgtgggcgtggccacctacaacggcttcctgtatgtggtgggcggccatgatgccccagccagcaaccactgcagccggctgagtgactgtgtggagagatatgaccccaagggggacagctggagcacagtggcccccctgtctgtgcccagagatgctgtggccgtgtgccccctgggggacaagctgtatgtggtgggcggctatgatggccacacctacctgaacacagtggagagctatgatgcccagagaaatgagtggaaggaggaggtgcctgtgaacatcggccgggccggggcctgtgtggtggtggtgaagctgccctag

SEQ ID NO: 19889 - DNA, 1134 bp, Artificial Sequence
  Description of Artificial Sequence: Synthetic coding sequence
atgaatggacctgtgagccccaagagcaaggcccggcccagcagccccagcacctcctggcacaggcctgccagcccctgccccagccctggccctggccacaccctgccccccaagccacccagcccccggggcaccacagccagccccaagggccgggtgcggaggaaggaggaggccaaggagagccccagcgctgctggccctgaggacaagagccagagcaagagaagagccagcaatgagaaggagagcgctgccccagccagccctgcccccagccctgcccccagccccaccccagccccaccccagaaggagcagcccccagctgagacccccacagccccagcccctcctgtgacccccagcaagcccatggccggcaccacagaccgggaggaggccacccggctgctggccgagaagaggcggcaggcccgggagcagcgggagcgggaggagcaggagcggcggctgcaggccgagcgggacaagaggatgagggaggagcagctggcccgggaggccgaggcccgggcagagcgggaggccgaggccaggagaagagaggagcaggaggcccgggagaaggcccaggccgagcaggaggagcaggagcggctgcagaagcagaaggaggaggccgaggcccggagccgggaggaggccgagcggcagaggctggagcgggagaagcacttccagcagcaggagcaggagcggcaggagaggaggaagaggctggaggagatcatgaagaggaccaggaagtctgaggtgtctgagaccaagaagcaggacagcaaggaggccaatgccaacggcagcagccctgagcctgtgaaggctgtggaggcccggagccctggcctgcagaaggaggccgtgcagaaggaggagcccatcccccaggagccccagtggagcctgcccagcaaggagctgcctgccagcctggtgaatggcctgcagcccctgcctgcccaccaggagaatggcttcagcaccaacggccccagcggggacaagagcctgagcaggaccccagagaccctgctgccctttgctgaggccgaggccttcctgaagaaggctgtggtgcagagcccccaggtgacagaggtgctgtag

SEQ ID NO: 19890 - DNA, 2427 bp, Artificial Sequence
  Description of Artificial Sequence: Synthetic coding sequence
atggagagcggccccagggctgagctgggcgctggggcccccccagctgtggtggcccggaccccacctgagccccggcccagccctgagggggaccccagccccccacctccacccatgtctgccctggtgcctgacaccccaccagacaccccaccagccatgaagaatgccaccagcagcaagcagctgcccctggagcctgagagccccagcggccaggtgggccccaggcctgccccaccccaggaggagagccccagcagcgaggccaagagccggggccccaccccaccagccatgggccccagagatgcccggcccccccggcgcagcagccagcccagccccacagctgtgcctgccagtgacagcccccccaccaagcaggaggtgaagaaggccggggagcggcacaagctggccaaggagcggcgggaggagcgggccaagtacctggccgccaagaaggctgtgtggctggagaaggaggagaaggccaaggccctgcgggagaagcagctgcaggagaggagaagaaggctggaggagcagaggctgaaggccgagcagaggcgggccgccctggaggagcggcagaggcagaagctggagaagaacaaggagagatatgaagctgccatccagaggtctgtgaagaagacctgggccgagatccggcagcagcgctggagctgggccggggccctgcaccacagcagccctggccacaagaccagcggcagccgctgcagcgtgtctgctgtgaacctgcccaagcacgtggacagcatcatcaacaagaggctgagcaagagcagcgccaccctgtggaacagccccagcaggaacagaagcctgcagctgagcgcctgggagagcagcatcgtggaccggctgatgacccccaccctgtccttcctggcccggagccgctctgctgtgaccctgcccagaaatggccgggaccaggccgtgcctgtgtgccccaggtctgccagcgccagccccctgaccccctgcagcgtgaccaggtctgtgcaccgctgtgccccagctggggagcggggggagaggaggaagcccaatgctgggggcagccctgcccctgtgagaagaagacctgaggccagccctgtgcagaagaaggagaagaaggacaaggagagagaaaatgagaaggagaagagcgccctggcccgggagaggagcctgaagaagaggcagagcctgcctgccagcccccgggcccggctgagcgccagcacagccagcgagctgagccccaagagcaaggcccggcccagcagccccagcacctcctggcacaggcctgccagcccctgccccagccctggccctggccacaccctgccccccaagccacccagcccccggggcaccacagccagccccaagggccgggtgcggaggaaggaggaggccaaggagagccccagcgctgctggccctgaggacaagagccagagcaagagaagagccagcaatgagaaggagagcgctgccccagccagccctgcccccagccctgcccccagccccaccccagccccaccccagaaggagcagcccccagctgagacccccacagatgctgctgtgctgaccagccccccagccccagcccctcctgtgacccccagcaagcccatggccggcaccacagaccgggaggaggccacccggctgctggccgagaagaggcggcaggcccgggagcagcgggagcgggaggagcaggagcggcggctgcaggccgagcgggacaagaggatgagggaggagcagctggcccgggaggccgaggcccgggcagagcgggaggccgaggcccggcggcgggaggagcaggaggcccgggagaaggcccaggccgagcaggaggagcaggagcggctgcagaagcagaaggaggaggccgaggcccggagccgggaggaggccgagcggcagaggctggagcgggagaagcacttccagcagcaggagcaggagcggcaggagaggaggaagaggctggaggagatcatgaagaggaccaggaagtctgaggtgtctgagaccaagaagcaggacagcaaggaggccaatgccaacggcagcagccctgagcctgtgaaggctgtggaggcccggagccctggcctgcagaaggaggccgtgcagaaggaggagcccatcccccaggagccccagtggagcctgcccagcaaggagctgcctgccagcctggtgaatggcctgcagcccctgcctgcccaccaggagaatggcttcagcaccaacggccccagcggggacaagagcctgagcaggaccccagagaccctgctgccctttgctgaggccgaggccttcctgaagaaggctgtggtgcagagcccccaggtgacagaggtgctgtag

SEQ ID NO: 19891 - DNA, 2526 bp, Artificial Sequence
  Description of Artificial Sequence: Synthetic coding sequence
atggagagcggccccagggctgagctgggcgctggggcccccccagctgtggtggcccggaccccacctgagccccggcccagccctgagggggaccccagccccccacctccacccatgtctgccctggtgcctgacaccccaccagacaccccaccagccatgaagaatgccaccagcagcaagcagctgcccctggagcctgagagccccagcggccaggtgggccccaggcctgccccaccccaggaggagagccccagcagcgaggccaagagccggggccccaccccaccagccatgggccccagagatgcccggcccccccggcgcagcagccagcccagccccacagctgtgcctgccagtgacagcccccccaccaagcaggaggtgaagaaggccggggagcggcacaagctggccaaggagcggcgggaggagcgggccaagtacctggccgccaagaaggctgtgtggctggagaaggaggagaaggccaaggccctgcgggagaagcagctgcaggagaggagaagaaggctggaggagcagaggctgaaggccgagcagaggcgggccgccctggaggagcggcagaggcagaagctggagaagaacaaggagagatatgaagctgccatccagaggtctgtgaagaagacctgggccgagatccggcagcagcgctggagctgggccggggccctgcaccacagcagccctggccacaagaccagcggcagccgctgcagcgtgtctgctgtgaacctgcccaagcacgtggacagcatcatcaacaagaggctgagcaagagcagcgccaccctgtggaacagccccagcaggaacagaagcctgcagctgagcgcctgggagagcagcatcgtggaccggctgatgacccccaccctgtccttcctggcccggagccgctctgctgtgaccctgcccagaaatggccgggaccagggccggggctgtgaccccggccggggccccacctggggccgggccggggccagcctggcccggggcccccagcctgacaggacccaccccagcgctgctgtgcctgtgtgccccaggtctgccagcgccagccccctgaccccctgcagcgtgaccaggtctgtgcaccgctgtgccccagctggggagcggggggagaggaggaagcccaatgctgggggcagccctgcccctgtgagaagaagacctgaggccagccctgtgcagaagaaggagaagaaggacaaggagagagaaaatgagaaggagaagagcgccctggcccgggagaggagcctgaagaagaggcagagcctgcctgccagcccccgggcccggctgagcgccagcacagccagcgagctgagccccaagagcaaggcccggcccagcagccccagcacctcctggcacaggcctgccagcccctgccccagccctggccctggccacaccctgccccccaagccacccagcccccggggcaccacagccagccccaagggccgggtgcggaggaaggaggaggccaaggagagccccagcgctgctggccctgaggacaagagccagagcaagagaagagccagcaatgagaaggagagcgctgccccagccagccctgcccccagccctgcccccagccccaccccagccccaccccagaaggagcagcccccagctgagacccccacagatgctgctgtgctgaccagccccccagccccagcccctcctgtgacccccagcaagcccatggccggcaccacagaccgggaggaggccacccggctgctggccgagaagaggcggcaggcccgggagcagcgggagcgggaggagcaggagcggcggctgcaggccgagcgggacaagaggatgagggaggagcagctggcccgggaggccgaggcccgggcagagcgggaggccgaggcccggcggcgggaggagcaggaggcccgggagaaggcccaggccgagcaggaggagcaggagcggctgcagaagcagaaggaggaggccgaggcccggagccgggaggaggccgagcggcagaggctggagcgggagaagcacttccagcagcaggagcaggagcggcaggagaggaggaagaggctggaggagatcatgaagaggaccaggaagtctgaggtgtctgagaccaagcagaagcaggacagcaaggaggccaatgccaacggcagcagccctgagcctgtgaaggctgtggaggcccggagccctggcctgcagaaggaggccgtgcagaaggaggagcccatcccccaggagccccagtggagcctgcccagcaaggagctgcctgccagcctggtgaatggcctgcagcccctgcctgcccaccaggagaatggcttcagcaccaacggccccagcggggacaagagcctgagcaggaccccagagaccctgctgccctttgctgaggccgaggccttcctgaagaaggctgtggtgcagagcccccaggtgacagaggtgctgtag

SEQ ID NO: 19892 - DNA, 495 bp, Artificial Sequence
  Description of Artificial Sequence: Synthetic coding sequence
aacctgcccaagcacgtggacagcatcatcaacaagaggcagaggctggagcgggagaagcacttccagcagcaggagcaggagcggcaggagaggaggaagaggctggaggagatcatgaagaggaccaggaagtctgaggtgtctgagaccaagaagcaggacagcaaggaggccaatgccaacggcagcagccctgagcctgtgaaggctgtggaggcccggagccctggcctgcagaaggaggccgtgcagaaggaggagcccatcccccaggagccccagtggagcctgcccagcaaggagctgcctgccagcctggtgaatggcctgcagcccctgcctgcccaccaggagaatggcttcagcaccaacggccccagcggggacaagagcctgagcaggaccccagagaccctgctgccctttgctgaggccgaggccttcctgaagaaggctgtggtgcagagcccccaggtgacagaggtgctgtag

SEQ ID NO: 19893 - DNA, 345 bp, Artificial Sequence
  Description of Artificial Sequence: Synthetic coding sequence
atggtgatccgggtgtacatcgccagcagcagcggcagcacagccatcaagaagaagcagcaggatgtgctgggcttcctggaggccaacaagattggatttgaggagaaggacattgctgccaatgaggagaacaggaagtggatgagagaaaatgtgcctgagaacagcaggcctgccaccggctaccccctgcccccccagatcttcaatgaaagccagtacagaggagactatgatgccttctttgaggccagagaaaataatgctgtgtatgccttcctgggcctgacagcccctcctggcagcaaggaggccgaggtgcaggccaagcagcaggcctag

SEQ ID NO: 19894 - DNA, 537 bp, Artificial Sequence
  Description of Artificial Sequence: Synthetic coding sequence
atgagcggcttcagcacagaggagcgggccgcccccttcagcctggagtacagagtcttcctgaagaatgagaagggccagtacatcagccccttccatgacatccccatctatgctgacaaggatgtgttccacatggtggtggaggtgccccgctggagcaatgccaagatggagatcgccaccaaggaccccctgaaccccatcaagcaggatgtgaagaagggcaagctgcgctacgtggccaacctcttcccctacaagggctacatctggaactacggggccatcccccagacctgggaggaccccggccacaatgacaagcacacaggctgctgcggggacaatgaccccattgatgtgtgtgaaattggcagcaaggtgtgtgcccggggggagatcatcggcgtgaaggtgctgggcatcctggccatgattgatgaaggagaaacagactggaaggtgattgccatcaacgtggatgatcctgatgctgccaactacaacgtgtgcaacagcgtggtgatcctgtag

SEQ ID NO: 19895 - DNA, 870 bp, Artificial Sequence
  Description of Artificial Sequence: Synthetic coding sequence
atgagcggcttcagcacagaggagcgggccgcccccttcagcctggagtacagagtcttcctgaagaatgagaagggccagtacatcagccccttccatgacatccccatctatgctgacaaggatgtgttccacatggtggtggaggtgccccgctggagcaatgccaagatggagatcgccaccaaggaccccctgaaccccatcaagcaggatgtgaagaagggcaagctgcgctacgtggccaacctcttcccctacaagggctacatctggaactacggggccatcccccagacctgggaggaccccggccacaatgacaagcacacaggctgctgcggggacaatgaccccattgatgtgtgtgaaattggcagcaaggtgtgtgcccggggggagatcatcggcgtgaaggtgctgggcatcctggccatgattgatgaaggagaaacagactggaaggtgattgccatcaacgtggatgatcctgatgctgccaactacaatgacatcaatgatgtgaagaggctgaagccaggctacctggaggccaccgtggactggttccgccgctacaaggtgcctgatggcaagccagaaaatgaatttgccttcaatgctgagttcaaggacaaggactttgccatcgacatcatcaagagcacccatgaccactggaaggccctggtgaccaagaagaccaacgggaagggcatcagctgcatgaacaccaccctgtctgagagccccttcaagtgtgaccctgatgctgcccgggccatcgtggatgccctgcccccaccctgtgagagcgcctgcaccgtgcccacagatgtggacaagtggttccaccaccagaagaactag

SEQ ID NO: 19896 - DNA, 2103 bp, Artificial Sequence
  Description of Artificial Sequence: Synthetic coding sequence
atgacagagcgctgcagcctgtggagcgccctgtctgctgctgcctgctgcttctaccggggcagctttgtgcagttcagcaaggagaagtacatcctggacagcagccctgagaagctgcacaaggagctggaggaggagctgaagctgagcagcacagacctgcggagccacgcctggtaccacggccgcatcccccgggaggtgtctgagaccctggtgcagagaaatggagacttcctgatccgggacagcctgaccagcctgggggactatgtgctgacctgccgctggaggaaccaggccctgcacttcaagatcaacaaggtggtggtgaaggccggggagagctacacccacatccagtacctgtttgagcaggagagctttgaccacgtgcctgccctggtgcgctaccacgtgggcagcaggaaggctgtgtctgagcagagcggggccatcatctactgccctgtgaacagaaccttccccctgcgctacctggaggccagctatggcctgggccagggcagcagcaagccagccagccctgtgagccccagcggccccaagggcagccacatgaagagaagatctgtgaccatgacagatggcctgacagctgacaaggtgaccaggagtgatggctgccccaccagcaccagcctgccccggccccgggacagcatccgcagctgtgccctgtccatggaccagatcccagacctgcacagccccatgagccccatcagcgagagccccagcagccctgcctacagcacagtgaccagggtgcatgctgccccagctgcccccagcgccacagccctgcctgccagccctgtggcccggcgcagcagcgagccccagctgtgccccggcagcgcccccaagacccacggggagagtgacaagggcccccacaccagccccagccacaccctgggcaaggccagccccagccccagcctgagcagctacagcgaccctgacagcggccactactgccagctgcagccccctgtgcggggcagccgggagtgggccgccacagagaccagcagccagcaggcccggagctatggagagcggctgaaggagctgtctgaaaatggagcccctgagggggactggggcaagaccttcaccgtgcccatcgtggaggtgaccagcagcttcaacccagccaccttccagagcctgctgatcccccgggacaaccggcccctggaggtgggcctgctgaggaaggtgaaggagctgctggccgaggtggatgcccggaccctggcccggcacgtgaccaaggtggactgcctggtggcccgcatcctgggcgtgaccaaggagatgcagaccctgatgggcgtgcgctggggcatggagctgctgaccctgccccacggccggcagctgcggctggacctgctggagcgcttccacaccatgagcatcatgctggccgtggacatcctgggctgcaccggcagcgctgaggagcgggccgccctgctgcacaagaccatccagctggccgctgagctgcggggcaccatgggcaacatgttctcctttgctgctgtgatgggcgccctggacatggcccagatcagccggctggagcagacctgggtgaccctgcggcagaggcacacagagggcgccatcctgtatgagaagaagctgaagcccttcctgaagagcctgaatgaaggcaaggagggcccccccctgagcaacaccaccttcccccacgtgctgcccctcatcaccctgctggagtgtgacagcgcccctcctgagggccctgagccctggggcagcacagaacatggagtggaggtggtgctggcccacctggaggccgccaggacagtggcccaccacggcggcctgtaccacaccaatgctgaggtgaagctgcagggcttccaggcccggcctgagctgctggaggtgttcagcacagagttccagatgaggctgctgtggggcagccagggcgccagcagcagccaggccaggagatatgagaagtttgacaaggtgctgacagccctgagccacaagctggagcctgctgtgcgcagcagcgagctgtag

SEQ ID NO: 19897 - DNA, 2379 bp, Artificial Sequence
  Description of Artificial Sequence: Synthetic coding sequence
atggccccagccctgcccagcccccacaaggctgtggcccggcctgagctgctgctggacacagctgcccacagcggcaagctgcgggccccagatggaggagagggcgcagaatgtgccggccacaatggaggccccagctggggcgtgggccagggccagagccaggagcccagccggcagggcatcccccaggccccctggctggtgtcctggcagaggcggggcttcccccccagcagcttctgccccggccccctgaggacagagaagctgcgggccggccgctgccccctgctgctgtgtggcggggccgccggggagcctgaggccggcagtgactatgtgaagttcagcaaggagaagtacatcctggacagcagccctgagaagctgcacaaggagctggaggaggagctgaagctgagcagcacagacctgcggagccacgcctggtaccacggccgcatcccccgggaggtgtctgagaccctggtgcagagaaatggagacttcctgatccgggacagcctgaccagcctgggggactatgtgctgacctgccgctggaggaaccaggccctgcacttcaagatcaacaaggtggtggtgaaggccggggagagctacacccacatccagtacctgtttgagcaggagagctttgaccacgtgcctgccctggtgcgctaccacgtgggcagcaggaaggctgtgtctgagcagagcggggccatcatctactgccctgtgaacagaaccttccccctgcgctacctggaggccagctatggcctgggccagggcagcagcaagccagccagccctgtgagccccagcggccccaagggcagccacatgaagagaagatctgtgaccatgacagatggcctgacagctgacaaggtgaccaggagtgatggctgccccaccagcaccagcctgccccggccccgggacagcatccgcagctgtgccctgtccatggaccagatcccagacctgcacagccccatgagccccatcagcgagagccccagcagccctgcctacagcacagtgaccagggtgcatgctgccccagctgcccccagcgccacagccctgcctgccagccctgtggcccggcgcagcagcgagccccagctgtgccccggcagcgcccccaagacccacggggagagtgacaagggcccccacaccagccccagccacaccctgggcaaggccagccccagccccagcctgagcagctacagcgaccctgacagcggccactactgccagctgcagccccctgtgcggggcagccgggagtgggccgccacagagaccagcagccagcaggcccggagctatggagagcggctgaaggagctgtctgaaaatggagcccctgagggggactggggcaagaccttcaccgtgcccatcgtggaggtgaccagcagcttcaacccagccaccttccagagcctgctgatcccccgggacaaccggcccctggaggtgggcctgctgaggaaggtgaaggagctgctggccgaggtggatgcccggaccctggcccggcacgtgaccaaggtggactgcctggtggcccgcatcctgggcgtgaccaaggagatgcagaccctgatgggcgtgcgctggggcatggagctgctgaccctgccccacggccggcagctgcggctggacctgctggagcgcttccacaccatgagcatcatgctggccgtggacatcctgggctgcaccggcagcgctgaggagcgggccgccctgctgcacaagaccatccagctggccgctgagctgcggggcaccatgggcaacatgttctcctttgctgctgtgatgggcgccctggacatggcccagatcagccggctggagcagacctgggtgaccctgcggcagaggcacacagagggcgccatcctgtatgagaagaagctgaagcccttcctgaagagcctgaatgaaggcaaggagggcccccccctgagcaacaccaccttcccccacgtgctgcccctcatcaccctgctggagtgtgacagcgcccctcctgagggccctgagccctggggcagcacagaacatggagtggaggtggtgctggcccacctggaggccgccaggacagtggcccaccacggcggcctgtaccacaccaatgctgaggtgaagctgcagggcttccaggcccggcctgagctgctggaggtgttcagcacagagttccagatgaggctgctgtggggcagccagggcgccagcagcagccaggccaggagatatgagaagtttgacaaggtgctgacagccctgagccacaagctggagcctgctgtgcgcagcagcgagctgtag

SEQ ID NO: 19898 - DNA, 2112 bp, Artificial Sequence
  Description of Artificial Sequence: Synthetic coding sequence
atgacagctgtgggccgccgctgcccagccctgggcagcagaggagctgctggggagcctgaggccggcagtgactatgtgaagttcagcaaggagaagtacatcctggacagcagccctgagaagctgcacaaggagctggaggaggagctgaagctgagcagcacagacctgcggagccacgcctggtaccacggccgcatcccccgggaggtgtctgagaccctggtgcagagaaatggagacttcctgatccgggacagcctgaccagcctgggggactatgtgctgacctgccgctggaggaaccaggccctgcacttcaagatcaacaaggtggtggtgaaggccggggagagctacacccacatccagtacctgtttgagcaggagagctttgaccacgtgcctgccctggtgcgctaccacgtgggcagcaggaaggctgtgtctgagcagagcggggccatcatctactgccctgtgaacagaaccttccccctgcgctacctggaggccagctatggcctgggccagggcagcagcaagccagccagccctgtgagccccagcggccccaagggcagccacatgaagagaagatctgtgaccatgacagatggcctgacagctgacaaggtgaccaggagtgatggctgccccaccagcaccagcctgccccggccccgggacagcatccgcagctgtgccctgtccatggaccagatcccagacctgcacagccccatgagccccatcagcgagagccccagcagccctgcctacagcacagtgaccagggtgcacgccgccccagctgcccccagcgccacagccctgcctgccagccctgtggcccggcgcagcagcgagccccagctgtgccccggcagcgcccccaagacccatggagagagtgacaagggcccccacaccagccccagccacaccctgggcaaggccagccccagccccagcctgagcagctacagcgaccctgattctggccactactgccagctgcagccccctgtgcggggcagccgggagtgggccgccacagagaccagcagccagcaggcccggagctatggagagcggctgaaggagctgtctgaaaatggagcccctgagggggactggggcaagaccttcaccgtgcccatcgtggaggtgaccagcagcttcaacccagccaccttccagagcctgctgatcccccgggacaaccggcccctggaggtgggcctgctgaggaaggtgaaggagctgctggccgaggtggatgcccggaccctggcccggcacgtgaccaaggtggactgcctggtggcccgcatcctgggcgtgaccaaggagatgcagaccctgatgggcgtgcgctggggcatggagctgctgaccctgccccacggccggcagctgcggctggacctgctggagcgcttccacaccatgagcatcatgctggccgtggacatcctgggctgcaccggcagcgctgaggagagagctgccctgctgcacaagaccatccagctggccgctgagctgcggggcaccatgggcaacatgttctcctttgctgctgtgatgggcgccctggacatggcccagatcagccggctggagcagacctgggtgaccctgcggcagaggcacacagaaggagccatcctgtatgagaagaagctgaagcccttcctgaagagcctgaatgaaggcaaggagggcccccccctgagcaacaccaccttcccccacgtgctgcccctcatcaccctgctggagtgtgacagcgcccctcctgagggccctgagccctggggcagcacagagcacggcgtggaggtggtgctggcccacctggaggccgccaggacagtggcccaccacggcggcctgtaccacaccaatgctgaggtgaagctgcagggcttccaggcccggcctgagctgctggaggtgttcagcacagagttccagatgaggctgctgtggggcagccagggcgccagcagcagccaggcccggcgctatgagaagtttgacaaggtgctgacagccctgagccacaagctggagcctgctgtgcgcagcagcgagctgtag

SEQ ID NO: 19899 - DNA, 1869 bp, Artificial Sequence
  Description of Artificial Sequence: Synthetic coding sequence
atggaccagctgccccagaagaacctgctgcggctgcaccctgctggcagcgctggctgcagcactggagtggagagcagctccatggatggcttctggatggaggtggagcagatccagcagagagatgagctgcgggaggaggacagcggcggcaatgaaggccagctgcctgaggagggggaggccgagagccagtggctgcaggacaccggcctgagcggcctgctgggcggcctgggcctggatggagaccaccaggagctgctgagcaccctgacccagacccaggtggccgctgtgtgccggcggctggacatctatgcccggtctgtgcggcggcagcacaagacccctgtgagagatgtgagagatgtgtttggagtcttcaacagcggcaagatgagcagtgaaaatggagacagcggcatgaagggggcccagctgagcagcggggccagcaagtttcctcctgctgctgagcccggcggcctgcaggagcaggccggccgggaggaggccttcaacatggattctgcctacagcgagcaggccgctgtgctgctgcagaggagccggcccagcagaggaggcaccagcgcctggggcaagtgcagcctgcccaagttcaccgtgcccaagggccgcctgggcgtgacccgcatcggggacctgagcctgcaggacatgaggaaggtgcccagcctggccctgattgagctgacagccctgtgtgacatcctgggcctggacctgaagaggagcaaggccggcaagtggaaggctgctgagacccggctgtttggagtgcccctggacagcctgctggaggccgaccacaaggtgctgcccagcacccaggtgcccctggtgctgcaggccctgctgagctgcctggagaagaggggcctggacatggagggcatcctgcgggtgcccggcagccaggcccgggtgaagggcctggagcagaagctggagcgggacttctacgccggcctcttctcctgggatgaggtgcaccacaatgatgccagtgacctgctgaagcgcttcatcaggaagctgcccacccccctgctgacagctgagtacctgcctgcctttgctgtggtgcccaacatccccaacctgaagcagaggctgcaggtgctgcacctgctgatcctgatcctgcctgagcccaacagaaatgccctgaaggccctgctggagttcctgaggaaggtggtggcccgggagcagcacaacaagatgaccctgagaaatgtgtccacagtgatggcccccaacctcttcctgcaccagggccggccccccaagctgcccaagggcaaggagaagcagctggccgagggcgctgctgaggtggtgcagatcatggtgcactaccaggacctgctgtggacagtggccagcttcctggtggcccaggtgaggaagctgaatgacagcagcagccggcggccccagctgtgtgatgctggcctgaagacctggctgcggaggatgcacgccgaccgggacaaggctggagatggcctggaggccacccccaaggtggccaagatccaggtggtgtggcccatcaaggaccccctgaaggtgcccctgacccccagcaccaaggtggcccacgtgctgcggcagttcacagagcacctgagccctggcagcaagggccaggaggacagcgaggacatggacagcctgctgctgcaccaccgctccatggagagcgccaacatcctgctgtatgaggtgggcggcaacatcaatgagcaccggctggaccctgatgcctacctgctggacctgtaccgggccaacccccacggggagtgggtgctgaagcagaaccccacctag

SEQ ID NO: 19900 - DNA, 846 bp, Artificial Sequence
  Description of Artificial Sequence: Synthetic coding sequence
atggccacagagctgcagtgcccagacagcatgccctgccacaaccagcaggtgaacagcgccagcacccccagccctgagcagctgcggcctggggacctgatcctggaccatgctgggggcaacagagccagccgggccaaggtgatcctgctgaccggctacgcccacagcagcctgcctgctgagctggacagcggggcctgtggcggcagcagcctgaacagcgagggcaacagcggcagcggggacagcagcagctatgatgccccagctggcaacagcttcctggaggactgtgagctgagccggcagatcggggcccagctgaagctgctgcccatgaatgaccagatccgggagctgcagaccatcatccgggacaagacagccagcagaggagacttcatgttttctgctgacaggctcatccggctggtggtggaggagggcctgaaccagctgccctacaaggagtgcatggtgaccacccccaccggctacaagtatgagggcgtgaagtttgagaagggcaactgtggggtgtccatcatgaggtctggagaggccatggagcagggcctgcgggactgctgccgcagcatccgcatcggcaagatcctgatccagagtgatgaggagacccagagggccaaggtgtactatgccaagttccccccagacatctacagaaggaaggtgctgctgatgtaccccatcctgagcactggaaacacagtcatcgaggccgtgaaggtgctgattgaacatggagtgcagcccagcgtcatcatcctgctgagcctcttcagcaccccccacggggagttctccatgaggcagtag

SEQ ID NO: 19901 - DNA, 930 bp, Artificial Sequence
  Description of Artificial Sequence: Synthetic coding sequence
atggccacagagctgcagtgcccagacagcatgccctgccacaaccagcaggtgaacagcgccagcacccccagccctgagcagctgcggcctggggacctgatcctggaccatgctgggggcaacagagccagccgggccaaggtgatcctgctgaccggctacgcccacagcagcctgcctgctgagctggacagcggggcctgtggcggcagcagcctgaacagcgagggcaacagcggcagcggggacagcagcagctatgatgccccagctggcaacagcttcctggaggactgtgagctgagccggcagatcggggcccagctgaagctgctgcccatgaatgaccagatccgggagctgcagaccatcatccgggacaagacagccagcagaggagacttcatgttttctgctgacaggctcatccggctggtggtggaggagggcctgaaccagctgccctacaaggagtgcatggtgaccacccccaccggctacaagtatgagggcgtgaagtttgagaagggcaactgtggggtgtccatcatgaggtctggagaggccatggagcagggcctgcgggactgctgccgcagcatccgcatcggcaagatcctgatccagagtgatgaggagacccagagggccaaggtgtactatgccaagttccccccagacatctacagaaggaaggtgctgctgatgtaccccatcctgagcactggaaacacagtcatcgaggccgtgaaggtgctgattgaacatggagtgcagcccagcgtcatcatcctgctgagcctcttcagcaccccccacggggccaagagcatcatccaggagttccctgagatcaccatcctgaccacagaggtgcaccctgtggcccccacccacttcggccagaagtacttcggcacagactag

SEQ ID NO: 19902 - DNA, 633 bp, Artificial Sequence
  Description of Artificial Sequence: Synthetic coding sequence
atggtgtctggcagcgagcagaagttcctgattggcctgggcaagagccagatctacacctgggatggccggcagagcgaccgctggatcaagctggacctgaagacagagctgccccgggacaccctgctgtctgtggagatcgtgcatgagctgaagggggagggcaaggcccagaggaagatcagcgccatccacatcctggatgtgctggtgctgaatggaacagatgtgcgggagcagcacttcaaccagaggatccagctggccgagaagtttgtgaaggctgtgtccaagcccagcaggccagacatgaaccccatccgggtgaaggaggtgtaccgcctggaggagatggagaagatctttgtgcggctggagatgaagatcatcaagggcagcagcggcacccccaagctgagctacacaggaagagatgacagacactttgtgcccatgggcctgtacatcgtgaggacagtgaatgagccctggaccatgggcttcagcaagagcttcaagaagaagttcttctacaacaagaagaccaaggacagcacctttgacctgcctgctgacagcatcgcccccttccacctgcccagcctggcctgcctgagcaagatggactag

SEQ ID NO: 19903 - DNA, 1119 bp, Artificial Sequence
  Description of Artificial Sequence: Synthetic coding sequence
atgaagagaagaacagatcctgagtgcacagcccccatcaagaagcagaagaagagggtggccgagctggccctgagcctgagcagcaccagtgatgatgagccccccagctctgtgtcccatggagccaaggccagcaccaccagcctgagcggcagtgacagcgagacagagggcaagcagcacagcagtgacagctttgatgatgccttcaaggctgacagcctggtggagggcaccagcagccgctacagcatgtacaacagcgtgtcccagaagctgatggccaagatgggcttccgggagggggagggcctgggcaagtacagccagggcaggaaggacatcgtggaggccagcagccagaagggcagaagaggcctgggcctgaccctgcggggctttgaccaggagctgaatgtggactggagagatgagcctgagcccagcgcctgtgagcaggtgtcctggttccctgagtgcaccacagagatcccagacacccaggagatgtctgactggatggtggtgggcaagaggaagatgatcattgaagatgaaacagagttctgtggggaggagctgctgcacagcgtgctgcagtgcaagaagcccctggtgaaggaccgggaggccgagctgctgtactttgctgatgtgtgtgccggccctgggggcttctctgaatatgtgctgtggaggaagaagtggcacgccaagggcttcggcatgaccctgaagggccccaatgacttcaagctggaggacttctacagcgccagcagcgagctgtttgagccctactatggagagggcggcattgatggagatggagacatcaccaggcctgagaacatcagcgccttcaggaactttgtgctggacaacacagacaggaagggcgtgcacttcctgatggctgatggcggcttctctgtggagggccaggagaacctgcaggagatcctgagcaagcagctgctgctgtgccagttcctgatggccctgagcatcgtgaggactggaggccacttcatctgcaagacctttgacctcttcacccccttctctgtgggcctggtgtacctgctgtactgctgctttgagcgggtgtgctag

SEQ ID NO: 19904 - DNA, 615 bp, Artificial Sequence; identical to SEQ ID NO: 19509
  Description of Artificial Sequence: Synthetic coding sequence

SEQ ID NO: 19905 - DNA, 1443 bp, Artificial Sequence
  Description of Artificial Sequence: Synthetic coding sequence
atggccggctacctgtctgagagtgactttgtgatggtggaggagggcttcagcacccgggacctgctgaaggagctgaccctgggcgccagccaggccaccacagatgaggtggccgccttctttgtggccgacctgggcgccatcgtgaggaagcacttctgcttcctgaagtgcctgccccgggtgcggcccttctatgctgtgaagtgcaacagcagccctggggtgctgaaggtgctggcccagctgggcctgggcttcagctgtgccaacaaggccgagatggagctggtgcagcacatcggcatcccagccagcaagatcatctgtgccaacccctgcaagcagatcgcccagatcaagtatgctgccaagcacggcatccagctgctgagctttgacaatgagatggagctggccaaggtggtgaagagccaccccagcgccaagatggtgctgtgcatcgccacagatgacagccacagcctgagctgcctgagcctgaagtttggagtgtccctgaagagctgccgccacctgctggagaatgccaagaagcaccacgtggaggtggtgggcgtgtccttccacatcggcagcggctgcccagacccccaggcctatgcccagagcattgctgatgcccggctggtgtttgagatgggcacagagctgggccacaagatgcacgtgctggacctgggcggcggcttccctggaacagagggcgccaaggtgcgctttgaggagatcgccagcgtcatcaacagcgccctggacctgtacttccctgagggctgcggcgtggacatctttgctgagctgggccgctactacgtgaccagcgccttcaccgtggccgtgtccatcatcgccaagaaggaggtgctgctggaccagcccggccgggaggcccccctgcccccaccccacatcgccacctgtgccgccagcgagcccagccccccagcagaagaaaatggcagcaccagcaagaccatcgtgtaccacctggatgagggcgtgtatggcatcttcaacagcgtgctgtttgacaacatctgccccacccccatcctgcagaagaagcccagcacagagcagcccctgtacagcagcagcctgtggggccctgctgtggatggctgtgactgtgtggccgagggcctgtggctgccccagctgcacgtgggggactggctggtgtttgacaacatgggcgcctacacagtgggcatgggcagccccttctggggcacccaggcctgccacatcacctacgccatgagccgggtggcctgggaggccctgcggcggcagctgatggctgctgagcaggaggatgatgtggagggcgtgtgcaagcccctgagctgtggctgggagatcacagacaccctgtgtgtgggccctgtgttcaccccagccagcatcatgtag

SEQ ID NO: 19906 - DNA, 1383 bp, Artificial Sequence; identical to SEQ ID NO: 18687
  Description of Artificial Sequence: Synthetic coding sequence

SEQ ID NO: 19907 - DNA, 2508 bp, Artificial Sequence
  Description of Artificial Sequence: Synthetic coding sequence
atgaagagaagaacagatcctgagtgcacagcccccatcaagaagcagaagaagagggtggccgagctggccctgagcctgagcagcaccagtgatgatgagccccccagctctgtgtcccatggagccaaggccagcaccaccagcctgagcggcagtgacagcgagacagagggcaagcagcacagcagtgacagctttgatgatgccttcaaggctgacagcctggtggagggcaccagcagccgctacagcatgtacaacagcgtgtcccagaagctgatggccaagatgggcttccgggagggggagggcctgggcaagtacagccagggcaggaaggacatcgtggaggccagcagccagaagggcagaagaggcctgggcctgaccctgcggggctttgaccaggagctgaatgtggactggagagatgagcctgagcccagcgcctgtgagcaggtgtcctggttccctgagtgcaccacagagatcccagacacccaggagatgtctgactggatggtggtgggcaagaggaagatgatcattgaagatgaaacagagttctgtggggaggagctgctgcacagcgtgctgcagtgcaagtctgtgtttgatgtgctggatggagaggagatgagaagagcccggacccgggccaacccctatgagatgatccggggcgtcttcttcctgaacagagctgccatgaagatggccaacatggactttgtgtttgacaggatgttcaccaacccccgggacagctatggcaagcccctggtgaaggaccgggaggccgagctgctgtactttgctgatgtgtgtgccggccctgggggcttctctgaatatgtgctgtggaggaagaagtggcacgccaagggcttcggcatgaccctgaagggccccaatgacttcaagctggaggacttctacagcgccagcagcgagctgtttgagccctactatggagagggcggcattgatggagatggagacatcaccaggcctgagaacatcagcgccttcaggaactttgtgctggacaacacagacaggaagggcgtgcacttcctgatggctgatggcggcttctctgtggagggccaggagaacctgcaggagatcctgagcaagcagctgctgctgtgccagttcctgatggccctgagcatcgtgaggactggaggccacttcatctgcaagacctttgacctcttcacccccttctctgtgggcctggtgtacctgctgtactgctgctttgagcgggtgtgcctcttcaagcccatcaccagcaggcctgccaacagcgagagatatgtggtgtgcaagggcctgaaggtgggcattgatgatgtgcgggactacctgtttgctgtgaacatcaagctgaaccagctgaggaacacagacagtgatgtgaacctggtggtgcccctggaggtgatcaagggggaccacgagttcacagactacatgatccgcagcaatgaaagccactgcagcctgcagatcaaggccctggccaagatccacgcctttgtgcaggacaccaccctgtctgagccccggcaggccgagatcaggaaggagtgcctgcggctgtggggcatcccagaccaggcccgggtggcccccagcagcagtgaccccaagagcaagttctttgagctgatccagggcacagaaattgacatcttctcctacaagcccaccctgctgaccagcaagaccctggagaagatccggcctgtgtttgactaccgctgcatggtgtctggcagcgagcagaagttcctgattggcctgggcaagagccagatctacacctgggatggccggcagagcgaccgctggatcaagctggacctgaagacagagctgccccgggacaccctgctgtctgtggagatcgtgcatgagctgaagggggagggcaaggcccagaggaagatcagcgccatccacatcctggatgtgctggtgctgaatggaacagatgtgcgggagcagcacttcaaccagaggatccagctggccgagaagtttgtgaaggctgtgtccaagcccagcaggccagacatgaaccccatccgggtgaaggaggtgtaccgcctggaggagatggagaagatctttgtgcggctggagatgaagatcatcaagggcagcagcggcacccccaagctgagctacacaggaagagatgacagacactttgtgcccatgggcctgtacatcgtgaggacagtgaatgagccctggaccatgggcttcagcaagagcttcaagaagaagttcttctacaacaagaagaccaaggacagcacctttgacctgcctgctgacagcatcgcccccttccacatctgctactacggccgcctcttctgggagtggggagatggcatccgggtgcatgacagccagaagccccaggaccaggacaagctgagcaaggaggatgtgctgtccttcatccagatgcaccgggcctag

SEQ ID NO: 19908 - DNA, 252 bp, Artificial Sequence
  Description of Artificial Sequence: Synthetic coding sequence
tgacaggagctgctgaaggagaagaccctggccgagcagaacctggaggacacccggcagcagctgctggccgcccggagcagccaggccaaggccatcaacaccctggagaccagggtgcgggagctggagcagaccctgcaggccagcgaggagcagctgcagcagagcaagggcatcgtggccgcccaggagacccagatccaggagctggtgtctgcctactggagctgctgcatccctggcccctag

SEQ ID NO: 19909 - DNA, 2304 bp, Artificial Sequence
  Description of Artificial Sequence: Synthetic coding sequence
atgtttgccaagctgaagaagaagattgctgaggagacagctgtggcccagaggcctggaggagccacccgcatccccaggtctgtgtccaaggagagcgtggcctccatgggcgctgacagcggagatgactttgccagtgatggcagcagcagccgggaggacctgagcagccagctgctgcggagaaatgagcagatcaggaagctggaggcccggctgagtgactatgcagagcaggtgaggaacctgcagaagatcaaggagaagctggagatcgccctggagaagcaccaggacagctccatgaggaagttccaggagcagaatgagaccttccaggccaacagagccaagatggccgagggcctggccctggccctggccaggaaggaccaggagtggagcgagaagatggaccagctggagaaggagaagaacatcctgacagcccagctgcaggagatgaagaaccagagcatgaacctcttccagaggagagatgagatggatgagctggagggcttccagcagcaggagctgagcaagatcaagcacatgctgctgaagaaggaggagagcctgggcaagatggagcaggagctggaggcccggacccgggagctgagcaggacccaggaggagctgatgaacagcaaccagatgagcagtgacctgagccagaagctggaggagctgcagaggcactacagcaccctggaggagcagagggaccacgtgattgccagcaagacaggagctgagagcaagatcacagccctggagcagaaggagcaggagctgcaggccctgatccagcagctgagcattgacctgcagaaggtgacagctgagacccaggagaaggaggatgtgatcacccacctgcaggagaaggtggccagcctggagaagaggctggagcagaacctgagcggggaggagcacctgcaggagctgctgaaggagaagaccctggccgagcagaacctggaggacacccggcagcagctgctggccgcccggagcagccaggccaaggccatcaacaccctggagaccagggtgcgggagctggagcagaccctgcaggccagcgaggagcagctgcagcagagcaagggcatcgtggccgcccaggagacccagatccaggagctggccgccgccaaccaggagagcagccacgtgcagcagcaggccctggccctggagcagcagttcctggagaggacccaggccctggaggcccagatcgtggccctggagaggaccagggctgctgaccagaccacagctgagcagggcatgaggcagctggagcaggagaatgctgccctgaaggaatgtagaaatgaatatgaaagaagcctgcagaaccaccagtttgagctgaagaagctgaaggaggagtggagccagcgggagatcgtgtctgtggccatggcccaggccctggaggaggtgaggaagcagcgggaggagttccagcagcaggccgccaacctgacagccatcattgatgagaaggagcagaacctgcgggagaagacagaggtgctgctgcagaaggagcaggagatcctgcagctggagcggggccacaacagcgccctgctgcagatccaccagctgcaggccgagctggaggccctgcggaccctgaaggccgaggaggccgctgtggtggccgagcaggaggacctgctgcggctgcggggccccctgcaggccgaggccctgtctgtgaatgaaagccacgtgaccagccgggccatgcaggaccccgtcttccagctgcccacagctggccgcacccccaacggggaggtgggcgccatggacctgacccagctgcagaaggagaagcaggacctggagcagcagctgctggagaagaacaagaccatcaagcagatgcagcagaggatgctggagctgaggaagaccctgcagaaggagctgaagatccggccagacaatgagctgtttgaggtgcgggagaagccaggccctgagatggccaacatggcccccagcgtgaccaacaacacagacctgacagatgcccgggagatcaactttgagtacctgaagcacgtggtgctgaagttcatgagctgccgggagagcgaggccttccacctgatcaaggctgtgtctgtgctgctgaacttcagccaggaggaggagaacatgctgaaggagaccctggagtacaagatgtcctggtttggcagcaagccagcccccaagggcagcatccggcccagcatcagcaacccccgcatcccctggagctag

SEQ ID NO: 19910 - DNA, 291 bp, Artificial Sequence
  Description of Artificial Sequence: Synthetic coding sequence
tgagccaagatcaaggcccgggacctgcggggcaagaagaaggaggagctgctgaagcagctggatgacctgaaggtggagctgagccagctgcgggtggccaaggtgactggaggagctgccagcaagctgagcaagatccgggtggtgaggaagagcatcgcccgggtgctgaccgtcatcaaccagacccagaaggagaacctgaggaagttctacaaggctgctgctgggggcccctgcatccagatggacagagtgctgccccagcccccagcctgcagctgctag

SEQ ID NO: 19911 - DNA, 1035 bp, Artificial Sequence
  Description of Artificial Sequence: Synthetic coding sequence
atgagaagaagaagagaggaggagggcatccagctgaggaagcagaagcgggagcagcagctgttcaagagaagaaatgtggagctgatcaatgaggaggccgccatgtttgacagcctgctgatggacagctatgtgagcagcaccaccggggagagcgtcatcacccgggagatggtggagatgctgttcagtgatgacagcgacctgcagctggccaccacccagaagttcaggaagctgctgagcaaggagcccagcccccccattgatgaagtcatcaacaccccccgggtggtggacagatttgtggagttcctgaagagaaatgaaaactgcaccctgcaggccgtgtgggccctgggcaacattgctggggacagctctgtgtgccgggactatgtgctgaactgcagcatcctgaaccccctgctgaccctgctgaccaagagcacccggctgaccatgaccagaaatgctgtgtgggccctgagcaacctgtgccggggcaagaaccccccacctgagtttgccaaggtgagcccctgcctgcctgtgctgagccggctgctcttcagcagtgacagcgacctgctggctgatgcctgctgggccctgagctacctgagtgatggccccaatgagaagatccaggccgtgattgattctggagtgtgccggcggctggtggagctgctgatgcacaatgactacaaggtggccagccctgccctgcgggctgtgggcaacatcgtgactggagatgacatccagacccaggtgatcctgaactgcagcgccctgccctgcctgctgcacctgctgagcagccccaaggagagcatcaggaaggaggcctgctggaccatcagcaacatcacagctggcaacagagcccagatccaggccgtgattgatgccaacatcttccctgtgctgattgagatcctgcagaaggccgagttccgcaccaggaaggaggccgcctgggccatcaccaatgccaccagcggcggcaccccagagcagatctag

SEQ ID NO: 19912 - DNA, 582 bp, Artificial Sequence; identical to SEQ ID NO: 18345
  Description of Artificial Sequence: Synthetic coding sequence

SEQ ID NO: 19913 - DNA, 1611 bp, Artificial Sequence
  Description of Artificial Sequence: Synthetic coding sequence
atggagaccatggccagccctgggaaggacaactacaggatgaagagctacaagaacaatgccctgaaccctgaggagatgagaagaagaagagaggaggagggcatccagctgaggaagcagaagcgggagcagcagctgttcaagagaagaaatgtggagctgatcaatgaggaggccgccatgtttgacagcctgctgatggacagctatgtgagcagcaccaccggggagagcgtcatcacccgggagatggtggagatgctgttcagtgatgacagcgacctgcagctggccaccacccagaagttcaggaagctgctgagcaaggagcccagcccccccattgatgaagtcatcaacaccccccgggtggtggacagatttgtggagttcctgaagagaaatgaaaactgcaccctgcagtttgaagctgcctgggccctgaccaacatcgccagcggcaccagccagcagaccaagatcgtcatcgaggccggggctgtgcccatcttcatcgagctgctgaacagcgactttgaagatgtgcaggagcaggccgtgtgggccctgggcaacattgctggggacagctctgtgtgccgggactatgtgctgaactgcagcatcctgaaccccctgctgaccctgctgaccaagagcacccggctgaccatgaccagaaatgctgtgtgggccctgagcaacctgtgccggggcaagaaccccccacctgagtttgccaaggtgagcccctgcctgcctgtgctgagccggctgctcttcagcagtgacagcgacctgctggctgatgcctgctgggccctgagctacctgagtgatggccccaatgagaagatccaggccgtgattgattctggagtgtgccggcggctggtggagctgctgatgcacaatgactacaaggtggccagccctgccctgcgggctgtgggcaacatcgtgactggagatgacatccagacccaggtgatcctgaactgcagcgccctgccctgcctgctgcacctgctgagcagccccaaggagagcatcaggaaggaggcctgctggaccatcagcaacatcacagctggcaacagagcccagatccaggccgtgattgatgccaacatcttccctgtgctgattgagatcctgcagaaggccgagttccgcaccaggaaggaggccgcctgggccatcaccaatgccaccagcggcggcaccccagagcagatccgctacctggtgtccctgggctgcatcaagcccctgtgtgacctgctgactgtgatggacagcaagatcgtgcaggtggccctgaatggcctggagaacatcctgcggctgggggagcaggagggcaagaggagcggcagcggcgtgaacccctactgcggcctcatcgaggaggcctacggcctggacaagattgagttcctgcagagccatgagaaccaggagatctaccagaaggcctttgacctgattgagcactactttggagtggaggatgatgacagcagcctggccccccaggtggatgagacccagcagcagttcatcttccagcagcctgaggcccccatggagggcttccagctgtag

SEQ ID NO: 19914 - DNA, 2769 bp, Artificial Sequence
  Description of Artificial Sequence: Synthetic coding sequence
atgatcaccagcgctgctggcatcatcagcctgctggatgaagatgagccccagctgaaggagtttgccctgcacaagctgaatgctgtggtgaatgacttctgggccgagatcagcgagagcgtggacaagattgaggtgctgtatgaagatgagggcttccgcagccggcagtttgctgccctggtggccagcaaggtgttctaccacctgggcgcctttgaggagagcctgaactatgccctgggcgctggggacctcttcaacgtgaatgacaacagtgaatatgtggagaccatcatcgccaagtgcatcgaccactacaccaagcagtgtgtggagaatgctgacctgcctgagggggagaagaagcccatcgaccagaggctggagggcatcgtgaacaagatgttccagcgctgcctggatgaccacaagtacaagcaggccatcggcatcgccctggagacccggcggctggatgtgtttgagaagaccatcctggagagcaatgatgtgcccggcatgctggcctacagcctgaagctgtgcatgagcctgatgcagaacaagcagttcaggaacaaggtgctgcgggtgctggtgaagatctacatgaacctggagaagccagacttcatcaacgtgtgccagtgcctgatcttcctggatgacccccaggccgtgtctgacatcctggagaagctggtgaaggaggacaacctgctgatggcctaccagatctgctttgacctgtatgaaagtgccagccagcagttcctgagcagcgtcatccagaacctgaggacagtgggcacccccatcgcctctgtgcccggcagcaccaacacaggcaccgtgcccggcagcgagaaggacagcgacagcatggagacagaggagaagaccagcagcgcctttgtgggcaagaccccagaggccagccctgagcccaaggaccagaccctgaagatgatcaagatcctgagcggggagatggccatcgagctgcacctgcagttcctgatccggaacaacaacacagacctgatgatcctgaagaacaccaaggatgctgtgagaaattctgtgtgccacacagccaccgtgattgccaacagcttcatgcactgcggcaccaccagtgaccagttcctgcgggacaacctggagtggctggcccgggccaccaactgggccaagttcaccgccacagccagcctgggcgtcatccacaagggccacgagaaggaggccctgcagctgatggccacctacctgcccaaggacaccagccctggcagcgcctaccaggagggcggcggcctgtatgccctgggcctcatccacgccaaccacggcggggacatcatcgactacctgctgaaccagctgaagaatgccagcaatgacatcgtgagacatggaggcagcctgggcctgggcctggccgccatgggcacagcccggcaggatgtgtatgacctgctgaagaccaacctgtaccaggatgatgctgtgactggagaggccgccggcctggccctgggcctggtgatgctgggcagcaagaatgcccaggccatcgaggacatggtgggctacgcccaggagacccagcacgagaagatcctgcggggcctggccgtgggcatcgccctggtgatgtatggccgcatggaggaggctgatgccctgattgagagcctgtgccgggacaaggaccccatcctgcggcgcagcggcatgtacacagtggccatggcctactgcggcagcggcaacaacaaggccatccggcggctgctgcacgtggccgtgtctgatgtgaatgatgatgtgagaagagctgctgtggagagcctgggcttcatcctcttccgcaccccagagcagtgccccagcgtggtgtccctgctgtctgagagctacaacccccacgtgcgctacggggccgccatggccctgggcatctgctgtgccggcactggaaacaaggaggccatcaacctgctggagcccatgaccaatgaccctgtgaactacgtgcggcagggcgccctgattgccagcgccctgatcatgatccagcagacagagatcacctgccccaaggtgaaccagttccggcagctgtacagcaaggtgatcaatgacaagcatgatgatgtgatggccaagtttggagccatcctggcccagggcatcctggatgctgggggccacaacgtgaccatcagcctgcagagcaggacaggccacacccacatgcccagcgtggtgggcgtgctggtgttcacccagttctggttctggttccccctgagccacttcctgagcctggcctacacccccacctgtgtgattggcctgaacaaggacctgaaggtgtccacagctgtgctgagcatcacagccaaggccaagaagaaggagaaggagaaggagaagaaggaggaggagaagatggaggtggatgaggccgagaagaaggaggagaaggagaagaagaaggagcctgagcccaacttccagctgctggacaacccagcccgggtgatgcctgcccagctgaaggtgctgaccatgcctgagacctgccgctaccagcccttcaagcccctgagcattggaggcatcatcatcctgaaggacaccagcgaggacatcgaggagctggtggagcctgtggccgcccacggccccaagattgaggaggaggagcaggagcctgagcccccagagccctttgagtacattgatgactag

SEQ ID NO: 19915 - DNA, 1227 bp, Artificial Sequence
  Description of Artificial Sequence: Synthetic coding sequence
atgcctgaggagcaggccttctctgtgctggtgaagatcatgtttgattatggcctgcgggagctgttcaagcagaactttgaggacctgcactgcaagttctaccagctggagcggctgatgcaggagtacatcccagacctgtacaaccacttcctggacatcagcctggaggcccacatgtatgccagccagtggttcctgaccctcttcaccgccaagttccccctgtacatggtgttccacatcatcgacctgctgctgtgtgagggcatcagcgtcatcttcaacgtggccctgggcctgctgaagaccagcaaggatgacctgctgctgacagactttgaaggagccctgaagttcttccgggtgcagctgcccaagcgctacagaagtgaggagaatgccaagaagctgatggagctggcctgcaacatgaagatcagccagaagaagctgaagaagtatgagaaggagtaccacaccatgagggagcagcaggcccagcaggaggaccccatcgagagatttgagcgggagaacagaaggctgcaggaggccaacatgaggctggagcaggagaatgatgacctggcccacgagctggtgaccagcaagatcgccctgaggaaggacctggacaatgctgaggagaaggcagatgccctgaacaaggagctgctgatgaccaagcagaagctgattgatgctgaggaggagaagaggcggctggaggaggagagcgcccagctgaaggagatgtgccggcgggagctggacaaggccgagagcgagatcaagaagaacagcagcatcattggagactacaagcagatctgcagccagctgtctgagcggctggagaagcagcagacagccaacaaggtggagattgagaagatccggcagaaggtggatgactgtgagcgctgccgggagttcttcaacaaggagggccgggtgaagggcatcagcagcaccaaggaggtgctggatgaggacacagatgaggagaaggagaccctgaagaaccagctgcgggagatggagctggagctggcccagaccaagctgcagctggtggaggccgagtgcaagatccaggacctggagcaccacctgggcctggccctgaatgaggtgcaggccgccaagaagacctggttcaacagaaccctgagcagcatcaagacagccaccggggtgcagggcaaggagacctgctag

SEQ ID NO: 19916 - DNA, 3210 bp, Artificial Sequence
  Description of Artificial Sequence: Synthetic coding sequence
atggatgacaaggcctctgtgggcaagatctctgtgtccagtgacagcgtgtccaccctgaacagtgaagattttgtgctggtgtcccggcagggagatgagacccccagcaccaacaacggcagtgatgatgagaagacaggcctgaagatcgtgggcaatggcagcgagcagcagctgcagaaggagctggctgatgtgctgatggacccccccatggatgaccagcctggagagaaggagctggtgaagaggagccagctggatggagaaggagatggccccctgagcaaccagctgagcgccagcagcaccatcaaccctgtgcccctggtgggcctgcagaagccagagatgagcctgcctgtgaagccaggccagggcgacagcgaggccagcagccccttcacccctgtggctgatgaggacagcgtggtgttcagcaagctgacctacctgggctgtgcctctgtgaatgcccccaggtctgaggtggaggccctgaggatgatgagcatcctgcggagccagtgccagatcagcctggatgtgaccctgtctgtgcccaacgtgtctgagggcatcgtgcggctgctggacccccagaccaacacagaaattgccaactaccccatctacaagatcctcttctgtgtgcggggccatgatggcaccccagagagtgactgctttgccttcacagagagccactacaatgctgagctgttccgcatccacgtgttccgctgtgagatccaggaggccgtgagccgcatcctgtacagctttgccacagccttccgccgcagcgccaagcagacccccctgagcgccacagctgccccccagaccccagacagcgacatcttcaccttctctgtgtccctggagatcaaggaggatgatggcaagggctacttctctgctgtgcccaaggacaaggaccggcagtgcttcaagctgcggcagggcatcgacaagaagatcgtcatctacgtgcagcagaccaccaacaaggagctggccatcgagcgctgcttcggcctgctgctgagccctgggaaggatgtgaggaacagcgacatgcacctgctggacctggagagcatgggcaagagcagtgatggcaagagctatgtgatcaccggctcctggaaccccaagagcccccacttccaggtggtgaatgaggagacccccaaggacaaggtgctcttcatgaccacagctgtggacctggtgatcacagaggtgcaggagcctgtgcgcttcctgctggagaccaaggtgcgggtgtgcagccccaatgaaagactcttctggcccttcagcaagaggagcaccacagagaacttcttcctgaagctgaagcagatcaagcagcgggagaggaagaacaacacagacaccctgtatgaggtggtgtgcctggagagcgagagcgagcgggagaggaggaagaccacagccagccccagcgtgcggctgccccagagcggcagccagagcagcgtcatccccagccccccagaagatgatgaggaggaggacaatgatgagcccctgctgagcggcagcggagatgtgtccaaagaatgtgccgagaagatcctggagacctggggcgagctgctgagcaagtggcacctgaacctgaatgtgcggcccaagcagctgagcagcctggtgagaaatggagtgcctgaggccctgcggggggaggtgtggcagctgctggccggctgccacaacaatgaccacctggtggagaagtaccgcatcctgatcaccaaggagagcccccaggacagcgccatcacccgggacatcaacagaaccttccctgcccatgactacttcaaggacacaggaggagatggccaggacagcctgtacaagatctgcaaggcctacagcgtgtatgatgaggagatcggctactgccagggccagagcttcctggccgctgtgctgctgctgcacatgcctgaggagcaggccttctctgtgctggtgaagatcatgtttgattatggcctgcgggagctgttcaagcagaactttgaggacctgcactgcaagttctaccagctggagcggctgatgcaggagtacatcccagacctgtacaaccacttcctggacatcagcctggaggcccacatgtatgccagccagtggttcctgaccctcttcaccgccaagttccccctgtacatggtgttccacatcatcgacctgctgctgtgtgagggcatcagcgtcatcttcaacgtggccctgggcctgctgaagaccagcaaggatgacctgctgctgacagactttgagggcgccctgaagttcttccgggtgcagctgcccaagcgctacagaagtgaagaaaatgccaagaagctgatggagctggcctgcaacatgaagatcagccagaagaagctgaagaagtatgagaaggagtaccacaccatgagggagcagcaggcccagcaggaggaccccatcgagagatttgaaagagaaaatagaaggctgcaggaggccaacatgaggctggagcaggagaatgatgacctggcccacgagctggtgaccagcaagatcgccctgaggaaggacctggacaatgctgaggagaaggcagatgccctgaacaaggagctgctgatgaccaagcagaagctgattgatgctgaggaggagaagaggcggctggaggaggagagcgcccagctgaaggagatgtgcagaagagagctggacaaggccgagagcgagatcaagaagaacagcagcatcatcggggactacaagcagatctgcagccagctgtctgagcggctggagaagcagcagacagccaacaaggtggagattgagaagatccggcagaaggtggatgactgtgagcgctgccgggagttcttcaacaaggagggccgggtgaagggcatcagcagcaccaaggaggtgctggatgaggacacagatgaggagaaggagaccctgaagaaccagctgcgggagatggagctggagctggcccagaccaagctgcagctggtggaggccgagtgcaagatccaggacctggagcaccacctgggcctggccctgaatgaggtgcaggccgccaagaagacctggttcaacagaaccctgagcagcatcaagacagccactggagtgcagggcaaggagacctgctag

SEQ ID NO: 19917 - DNA, 2808 bp, Artificial Sequence
  Description of Artificial Sequence: Synthetic coding sequence
atgcagaggaagctggtgaccctggtgaactgccagctggtggaggaggagggccgggtgcgggccatgagagctgcccggagcctgggggagaggacagtgacagagctgatcctgcagcaccagaacccccagcagctgagcgccaacctgtgggccgctgtgcgggcccggggctgccagttcctgggccctgccatgcaggaggaggccctgaagctggtgctgctggccctggaggatggcagcgccctgagcaggaaggtgctggtgctgtttgtggtgcagaggctggagccccgcttcccccaggccagcaagaccagcatcggccacgtggtgcagctgctgtaccgggccagctgcttcaaggtgaccaagagagatgaggacagcagcctgatgcagctgaaggaggagttccgctcctatgaggccctgcggcgggagcatgatgcccagatcgtgcacatcgccatggaggccggcctgcgcatcagccctgagcagtggagcagcctgctgtatggagacctggcccacaagagccacatgcagagcatcatcgacaagctgcagagccctgagagctttgccaagtctgtgcaggagctgaccatcgtgctgcagaggactggagaccctgccaacctgaaccggctgcggccccacctggagctgctggccaacatcgaccccaacccagatgctgtgagccccacctgggagcagctggagaatgccatggtggccgtgaagacagtggtgcacggcctggtggacttcatccagaactacagcaggaaaggacatgagaccccccagccccagcccaacagcaagtacaagacctccatgtgccgggacctgcggcagcagggcggctgcccccggggcaccaactgcacctttgcccacagccaggaggagctggagaagtaccgcctgaggaacaagaagatcaatgccaccgtgaggaccttccccctgctgaacaaggtgggcgtgaacaacacagtgaccaccacagctggaaatgtcatctctgtgattggcagcacagagaccaccgggaagatcgtgcccagcaccaacggcatcagcaatgcagaaaattctgtgtcccagctgatcagccgcagcacagacagcaccctgcgggccctggagaccgtgaagaaggtgggcaaggtgggcgccaacggccagaatgctgctggccccagcgctgacagcgtgacagagaacaagattggcagcccccccaagacccctgtgtccaatgtggccgccaccagcgctggccccagcaatgtgggcacagagctgaacagcgtgccccagaagagcagccccttcctgaccagggtgcctgtgtacccaccccacagcgagaacatccagtacttccaggaccccaggacccagatcccctttgaggtgccccagtacccccagacaggctactacccacctccacccaccgtgcctgctggggtggccccctgtgtgcccaggtttgtgcgcagcaacaacgtgcctgagagcagcctgcccccagcctccatgccctatgctgaccactacagcaccttcagcccccgggacaggatgaacagcagcccctaccagcccccaccaccccagccctacggccctgtgccccctgtgcccagcggcatgtatgcccctgtgtatgacagccgccgcatctggaggcctcccatgtaccagagagatgacatcatccgcagcaacagcctgccccccatggatgtgatgcacagctctgtgtaccagaccagcctgcgggagcgctacaacagcctggatggctactacagcgtggcctgccagccccccagcgagcccaggaccaccgtgcccctgccccgggagccctgtggccacctgaagaccagctgtgaggagcagatccggaggaagccagaccagtgggcccagtaccacacccagaaggcccccctggtgagcagcaccctgcctgtggccacccagagccccaccccacccagccccctcttctctgtggacttccgggctgacttcagcgagagcgtgtctggcaccaagtttgaggaggaccacctgagccactacagcccctggagctgtggcaccatcggcagctgcatcaatgccatcgacagcgagcccaaggatgtgattgccaacagcaatgctgtgctgatggacctggacagcggagatgtgaagagaagagtgcacctgtttgagacccagaggaggaccaaggaggaggaccccatcatccccttcagtgatggccccatcatcagcaagtggggcgccatcagccgcagcagcaggacaggctaccacaccacagatcctgtgcaggccacagccagccagggcagcgccaccaagcccatctctgtgtctgactatgtgccctacgtgaatgctgtggacagccgctggagcagctatggaaatgaggccaccagcagcgcccactacgtggagcgggaccgcttcatcgtgacagacctgagcggccacaggaagcacagcagcactggagacctgctgagcctggagctgcagcaggccaagagcaacagcctgctgctgcagcgggaggccaatgccctggccatgcagcagaagtggaacagcctggatgagggccgccacctgaccctgaacctgctgagcaaggagattgagctgagaaatggagaggtgaagaagctgaacctgagcgccagctgcctgatgtacctgttctctgctgctgcctcctggctgtaccactactag

SEQ ID NO: 19918 - DNA, 1437 bp, Artificial Sequence
  Description of Artificial Sequence: Synthetic coding sequence
atgcctgtgcaggccgcccagtggacagagttcctgagctgccccatctgctacaatgaatttgatgaaaatgtgcacaagcccatcagcctgggctgcagccacacagtgtgcaagacctgcctgaacaagctgcacaggaaggcctgcccctttgaccagacagccatcaacacagacattgatgtgctgcctgtgaactttgccctgctgcagctggtgggcgcccaggtgcctgaccaccagagcatcaagctgagcaacctgggggagaacaagcactatgaggtggccaagaagtgtgtggaggacctggccctgtacctgaagcccctgagcggcggcaagggcgtggccagcctgaaccagagcgccctgagccggcccatgcagaggaagctggtgaccctggtgaactgccagctggtggaggaggagggccgggtgcgggccatgagagctgcccggagcctgggggagaggacagtgacagagctgatcctgcagcaccagaacccccagcagctgagcgccaacctgtgggccgctgtgcgggcccggggctgccagttcctgggccctgccatgcaggaggaggccctgaagctggtgctgctggccctggaggatggcagcgccctgagcaggaaggtgctggtgctgtttgtggtgcagaggctggagccccgcttcccccaggccagcaagaccagcattggacatgtggtgcagctgctgtaccgggccagctgcttcaaggtgaccaagagagatgaggacagcagcctgatgcagctgaaggaggagttccgctcctatgaggccctgcggcgggagcatgatgcccagatcgtgcacatcgccatggaggccggcctgcgcatcagccctgagcagtggagcagcctgctgtatggagacctggcccacaagagccacatgcagagcatcatcgacaagctgcagagccctgagagctttgccaagtctgtgcaggagctgaccatcgtgctgcagaggactggagaccctgccaacctgaaccggctgcggccccacctggagctgctggccaacatcgaccccaacccagatgctgtgagccccacctgggagcagctggagaatgccatggtggccgtgaagacagtggtgcacggcctggtggacttcatccagaactacagcaggaagggccacgagaccccccagccccagcccaacagcaagtacaagacctccatgtgccgggacctgcggcagcagggcggctgcccccggggcaccaactgcacctttgcccacagccaggaggagctggagaagtaccgcctgaggaacaagaagatcaatgccacagaggtgctgaagcagcagggcaagctgttccaggtgcagacagagttccagatgcagaagacagtgttccccagctag

SEQ ID NO: 19919 - DNA, 3576 bp, Artificial Sequence; identical to SEQ ID NO: 19472
  Description of Artificial Sequence: Synthetic coding sequence

SEQ ID NO: 19920 - DNA, 1569 bp, Artificial Sequence
  Description of Artificial Sequence: Synthetic coding sequence
atggccgccagcgccaagaggaagcaggaggagaagcacctgaagatgctgcgggacatgacaggcctgccccacaacaggaagtgctttgactgtgaccagaggggccccacctacgtgaacatgacagtgggcagctttgtgtgcaccagctgcagcggcagcctgcggggcctgaaccccccccaccgggtgaagagcatctccatgaccaccttcacccagcaggagattgagttcctgcagaagcacggcaatgaggtgtgcaagcagatctggctgggcctgtttgatgacaggagcagcgccatcccagacttccgggacccccagaaggtgaaggagttcctgcaggagaagtatgagaagaagcgctggtacgtgcccccagagcaggccaaggtggtggcctctgtgcacgccagcatcagcggcagcagcgccagcagcaccagcagcaccccagaggtgaagcccctgaagagcctgctgggggacagcgcccccaccctgcacctgaacaagggcacccccagccagagccctgtggtgggccgcagccagggccagcagcaggagaagaagcagtttgacctgctgagtgacctgggcagtgacatctttgctgccccagccccccagagcacagccacagccaactttgccaactttgcccacttcaacagccatgctgggggcagcgctgcctctgtgaatgccaactttgcccactttgacaacttccccaagagcagcagcgctgactttggcaccttcaacaccagccagagccaccagacagccagcgctgtgtccaaggtgtccaccaacaaggccggcctgcagacagctgacaagtatgctgccctggccaacctggacaacatcttctctgctggccagggcggggaccagggcagcggcttcggcaccaccgggaaggcccctgtgggctctgtggtgtctgtgcccagccagagcagcgccagcagtgacaagtatgctgccctggccgagctggacagcgtcttcagcagcgctgccaccagcagcaatgcctacaccagcaccagcaatgccagcagcaatgtgtttggaacagtgcctgtggtggccagcgcccagacccagcctgccagcagctctgtgcctgccccctttggagccacccccagcaccaacccctttgtggccgccgccggccccagcgtggccagcagcaccaaccccttccagaccaatgcccggggggccacagctgccacctttggaacagcctccatgtccatgcccaccggcttcggcaccccagccccctacagcctgcccaccagcttcagcggcagcttccagcagcctgccttccctgcccaggccgccttcccccagcagacagccttcagccagcagcccaacggggccggctttgctgccttcggccagaccaagcctgtggtgaccccatttggccaggtggccgctgctggggtgagcagcaaccccttcatgaccggggcccccaccggccagttccccaccggcagcagcagcaccaaccccttcctgtag

SEQ ID NO: 19921 - DNA, 1524 bp, Artificial Sequence
  Description of Artificial Sequence: Synthetic coding sequence
atgcaggatgacagcattgaggccagcaccagcatcagccagctgctgcgggagagctacctggccgagaccaggcaccggggcaacaatgaaagaagcagagctgagcccagcagcaacccctgccacttcggcagccccagcggggctgctgagggcggcggcggccaggatgacctgcctgacctgagcgccttcctgagccaggaggagctggatgaatctgtgaacctggcccggctggccatcaactatgaccccctggagaaggcagatgagacccaggccaggaagaggctgagcccagaccagatgaagcacagccccaacctgagctttgagcccaacttctgccaggacaaccccaggagccccaccagcagcaaggagagcccccaggaggccaagaggccccagtactgcagcgagacccagagcaagaaggtgttcctgaacaaggctgctgacttcatcgaggagctgagcagcctcttcaagagccacagcagcaagaggatccggccccgggcctgcaagaaccacaagagcaagctggagagccagaacaaggtgatgcaggagaacagcagcagcttcagtgacctgtctgaaagaagagagaggagctctgtgcccatccccatcccagctgacacccgggacaatgaggtgaaccacgccctggagcagcaggaggccaagagaagagaggccgagcaggccgccagcgaggccgccggcggggacaccaccccaggcagcagccccagcagcctgtactatgaggagcccctgggccagcccccacgcttcacccagaagctgcggagccgggaggtgcctgagggcaccagggtgcagctggactgcatcgtggtgggcatccccccaccccaggtgcgctggtactgtgagggcaaggagctggagaacagcccagacatccacatcgtgcaggccggcaacctgcacagcctgaccatcgccgaggcctttgaggaggacaccggccgctacagctgctttgccagcaacatctatggaacagacagcaccagcgctgagatctacatcgagggcgtgagcagcagtgacagcgagggggaccccaacaaggaggagatgaaccgcatccagaagcccaatgaggtgagcagcccccccaccaccagcgctgtgattcctcctgctgtgccccaggcccagcacctggtggcccagccccgggtggccaccatccagcagtgccagagccccaccaactacctgcagggcctggatggcaagcccatcatcgccgcccctgtgttcaccaagatgctgcagaacctgagcgccagcgagggccagctggtggtgtttgaatgtcgggtgaagggggcccccagccccaaggtggagtggtaccgggagggcaccctgattgaggacagcccagacttccgcatcctgcagaagaagcccaggtccatggccgagcccgggaaggatgacttcaacttcaacctgctggtgtatgaatag

SEQ ID NO: 19922 - DNA, 3150 bp, Artificial Sequence
  Description of Artificial Sequence: Synthetic coding sequence
atgctgtgctggggcaatgccagctttggccagctgggcctgggcggcattgatgaggagatcgtgctggagcccaggaagagtgacttcttcatcaacaagagggtgagagatgtgggctgcggcctgcggcacacagtgtttgtgctggatgatggcaccgtgtacacctgtggctgcaatgacctgggccagctgggccacgagaagagcaggaagaagccagagcaggtggtggccctggatgcccagaacatcgtggccgtgtcctgtggggaggcccacaccctggccctgaatgacaagggccaggtgtatgcctggggcctggacagtgatggccagctgggcctggtgggcagcgaggagtgcatccgggtgcccaggaacatcaagagcctgagtgacatccagatcgtgcaggtggcctgtggctactaccacagcctggccctgagcaaggccagcgaggtgttctgctggggccagaacaagtatggccagctgggcctgggcacagactgcaagaagcagaccagcccccagctgctgaagagcctgctgggcatccccttcatgcaggtggccgccggcggggcccacagctttgtgctgaccctgagcggggccatcttcggctggggcaggaacaagtttggccagctgggcctgaatgatgaaaatgacagatatgtgcccaacctgctgaagagcctgcggagccagaagatcgtgtacatctgctgcggggaggaccacacagctgccctgaccaaggagggcggcgtcttcaccttcggggccggcggctacggccagctgggccacaacagcaccagccatgagatcaaccccaggaaggtgtttgagctgatgggcagcatcgtgacagaaattgcctgtggccggcagcacaccagcgcctttgtgcccagcagcggccgcatctacagctttggcctgggcggcaatggccagctgggcaccggcagcaccagcaacaggaagagccccttcaccgtgaagggcaactggtacccctacaacggccagtgcctgcctgacatcgacagcgaggagtacttctgtgtgaagaggatcttctctggaggagaccagagcttcagccactacagcagcccccagaactgtggccccccagatgacttccgctgccccaaccccaccaagcagatctggacagtgaatgaggccctgatccagaagtggctgagctaccccagcggccgcttccctgtggagatcgccaatgaaattgatggcaccttcagcagcagcggctgcctgaatggcagcttcctggccgtgtccaatgatgaccactacagaacaggcacccgcttcagcggcgtggacatgaatgctgcccggctgctcttccacaagctgatccagcctgaccacccccagatcagccagcaggtggccgccagcctggagaagaacctgatccccaagctgaccagcagcctgcctgatgtggaggccctgcgcttctacctgaccctgcctgagtgccccctgatgtctgacagcaacaacttcaccaccatcgccatcccctttggaacagccctggtgaacctggagaaggcccccctgaaggtgctggagaactggtggagcgtgctggagcccccactcttcctgaagatcgtggagctgttcaaggaggtggtggtgcacctgctgaagctgtacaagattggcatccccccatctgaaagacgcatcttcaacagcttcctgcacacagccctgaaggtgctggagatcctgcaccgggtgaatgagaagatgggccagatcatccagtatgacaagttctacatccacgaggtgcaggagctgattgacatcagaaatgactacatcaactgggtgcagcagcaggcctacggcatgctggccgacatccctgtgaccatctgcacctacccctttgtgtttgatgcccaggccaagaccaccctgctgcagacagatgctgtgctgcagatgcagatggccatcgaccaggcccaccggcagaatgtgagcagcctcttcctgcccgtcatcgagagcgtgaacccctgcctgatcctggtggtgcggcgggagaacatcgtgggagatgccatggaggtgctgaggaagaccaagaacatcgactacaagaagcccctgaaggtgatctttgtgggagaagatgctgtggatgctgggggcgtgaggaaggagttcttcctgctgatcatgagggagctgctggaccccaagtatggcatgttccgctactatgaggacagccgcctcatctggttcagtgacaagacctttgaggacagcgacctcttccacctgattggagtcatctgtggcctggccatctacaactgcaccatcgtggacctgcacttccccctggccctgtacaagaagctgctgaagaagaagcccagcctggatgacctgaaggagctgatgccagatgtgggccgctccatgcagcagctgctggactacccagaagatgacatcgaggagaccttctgcctgaacttcaccatcaccgtggagaactttggagccacagaggtgaaggagctggtgctgaatggagctgacacagctgtgaacaagcagaaccggcaggagtttgtggatgcctacgtggactacatcttcaacaagtctgtggccagcctgtttgatgccttccacgccggcttccacaaggtgtgtggcggcaaggtgctgctgctcttccagcccaatgagctgcaggccatggtgattggcaacaccaactatgactggaaggagctggagaagaacacagagtacaagggggagtactgggccgagcaccccaccatcaagatcttctgggaggtgttccacgagctgcccctggagaagaagaagcagttcctgctcttcctgaccggcagtgaccgcatccccatcctgggcatgaagagcctgaagctggtgatccagagcactggaggaggagaggagtacctgcctgtgagccacacctgcttcaacctgctggacctgcccaagtacacagagaaggagaccctgcggagcaagctgatccaggccatcgaccacaatgaaggcttcagcctcatctag

SEQ ID NO: 19923 - DNA, 726 bp, Artificial Sequence; identical to SEQ ID NO: 19313
  Description of Artificial Sequence: Synthetic coding sequence

SEQ ID NO: 19924 - DNA, 870 bp, Artificial Sequence
  Description of Artificial Sequence: Synthetic coding sequence
atgatcatcaactggaaccaggtgtctgtgctgtggaagtgcctgctgaagcagagcgccagctaccaggaccggcggcagagctggaggcgggcctccatgaaggagaccaacagaaggaagagcctgcaccccatccaccagggcatcacagagctgagccgcagcatctctgtggacctggccgagagcaagaggctgggctgcctgctgctgagcagcttccagttcagcatccagaagctggagcccttcctgcgggacaccaagggcttcagcctggagagcttccgggccaaggccagcagcctgtctgaggagctgaagcactttgctgatggcctggagacagatggcaccctgcagaagtgctttgaggacagcaatggcaaggccagtgacttcagcctggaggcctctgtggccgagatgaaggagtacatcaccaagttcagcctggagcggcagacctgggaccagctgctgctgcactaccagcaggaggccaaggagatcctgagccggggcagcacagaggccaagatcacagaggtgaaggtggagcccatgacctacctgggcagcagccagaatgaggtgctgaacaccaagccagactaccagaagatcctgcagaaccagagcaaggtgtttgactgcatggagctggtgatggatgagctgcagggctctgtgaagcagctgcaggccttcatggatgagagcacccagtgcttccagaaggtgtctgtgcagctgggcaagaggtccatgcagcagctggaccccagccctgccaggaagctgctgaagctgcagctgcagaaccccccagccatccacggcagcggcagcggcagctgccagtag

SEQ ID NO: 19925 - DNA, 750 bp, Artificial Sequence
  Description of Artificial Sequence: Synthetic coding sequence
atgacctctgtgaccaggtctgagatcattgatgagctgagccgcagcatctctgtggacctggccgagagcaagaggctgggctgcctgctgctgagcagcttccagttcagcatccagaagctggagcccttcctgcgggacaccaagggcttcagcctggagagcttccgggccaaggccagcagcctgtctgaggagctgaagcactttgctgatggcctggagacagatggcaccctgcagaagtgctttgaggacagcaatggcaaggccagtgacttcagcctggaggcctctgtggccgagatgaaggagtacatcaccaagttcagcctggagcggcagacctgggaccagctgctgctgcactaccagcaggaggccaaggagatcctgagccggggcagcacagaggccaagatcacagaggtgaaggtggagcccatgacctacctgggcagcagccagaatgaggtgctgaacaccaagccagactaccagaagatcctgcagaaccagagcaaggtgtttgactgcatggagctggtgatggatgagctgcagggctctgtgaagcagctgcaggccttcatggatgagagcacccagtgcttccagaaggtgtctgtgcagctgggcaagaggtccatgcagcagctggaccccagccctgccaggaagctgctgaagctgcagctgcagaaccccccagccatccacggcagcggcagcggcagctgccagtag

SEQ ID NO: 19926 - DNA, 855 bp, Artificial Sequence
  Description of Artificial Sequence: Synthetic coding sequence
atgacctctgtgaccaggtctgagatcattgatgagcagagcgccagctaccaggaccggcggcagagctggaggcgggcctccatgaaggagaccaacagaaggaagagcctgcaccccatccaccagggcatcacagagctgagccgcagcatctctgtggacctggccgagagcaagaggctgggctgcctgctgctgagcagcttccagttcagcatccagaagctggagcccttcctgcgggacaccaagggcttcagcctggagagcttccgggccaaggccagcagcctgtctgaggagctgaagcactttgctgatggcctggagacagatggcaccctgcagaagtgctttgaggacagcaatggcaaggccagtgacttcagcctggaggcctctgtggccgagatgaaggagtacatcaccaagttcagcctggagcggcagacctgggaccagctgctgctgcactaccagcaggaggccaaggagatcctgagccggggcagcacagaggccaagatcacagaggtgaaggtggagcccatgacctacctgggcagcagccagaatgaggtgctgaacaccaagccagactaccagaagatcctgcagaaccagagcaaggtgtttgactgcatggagctggtgatggatgagctgcagggctctgtgaagcagctgcaggccttcatggatgagagcacccagtgcttccagaaggtgtctgtgcagctgggcaagaggtccatgcagcagctggaccccagccctgccaggaagctgctgaagctgcagctgcagaaccccccagccatccacggcagcggcagcggcagctgccagtag

SEQ ID NO: 19927 - DNA, 1071 bp, Artificial Sequence
  Description of Artificial Sequence: Synthetic coding sequence
atgacctctgtgaccaggtctgagatcattgatgagaagggccctgtgatgagcaagacccatgaccaccagctggagagcagcctgagccctgtggaggtgtttgccaagaccagcgccagcctggagatgaaccagggcgtgtctgaggagcgcatccacctgggcagcagccccaagaagggcggcaactgtgacctgagccaccaggagcggctgcagagcaagagcctgcacctgagcccccaggagcagagcgccagctaccaggaccggcggcagagctggaggcgggcctccatgaaggagaccaacagaaggaagagcctgcaccccatccaccagggcatcacagagctgagccgcagcatctctgtggacctggccgagagcaagaggctgggctgcctgctgctgagcagcttccagttcagcatccagaagctggagcccttcctgcgggacaccaagggcttcagcctggagagcttccgggccaaggccagcagcctgtctgaggagctgaagcactttgctgatggcctggagacagatggcaccctgcagaagtgctttgaggacagcaatggcaaggccagtgacttcagcctggaggcctctgtggccgagatgaaggagtacatcaccaagttcagcctggagcggcagacctgggaccagctgctgctgcactaccagcaggaggccaaggagatcctgagccggggcagcacagaggccaagatcacagaggtgaaggtggagcccatgacctacctgggcagcagccagaatgaggtgctgaacaccaagccagactaccagaagatcctgcagaaccagagcaaggtgtttgactgcatggagctggtgatggatgagctgcagggctctgtgaagcagctgcaggccttcatggatgagagcacccagtgcttccagaaggtgtctgtgcagctgggcaagaggtccatgcagcagctggaccccagccctgccaggaagctgctgaagctgcagctgcagaaccccccagccatccacggcagcggcagcggcagctgccagtag

SEQ ID NO: 19928 - DNA, 1071 bp, Artificial Sequence; identical to SEQ ID NO: 19927
  Description of Artificial Sequence: Synthetic coding sequence

SEQ ID NO: 19929 - DNA, 1617 bp, Artificial Sequence
  Description of Artificial Sequence: Synthetic coding sequence
atggctgctgctgcctctgtgacaggccgggtgacctgggccgccagccccatgaggagcctgggcctgggccgccgcctgagcctgcccggcccccggctggatgctgtgacagctgctgtgaaccccagcctgagtgaccacggcaatggcctgggccggggcacccggggcagcggctgcagcggcggcagcctggtggccgactggggcggcggcgctgctgctgctgctgctgtggccctggccctggccccagccctgagcaccatgaggcggggcagcagcgagagcgagctggccgcccgctgggaggccgaggccgtggccgccgccaaggctgctgccaaggccgaggccgaggccacagctgagaccgtggccgagcaggtgcgggtggatgctggagctgctggggagcctgagtgcaaggccggggaggagcagcccaaggtgctggccccagccccagcccagcccagcgctgctgaggagggcaacacccaggtgctgcagaggcccccacccaccctgccccccagcaagcccaagcctgtgcagggcctgtgcccccacggcaagccccgggacaagggccgcagctgcaagaggagcagcggccacggcagcggggagaatggcagccagaggcctgtgacagtggacagcagcaaggcccggaccagcctggatgccctgaagatcagcatccggcagctgaagtggaaggagttcccctttggaagaaggctgccctgtgacatctactggcacggcgtgtccttccatgacaatgacatcttcagcggccaggtgaacaagtttcctggcatgacagagatggtgaggaagatcaccctgagcagagctgtgaggaccatgcagaacctcttccctgaggagtacaacttctaccccaggtcctggatcctgcctgatgagttccagctgtttgtggcccaggtgcagatggtgaaggatgatgaccccagctggaagcccaccttcatcgtgaagccagatggcggctgccagggagatggcatctacctgatcaaggaccccagcgacatccggctggccggcaccctgcagagcaggcctgctgtggtgcaggagtacatctgcaagcccctgctgattgacaagctgaagtttgacatccggctgtatgtgctgctgaagagcctggaccccctggagatctacatcgccaaggatggcctgagccgcttctgcacagagccctaccaggagcccacccccaagaacctgcaccgcatcttcatgcacctgaccaactacagcctgaacatccacagcggcaacttcatccacagcgacagcgccagcacaggcagcaagaggaccttcagcagcatcctgtgccgcctgagcagcaagggcgtggacatcaagaaggtgtggagcgacatcatctctgtggtgatcaagacagtcatcgccctgaccccagagctgaaggtgttctaccagagcgacatccccaccggccggcccggccccacctgcttccaggtgaccatcgccagcagccagcctgccttccctgccctgaccggcctgaagagggccctgtggctgcgggtgggctag

SEQ ID NO: 19930 - DNA, 1356 bp, Artificial Sequence
  Description of Artificial Sequence: Synthetic coding sequence
atgacagagatggtgaggaagatcaccctgagcagagctgtgaggaccatgcagaacctcttccctgaggagtacatctgcaagcccctgctgattgacaagctgaagtttgacatccggctgtatgtgctgctgaagagcctggaccccctggagatctacatcgccaaggatggcctgagccgcttctgcacagagccctaccaggagcccacccccaagaacctgcaccgcatcttcatgcacctgaccaactacagcctgaacatccacagcggcaacttcatccacagcgacagcgccagcacaggcagcaagaggaccttcagcagcatcctgtgccgcctgagcagcaaaggagtggacatcaagaaggtgtggagcgacatcatctctgtggtgatcaagacagtgattgccctgaccccagagctgaaggtgttctaccagagcgacatccccaccggccggcccggccccacctgcttccagatcctgggctttgacatcctgctgatgaagaacctgaagcccatcctgctggaggtgaatgccaaccccagcatgagaattgaacatgaacatgagctgagccctggggtgtttgaaaatgtgcccagcctggtggatgaggaggtgaaggtggccgtcatccgggacaccctgcggctgatggaccccctgaagaagaagcgggagaaccagagccagcagctggagaagccctttgctgggaaggaggatgccctggatggagagctgaccagcgccccagactgcaatgccaaccctgaggcccacctgcccagcatctgcctgaagcaggtgttccccaagtatgccaagcagttcaactacctgcggctggtggacaggatggccaacctcttcatccgcttcctgggcatcaagggcaccatgaagctgggccccaccggcttccgcaccttcatccgcagctgcaagctgagcagcagcagcctgtccatggctgctgtggacatcctgtacatcgacatcacccggcgctggaacagcatgaccctggaccagagggacagcggcatgtgcctgcaggcctttgtggaggccttcttcttcctggcccagaggaagttcaagatgctgcccctgcacgagcaggtggccagcctgattgacctgtgtgagtaccacctgagcctgctggatgagaagaggctggtgtgtggccggggcgtgcccagcggcggccggcccccccaccggggccccccccaggagcccagccccagcgcccagcctgctggggacaaccccccacccaggaccagctgtgccaacaagctgagccaccccaggcacaccctgtcctag

SEQ ID NO: 19931 - DNA, 1644 bp, Artificial Sequence
  Description of Artificial Sequence: Synthetic coding sequence
atgaaggtggtgaagtctgctgagcactacacagaaacagccctggatgagatccggctgctgaagtctgtgaggaacagcgaccccaatgaccccaaccgggagatggtggtgcagctgctggatgacttcaagatctctggagtgaatggcacccacatctgcatggtgtttgaggtgctgggccaccacctgctgaagtggatcatcaagagcaactaccagggcctgcccctgccctgtgtgaagaagatcatccagcaggtgctgcagggcctggactacctgcacaccaagtgccgcatcatccacacagacatcaagccagagaacatcctgctgtctgtgaatgagcagtacatccggcggctggccgctgaggccacagagtggcagaggtctggggcccccccacccagcggcagcgctgtgtccacagccccccagcccaagccagctgacaagatgagcaagaacaagaagaagaagctgaagaagaagcagaagaggcaggccgagctgctggagaagaggatgcaggagattgaggagatggagaaggagagcggccctggccagaagaggcccaacaagcaggaggagagcgagagccctgtggagcggcccctgaaggagaacccccccaacaagatgacccaggagaagctggaggagagcagcaccatcggccaggaccagaccctgatggagcgggacacagagggcggcgctgctgagatcaactgcaatggagtgattgaagtcatcaactacacccagaacagcaacaatgagaccctgcggcacaaggaggacctgcacaatgccaatgactgtgatgtgcagaacctgaaccaggagagcagcttcctgagcagccagaatggagacagcagcaccagccaggagacagacagctgcacccccatcaccagcgaggtgtctgacaccatggtgtgccagagcagcagcacagtgggccagagcttcagcgagcagcacatcagccagctgcaggagagcatccgggcagagatcccctgtgaagatgagcaggagcaggagcacaacggccccctggacaacaagggcaagagcacagctggcaacttcctggtgaaccccctggagcccaagaatgctgagaagctgaaggtgaagattgctgacctgggcaatgcctgctggcacaagcacttcacagaggacatccagacccggcagtaccgcagcctggaggtgctgattggcagcggctacaacaccccagctgacatctggagcacagcctgcatggcctttgagctggccaccggggactacctgtttgagccccacagcggggaggagtacaccagagatgaggaccacatcgtgcacatcatcgagctgattggccgcatcccccggcgcttcagcctgagcggcaagtacagccaggacttcttcagccacagaggagacctgaagcacatcaccaagctgaagccctggggcctgtttgaggtgctggtggagaagtatgagtggagccaggaggaggccgccggcttcacagacttcctgctgcccatgctggagctgatccctgagaagagggccacagctgctgagtgcctgcggcacccctggctgaacagctag

SEQ ID NO: 19932 - DNA, 1968 bp, Artificial Sequence
  Description of Artificial Sequence: Synthetic coding sequence
atggagaggaaggtgctggccctgcaggccaggaagaagaggaccaaggccaagaaggacaaggcccagaggaagtctgagacccagcaccggggcagcgccccccacagcgagagtgacctgcctgagcaggaggaggagatcctgggcagtgatgatgatgagcaggaggaccccaatgactactgcaagggcggctaccacctggtgaagatcggggacctcttcaacggccgctaccacgtgatcaggaagctgggctggggccacttcagcacagtgtggctgtcctgggacatccagggcaagaagtttgtggccatgaaggtggtgaagtctgctgagcactacacagaaacagccctggatgagatccggctgctgaagtctgtgaggaacagcgaccccaatgaccccaaccgggagatggtggtgcagctgctggatgacttcaagatcagcggcgtgaatggcacccacatctgcatggtgtttgaggtgctgggccaccacctgctgaagtggatcatcaagagcaactaccagggcctgcccctgccctgtgtgaagaagatcatccagcaggtgctgcagggcctggactacctgcacaccaagtgccgcatcatccacacagacatcaagccagagaacatcctgctgtctgtgaatgagcagtacatccggcggctggccgctgaggccacagagtggcagaggtctggggcccctcctccttctggcagcgctgtgtccacagccccccagcccaagccagctgacaagatgagcaagaacaagaagaagaagctgaagaagaagcagaagaggcaggccgagctgctggagaagaggatgcaggagattgaggagatggagaaggagagcggccctggccagaagaggcccaacaagcaggaggagagcgagagccctgtggagcggcccctgaaggaaaatccacccaacaagatgacccaggagaagctggaggagagcagcaccatcggccaggaccagaccctgatggagcgggacacagaaggaggagctgctgagatcaactgcaatggagtcatcgaggtgatcaactacacccagaacagcaacaatgagaccctgcggcacaaggaggacctgcacaatgccaatgactgtgatgtgcagaacctgaaccaggagagcagcttcctgagcagccagaatggagacagcagcaccagccaggagacagacagctgcacccccatcaccagcgaggtgtctgacaccatggtgtgccagagcagcagcacagtgggccagagcttcagcgagcagcacatcagccagctgcaggagagcatccgggcagagatcccctgtgaagatgagcaggagcaggagcacaacggccccctggacaacaagggcaagagcacagctggcaacttcctggtgaaccccctggagcccaagaatgctgagaagctgaaggtgaagattgctgacctgggcaatgcctgctgggtgcacaagcacttcacagaggacatccagacccggcagtaccgcagcctggaggtgctgattggcagcggctacaacaccccagctgacatctggagcacagcctgcatggcctttgagctggccaccggggactacctgtttgagccccacagcggggaggagtacaccagagatgaggaccacatcgccctgatcatcgagctgctgggcaaggtgcccaggaagctgattgtggccggcaagtacagcaaggagttcttcaccaagaagggggacctgaagcacatcaccaagctgaagccctggggcctgtttgaggtgctggtggagaagtatgagtggagccaggaggaggccgccggcttcacagacttcctgctgcccatgctggagctgatccctgagaagagggccacagctgctgagtgcctgcggcacccctggctgaacagctag

SEQ ID NO: 19933 - DNA, 864 bp, Artificial Sequence
  Description of Artificial Sequence: Synthetic coding sequence
atggccgccagcctgtggatgggagacctggagccctacatggatgagaacttcatcagccgggcctttgccaccatgggagaaacagtgatgtctgtgaagatcatccggaaccggctgaccggcatcccagctggctactgctttgtggagtttgctgacctggccacagctgagaagtgcctgcacaagatcaacgggaagcccctgcccggggccaccccagccaagcgcttcaagctgaactatgccacctacggcaagcagcctgacaacagccctgagtacagcctgtttgtgggggacctgaccccagatgtggatgatggcatgctgtatgagttctttgtgaaggtgtaccccagctgccggggcggcaaggtggtgctggaccagacaggagtgtccaagggctacggctttgtgaagttcacagatgagctggagcagaagagggccctgacagagtgccagggcgctgtgggcctgggcagcaagcctgtgcggctgtctgtggccatccccaaggccagccgggtgaagcctgtggagtacagccagatgtacagctacagctacaaccagtactaccagcagtaccagaactactatgcccagtggggctatgaccagaacacaggcagctacagctacagctacccccagtatggctacacccagagcaccatgcagacctatgaggaggtgggagatgatgccctggaggaccccatgccccagctggatgtgacagaggccaacaaggagttcatggagcagagcgaggagctgtatgatgccctgatggactgccactggcagcccctggacacagtgtcctctgagatcccagccatgatgtag

SEQ ID NO: 19934 - DNA, 438 bp, Artificial Sequence
  Description of Artificial Sequence: Synthetic coding sequence
atggccgagagaaatgaagaccaccacctgcaggtgctgaaggagagcgaggtgctgctgcaggccaagagagctgagctggagaagctgaagagccaggtgaccagccagcagcaggagatggctgtgctggaccggcagctgggccacaagaaggaggagctgcacctgctgcagggctccatggtgcaggccaaggctgacctgcaggaggccctgcggctgggggagacagaggtgacagagaagtgcaaccacatccgggaggtgaagagcctgctggaggagctgtccttccagaagggggagctgaatgtgcagatcagcgagaggaagacccagctgaccctcatcaagcaggagattgagaaggaggaggagaacctgcaggtggtgctgcggcagatgagcaagcacaagacagccttcctgcagtag

SEQ ID NO: 19935 - DNA, 3024 bp, Artificial Sequence
  Description of Artificial Sequence: Synthetic coding sequence
atgcagcacctgaagagcaagaagcgggaggagcgctggatgagggccagcaagaggcagagcgagaaggagatggaggagctgcaccacaacattgatgacctgctgcaggagaagaagagcctggagtgtgaggtggaggagctgcacaggacagtgcagaagaggcagcagcagaaggacttcattgatggaaatgtggagagcctgatgacagagctggagattgagaagagcctgaagcaccacgaggacatcgtggatgaaattgaatgtattgagaagaccctgctgaagagaagaagtgagctgcgggaggccgaccggctgctggccgaggccgagagcgagctgagctgcaccaaggagaaggtgtgcctgctggtggtgtggggcgtgtcctctgtgtggaccaagaatgctgtggagaagttcacagatgccaagaggagcctgctgcagacagaaagtgatgctgaggagctggagcggcgggcccaggagacagctgtgaacctggtgaaggctgaccagcagctgcggagcctgcaggctgatgccaaggacctggagcagcacaagatcaagcaggaggagatcctgaaggagatcaacaagatcgtggccgccaaggacagcgacttccagtgcctgagcaagaagaaggagaagctgacagaggagctgcagaagctgcagaaggacatcgagatggccgagagaaatgaagaccaccacctgcaggtgctgaaggagagcgaggtgctgctgcaggccaagagagctgagctggagaagctgaagagccaggtgaccagccagcagcaggagatggctgtgctggaccggcagctgggccacaagaaggaggagctgcacctgctgcagggctccatggtgcaggccaaggctgacctgcaggaggccctgcggctgggggagacagaggtgacagagaagtgcaaccacatccgggaggtgaagagcctgctggaggagctgtccttccagaagggggagctgaatgtgcagatcagcgagaggaagacccagctgaccctcatcaagcaggagattgagaaggaggaggagaacctgcaggtggtgctgcggcagatgagcaagcacaagacagagctgaagaacatcctggacatgctgcagctggagaaccacgagctgcagggcctgaagctgcagcacgaccagagggtgtctgagctggagaagacccaggtggccgtgctggaggagaagctggagctggagaacctgcagcagatcagccagcagcagaagggggagattgagtggcagaagcagctgctggagcgggacaagcgggagattgaaagaatgacagctgagagccgggccctgcagagctgtgtggagtgcctgagcaaggagaaggaggacctgcaggagaagtgtgacatctgggagaagaagctggcccagaccaagagggtgctggccgctgctgaggagaacagcaagatggagcagagcaacctggagaagctggagctgaatgtgaggaagctgcagcaggagctggaccagctgaacagagacaagctgagcctgcacaatgacatcagcgccatgcagcagcagctgcaggagaagcgggaggccgtgaacagcctgcaggaggagctggccaacgtgcaggaccacctgaacctggccaagcaggacctgctgcacaccaccaagcaccaggatgtgctgctgtctgagcagacccggctgcagaaggacatcagcgagtgggccaacagatttgaggactgccagaaggaggaggagaccaagcagcagcagctgcaggtgctgcagaatgaaattgaggagaacaagctgaagctggtgcagcaggagatgatgttccagaggctgcagaaggagcgggagagcgaggagagcaagctggagaccagcaaggtgaccctgaaggagcagcagcaccagctggagaaggagctgacagaccagaagagcaagctggaccaggtgctgagcaaggtgctggccgctgaggagcgggtgaggaccctgcaggaggaggagcgctggtgtgagagcctggagaagaccctgagccagaccaagaggcagctgtctgagcgggagcagcagctggtggagaagagcggggagctgctggccctgcagaaggaggccgacagcatgagagctgacttcagcctgctgaggaaccagttcctgacagagaggaagaaggccgagaagcaggtggccagcctgaaggaggccctgaagatccagaggagccagctggagaagaacctgctggagcagaagcaggagaacagctgcatccagaaggagatggccaccatcgagctggtggcccaggacaaccacgagcgggcccggcggctgatgaaggagctgaaccagatgcagtatgagtacacagagctgaagaagcagatggccaaccagaaggacctggagcggcggcagatggagatcagtgatgccatgaggaccctgaagtctgaggtgaaggatgagatccgcaccagcctgaagaacctgaaccagttcctgcctgagctgcctgctgacctggaggccatcctggagagaaatgaaaacctggagggggagctggagagcctgaaggagaacctgcccttcaccatgaatgaaggcccctttgaggagaagctgaacttcagccaggtgcacatcatggatgagcactggagaggagaggccctgcgggagaagctgcggcacagagaagatcggctgaaggcccagctgcggcactgcatgagcaagcaggccgaggtgctgatcaagggcaagaggcagacagagggcaccctgcacagcctgcggcggcaggtggatgccctgggggagctggtgaccagcaccagcgctgacagcgccagcagccccagcctgagccagctggagagcagcctgacagaggacagccagctgggccagaaccaggagaagaatgccagcgccaggtag

SEQ ID NO: 19936 - DNA, 2985 bp, Artificial Sequence
  Description of Artificial Sequence: Synthetic coding sequence
atgaaggcccagaagagcggcaaggagcagcagctggacatcatgaacaagcagtaccagcagctggagagccggctggatgagatcctgagcagaattgccaaggagacagaggagatcaaggacctggaggagcagctgacagagggccagattgctgccaatgaggccctgaagaaggacctggagggcgtcatcagcggcctgcaggagtacctgggcaccatcaagggccaggccacccaggcccagaatgaatgtaggaagctgagagatgagaaggagaccctgctgcagaggctgacagaggtggagcaggagcgggaccagctggagatcgtggccatggatgctgagaacatgaggaaggagctggccgagctggagagcgccctgcaggagcagcacgaggtgaatgccagcctgcagcagacccagggcgacctgagcgcctatgaggccgagctggaggcccggctgaacctgagagatgctgaggccaaccagctgaaggaggagctggagaaggtgacccggctgacccagctggagcagagcgccctgcaggccgagctggagaaggagcggcaggccctgaagaatgccctgggcaaggcccagttcagcgaggagaaggagcaggagaacagcgagctgcacgccaagctgaagcacctgcaggatgacaacaacctgctgaagcagcagctgaaggacttccagaaccacctgaaccacgtggtggatggcctggtgcggcctgaggaggtggccgcccgggtggatgagctgcggaggaagctgaagctgggcaccggggagatgaacatccacagccccagtgatgtgctgggcaagagcctggccgacctgcagaagcagttcagcgagatcctggcccggagcaagtgggagagagatgaggcccaggtgcgggagaggaagctgcaggaggagatggccctgcagcaggagaagctggccaccggccaggaggagttccggcaggcctgtgagcgggccctggaggccaggatgaactttgacaagaggcagcacgaggcccgcatccagcagatggagaatgagatccactacctgcaggagaacctgaagtccatggaggagatccagggcctgacagacctgcagctgcaggaggctgatgaggagaaggagcgcatcctggcccagctgcgggagctggagaagaagaagaagctggaggatgccaagagccaggagcaggtgtttggcctggacaaggagctgaagaagctgaagaaggctgtggccaccagtgacaagctggccacagctgagctgaccatcgccaaggaccagctgaagagcctgcatggaacagtgatgaagatcaaccaggagcgggcagaggagctgcaggaggccgagcgcttcagcaggaaggccgcccaggccgcccgggacctgaccagggctgaggccgagattgagctgctgcagaacctgctgcggcagaagggggagcagttccggctggagatggagaagacaggagtgggcaccggggccaacagccaggtgctggagattgagaagctgaatgagaccatggagcggcagaggacagaaattgcccggctgcagaatgtgctggacctgactggaagtgacaacaagggcggctttgaaaatgtgctggaggagattgctgagctgcggcgggaggtgtcctaccagaatgactacatcagctccatggctgaccccttcaagagaagaggctactggtacttcatgcctcctccacccagcagcaaggtgagcagccacagcagccaggccaccaaggacagcggcgtgggcctgaagtacagcgccagcacccctgtgaggaagccccggcccggccagcaggacggcaaggagggcagccagcccccaccagccagcggctactgggtgtacagccccatccgcagcggcctgcacaagctgttccccagcagagatgctgacagcggcggggacagccaggaggagagcgagctggatgaccaggaggagcccccatttgtgcccccacctggctacatgatgtacacagtgctgcctgatggcagccctgtgccccagggcatggccctgtatgcccctcctccacccctgcccaacaacagccggcccctgaccccaggcaccgtggtgtatggccccccacctgctggggcccccatggtgtatggccccccaccacccaacttcagcatccccttcatccccatgggcgtgctgcactgcaatgtgcctgagcaccacaacctggagaatgaggtgtcccggctggaggacatcatgcagcacctgaagagcaagaagcgggaggagcgctggatgagggccagcaagaggcagagcgagaaggagatggaggagctgcaccacaacattgatgacctgctgcaggagaagaagagcctggagtgtgaggtggaggagctgcacaggacagtgcagaagaggcagcagcagaaggacttcattgatggaaatgtggagagcctgatgacagagctggagattgagaagagcctgaagcaccatgaagatattgtggatgaaattgagtgcatcgagaagaccctgctgaagagaagaagtgagctgcgggaggccgaccggctgctggccgaggccgagagcgagctgagctgcaccaaggagaagaccaagaatgctgtggagaagttcacagatgccaagaggagcctgctgcagacagaaagtgatgctgaggagctggagcggcgggcccaggagacagctgtgaacctggtgaaggctgaccagcagctgcggagcctgcaggctgatgccaaggacctggagcagcacaagatcaagcaggaggagatcctgaaggagatcaacaagatcgtggccgccaaggacagcgacttccagtgcctgagcaagaagaaggagaagctgacagaggagtag

SEQ ID NO: 19937 - DNA, 5322 bp, Artificial Sequence
  Description of Artificial Sequence: Synthetic coding sequence
atgaaggcccagaagagcggcaaggagcagcagctggacatcatgaacaagcagtaccagcagctggagagccggctggatgagatcctgagcagaattgccaaggagacagaggagatcaaggacctggaggagcagctgacagagggccagattgctgccaatgaggccctgaagaaggacctggagggcgtcatcagcggcctgcaggagtacctgggcaccatcaagggccaggccacccaggcccagaatgaatgtaggaagctgagagatgagaaggagaccctgctgcagaggctgacagaggtggagcaggagcgggaccagctggagatcgtggccatggatgctgagaacatgaggaaggagctggccgagctggagagcgccctgcaggagcagcacgaggtgaatgccagcctgcagcagacccagggcgacctgagcgcctatgaggccgagctggaggcccggctgaacctgagagatgctgaggccaaccagctgaaggaggagctggagaaggtgacccggctgacccagctggagcagagcgccctgcaggccgagctggagaaggagcggcaggccctgaagaatgccctgggcaaggcccagttcagcgaggagaaggagcaggagaacagcgagctgcacgccaagctgaagcacctgcaggatgacaacaacctgctgaagcagcagctgaaggacttccagaaccacctgaaccacgtggtggatggcctggtgcggcctgaggaggtggccgcccgggtggatgagctgcggaggaagctgaagctgggcaccggggagatgaacatccacagccccagtgatgtgctgggcaagagcctggccgacctgcagaagcagttcagcgagatcctggcccggagcaagtgggagagagatgaggcccaggtgcgggagaggaagctgcaggaggagatggccctgcagcaggagaagctggccaccggccaggaggagttccggcaggcctgtgagcgggccctggaggccaggatgaactttgacaagaggcagcacgaggcccgcatccagcagatggagaatgagatccactacctgcaggagaacctgaagtccatggaggagatccagggcctgacagacctgcagctgcaggaggctgatgaggagaaggagcgcatcctggcccagctgcgggagctggagaagaagaagaagctggaggatgccaagagccaggagcaggtgtttggcctggacaaggagctgaagaagctgaagaaggctgtggccaccagtgacaagctggccacagctgagctgaccatcgccaaggaccagctgaagagcctgcatggaacagtgatgaagatcaaccaggagcgggcagaggagctgcaggaggccgagcgcttcagcaggaaggccgcccaggccgcccgggacctgaccagggctgaggccgagattgagctgctgcagaacctgctgcggcagaagggggagcagttccggctggagatggagaagacaggagtgggcaccggggccaacagccaggtgctggagattgagaagctgaatgagaccatggagcggcagaggacagaaattgcccggctgcagaatgtgctggacctgactggaagtgacaacaagggcggctttgaaaatgtgctggaggagattgctgagctgcggcgggaggtgtcctaccagaatgactacatcagctccatggctgaccccttcaagagaagaggctactggtacttcatgcctcctccacccagcagcaaggtgagcagccacagcagccaggccaccaaggacagcggcgtgggcctgaagtacagcgccagcacccctgtgaggaagccccggcccggccagcaggacggcaaggagggcagccagcccccaccagccagcggctactgggtgtacagccccatccgcagcggcctgcacaagctgttccccagcagagatgctgacagcggcggggacagccaggaggagagcgagctggatgaccaggaggagcccccatttgtgcccccacctggctacatgatgtacacagtgctgcctgatggcagccctgtgccccagggcatggccctgtatgcccctcctccacccctgcccaacaacagccggcccctgaccccaggcaccgtggtgtatggccccccacctgctggggcccccatggtgtatggccccccaccacccaacttcagcatccccttcatccccatgggcgtgctgcactgcaatgtgcctgagcaccacaacctggagaatgaggtgtcccggctggaggacatcatgcagcacctgaagagcaagaagcgggaggagcgctggatgagggccagcaagaggcagagcgagaaggagatggaggagctgcaccacaacattgatgacctgctgcaggagaagaagagcctggagtgtgaggtggaggagctgcacaggacagtgcagaagaggcagcagcagaaggacttcattgatggaaatgtggagagcctgatgacagagctggagattgagaagagcctgaagcaccatgaagatattgtggatgaaattgagtgcatcgagaagaccctgctgaagagaagaagtgagctgcgggaggccgaccggctgctggccgaggccgagagcgagctgagctgcaccaaggagaagaccaagaatgctgtggagaagttcacagatgccaagaggagcctgctgcagacagaaagtgatgctgaggagctggagcggcgggcccaggagacagctgtgaacctggtgaaggctgaccagcagctgcggagcctgcaggctgatgccaaggacctggagcagcacaagatcaagcaggaggagatcctgaaggagatcaacaagatcgtggccgccaaggacagcgacttccagtgcctgagcaagaagaaggagaagctgacagaggagctgcagaagctgcagaaggacatcgagatggccgagagaaatgaagaccaccacctgcaggtgctgaaggagagcgaggtgctgctgcaggccaagagagctgagctggagaagctgaagagccaggtgaccagccagcagcaggagatggctgtgctggaccggcagctgggccacaagaaggaggagctgcacctgctgcagggctccatggtgcaggccaaggctgacctgcaggaggccctgcggctgggggagacagaggtgacagagaagtgcaaccacatccgggaggtgaagagcctgctggaggagctgtccttccagaagggggagctgaatgtgcagatcagcgagaggaagacccagctgaccctcatcaagcaggagattgagaaggaggaggagaacctgcaggtggtgctgcggcagatgagcaagcacaagacagagctgaagaacatcctggacatgctgcagctggagaaccacgagctgcagggcctgaagctgcagcacgaccagagggtgtctgagctggagaagacccaggtggccgtgctggaggagaagctggagctggagaacctgcagcagatcagccagcagcagaagggggagattgagtggcagaagcagctgctggagcgggacaagcgggagattgaaagaatgacagctgagagccgggccctgcagagctgtgtggagtgcctgagcaaggagaaggaggacctgcaggagaagtgtgacatctgggagaagaagctggcccagaccaagagggtgctggccgctgctgaggagaacagcaagatggagcagagcaacctggagaagctggagctgaatgtgaggaagctgcagcaggagctggaccagctgaacagagacaagctgagcctgcacaatgacatcagcgccatgcagcagcagctgcaggagaagcgggaggccgtgaacagcctgcaggaggagctggccaacgtgcaggaccacctgaacctggccaagcaggacctgctgcacaccaccaagcaccaggatgtgctgctgtctgagcagacccggctgcagaaggacatcagcgagtgggccaacagatttgaggactgccagaaggaggaggagaccaagcagcagcagctgcaggtgctgcagaatgaaattgaggagaacaagctgaagctggtgcagcaggagatgatgttccagaggctgcagaaggagcgggagagcgaggagagcaagctggagaccagcaaggtgaccctgaaggagcagcagcaccagctggagaaggagctgacagaccagaagagcaagctggaccaggtgctgagcaaggtgctggccgctgaggagcgggtgaggaccctgcaggaggaggagcgctggtgtgagagcctggagaagaccctgagccagaccaagaggcagctgtctgagcgggagcagcagctggtggagaagagcggggagctgctggccctgcagaaggaggccgacagcatgagagctgacttcagcctgctgaggaaccagttcctgacagagaggaagaaggccgagaagcaggtggccagcctgaaggaggccctgaagatccagaggagccagctggagaagaacctgctggagcagaagcaggagaacagctgcatccagaaggagatggccaccatcgagctggtggcccaggacaaccacgagcgggcccggcggctgatgaaggagctgaaccagatgcagtatgagtacacagagctgaagaagcagatggccaaccagaaggacctggagcggcggcagatggagatcagtgatgccatgaggaccctgaagtctgaggtgaaggatgagatccgcaccagcctgaagaacctgaaccagttcctgcctgagctgcctgctgacctggaggccatcctggagagaaatgaaaacctggagggggagctggagagcctgaaggagaacctgcccttcaccatgaatgaaggcccctttgaggagaagctgaacttcagccaggtgcacatcatggatgagcactggagaggagaggccctgcgggagaagctgcggcacagagaagatcggctgaaggcccagctgcggcactgcatgagcaagcaggccgaggtgctgatcaagggcaagaggcagacagagggcaccctgcacagcctgcggcggcaggtggatgccctgggggagctggtgaccagcaccagcgctgacagcgccagcagccccagcctgagccagctggagagcagcctgacagaggacagccagctgggccagaaccaggagaagaatgccagcgccaggtag

SEQ ID NO: 19938 - DNA, 2487 bp, Artificial Sequence
  Description of Artificial Sequence: Synthetic coding sequence
atggagaagcagaagcaggagattgctgggaagcagaaggagatcaaggacctgcagatcgccatcgacagcctggacagcaaggaccccaagcacagccacatgaaggcccagaagagcggcaaggagcagcagctggacatcatgaacaagcagtaccagcagctggagagccggctggatgagatcctgagcagaattgccaaggagacagaggagatcaaggacctggaggagcagctgacagagggccagattgctgccaatgaggccctgaagaaggacctggagggcgtcatcagcggcctgcaggagtacctgggcaccatcaagggccaggccacccaggcccagaatgaatgtaggaagctgagagatgagaaggagaccctgctgcagaggctgacagaggtggagcaggagcgggaccagctggagatcgtggccatggatgctgagaacatgaggaaggagctggccgagctggagagcgccctgcaggagcagcacgaggtgaatgccagcctgcagcagacccagggcgacctgagcgcctatgaggccgagctggaggcccggctgaacctgagagatgctgaggccaaccagctgaaggaggagctggagaaggtgacccggctgacccagctggagcagagcgccctgcaggccgagctggagaaggagcggcaggccctgaagaatgccctgggcaaggcccagttcagcgaggagaaggagcaggagaacagcgagctgcacgccaagctgaagcacctgcaggatgacaacaacctgctgaagcagcagctgaaggacttccagaaccacctgaaccacgtggtggatggcctggtgcggcctgaggaggtggccgcccgggtggatgagctgcggaggaagctgaagctgggcaccggggagatgaacatccacagccccagtgatgtgctgggcaagagcctggccgacctgcagaagcagttcagcgagatcctggcccggagcaagtgggagagagatgaggcccaggtgcgggagaggaagctgcaggaggagatggccctgcagcaggagaagctggccaccggccaggaggagttccggcaggcctgtgagcgggccctggaggccaggatgaactttgacaagaggcagcacgaggcccgcatccagcagatggagaatgagatccactacctgcaggagaacctgaagtccatggaggagatccagggcctgacagacctgcagctgcaggaggctgatgaggagaaggagcgcatcctggcccagctgcgggagctggagaagaagaagaagctggaggatgccaagagccaggagcaggtgtttggcctggacaaggagctgaagaagctgaagaaggctgtggccaccagtgacaagctggccacagctgagctgaccatcgccaaggaccagctgaagagcctgcatggaacagtgatgaagatcaaccaggagcgggcagaggagctgcaggaggccgagcgcttcagcaggaaggccgcccaggccgcccgggacctgaccagggctgaggccgagattgagctgctgcagaacctgctgcggcagaagggggagcagttccggctggagatggagaagacaggagtgggcaccggggccaacagccaggtgctggagattgagaagctgaatgagaccatggagcggcagaggacagaaattgcccggctgcagaatgtgctggacctgactggaagtgacaacaagggcggctttgaaaatgtgctggaggagattgctgagctgcggcgggaggtgtcctaccagaatgactacatcagctccatggctgaccccttcaagagaagaggctactggtacttcatgcctcctccacccagcagcaaggtgagcagccacagcagccaggccaccaaggacagcggcgtgggcctgaagtacagcgccagcacccctgtgaggaagccccggcccggccagcaggacggcaaggagggcagccagcccccaccagccagcggctactgggtgtacagccccatccgcagcggcctgcacaagctgttccccagcagagatgctgacagcggcggggacagccaggaggagagcgagctggatgaccaggaggagcccccatttgtgcccccacctggctacatgatgtacacagtgctgcctgatggcagccctgtgccccagggcatggccctgtatgcccctcctccacccctgcccaacaacagccggcccctgaccccaggcaccgtggtgtatggccccccacctgctggggcccccatggtgtatggccccccaccacccaacttcagcatccccttcatccccatgggcgtgctgcactgcaatgtgcctgagcaccacaacctggtgtctgggaagacctacaacagcctgagcaccctgctgccctgggtgacagacaaggtgatctacctgatgtcctag

SEQ ID NO: 19939 - DNA, 6978 bp, Artificial Sequence; identical to SEQ ID NO: 18318
  Description of Artificial Sequence: Synthetic coding sequence

SEQ ID NO: 19940 - DNA, 1359 bp, Artificial Sequence
  Description of Artificial Sequence: Synthetic coding sequence
atgaagaagggcagccagcagaagatcttcagcaaggccaagatccccagcagcagccacagccccatccccagctccatgagcaacatgaggagccgcagcctgagccccctgattggcagcgagaccctgcccttccacagcggcggccagtggtgtgagcaggtggagattgctgatgagaacaacatgctgctggactaccaggaccacaagggagctgacagccacgccggcgtgcgctacatcacagaggccctgatcaagaagctgaccaagcaggacaacctggccctgatcaagagcctgaacctgagcctgagcaaggatggcggcaagaagttcaagtacatcgagaacctggagaagtgtgtgaagctggaggtgctgaacctgagctacaacctgattggcaagattgagaagctggacaagctgctgaagctgcgggagctgaacctgagctacaacaagatcagcaagattgagggcatcgagaacatgtgcaacctgcagaagctgaacctggccggaaatgaaattgagcacatccctgtgtggctgggcaagaagctgaagagcctgcgggtgctgaacctgaagggcaacaagatcagcagcctgcaggacatcagcaagctgaagcccctgcaggacctgatcagcctcatcctggtggagaaccctgtggtgaccctgccccactacctgcagttcaccatcttccacctgcggagcctggagagcctggagggccagcctgtgaccacccaggaccggcaggaggcctttgagcgcttcagcctggaggaggtggagcggctggagcgggacctggagaagaagatgattgaaacagaggagctgaagagcaagcagacccgcttcctggaggagatcaagaaccaggacaagctgaacaagagcctgaaggaggaggccatgctgcagaagcagagctgtgaggagctgaagagtgacctgaacaccaagaatgagctgctgaagcagaagaccatcgagctgacccgggcctgccagaagcagtatgagctggagcaggagctggccttctacaagattgatgccaagtttgagcccctgaactactaccccagtgaatatgcagaaattgacaaggccccagatgagagcccctacatcggcaagagccgctacaagaggaacatgtttgccacagagagctacatcattgattctgcccaggccgtgcagatcaagaagatggagccagatgagcagctgagaaatgaccacatgaacctgcggggccacacccccctggacacccagctggaggaccacaagctggactaccagaactgcatgatgaagtag

SEQ ID NO: 19941 - DNA, 1053 bp, Artificial Sequence
  Description of Artificial Sequence: Synthetic coding sequence
atgtgctgtgacagcgactttgtggccaggaacaagagccaggacagcggcattgctgagatggaggagctgcctgtgccccacaacatcaagatcagcaacatcacctgtgacagcttcaagatctcctgggagatggacagcaagagcaaggaccgcatcacccactacttcatcgacctgaacaagaaggagaacaagaacagcaacaagttcaagcacaaggatgtgcccaccaagctggtggccaaggctgtgcccctgcccatgacagtgcggggccactggttcctgagccccaggacagagtacacagtggccgtgcagacagccagcaagcaggtggatggagactatgtggtgtctgagtggagcgagatcatcgagttctgcacagctgactacagcaaggtgcacctgacccagctgctggagaaggccgaggtgattgctggccgcatgctgaagttcagcgtcttctacagaaaccagcacaaggagtactttgattatgtgcgggagcaccacggcaatgccatgcagcccagcgtgaaggacaacagcggcagccacggcagccccatcagcggcaagctggagggcatcttcttcagctgcagcacagagttcaacacaggcaagccaccccaggacagcccctacggccgctacagatttgaaattgctgctgagaagctgttcaaccccaacaccaacctgtactttggagacttctactgcatgtacacagcctaccactacgtgatcctggtgattgcccctgtgggcagccctggagatgagttctgcaagcagaggctgccccagctgaacagcaaggacaacaagttcctgacctgcacagaggaggatggagtgctggtgtaccaccacgcccaggatgtgatcctggaggtgatctacacagatcctgtggacctgtctgtgggcaccgtggccgagatcaccggccaccagctgatgagcctgagcacagccaatgccaagaaggaccccagctgcaagacctgcaacatctctgtgggccgctag

SEQ ID NO: 19942 - DNA, 1131 bp, Artificial Sequence
  Description of Artificial Sequence: Synthetic coding sequence
atggaggtgccccggctggaccacgccctgaacagccccaccagcccctgtgaggaggtgatcaagaacctgagcctggaggccatccagctgtgtgacagagatggcaacaagagccaggacagcggcattgctgagatggaggagctgcctgtgccccacaacatcaagatcagcaacatcacctgtgacagcttcaagatctcctgggagatggacagcaagagcaaggaccgcatcacccactacttcatcgacctgaacaagaaggagaacaagaacagcaacaagttcaagcacaaggatgtgcccaccaagctggtggccaaggctgtgcccctgcccatgacagtgcggggccactggttcctgagccccaggacagagtacacagtggccgtgcagacagccagcaagcaggtggatggagactatgtggtgtctgagtggagcgagatcatcgagttctgcacagctgactacagcaaggtgcacctgacccagctgctggagaaggccgaggtgattgctggccgcatgctgaagttcagcgtcttctacagaaaccagcacaaggagtactttgattatgtgcgggagcaccacggcaatgccatgcagcccagcgtgaaggacaacagcggcagccacggcagccccatcagcggcaagctggagggcatcttcttcagctgcagcacagagttcaacacaggcaagccaccccaggacagcccctacggccgctacagatttgaaattgctgctgagaagctgttcaaccccaacaccaacctgtactttggagacttctactgcatgtacacagcctaccactacgtgatcctggtgattgcccctgtgggcagccctggagatgagttctgcaagcagaggctgccccagctgaacagcaaggacaacaagttcctgacctgcacagaggaggatggagtgctggtgtaccaccacgcccaggatgtgatcctggaggtgatctacacagatcctgtggacctgtctgtgggcaccgtggccgagatcaccggccaccagctgatgagcctgagcacagccaatgccaagaaggaccccagctgcaagacctgcaacatctctgtgggccgctag

SEQ ID NO: 19943 - DNA, 1263 bp, Artificial Sequence; identical to SEQ ID NO: 18898
  Description of Artificial Sequence: Synthetic coding sequence

SEQ ID NO: 19944 - DNA, 411 bp, Artificial Sequence
  Description of Artificial Sequence: Synthetic coding sequence
gaccccctgtcctggctgagcggcccctggggccaggtgcctgctggcatctgccccccaagacaccggggctggtaccacttccgggaccagatcctggccggcagccctgaggccttctttgtgctgaatgctgatgtgtgcagcgacttccccctgagcgccatgctggaggcccaccggcggcagaggcaccccttcctgctgctgggcaccacagccaacagaacccagagcctgaactacggctgcatcgtggagaacccccagacccatgaggtgctgcactacgtggagaagcccagcaccttcatcagtgacatcatcaactgtggcatctacctgttcagccctgaggccctgaagcccctgagagatgtgttccagaggaaccagcaggacggccagtag

SEQ ID NO: 19945 - DNA, 1365 bp, Artificial Sequence
  Description of Artificial Sequence: Synthetic coding sequence
atggagaggaaggactttgagacctggctggacaacatctctgtgaccttcctgagcctgacagacctgcagaagaatgagaccctggaccacctgatcagcctgagcggggctgtgcagctgcggcacctgagcaacaacctggagaccctgctgaagagggacttcctgaagctgctgcccctggagctgtccttctacctgctgaagtggctggacccccagaccctgctgacctgctgcctggtgtccaagcagtggaacaaggtgatcagcgcctgcacagaggtgtggcagacagcctgcaagaacctgggctggcagattgatgacagcgtgcaggatgccctgcactggaagaaggtgtacctgaaggccatcctgaggatgaagcagctggaggaccacgaggcctttgagaccagcagcctgattggccacagcgcccgggtgtatgccctgtactacaaggatggcctgctgtgcaccggcagtgatgacctgagcgccaagctgtgggatgtgtccacaggccagtgtgtgtatggcatccagacccacacctgtgccgctgtgaagtttgatgagcagaagctggtgacaggcagctttgacaacacagtggcctgctgggagtggagcagcggggcccggacccagcacttccggggccacactggagctgtgttttctgtggactacaatgatgagctggacatcctggtgtctggcagcgctgacttcaccgtgaaggtgtgggccctgtctgctggcacctgcctgaacaccctgaccggccacacagagtgggtgaccaaggtggtgctgcagaagtgcaaggtgaagagcctgctgcacagccctggggactacatcctgctgtctgctgacaagtatgagatcaagatctggcccatcggccgggagatcaactgcaagtgcctgaagaccctgtctgtgtctgaggacaggagcatctgcctgcagccccggctgcactttgatggcaagtacatcgtgtgcagcagcgccctgggcctgtaccagtgggactttgccagctatgacatcctgcgggtcatcaagaccccagagatcgccaacctggccctgctgggctttggagacatctttgccctgctgtttgacaaccgctacctgtacatcatggacctgaggacagagagcctcatcagccgctggcccctgcctgagtacaggaagagcaagaggggcagcagcttcctggccggggaggcctcctggctgaatggcctggatggccacaatgacaccggcctggtgtttgccacctccatgccagaccacagcatccacctggtgctgtggaaggagcacggctag

SEQ ID NO: 19946 - DNA, 372 bp, Artificial Sequence
  Description of Artificial Sequence: Synthetic coding sequence
atggaggccgctgagacagaggccgaggccgccgccctggaggtgctggccgaggtggccggcatcctggagcctgtgggcctgcaggaggaggccgagctgcctgccaagatcctggtggagtttgtggtggacagccagaagaaggacaagctgctgtgcagccagctgcaggtggccgacttcctgcagaacatcctggcccaggagcggccctggtgtgtgctgcagggctgctggagcaccacctgctggcgctgcaagtttgccatgacctcctggaggacagctgcctggaggaagatcctggagaaggccagtgacttcccccacctgcccaccatcatcaccgggaagacagtgaacagctag

SEQ ID NO: 19947 - DNA, 834 bp, Artificial Sequence
  Description of Artificial Sequence: Synthetic coding sequence
atggaggccgctgagacagaggccgaggccgccgccctggaggtgctggccgaggtggccggcatcctggagcctgtgggcctgcaggaggaggccgagctgcctgccaagatcctggtggagtttgtggtggacagccagaagaaggacaagctgctgtgcagccagctgcaggtggccgacttcctgcagaacatcctggcccaggaggacacagccaagggcctggaccccctggccagcgaggacaccagccggcagaaggccatcgccgccaaggagcagtggaaggagctgaaggccacctaccgggagcacgtggaggccatcaagattggcctgaccaaggccctgacccagatggaggaggcccagaggaagaggacccagctgcgggaggcctttgagcagctgcaggccaagaagcagatggccatggagaagagaagagctgtgcagaaccagtggcagctgcagcaggagaagcacctgcagcacctggccgaggtgtctgctgaggtgcgggagaggaagacaggcacccagcaggagctggacagagtcttccagaagctgggcaacctgaagcagcaggccgagcaggagcgggacaagctgcagcgctaccagaccttcctgcagctgctgtacaccctgcagggcaagctgctcttccctgaggccgaggccgaggccgagaacctgcctgatgacaagccccagcagcccacccggccccaggagcagagcactggagacaccatgggccgggaccccggggtgtccttcaaggctgtgggcctgcagcctgctggagatgtgaacctgccctag

SEQ ID NO: 19948 - DNA, 1713 bp, Artificial Sequence
  Description of Artificial Sequence: Synthetic coding sequence
atgagcagcatcggggagggcatcgacttcagccaggagcggcagaagatcagcggcctgcggaccctggagcagagcgtgggggagtggctggagagcatcggcctgcagcagtatgagagcaagctgctgctgaatggatttgatgatgtgcacttcctgggcagcaatgtgatggaggagcaggacctgcgggacatcggcatcagtgacccccagcacaggaggaagctgctgcaggccgcccggagcctgcccaaggtgaaggccctgggctatgatggcaacagcccccccagcgtgcccagctggctggacagcctgggcctgcaggactatgtgcacagcttcctgagcagcggctacagcagcattgacacagtgaagaacctgtgggagctggagctggtgaatgtgctgaaggtgcagctgctgggccacaggaagaggatcatcgccagcctggccgaccggccctatgaggagcccccccagaagcccccacgcttcagccagctgcgctgccaggacctgctgagccagaccagcagccccctgagccagaatgacagctgcaccggccgctctgctgacctgctgctgcccccaggggacaccggcagaagaagacatgacagcctgcatgaccctgctgcccccagcagagctgagcgcttccgcatccaggaggagcaccgggaggccaagctgaccctgcggccccccagcctggccgccccctatgcccctgtgcagagctggcagcaccagcctgagaagctgatctttgagagctgtggctatgaggccaactacctgggctccatgctgatcaaggacctgcggggcacagagagcacccaggatgcctgtgccaagatgaggaagagcacagagcacatgaagaagatccccaccatcatcctgagcatcacctacaagggcgtgaagttcattgatgccagcaacaagaatgtgattgctgagcacgagatccggaacatcagctgtgccgcccaggaccctgaggacctgtgcacctttgcctacatcaccaaggacctgcagaccagccaccactactgccacgtgttcagcacagtggatgtgaacctgacctatgagatcatcctgaccctgggccaggcctttgaggtggcctaccagctggccctgcaggcccagaagagccgggccaccggggccagcgctgctgagatgattgagaccaagagcagcaagcctgtgcccaagccccgggtgggcgtgaggaagtctgctgtgcccctgcccccagacagccgctgctgctactgccacacctgcaccacccaccggcccagctacctgcccctgcccagcgtgtccccaggagtgaagctggagcccccagacatggaccaggatgcccagagccacgcctctgtgtcctgggtggtggaccccaagccagacagcaagaggagcctgagcaccaaccacacccggctggagctggtgtgctgcagccagccagaaaatgagctggtgtccaccatcagcggggacaagcccaagagcttcctggagcccctgctgtttgtgatgcccaccacagcctacaaccacaactgcccagagtggaggagccagaaggatggcggctgcagcaccagtgaatgtccccaccacctgtgcctggagaagccaggagtgctgagcctggagatgtag

SEQ ID NO: 19949 - DNA, 1785 bp, Artificial Sequence; identical to SEQ ID NO: 18616
  Description of Artificial Sequence: Synthetic coding sequence

SEQ ID NO: 19950 - DNA, 1785 bp, Artificial Sequence
  Description of Artificial Sequence: Synthetic coding sequence
atggaggccgtgtgcctgggcacctgcccagagcctgaggcctccatgagcacagccatccctggcctgaagaagggcaacaatgccctgcagagcatcatcctgcagaccctgctggagaaggaaaatggccagaggaaatatggaggccccccacctggctgggatgctgcccctcctgagcggggctgtgagatcttcatcggcaagctgccccgggacctgtttgaagatgagctgatccccctgtgtgagaagattggcaagatctatgagatgaggatgatgatggacttcaacggcaacaacagaggctacgcctttgtgaccttcagcaacaaggtggaggccaagaatgccatcaagcagctgaacaactatgagatcagaaatggccgcctgctgggcgtgtgtgcctctgtggacaactgccgcctgtttgtgggcggcatccccaagaccaagaagcgggaggagatcctgtctgagatgaagaaggtgacagagggcgtggtggatgtgattgtgtaccccagcgctgctgacaagaccaagaacagaggatttgcctttgtggagtatgagagccacagagctgctgccatggcccggaggaagctgctgcccggccgcatccagctgtggggccatggaattgctgtggactgggccgagcctgaggtggaggtggatgaggacaccatgagctctgtgaagatcctgtatgtgaggaacctgatgctgagcaccagcgaggagatgattgagaaggagttcaacaacatcaagccaggagctgtggagcgggtgaagaagatccgggactatgcctttgtgcacttcagcaacagagaagatgctgtggaggccatgaaggccctgaatggcaaggtgctggatggcagccccatcgaggtgaccctggccaagcctgtggacaaggacagctatgtgcgctacacccggggcaccggcggccggggcaccatgctgcagggcgagtacacctacagcctgggccaggtgtatgaccccaccaccacctacctgggcgcccctgtgttctacgccccccagacctacgccgccatccccagcctgcacttccctgccaccaagggccacctgagcaacagagccatcatccgggcccccagcgtgagaggagctgctggggtgcggggcctgggcggccggggctacctggcctacacaggcctgggccggggctaccaggtgaagggggacaagcgggaggacaagctgtatgacatcctgcccggcatggagctgacccccatgaaccctgtgaccctgaagccccagggcatcaagctggccccccagatcctggaggagatctgccagaagaacaactggggccagcctgtgtaccagctgcacagcgccatcggccaggaccagaggcagctgttcctgtacaagatcaccatcccagccctggccagccagaacccagccatccaccccttcaccccacccaagctgagcgcctttgtggatgaggccaagacctacgccgctgagtacaccctgcagaccctgggcatccccacagatggaggagatggcaccatggccacagctgctgctgctgccacagccttccctggctatgctgtgcccaatgccacagcccctgtgtctgctgcccagctgaagcaggccgtgaccctgggccaggacctggccgcctacaccacctatgaggtgtaccccacctttgctgtgacagcccggggagatggctacggcaccttctag

SEQ ID NO: 19951 - DNA, 1761 bp, Artificial Sequence
  Description of Artificial Sequence: Synthetic coding sequence
atggagagcaaccacaagtctggagatggcctgagcggcacccagaaggaggccgccctgcgggccctggtgcagaggacaggctacagcctggtgcaggagaatggccagaggaaatatggaggccccccacctggctgggatgctgcccctcctgagcggggctgtgagatcttcatcggcaagctgccccgggacctgtttgaagatgagctgatccccctgtgtgagaagattggcaagatctatgagatgaggatgatgatggacttcaacggcaacaacagaggctacgcctttgtgaccttcagcaacaaggtggaggccaagaatgccatcaagcagctgaacaactatgagatcagaaatggccgcctgctgggcgtgtgtgcctctgtggacaactgccgcctgtttgtgggcggcatccccaagaccaagaagcgggaggagatcctgtctgagatgaagaaggtgacagagggcgtggtggatgtgattgtgtaccccagcgctgctgacaagaccaagaacagaggatttgcctttgtggagtatgagagccacagagctgctgccatggcccggaggaagctgctgcccggccgcatccagctgtggggccatggaattgctgtggactgggccgagcctgaggtggaggtggatgaggacaccatgagctctgtgaagatcctgtatgtgaggaacctgatgctgagcaccagcgaggagatgattgagaaggagttcaacaacatcaagccaggagctgtggagcgggtgaagaagatccgggactatgcctttgtgcacttcagcaacagagaagatgctgtggaggccatgaaggccctgaatggcaaggtgctggatggcagccccatcgaggtgaccctggccaagcctgtggacaaggacagctatgtgcgctacacccggggcaccggcggccggggcaccatgctgcagggcgagtacacctacagcctgggccaggtgtatgaccccaccaccacctacctgggcgcccctgtgttctacgccccccagacctacgccgccatccccagcctgcacttccctgccaccaagggccacctgagcaacagagccatcatccgggcccccagcgtgagaggagctgctggggtgcggggcctgggcggccggggctacctggcctacacaggcctgggccggggctaccaggtgaagggggacaagcgggaggacaagctgtatgacatcctgcccggcatggagctgacccccatgaaccctgtgaccctgaagccccagggcatcaagctggccccccagatcctggaggagatctgccagaagaacaactggggccagcctgtgtaccagctgcacagcgccatcggccaggaccagaggcagctgttcctgtacaagatcaccatcccagccctggccagccagaacccagccatccaccccttcaccccacccaagctgagcgcctttgtggatgaggccaagacctacgccgctgagtacaccctgcagaccctgggcatccccacagatggaggagatggcaccatggccacagctgctgctgctgccacagccttccctggctatgctgtgcccaatgccacagcccctgtgtctgctgcccagctgaagcaggccgtgaccctgggccaggacctggccgcctacaccacctatgaggtgtaccccacctttgctgtgacagcccggggagatggctacggcaccttctag

SEQ ID NO: 19952 - DNA, 1761 bp, Artificial Sequence; identical to SEQ ID NO: 19951
  Description of Artificial Sequence: Synthetic coding sequence

SEQ ID NO: 19953 - DNA, 1542 bp, Artificial Sequence
  Description of Artificial Sequence: Synthetic coding sequence
atgcagaggacctttgcctggctgctggacagagtgcagcacctgggcgcccctgtgaccctgcgggccagctacctggagatctacaatgagcaggtgcgggacctgctgagcctgggcagcccccggcccctgcctgtgcgctggaacaagacccggggcttctacgtggagcagctgcgggtggtggagtttggcagcctggaggccctgatggagctgctgcagacaggcctgagcagaagaagaaattctgcccacaccctgaaccaggccagcagccgcagccacgccctgctgaccctgtacatcagccggcagacagcccagcagatgcccagcgtggaccctggagagccccctgtgggcggcaagctgtgctttgtggacctggccggcagcgagaaggtggccgccaccggcagcagaggagagctgatgctggaggccaacagcatcaacagaagcctgctggccctgggccactgcatcagcctgctgctggacccccagaggaagcagagccacatccccttccgggacagcaagctgaccaagctgctggccgacagcctgggcggccggggcgtgaccctgatggtggcctgtgtgagccccagcgcccagtgcctgcctgagaccctgagcaccctgcgctatgccagccgggcccagagggtgaccacccggccccaggcccccaagagccctgtggccaagcagccccagaggctggagacagagatgctgcagctgcaggaggagaacagaaggctgcagttccagctggaccagatggactgcaaggccagcggcctgagcggggcccgggtggcctgggcccagaggaacctgtatggcatgctgcaggagttcatgctggagaatgaaaggctgaggaaggagaagagccagctgcagaacagccgggacctggcccagaatgagcagaggatcctggcccagcaggtgcacgccctggagcggcggctgctgagcgcctgctaccaccaccagcagggccctggcctgaccccaccctgcccctgcctgatggccccagccccaccctgccacgccctgccccccctgtacagctgcccctgctgccacatctgccccctgtgccgggtgcccctggcccactgggcctgcctgcctggagagcaccacctgccccaggtgctggaccctgaggccagcggcggccggcccccatctgcccggcccccaccctgggccccaccctgcagccctggcagcgccaagtgcccccgggagaggagccacagcgactggacccagaccagggtgctggccgagatgctgacagaggaggaggtggtgcccagcgccccacccctgcctgtgcggccccccaagaccagccctggcctgcggggcggggccggcgtgcccaacctggcccagaggctggaggccctgcgggaccagatcggcagcagcctgcggcggggccgcagccagcccccctgcagcgagggcgcccggagccctggccaggtgctgcccccccactag

SEQ ID NO: 19954 - DNA, 786 bp, Artificial Sequence
  Description of Artificial Sequence: Synthetic coding sequence
atggtgaagggggagaagggccccaagggcaagaagatcaccctgaaggtggccaggaactgcatcaagatcacctttgatggcaagaagaggctggacctgagcaagatgggcatcaccaccttccccaagtgcatcctgcggctgagtgacatggatgagctggacctgagcaggaacctgatcaggaagatcccagacagcatcagcaagttccagaacctgcgctggctggacctgcacagcaactacatcgacaagctgcctgagagcatcggccagatgaccagcctgctgtacctgaatgtgagcaacaaccggctgaccagcaatggcctgcctgtggagctgaagcagctgaagaacatccgggctgtgaacctgggcctgaaccacctggacagcgtgcccaccaccctgggcgccctgaaggagctgcacgaggtgggcctgcatgacaacctgctgaacaacatccctgtgtccatcagcaagctgcccaagctgaagaagctgaacatcaagaggaaccccttccccaagccaggagagagcgagatcttcatcgacagcatccggcggctggagaacctgtatgtggtggaggagaaggacctgtgtgccgcctgcctgaggaagtgccagaatgcccgggacaacctgaaccgcatcaagaacatggccaccaccacccccaggaagaccatcttccccaacctgatcagccccaacagcatggccaaggacagctgggaggactggaggatccggctgaccagcagctag

SEQ ID NO: 19955 - DNA, 1770 bp, Artificial Sequence
  Description of Artificial Sequence: Synthetic coding sequence
atggccagcagccagagggacatggaggactgggtgcaggccatccggcgggtcatctgggcccccctgggcggcggcacagcccggcgcagccacgcccaccccctggagcccctgcccccaggcatcttcggccagaggctggaggagaccgtgcaccacgagaggaaatatggcccccggctggcccccctgctggtggagcagtgtgtggacttcatccgggagcggggcctgacagaggagggcctcttcaggatgcctggccaggccaacctggtgcgggacctgcaggacagctttgactgtggggagaagcccctgtttgacagcaccacagatgtgcacacagtggccagcctgctgaagctgtacctgcgggagctgcctgagcctgtggtgccctttgcccgctatgaggacttcctgagctgtgcccagctgctgaccaaggatgaaggagagggcaccctggagctggccaagcaggtgagcaacctgccccaggccaactacaacctgctgcgctacatctgcaagttcctggatgaggtgcaggcctacagcaatgtgaacaagatgtctgtgcagaacctggccaccgtgtttggccccaacatcctgcggccccaggtggaggaccctgtgaccatcatggagggcaccagcctggtgcagcacctgatgacagtgctgatcaggaagcacagccagctgttcaccgcccctgtgcctgagggccccaccagcccccggggcggcctgcagtgtgctgtgggctggggcagcgaggaggtgacccgggacagccagggcgagcccggcggccctggcctgcctgcccacaggaccagcagcctggatggagctgctgtggccgtgctgagcaggacagcccccactggacctggcagccgctgcagccctgggaagaaggtgcagaccctgcccagctggaagagcagcttccggcagcccaggagcctgagcggcagccccaagggcggcggcagcagcctggaggtgcccatcatcagcagcggcggcaactggctgatgaatggcctgagcagcctgcggggccacagaagagccagcagcggggaccggctgaaggacagcggctctgtgcagaggctgagcacctatgacaacgtgcctgcccctggcctggtgcccggcatccccagcgtggcctccatggcctggagcggggccagcagcagcgagagctctgtgggcggcagcctgagcagctgcacagcctgccgggccagtgacagcagcgcccggagcagcctgcacacagactgggccctggagcccagccccctgcccagcagcagcgaggaccccaagagcctggacctggaccacagcatggatgaggccggggccggggccagcaacagcgagcccagcgagccagacagccccacccgggagcacgccaggagaagtgaggccctgcagggcctggtgacagagctgcgggcagagctgtgccggcagaggacagaatatgaaagatctgtgaagagaattgaggagggcagcgctgacctgaggaagaggatgagccggctggaggaggagctggaccaggagaagaagaagtacatcatgctggagatcaagctgaggaacagcgagcgggccagagaagatgctgagaggaggaaccagctgctgcagcgggagatggaggagttcttcagcaccctgggcagcctgactgtgggcgccaagggggcccgggcccccaagtag

SEQ ID NO: 19956 - DNA, 1209 bp, Artificial Sequence
  Description of Artificial Sequence: Synthetic coding sequence
atgtctgctgagggcgctgagcccggccctggcagcggcagcggccctggccctggccccctgtgcccagagcacggccaggccctgtcctggttctgtggcagcgagaggaggcctgtgtgtgccgcctgtgccggcctgggcggccgctgccggggccaccgcatcagaagagctgaggagagagctgaggagctgaggaacaagatcgtggaccagtgtgagcggctgcagctgcagagcgctgccatcaccaagtatgtggctgatgtgctgcccgggaagaaccagagagctgtgtccatggccagcgctgcccgggagctggtgatccagaggctgagcctggtgcgcagcctgtgtgagagcgaggagcagaggctgctggagcaggtgcatggagaggaggagcgggcccaccagagcatcctgacccagagggtgcactgggccgaggccctgcagaagctggacaccatcagaacaggcctggtgggcatgctgacccacctggatgacctgcagctgatccagaaggagcaggagatctttgagaggacagaggaggccgagggcatcctggacccccaggagagcgagatgctgaacttcaatgagaagtgcaccaggagccccctgctgacccagctgtgggccacagctgtgctgggcagcctgtctggaacagaggacatcagaattgatgagaggacagtgagccccttcctgcagctgagtgatgacaggaagaccctgaccttcagcaccaagaagagcaaggcctgtgctgatggccctgagagatttgaccactggcccaatgccctggccgccaccagcttccagaatggcctgcacgcctggatggtgaatgtgcagaacagctgtgcctacaaggtgggcgtggccagcggccacctgcccaggaagggcagcggcagtgactgccgcctgggccacaatgccttctcctgggtgttcagccgctatgaccaggagttccgcttcagccacaacggccagcacgagcccctgggcctgctgcggggccctgcccagctgggcgtggtgctggacctgcaggtgcaggagctgctcttctatgagcccgccagcggcaccgtgctgtgtgcccaccacgtgtccttccctggccccctcttccctgtgtttgctgtggccgaccagaccatcagcatcgtgaggtag

SEQ ID NO: 19957 - DNA, 258 bp, Artificial Sequence
  Description of Artificial Sequence: Synthetic coding sequence
atgctgcggaggaagcccacccggctggagctgaagctggatgacatcgaggagtttgagaacatcaggaaggacctggagaccaggaagaagcagaaggaggatgtggaggtggtgggcggcagtgatggagagggcgccatcggcctgagcagtgaccccaagagccgggagcagatgatcaatgacagaattggctacaagccccagcccaagcccaacaacagaagcagccagtttggcagcctggagttctag

SEQ ID NO: 19958 - DNA, 744 bp, Artificial Sequence
  Description of Artificial Sequence: Synthetic coding sequence
atgctgagtgatggctgcggcagcgaggagaagatctctgtgcccagctgctacggcggcattggagcccctgtgtcccggcaggtgcctgccagccatgattctgagctgatggccttcatgaccaggaagctgtgggacctggagcagcaggtgaaggcccagacagatgagatcctgagcaaggaccagaagattgctgccctggaggacctggtgcagaccctgcggccccaccctgctgaggccaccctgcagaggcaggaggagctggagaccatgtgtgtgcagctgcagaggcaggtgcgggagatggagcgcttcctgagtgactatggcctgcagtgggtgggggagcccatggaccaggaggacagcgagagcaagacagtgtctgagcacggggagcgggactggatgacagccaagaagttctggaagccaggggacagcctggcccctcctgaggtggactttgaccggctgctggccagcctgcaggacctgtctgagctggtggtggagggggacacccaggtgacccctgtgcctgggggcgcccggctgcggaccctggagcccatccccctgaagctgtacagaaatggcatcatgatgtttgatggccccttccagcccttctatgaccccagcacccagcgctgcctgcgggacatcctggatggcttcttccccagcgagctgcagaggctgtacccaaatggagtgcccttcaaggtgtag

SEQ ID NO: 19959 - DNA, 1464 bp, Artificial Sequence; identical to SEQ ID NO: 19464
  Description of Artificial Sequence: Synthetic coding sequence

SEQ ID NO: 19960 - DNA, 1020 bp, Artificial Sequence; identical to SEQ ID NO: 19098
  Description of Artificial Sequence: Synthetic coding sequence

SEQ ID NO: 19961 - DNA, 1563 bp, Artificial Sequence
  Description of Artificial Sequence: Synthetic coding sequence
atgagcagccccctggccagcctgagcaagaccaggaaggtgcccctgcccagcgagcccatgaaccctggaagaagaggcatccgcatctatggagatgaagatgaggtggacatgctgagtgatggctgcggcagcgaggagaagatctctgtgcccagctgctacggcggcattggagcccctgtgtcccggcaggtgcctgccagccatgattctgagctgatggccttcatgaccaggaagctgtgggacctggagcagcaggtgaaggcccagacagatgagatcctgagcaaggaccagaagattgctgccctggaggacctggtgcagaccctgcggccccaccctgctgaggccaccctgcagaggcaggaggagctggagaccatgtgtgtgcagctgcagaggcaggtgcgggagatggagcgcttcctgagtgactatggcctgcagtgggtgggggagcccatggaccaggaggacagcgagagcaagacagtgtctgagcacggggagcgggactggatgacagccaagaagttctggaagccaggggacagcctggcccctcctgaggtggactttgaccggctgctggccagcctgcaggacctgtctgagctggtggtggagggggacacccaggtgacccctgtgcctgggggcgcccggctgcggaccctggagcccatccccctgaagctgtacagaaatggcatcatgatgtttgatggccccttccagcccttctatgaccccagcacccagcgctgcctgcgggacatcctggatggcttcttccccagcgagctgcagaggctgtacccaaatggagtgcccttcaaggtgtctgacctgaggaaccaggtgtacctggaggatggcctggaccccttccctggagagggccgggtggtgggccggcagctgatgcacaaggccctggacagagtggaggagcaccctggcagcaggatgacagctgagaagttcctgaaccggctgcccaagtttgtgatccggcagggcgaggtgattgacatccggggccccatccgggacaccctgcagaactgctgccccctgcctgcccgcatccaggagatcgtggtggagacccccaccctggccgctgagcgggagaggagccaggagagccccaacaccccagccccacccctgtccatgctgcgcatcaagtcagaaaatggagagcaggccttcctgctgatgatgcagcctgacaacaccatcggagatgtgcgggccctgctggcccaggcccgggtgatggatgccagcgcctttgagatcttcagcaccttcccccccaccctgtaccaggatgacaccctgaccctgcaggccgccggcctggtgcccaaggccgccctgctgctgcgggcccggcgggcccccaagagcagcctgaagttcagccctggcccctgccccggccctggccctggccccagccctggccctggccctggccccagccctggccctggccctggccccagcccctgccccggccccagccccagcccccagtag

SEQ ID NO: 19962 - DNA, 1563 bp, Artificial Sequence; identical to SEQ ID NO: 19961
  Description of Artificial Sequence: Synthetic coding sequence

SEQ ID NO: 19963 - DNA, 834 bp, Artificial Sequence
  Description of Artificial Sequence: Synthetic coding sequence
atgtttgatggccccttccagcccttctatgaccccagcacccagcgctgcctgcgggacatcctggatggcttcttccccagcgagctgcagaggctgtaccccaacggggtgcccttcaaggtgtctgacctgaggaaccaggtgtacctggaggatggcctggaccccttccctggagagggccgggtggtgggccggcagctgatgcacaaggccctggacagagtggaggagcaccctggcagcaggatgacagctgagaagttcctgaaccggctgcccaagtttgtgatccggcagggcgaggtgattgacatccggggccccatccgggacaccctgcagaactgctgccccctgcctgcccgcatccaggagatcgtggtggagacccccaccctggccgctgagcgggagaggagccaggagagccccaacaccccagccccacccctgtccatgctgcgcatcaagtcagaaaatggagagcaggccttcctgctgatgatgcagcctgacaacaccatcggagatgtgcgggccctgctggcccaggcccgggtgatggatgccagcgcctttgagatcttcagcaccttcccccccaccctgtaccaggatgacaccctgaccctgcaggccgccggcctggtgcccaaggccgccctgctgctgcgggcccggcgggcccccaagagcagcctgaagttcagccctggcccctgccccggccctggccctggccccagccctggccctggccctggccccagccctggccctggccctggccccagcccctgccccggccccagccccagcccccagtag

SEQ ID NO: 19964 - DNA, 1314 bp, Artificial Sequence
  Description of Artificial Sequence: Synthetic coding sequence
atggccggcggcccccccaaggccctgcccagcacaggcccccacagcctgcgggacatgccccaccccctggccggcagcagcagcgaggaggccgtgggcggggacagcacccccagcccagacctgctgatggcccggagctttggagacaaggacctgatcctgcccaacggcggcaccccagctggcaccagcagccctgccagcagcagcagcctgctgaaccggctgcagctggatgatgacattgatggagagacccgggacctcttcgtcatcgtggatgaccccaagaagcacgtgtgcaccatggagacctacatcacctaccgcatcaccaccaagagcaccagggtggagtttgacctgcctgagtacagcgtgagaagacgctaccaggactttgactggctgcggagcaagctggaggagagccagcccacccacctgatcccccccctgcctgagaagtttgtggtgaagggcgtggtggaccgcttcagcgaggagtttgtggagaccaggaggaaggccctggacaagttcctgaagaggatcacagaccaccctgtgctgtccttcaatgagcacttcaacatcttcctgacagccaaggacctgaatgcctacaagaagcagggcatcgccctgctgaccaggatgggagagagcgtgaagcacgtgactggaggctacaagctgcggacccggcccctggagtttgctgccatcggggactacctggacacctttgccctgaagctgggcaccatcgaccgcatcgcccagaggatcatcaaggaggagattgagtacctggtggagctgcgggagtatggccctgtgtacagcacctggagcgccctggagggggagctggccgagcccctggagggcgtgtctgcctgcatcggcaactgcagcacagccctggaggagctgacagatgacatgacagaggacttcctgcctgtgctgcgggagtacatcctgtacagcgacagcatgaagtctgtgctgaagaagagggaccaggtgcaggccgagtatgaggccaagctggaggccgtggccctgaggaaagaagatcggcccaaggtgcctgcagatgtggagaagtgccaggacaggatggagtgcttcaatgctgacctgaaggctgacatggagcgctggcagaacaacaagaggcaggacttccggcagctgctgatgggcatggctgacaagaacatccagtactatgagaagtgcctgatggcctgggagagcatcatccccctgctgcaggagaagcaggaggccaagtag

SEQ ID NO: 19965 - DNA, 1263 bp, Artificial Sequence
  Description of Artificial Sequence: Synthetic coding sequence
atgagcagcccccgggacttccgggcagagcctgtgaatgactatgagggcaatgacagcgaggccgaggacctgaacttccgggagaccctgcccagcagcagccaggagaacacccccaggagcaaggtgtttgagaacaaggtgaacagcgagaaggtgaagctgagcctgaggaacttcccccacaatgactatgaagatgtgtttgaggagcccagcgagagcggcagtgaccccagcatgtggacagcccggggccccttccggcgggaccgctggagcagtgaagatgaggaggccgccggccccagccaggccctgagccccctgctgagtgacaccaggaagatcgtgtctgagggggagctggaccagctggcccagatccggcccctcatcttcaacttccacgagcagacagccatcaaggactgcctgaagatcctggaggagaagacagctgcctatgacatcatgcaggagttcatggccctggagctgaagaacctgcccggggagttcaacagcggcaaccagcccagcaaccgggagaagaaccgctacagagacatcctgccctatgacagcaccagggtgcccctgggcaagagcaaggactacatcaatgccagctacatccgcatcgtgaactgtggggaggagtacttctacatcgccacccagggccccctgctgagcaccattgatgacttctggcagatggtgctggagaacaacagcaatgtgattgccatgatcacccgggagattgagggcggcatcatcaagtgctaccactactggcccatcagcctgaagaagcccctggagctgaagcacttccgggtcttcctggagaactaccagatcctgcagtacttcatcatccgcatgttccaggtggtggagaagagcacaggcaccagccacagcgtgaagcagctgcagttcaccaagtggccagaccacggcaccccagccagcgctgacagcttcatcaagtacatccgctatgccaggaagagccacctgaccggccccatggtggtgcactgcagcgctggcattggaagaactggagtcttcctgtgtgtggatgtggtgttctgtgccatcgtgaagaactgcagcttcaacatcatggacatcgtggcccagatgagggagcagaggagcggcatggtgcagaccaaggagcagtaccacttctgctatgacatcgtgctggaggtgctgaggaagctgctgaccctggactag

SEQ ID NO: 19966 - DNA, 837 bp, Artificial Sequence
  Description of Artificial Sequence: Synthetic coding sequence
atgagcagcccccgggacttccgggcagagcctgtgaatgactatgagggcaatgacagcgaggccgaggacctgaacttccgggagaccctgcccagcagcagccaggagaacacccccaggagcaaggtgtttgagaacaaggtgaacagcgagaaggtgaagctgagcctgaggaacttcccccacaatgactatgaagatgtgtttgaggagcccagcgagagcggcagtgaccccagcatgtggacagcccggggccccttccggcgggaccgctggagcagtgaagatgaggaggccgccggccccagccaggccctgagccccctgctgagtgacaccaggaagatcgtgtctgagggggagctggaccagctggcccagatccggcccctcatcttcaacttccacgagcagacagccatcaaggactgcctgaagatcctggaggagaagacagctgcctatgacatcatgcaggagttcatgacaggcaccagccacagcgtgaagcagctgcagttcaccaagtggccagaccacggcaccccagccagcgctgacagcttcatcaagtacatccgctatgccaggaagagccacctgaccggccccatggtggtgcactgcagcgctggcattggaagaactggagtcttcctgtgtgtggatgtggtgttctgtgccatcgtgaagaactgcagcttcaacatcatggacatcgtggcccagatgagggagcagaggagcggcatggtgcagaccaaggagcagtaccacttctgctatgacatcgtgctggaggtgctgaggaagctgctgaccctggactag

SEQ ID NO: 19967 - DNA, 681 bp, Artificial Sequence
  Description of Artificial Sequence: Synthetic coding sequence
atgagcagcccccgggacttccgggcagagcctgtgaatgactatgagggcaatgacagcgaggccgaggacctgaacttccgggagaccctgcccagcagcagccaggagaacacccccaggagcaaggtgtttgagaacaaggtgaacagcgagaaggtgaagctgagcctgaggaacttcccccacaatgactatgaagatgtgtttgaggagcccagcgagagcggcagtgaccccagcatgtggacagcccggggccccttccggcgggaccgctggagcagtgaagatgaggaggccgccggccccagccaggccctgagccccctgctgagtgacaccaggaagatcgtgtctgagggggagctggaccagctggcccagatccggcccctcatcttcaacttccacgagcagacagccatcaaggactgcctgaagatcctggaggagaagacagctgcctatgacatcatgcaggagttcatggccctggagctgaagaacctgcccggggagttcaacagcggcaaccagcccagcaaccgggagaagaaccgctacagagacatcctgcccttccagcaccacggctacagcggccccaatgaaagaaccaccttctggcacggcagcaatgaaggagctgtgtccctgctgctgcgctactgtgcctag

SEQ ID NO: 19968 - DNA, 681 bp, Artificial Sequence
  Description of Artificial Sequence: Synthetic coding sequence
atgcaccagacctgtgtgcggctggagcgggaggccagcgcccggcccagccctggccctgtgctgcccccccggcccctgcccagccacacagagctgcagatccgggagggccccaagaggaccatccgggctgctgctgagggcgccccctgtgtgggccgggtgcgctgtgcccctggcaacagaggaggccgggagggcgccagcggcgtgcggggcggcgtggcccaggtgcccccccggctgcctgccccacccatcggccctgagagagatgacctggccggcggggccggcaggaagcccctgcccagcacagctgctgccagcagccctggcagcgctgctgctgccacagctgccctgtgccccccagcccggctgagcacccccagcatgagcggcctgcgggtgtacagcacctctgtgacaggcagccgggagatcaagagccagcagagcgaggtgacccgcatcctggatggcaagaggatccagtaccagctggtggacatcagccaggacaatgccctgagagatgagatgagggccctggccggcaaccccaaggccaccccaccccagatcgtgaatggagaccagtactgtggggactatgagctgtttgtggaggccgtggagcagaacaccctgcaggagttcctgaagctggcctag

SEQ ID NO: 19969 - DNA, 1518 bp, Artificial Sequence
  Description of Artificial Sequence: Synthetic coding sequence
atggaccctggaaatgaaaacagcgccacagaggccgccgccatcatcgacctggaccctgactttgagccccagagccggcccaggagctgcacctggcccctgcccaggcctgagatcgccaaccagcccagcgagcccccagaggtggagccagacctgggggagaaggtgcacacagagggccgctctgagcccatcctgctgcccagccggctgcctgagcctgctgggggcccccagcccggcatcctgggcgctgtgacaggccccaggaaaggaggcagcagaagaaatgcctggggcaaccagagctatgcagagctgatcagccaggccatcgagagcgcccctgagaagaggctgaccctggcccagatctatgagtggatggtgaggacagtgccctacttcaaggacaagggggacagcaacagcagcgctggctggaagaacagcatccgccacaacctgagcctgcacagcaagttcatcaaggtgcacaatgaggccaccgggaagagctcctggtggatgctgaaccctgagggcggcaagagcggcaaggcccccaggagaagagctgcctccatggacagcagcagcaagctgctgcggggccgcagcaaggcccccaagaagaagcccagcgtgctgcctgcccctcctgagggcgccacccccaccagccctgtgggccactttgccaagtggagcggcagcccctgcagcaggaaccgggaggaggccgacatgtggaccaccttccggcccaggagcagcagcaatgccagctctgtgtccacccggctgagccccctgcggcctgagagcgaggtgctggccgaggagatcccagcctctgtgtcctcctatgctgggggcgtgccccccaccctgaatgaaggcctggagctgctggatggcctgaacctgaccagcagccacagcctgctgagccgcagcggcctgagcggcttcagcctgcagcaccctggggtgacaggccccctgcacacctacagcagcagcctcttcagccctgctgagggccccctgtctgctggggagggctgcttcagcagcagccaggccctggaggccctgctgaccagtgacaccccacctcctccagcagatgtgctgatgacccaggtggaccccatcctgagccaggcccccaccctgctgctgctgggcggcctgcccagcagcagcaagctggccaccggggtgggcctgtgccccaagcccctggaggcccctggccccagcagcctggtgcccaccctgtccatgattgcccctcctcctgtgatggccagcgcccccatccccaaggccctgggcacccctgtgctgaccccacccacagaggccgccagccaggacaggatgccccaggacctggacctggacatgtacatggagaacctggagtgtgacatggacaacatcatcagtgacctgatggatgaaggagagggcctggacttcaactttgagccagacccctag

SEQ ID NO: 19970 - DNA, 1062 bp, Artificial Sequence
  Description of Artificial Sequence: Synthetic coding sequence
atggactacaagagcagcctcatccaggacggcaaccccatggagaacctggagaagcagctgatctgccccatctgcctggagatgttcaccaagcctgtggtgatcctgccctgccagcacaacctgtgcaggaaatgtgccaatgacatcttccaggccgccaacccctactggaccagccggggcagctctgtgtccatgtctgggggccgcttccgctgccccacctgcagacatgaggtgatcatggacagacatggagtgtatggcctgcagaggaacctgctggtggagaacatcatcgacatctacaagcaggagtgcagcagccggcccctgcagaagggcagccaccccatgtgcaaggagcatgaagatgagaagatcaacatctactgcctgacctgtgaggtgcccacctgcagcatgtgcaaggtgtttggcatccacaaggcctgtgaggtggcccccctgcagagcgtcttccagggccagaagacagagctgaacaactgcatctccatgctggtggccggaaatgacagagtgcagaccatcatcacccagctggaggacagcagaagagtgaccaaggagaacagccaccaggtgaaggaggagctgagccagaagtttgacaccctgtatgccatcctggatgagaagaagtctgagctgctgcagaggatcacccaggagcaggagaagaagctgtccttcatcgaggccctgatccagcagtaccaggagcagctggacaagagcaccaagctggtggagacagccatccagagcctggatgagcccggcggggccaccttcctgctgacagccaagcagctgatcaagagcatcgtggaggccagcaagggctgccagctgggcaagacagagcagggctttgagaacatggacttcttcaccctggacctggagcacatcgcagatgccctgcgggccatcgactttggaacagatgaggaggaggaggagttcatcgaggaggaggaccaggaggaggaggagagcacagagggcaaggaggagggccaccagtag

SEQ ID NO: 19971 - DNA, 1179 bp, Artificial Sequence
  Description of Artificial Sequence: Synthetic coding sequence
atgggcgtgaaccagagcgtgggcttcccccctgtgacaggcccccacctggtgggctgtggagatgtgatggagggccagaacctgcagggcagcttcttccgcctcttctacccctgccagaaggccgaggagaccatggagcagcccctgtggatccccaggtatgagtactgcaccggcctggccgagtacctgcagttcaacaagagatgtggcggcctgctcttcaacctggccgtgggcagctgccgcctgcctgtgtcctggaatggccccttcaagaccaaggacagcggctaccccctcatcatcttcagccacggcctgggcgccttccgcaccctgtacagcgccttctgcatggagctggccagccggggctttgtggtggccgtgcctgagcaccgggacagatctgctgccaccacctacttctgcaagcaggcccctgaggagaaccagcccaccaatgaaagcctgcaggaggagtggatccccttcagaagagtggaggagggggagaaggagttccacgtgaggaacccccaggtgcaccagagggtgtctgaatgtctgcgggtgctgaagatcctgcaggaggtgacagctggccagacagtgttcaacatcctgcccggcggcctggacctgatgaccctgaagggcaacatcgacatgagccgggtggccgtgatgggccacagctttggaggagccacagccatcctggccctggccaaggagacccagttccgctgtgctgtggccctggatgcctggatgttccccctggagcgggacttctaccccaaggcccggggccctgtgttcttcatcaacacagagaagttccagaccatggagagcgtgaacctgatgaagaagatctgtgcccagcacgagcagagccgcatcatcaccgtgctgggctctgtgcacaggagccagacagactttgcctttgtgacaggcaacctgattggcaagttcttcagcacagagacccggggcagcctggacccctatgagggccaggaggtgatggtgcgggccatgctggccttcctgcagaagcacctggacctgaaggaggactacaaccagtggaacaacctgattgagggcatcggccccagcctgacccctggggccccccaccacctgagcagcctgtag

SEQ ID NO: 19972 - DNA, 1179 bp, Artificial Sequence; identical to SEQ ID NO: 19971
  Description of Artificial Sequence: Synthetic coding sequence

SEQ ID NO: 19973 - DNA, 213 bp, Artificial Sequence
  Description of Artificial Sequence: Synthetic coding sequence
atggtgaggaccaagacctggaccctgaagaagcactttgtgggctaccccaccaacagcgactttgagctgaagacagctgagctgccccccctgaagaatggagaggtgctgctggaggccctcttcctgactgtggacccctacatgagggtggccgccaagaggctgaaggagggggacaccatgatgggccagcaggtggccaagtag

SEQ ID NO: 19974 - DNA, 213 bp, Artificial Sequence; identical to SEQ ID NO: 19973
  Description of Artificial Sequence: Synthetic coding sequence

SEQ ID NO: 19975 - DNA, 534 bp, Artificial Sequence; identical to SEQ ID NO: 18316
  Description of Artificial Sequence: Synthetic coding sequence

SEQ ID NO: 19976 - DNA, 1263 bp, Artificial Sequence; identical to SEQ ID NO: 19965
  Description of Artificial Sequence: Synthetic coding sequence

SEQ ID NO: 19977 - DNA, 837 bp, Artificial Sequence; identical to SEQ ID NO: 19966
  Description of Artificial Sequence: Synthetic coding sequence

SEQ ID NO: 19978 - DNA, 681 bp, Artificial Sequence; identical to SEQ ID NO: 19967
  Description of Artificial Sequence: Synthetic coding sequence

SEQ ID NO: 19979 - DNA, 789 bp, Artificial Sequence
  Description of Artificial Sequence: Synthetic coding sequence
atgagccgctacctgcggccccccaacaccagcctgtttgtgagaaatgtggctgatgacaccaggtctgaggacctgcggcgggagtttggccgctatggccccatcgtggatgtgtatgtgcccctggacttctacacccggcggccccggggctttgcctacgtgcagtttgaagatgtgagagatgctgaagatgccctgcacaacctggacaggaagtggatctgtggccggcagatcgagatccagtttgcccagggcgacaggaagacccccaaccagatgaaggccaaggagggcagaaatgtgtacagcagcagccgctatgatgattatgaccgctacagaagaagccgcagccgctcctatgaaagaagaagaagccgcagccgcagctttgactacaactacagaagaagctacagccccaggaacagccggcccaccggccggccccggcgcagccgcagccacagcgacaatgaccgcttcaagcacaggaacagaagcttcagccgcagcaagagcaacagccgcagccgcagcaagagccagcccaagaaggagatgaaggccaagagccgcagccgcagcgccagccacaccaagacccggggcaccagcaagacagacagcaagacccactacaagagcggcagccgctatgagaaggagagcaggaagaaggagccccccaggagcaagagccagagccgcagccagagccgcagccgcagcaagagccgcagccgctcctggaccagccccaagagcagcggccactag

SEQ ID NO: 19980 - DNA, 522 bp, Artificial Sequence
  Description of Artificial Sequence: Synthetic coding sequence
atgagccgctacctgcggccccccaacaccagcctgtttgtgagaaatgtggctgatgacaccaggtctgaggacctgcggcgggagtttggccgctatggccccatcgtggatgtgtatgtgcccctggacttctacacccggcggccccggggctttgcctacgtgcagtttgaagatgtgagagatgctgaagatgccctgcacaacctggacaggaagtggatctgtggccggcagatcgagatccagtttgcccagggcgacaggaagacccccaaccagatgaaggccaaggagggcagaaatgtgtacagcagcagccgctatgatgattatgaccgctacagaagaagccgcagccgctcctatgaaagaagaagaagccgcagccgcagctttgactacaactacagaagaagctacagccccaggaacagccggcccaccggccggccccggcgcagccgcagccacagcgacaatgacagccaggtgtccaagaagaagaatgaaagatag

SEQ ID NO: 19981 - DNA, 669 bp, Artificial Sequence
  Description of Artificial Sequence: Synthetic coding sequence
atgtctgccttcggccatgatgaggcctggatggaggccggcggcttcggcctggaggccgctgagaggacagagtaccagagcctgtgcaagagcaagctgctcttcctgggggagcagagcgtgggcaagaccagcatcatcagccgcttcatgtacaacagctttggctgtgcctgccaggccaccgtgggcatcgacttcctgagcaagaccatgtacctggaggaccagatcgtgcagctgcagctgtgggacacagctggccaggagcgcttccacagcctcatccccagctacatccgggacagcaccatcgctgtggtggtgtatgacatcaccaacatcaacagcttcaaggagacagacaagtgggtggagcacgtgcgggcagagagaggagatgatgtggtgatcatgctgctgggcaacaagattgacctggacaacaagaggcaggtgacagctgagcagggcgaggagaagagcaggaacctgaatgtgatgtttattgagaccagcgccaagacaggctacaacgtgaagaagctgttccggcgggtggccagcgccctgctgagcaccaggaccagccccccacccaaggagggcaccgtggagattgagctggagagctttgaggagagcggcaacagaagctactgctag

SEQ ID NO: 19982 - DNA, 348 bp, Artificial Sequence
  Description of Artificial Sequence: Synthetic coding sequence
atggtgcagatcatcaaggacaccaatgagttcaagaccttcctgacagctgctggccacaagctggccgtggtgcagttcagcagcaagagatgtggcccctgcaagaggatgtttcctgtgttccacgccatgtctgtgaagtaccagaatgtgttctttgccaacgtggatgtgaacaacagccctgagctggccgagacctgccacatcaagaccatccccaccttccagatgttcaagaagagccagaaggtgaccctcttcagccgcatcaagaggatcatctgctgctacagaagtggcttcatgagcaacctgtgcctggctgatgatggaaatgaatag

SEQ ID NO: 19983 - DNA, 384 bp, Artificial Sequence
  Description of Artificial Sequence: Synthetic coding sequence
atggtgcagatcatcaaggacaccaatgagttcaagaccttcctgacagctgctggccacaagctggccgtggtgcagttcagcagcaagagatgtggcccctgcaagaggatgtttcctgtgttccacgccatgtctgtgaagtaccagaatgtgttctttgccaacgtggatgtgaacaacagccctgagctggccgagacctgccacatcaagaccatccccaccttccagatgttcaagaagagccagaaggtgaccctcttcagccgcatcaagaggatcatctgctgctacagaagtggcttcatgagcaacctgatctttgagttctgtggggctgatgccaagaagctggaggccaagacccaggagctgatgtag

SEQ ID NO: 19984 - DNA, 1767 bp, Artificial Sequence
  Description of Artificial Sequence: Synthetic coding sequence
atgcacaggtctgcccccagccagaccaccaagaggagccgcagccccttcagcaccaccaggaggtcctgggatgattctgagagcagcggcaccaacctgaacatcgacaatgaagactacagccgctacccaccccgggagtaccgggccagcggcagcagaagaggcatggcctacggccacatcgacagctatggagcagatgattctgaggaggagggcgccggccctgtggagcggccccctgtgcggggcaagacaggcaagttcaaggatgacaagctgtatgaccctgagaagggggcccggagcctggccggccccccaccccacttcagcagcttcagcagagatgtgcgggaggagcgggacaagctggaccctgtgcctgctgcccgctgcagcgccagcagagctgacttcctgccccagagctctgtggccagccagagcagcagcgagggcaagctggccaccaagggggacagcagcgagcgggagcggcgggagcagaacctgcctgcccggcccagccgggcccctgtgtccatctgtggcggcggggagaacaccagcaagtctgctgaggagcctgtggtgcggcccaagatccggaacctggccagccccaactgtgtgaagcccaagatcttctttgacacagatgatgatgatgacatgccccacagcaccagccgctggagggacacagccaatgacaatgaaggccacagtgatggcctggcccggcggggccgcggggagagcagcagcggctacccagagcccaagtacccagaggacaagcgggaggcccggagtgaccaggtgaagccagagaaggtgcccaggagaagaaggaccatggctgaccctgacttctggacccacagtgatgactactacaagtactgtgatgaggacagcgacagcgacaaggagtggattgctgccctgcggaggaagtaccgcagccgggagcagaccctgagcagcagcggggagagctgggagaccctgcccgggaaggaggagcgggagcccccccaggccaaggtgtctgccagcacaggcaccagccctggccctggggccagcgccagcgctggggccggggccggggccagcgctggcagcaatggcagcaactacctggaggaggtgcgggagcccagcctgcaggaggagcaggccagcctggaggagggggagatcccctggctgcagtaccatgaaaatgacagcagcagcgagggggacaatgacagcggccacgagctgatgcagcccggggtcttcatgctggatggcaacaacaacctggaggatgacagctctgtgtctgaggacctggaggtggactggagcctgtttgatggctttgctgatggcctgggcgtggccgaggccatctcctatgtggacccccagttcctgacctacatggccctggaggagcggctggcccaggccatggagacagccctggcccacctggagagcctggccgtggatgtggaggtggccaaccccccagccagcaaggagagcattgatgccctgcctgagatcctggtgacagaagatcatggagctgtgggccaggagatgtgctgccccatctgctgcagtgaatatgtgaagggggaggtggccacagagctgccctgccaccactacttccacaagccctgtgtgtccatctggctgcagaagagcggcacctgccctgtgtgccgctgcatgtttcctccacccctgtag

SEQ ID NO: 19985 - DNA, 612 bp, Artificial Sequence
  Description of Artificial Sequence: Synthetic coding sequence
atgcctgagcagttctctgtggccgagttcctggccgtgacagctgaggacctgagcagccctgctggagctgctgcctttgctgccaagatgccccgctacagaggagctgccctggcccgggaggagatcctggagggggaccaggccatcctgcagaggatcaagaaggctgtgcgggccatccacagcagcggcctgggccacgtggagaatgaggagcagtaccgggaggccgtggagagcctgggcaacagccacctgagccagaacagccatgagctgagcacaggcttcctgaacctggccgtgttcacccgggaggtggccgccctcttcaagaacctgatccagaacctgaacaacatcgtgtccttccccctggacagcctgatgaagggccagctgagagatggccggcaggacagcaagaagcagctggagaaggcctggaaggactatgaggccaagatggccaagctggagaaggagcgggaccgggcccgggtgactggaggcatcccagcctggaacctgggcatcccagccaagccccaccccaccctgaagagggccagcgagagcccccaggcccccccagaccctgcctag

SEQ ID NO: 19986 - DNA, 1932 bp, Artificial Sequence; identical to SEQ ID NO: 19595
  Description of Artificial Sequence: Synthetic coding sequence

SEQ ID NO: 19987 - DNA, 1368 bp, Artificial Sequence
  Description of Artificial Sequence: Synthetic coding sequence
atgggccaggagagcagcaagcctgtgtggcccaaccccaccggcggctaccagagcaacacaggaagaagatatggaagaagacatgcctacgtgtccttccggccccccaccagccagcgggagcgcatcgccagccagaggaagaccaacagcgaggtgcccatgcacaggtctgcccccagccagaccaccaagaggagccgcagccccttcagcaccacccggcgctcctgggatgacagcgagagcagcggcaccaacctgaacatcgacaatgaagactacagcagcaccagccgctggagggacacagccaatgacaatgaaggccacagtgatggcctggcccggcggggccgcggggagagcagcagcggctacccagagcccaagtacccagaggacaagcgggaggcccggagtgaccaggtgaagccagagaaggtgcccaggagaagaaggaccatggctgaccctgacttctggacccacagtgatgactactacaagtactgtgatgaagattctgacagcgacaaggagtggattgctgccctgcggaggaagtaccgcagccgggagcagaccctgagcagcagtggagagagctgggagaccctgcccgggaaggaggagcgggagcccccccaggccaaggtgtctgccagcacaggcaccagccctggccctggggccagcgccagcgctggagctggagctggggccagcgctggcagcaatggcagcaactacctggaggaggtgcgggagcccagcctgcaggaggagcaggccagcctggaggagggggagatcccctggctgcagtaccatgaaaatgacagcagcagcgagggggacaatgattctggccacgagctgatgcagcccggggtcttcatgctggatggcaacaacaacctggaggatgacagctctgtgtctgaggacctggaggtggactggagcctgtttgatggctttgctgatggcctgggcgtggccgaggccatctcctatgtggacccccagttcctgacctacatggccctggaggagcggctggcccaggccatggagacagccctggcccacctggagagcctggccgtggatgtggaggtggccaaccccccagccagcaaggagagcattgatgccctgcctgagatcctggtgacagaggaccacggggctgtgggccaggagatgtgctgccccatctgctgcagtgaatatgtgaagggggaggtggccacagagctgccctgccaccactacttccacaagccctgtgtgtccatctggctgcagaagagcggcacctgccctgtgtgccgctgcatgttccccccacccctgtag

SEQ ID NO: 19988 - DNA, 390 bp, Artificial Sequence
  Description of Artificial Sequence: Synthetic coding sequence
atggccgagctgatccagaagaagctgcagggcgaggtggagaagtaccagcagctgcagaaggacctgagcaagtccatgagcggccggcagaagctggaggcccagctgacagagaacaacatcgtgaaggaggagctggccctgctggatggcagcaatgtggtgttcaagctgctgggccctgtgctggtgaagcaggagctgggggaggcccgggccaccgtgggcaagaggctggactacatcacagctgagatcaagagatatgagagccagctgcgggacctggagcggcagagcgagcagcagcgggagaccctggcccagctgcagcaggagttccagagggcccaggccgccaaggccggggcccctgggaaggcctag

SEQ ID NO: 19989 - DNA, 390 bp, Artificial Sequence; identical to SEQ ID NO: 19988
  Description of Artificial Sequence: Synthetic coding sequence

SEQ ID NO: 19990 - DNA, 390 bp, Artificial Sequence; identical to SEQ ID NO: 19988
  Description of Artificial Sequence: Synthetic coding sequence

SEQ ID NO: 19991 - DNA, 1512 bp, Artificial Sequence
  Description of Artificial Sequence: Synthetic coding sequence
atgaagtgtgagcactgcaccaggaaggagtgcagcaagaagaccaagacagatgaccaggagaatgtgtctgcagatgcccccagccctgcccaggagaatggagagaagggggagttccacaagctggctgatgccaagatcttcctgagtgactgcctggcctgtgacagctgcatgacagctgaggagggcgtgcagctgagccagcagaatgccaaggacttcttccgggtgctgaacctgaacaagaagtgtgacaccagcaagcacaaggtgctggtggtgtctgtgtgcccccagagcctgccctactttgctgccaagttcaacctgtctgtgacagatgccagccggcggctgtgtggcttcctgaagagcctgggcgtgcactacgtgtttgacaccaccatcgctgctgacttcagcatcctggagagccagaaggagtttgtgcggcgctaccggcagcacagcgaggaggagaggaccctgcccatgctgaccagcgcctgccccggctgggtgcgctatgcagagcgggtgctgggccggcccatcacagcccacctgtgcacagccaagagcccccagcaggtgatgggcagcctggtgaaggactactttgcccggcagcagaacctgagccctgagaagatcttccacgtgattgtggccccctgctatgacaagaagctggaggccctgcaggagagcctgcccccagccctgcacggcagcagaggagctgactgtgtgctgaccagcggcaaggtgctgatctcctggtggtgcacccctgtgatcacagccacccaggaggccgccgcccgggagagcctggagcccggccggcagaggctgcagagggacaagatcgcccccctggacagcagcctgggcggcggcggggagatcgcccagatcatggagcagggcgacctgtctgtgagagatgctgctgtggacaccctgtttggagacctgaaggaggacaaggtgaccaggcatgatggagccagcagtgatggccacctggcccacatcttcagacatgctgccaaggagctgttcaatgaagatgtggaggaggtgacctaccgggccctgaggaacaaggacttccaggaggtgaccctggagaagaatggagaggtggtgctgcgctttgctgctgcctacggcttcaggaacatccagaacatgatcctgaagctgaagaagggcaagttccccttccactttgtggaggtgctggcctgtgccggcggctgcctgaatggccggggccaggcccagaccccagatggccatgctgacaaggccctgctgcggcagatggagggcatctatgctgacatccctgtgagaagacctgagagcagcgcccacgtgcaggagctgtaccaggagtggctggagggcatcaacagccccaaggcccgggaggtgctgcacaccacctaccagagccaggagcggggcacccacagcctggacatcaagtggtag

SEQ ID NO: 19992 - DNA, 348 bp, Artificial Sequence
  Description of Artificial Sequence: Synthetic coding sequence
atggccacagagcctgaggccgctgagcctgtggtgcccagcctggtggaccgctacttcacccgctggtacaagccagatgtgaagggcaagttctgtgaggaccactgcatcctgcagcacagcaaccgcatctgtgtgatcaccctggccgagagccaccctgtgctgcagagcggcaagaccatcaagagcatctcctaccagatcagcaccaactgcagccggctgcagaacaaggtgtctgggaagttcaagaggcgcatcatctacctggagaaggtggaggatgtgatcaagaggaagatgatgcccctgagcctgggcctgcacctgccccacagctag

SEQ ID NO: 19993 - DNA, 1566 bp, Artificial Sequence
  Description of Artificial Sequence: Synthetic coding sequence
atgaatgtgtccctgagccagaagacagtgaagatccacaggctcttccccatgctggccttcagcgagccctatgaatttgtgtccctggagtggctgcagaagtggctggatgagagcacccccaccaagcccatcgacaaccacgcctgcctgtgcagccatgacaagctgcacccagacaagatcagcatcatgaagaggatcagtgaatatgctgctgacatcttctacagccgctatggaggcggcccccggctgactgtgaaggccctgtgcaaggaatgtgtggtggagcgctgccgcatcctgcggctgaagaaccagctgaatgaagactacaagacagtgaacaacctgctgaaggctgctgtgaagggagatggcttctgggtgggcaagagcagcctgcgctcctggaggcagctggccctggagcagctggatgagcaggatggagatgctgagcagagcaatggcaagatgaatggcagcaccctgaacaaggatgagagcaaggaggagaggaaggaggaggaggagctgaacttcaatgaagacatcctgtgcccccacggggagctgtgcatcagtgaaaatgaaagaaggctggtgtccaaggaggcctggagcaagctgcagcagtacttccccaaggcccctgagttccccagctacaaggagtgctgcagccagtgcaagatcctggagcgggagggggaggagaatgaggccctgcacaagatgattgccaatgagcagaagaccagcctgcccaacctcttccaggacaagaaccggccctgcctgagcaactggccagaggacacagatgtgctgtacatcgtgtcccagttctttgtggaggagtggaggaagtttgtgaggaagcccacccgctgcagccctgtgtcctctgtgggcaacagcgccctgctgtgcccccacggcggcctgatgttcacctttgcctccatgaccaaggaggacagcaagctgattgccctgatctggcccagcgagtggcagatgatccagaagctgtttgtggtggaccacgtgatcaagatcacccgcatcgaggtgggagatgtgaaccccagcgagacccagtacatcagcgagcccaagctgtgcccagaatgtcgggagggcctgctgtgccagcagcagagggacctgcgggagtacacccaggccaccatctacgtgcacaaggtggtggacaacaagaaggtgatgaaggacagcgcccctgagctgaatgtgagcagcagcgagacagaggaggacaaggaggaggccaagccagatggagagaaggaccctgacttcaaccagatcatgcacgccttctctgtggccccctttgaccagaacctgagcattgatggcaagatcctgagtgatgactgtgccaccctgggcaccctgggcgtcatccctgagagcgtcatcctgctgaaggcagatgagcccatcgctgactatgctgccatggatgatgtgatgcaggtgtgcatgcctgaggagggcttcaagggcaccggcctgctgggccactag

SEQ ID NO: 19994 - DNA, 984 bp, Artificial Sequence
  Description of Artificial Sequence: Synthetic coding sequence
atgacagctgtgggcgctgagcggctgacctctgtgcgggcctggctgagctgctgcggggcctgtgtgtgtgtgttcctgttcctgtgcctgtgtgtgttccccctgcgggtgcacgtgcacgtgtggggcggggagtgccgggtggacattgctgtgtttgtgtccaagcacatgattgtggccctgatgcacgtgactggagctgctggcctgctgcggctgtgtgtgcgggcctgtgtgtgcatgagggtgtgtgccacagcccacatgtacagagtggacaagagcttcaccagcagaagatctgtgtggaggagtgatggccagaaccagcacttcccccaggccctggacctgagccgggtgaacctggtgcccagctacacccccagcctgtaccccaagaacacagacctgtttgagatgattgagaagatgcagggcagcaggatggatgagcagcgctgcagcttccccccacccctgaagacagaggaggactacatcccctaccccagcgtgcatgaggtgctgggccgggagggccccttccccctcatcctgctgccccagtttggaggctactggattgagggcaccaaccacgagatcaccagcatccctgagacagagcccctgcagagccccaccaccaaggtgaagctggagtgcaaccccacagcccgcatctacaggaagcacttcctgggcaaggagcacttcaactactacagcctggatgctgccctgggccacctggtgttcagcctgaagtatgatgtgattggagaccaggagcacctgcggctgctgctgcggaccaagtgcaggacctaccatgatgtgatccccatcagctgcctgacagagttccccaacgtggtgcagatggccaagctggtgtgtgaagatgtgaatgtggaccgcttctaccctgtgctgtaccccaaggtgtggctggacctgggcacagcccactag

SEQ ID NO: 19995 - DNA, 2079 bp, Artificial Sequence
  Description of Artificial Sequence: Synthetic coding sequence
atgattgagaagatgcagggcagcaggatggatgagcagcgctgcagcttccccccacccctgaagacagaggaggactacatcccctaccccagcgtgcatgaggtgctgggccgggagggccccttccccctcatcctgctgccccagtttggaggctactggattgagggcaccaaccacgagatcaccagcatccctgagacagagcccctgcagagccccaccaccaaggtgaagctggagtgcaaccccacagcccgcatctacaggaagcacttcctgggcaaggagcacttcaactactacagcctggatgctgccctgggccacctggtgttcagcctgaagtatgatgtgattggagaccaggagcacctgcggctgctgctgcggaccaagtgcaggacctaccatgatgtgatccccatcagctgcctgacagagttccccaacgtggtgcagatggccaagctggtgtgtgaagatgtgaatgtggaccgcttctaccctgtgctgtaccccaaggccagccggctgattgtgacctttgatgaacatgtgatcagcaacaacttcaagtttggagtcatctaccagaagctgggccagaccagcgaggaggagctgttcagcaccaatgaggagagccctgcctttgtggagttcctggagttcctgggccagaaggtgaagctgcaggacttcaagggcttccggggcggcctggatgtgacccacggccagacaggaacagagagcgtgtactgcaacttcaggaacaaggagatcatgtttcatgtgtccaccaagctgccctacacagaaggagatgcccagcagctgcagaggaagaggcacatcggaaatgacatcgtggccgtggtgttccaggatgagaacaccccatttgtgcctgacatgattgccagcaacttcctgcacgcctacgtggtggtgcaggccgagggcggcggcccagatggccccctgtacaaggtgtctgtgacagccagagatgatgtgcccttctttggaccacccctgcctgaccctgctgtgttcagaaaaggacctgagttccaggagttcctgctgaccaagctgatcaatgcagaatatgcctgctacaaggccgagaagtttgccaagctggaggagaggaccagggctgccctgctggagaccctgtatgaggagctgcacatccacagccagagcatgatgggcctgggcggagatgaggacaagatggagaatggcagcggcggcggcggcttctttgagagcttcaagagggtcatccgcagccgcagccagagcatggatgccatgggcctgagcaacaagaagcccaacacagtgtccaccagccacagcggcagctttgcccccaacaacccagacctggccaaggccgccggcatcagcctgctgatccctgggaagagcgccagccgcttcggccggcggggcagcgccatcggcattggaacagtggaggaggtggtggtgagaggagctgctggcagcggcggctgcctgcacgccctcttcagcgcccggagccaggacggcggccacatcggagatgtggcccccctgcccccaggccaggcccctggccgggccggctggagcggcggcagcagtgatggcacccagcacctgctgtggggcctgagcctcatcgtgcctgggaagagccccaccaggaagaagagcggccccttcggcagcagaagaagcagcgccatcggcatcgagaacatccaggaggtgcaggagaagcgggagagccccccagctggccagaagaccccagacagcggccacgtgtcccaggagcccaagtctgagaacagcagcacccagagcagccctgagatgcccaccaccaagaacagagctgagacagctgcccagagagctgaggccctgaagctgcccctgctggtgcagtgccagcagctgcggcagaggggcggcggagatggcggctgcggccggcggggccacaggcctggagagagggtcatcctgaggaacaccccccaggccggcctgctgcacctgtag

SEQ ID NO: 19996 - DNA, 2085 bp, Artificial Sequence
  Description of Artificial Sequence: Synthetic coding sequence
atggcccagctgcggcctgctgtgcccccaggccggccccggcggggcagcctgcctgctggggcctcctggcagaacacagacctgtttgagatgattgagaagatgcagggcagcaggatggatgagcagcgctgcagcttccccccacccctgaagacagaggaggactacatcccctaccccagcgtgcatgaggtgctgggccgggagggccccttccccctcatcctgctgccccagtttggaggctactggattgagggcaccaaccacgagatcaccagcatccctgagacagagcccctgcagagccccaccaccaaggtgaagctggagtgcaaccccacagcccgcatctacaggaagcacttcctgggcaaggagcacttcaactactacagcctggatgctgccctgggccacctggtgttcagcctgaagtatgatgtgattggagaccaggagcacctgcggctgctgctgcggaccaagtgcaggacctaccatgatgtgatccccatcagctgcctgacagagttccccaacgtggtgcagatggccaagctggtgtgtgaagatgtgaatgtggaccgcttctaccctgtgctgtaccccaaggccagccgcctcatcgtgacctttgatgagcacgtgatcagcaacaacttcaagtttggagtcatctaccagaagctgggccagaccagcgaggaggagctgttcagcaccaatgaggagagccctgcctttgtggagttcctggagttcctgggccagaaggtgaagctgcaggacttcaagggcttccggggcggcctggatgtgacccacggccagacaggaacagaatctgtgtactgcaacttcaggaacaaggagatcatgttccacgtgtccaccaagctgccctacacagaaggagatgcccagcagctgcagaggaagaggcacatcggaaatgacatcgtggccgtggtgttccaggatgagaacaccccatttgtgcctgacatgattgccagcaacttcctgcacgcctacgtggtggtgcaggccgagggcggcggcccagatggccccctgtacaaggtgtctgtgacagccagagatgatgtgcccttcttcggcccccccctgcctgaccctgctgtgttcaggaagggccctgagttccaggagttcctgctgaccaagctgatcaatgcagaatatgcctgctacaaggccgagaagtttgccaagctggaggagaggacccgggccgccctgctggagaccctgtatgaggagctgcacatccacagccagagcatgatgggcctgggcggagatgaggacaagatggagaatggaagtggcggcggcggcttctttgagagcttcaagagggtcatccgcagccgcagccagagcatggatgccatgggcctgagcaacaagaagcccaacacagtgtccaccagccacagcggcagctttgcccccaacaacccagacctggccaaggctgctggcatcagcctcatcgtgcctgggaagagccccaccaggaagaagagcggccccttcggcagcagaagaagcagcgccatcggcatcgagaacatccaggaggtgcaggagaagcgggagagccccccagctggccagaagaccccagacagcggccacgtgtcccaggagcccaagtctgagaacagcagcacccagagcagccctgagatgcccaccaccaagaacagagctgagacagctgcccagagagctgaggccctgaaggacttcagccgcagcagcagcagcgccagcagctttgcctctgtggtggaggagacagaaggagtggatggagaggacaccggcctggagagcgtgagcagcagcggcaccccccacaagagggacagcttcatctacagcacctggctggaggacagcgtgtccaccaccagcggcggcagcagccctggccccagccgcagcccccacccagatgctgggaagctgggggaccctgcctgcccagagatcaagatccagctggaggccagcgagcagcacatgccccagctgggctgctag

SEQ ID NO: 19997 - DNA, 2082 bp, Artificial Sequence
  Description of Artificial Sequence: Synthetic coding sequence
atggcccagctgcggcctgctgtgcccccaggccggccccggcggggcagcctgcctgctggggcctcctggcagaacacagacctgtttgagatgattgagaagatgcagggcagcaggatggatgagcagcgctgcagcttccccccacccctgaagacagaggaggactacatcccctaccccagcgtgcatgaggtgctgggccgggagggccccttccccctcatcctgctgccccagtttggaggctactggattgagggcaccaaccacgagatcaccagcatccctgagacagagcccctgcagagccccaccaccaaggtgaagctggagtgcaaccccacagcccgcatctacaggaagcacttcctgggcaaggagcacttcaactactacagcctggatgctgccctgggccacctggtgttcagcctgaagtatgatgtgattggagaccaggagcacctgcggctgctgctgcggaccaagtgcaggacctaccatgatgtgatccccatcagctgcctgacagagttccccaacgtggtgcagatggccaagctggtgtgtgaagatgtgaatgtggaccgcttctaccctgtgctgtaccccaaggccagccgcctcatcgtgacctttgatgagcacgtgatcagcaacaacttcaagtttggagtcatctaccagaagctgggccagaccagcgaggaggagctgttcagcaccaatgaggagagccctgcctttgtggagttcctggagttcctgggccagaaggtgaagctgcaggacttcaagggcttccggggcggcctggatgtgacccacggccagacaggaacagaatctgtgtactgcaacttcaggaacaaggagatcatgttccacgtgtccaccaagctgccctacacagaaggagatgcccagctgcagaggaagaggcacatcggaaatgacatcgtggccgtggtgttccaggatgagaacaccccatttgtgcctgacatgattgccagcaacttcctgcacgcctacgtggtggtgcaggccgagggcggcggcccagatggccccctgtacaaggtgtctgtgacagccagagatgatgtgcccttctttggaccacccctgcctgaccctgctgtgttcagaaaaggacctgagttccaggagttcctgctgaccaagctgatcaatgcagaatatgcctgctacaaggccgagaagtttgccaagctggaggagaggaccagggctgccctgctggagaccctgtatgaggagctgcacatccacagccagagcatgatgggcctgggcggagatgaggacaagatggagaatggcagcggcggcggcggcttctttgagagcttcaagagggtcatccgcagccgcagccagagcatggatgccatgggcctgagcaacaagaagcccaacacagtgtccaccagccacagcggcagctttgcccccaacaacccagacctggccaaggccgccggcatcagcctgattgtgcctgggaagagccccaccaggaagaagagcggccccttcggcagccgccgcagcagcgccatcggcatcgagaacatccaggaggtgcaggagaagcgggagagccccccagctggccagaagaccccagattctggccacgtgtcccaggagcccaagtctgagaacagcagcacccagagcagccctgagatgcccaccaccaagaacagagctgagacagctgcccagagagctgaggccctgaaggacttcagccgcagcagcagcagcgccagcagctttgcctctgtggtggaggagacagagggcgtggatggagaggacaccggcctggagagcgtgagcagcagcggcaccccccacaagagggacagcttcatctacagcacctggctggaggacagcgtgtccaccaccagcggcggcagcagccctggccccagccgcagcccccacccagatgctgggaagctgggggaccctgcctgcccagagatcaagatccagctggaggccagcgagcagcacatgccccagctgggctgctag

SEQ ID NO: 19998 - DNA, 1992 bp, Artificial Sequence
  Description of Artificial Sequence: Synthetic coding sequence
atgattgagaagatgcagggcagcaggatggatgagcagcgctgcagcttccccccacccctgaagacagaggaggactacatcccctaccccagcgtgcatgaggtgctgggccgggagggccccttccccctcatcctgctgccccagtttggaggctactggattgagggcaccaaccacgagatcaccagcatccctgagacagagcccctgcagagccccaccaccaaggtgaagctggagtgcaaccccacagcccgcatctacaggaagcacttcctgggcaaggagcacttcaactactacagcctggatgctgccctgggccacctggtgttcagcctgaagtatgatgtgattggagaccaggagcacctgcggctgctgctgcggaccaagtgcaggacctaccatgatgtgatccccatcagctgcctgacagagttccccaacgtggtgcagatggccaagctggtgtgtgaagatgtgaatgtggaccgcttctaccctgtgctgtaccccaaggccagccggctgattgtgacctttgatgaacatgtgatcagcaacaacttcaagtttggagtcatctaccagaagctgggccagaccagcgaggaggagctgttcagcaccaatgaggagagccctgcctttgtggagttcctggagttcctgggccagaaggtgaagctgcaggacttcaagggcttccggggcggcctggatgtgacccacggccagacaggaacagagagcgtgtactgcaacttcaggaacaaggagatcatgtttcatgtgtccaccaagctgccctacacagaaggagatgcccagcagctgcagaggaagaggcacatcggaaatgacatcgtggccgtggtgttccaggatgagaacaccccatttgtgcctgacatgattgccagcaacttcctgcacgcctacgtggtggtgcaggccgagggcggcggcccagatggccccctgtacaaggtgtctgtgacagccagagatgatgtgcccttctttggaccacccctgcctgaccctgctgtgttcagaaaaggacctgagttccaggagttcctgctgaccaagctgatcaatgcagaatatgcctgctacaaggccgagaagtttgccaagctggaggagaggaccagggctgccctgctggagaccctgtatgaggagctgcacatccacagccagagcatgatgggcctgggcggagatgaggacaagatggagaatggcagcggcggcggcggcttctttgagagcttcaagagggtcatccgcagccgcagccagagcatggatgccatgggcctgagcaacaagaagcccaacacagtgtccaccagccacagcggcagctttgcccccaacaacccagacctggccaaggccgccggcatcagcctgattgtgcctgggaagagccccaccaggaagaagagcggccccttcggcagccgccgcagcagcgccatcggcatcgagaacatccaggaggtgcaggagaagcgggagagccccccagctggccagaagaccccagattctggccacgtgtcccaggagcccaagtctgagaacagcagcacccagagcagccctgagatgcccaccaccaagaacagagctgagacagctgcccagagagctgaggccctgaaggacttcagccgcagcagcagcagcgccagcagctttgcctctgtggtggaggagacagagggcgtggatggagaggacaccggcctggagagcgtgagcagcagcggcaccccccacaagagggacagcttcatctacagcacctggctggaggacagcgtgtccaccaccagcggcggcagcagccctggccccagccgcagcccccacccagatgctgggaagctgggggaccctgcctgcccagagatcaagatccagctggaggccagcgagcagcacatgccccagctgggctgctag

SEQ ID NO: 19999 - DNA, 744 bp, Artificial Sequence
  Description of Artificial Sequence: Synthetic coding sequence
atgctggtgctgcggagcgccctgacccgggccctggccagcaggaccctggccccccagatgtgcagcagctttgccaccggcccccggcagtatgatggcatcttctatgagttccgcagctactacctgaagcccagcaagatgaatgagttcctggagaactttgagaagaatgcccacctgaggacagcccacagcgagctggtgggctactggagcgtggagtttggaggccgcatgaacacagtgttccacatctggaagtatgacaactttgcccacaggacagaggtgaggaaggccctggccaaggacaaggagtggcaggagcagttcctgatccccaacctggccctgattgacaagcaggagagcgagatcacctacctggtgccctggtgcaagctggagaagccacccaaggagggcgtgtatgagctggccaccttccagatgaagccaggcggccctgccctgtggggagatgccttcaagagagctgtgcacgcccacgtgaacctgggctacaccaagctggtgggcgtcttccacacagaatatggagccctgaacagagtgcacgtgctgtggtggaatgaatctgctgacagcagagctgctggccgccacaagagccatgaggacccccgggtggtggccgctgtgcgggagagcgtgaactacctggtgtcccagcagaacatgctgctgatccccaccagcttcagccccctgaagtag

SEQ ID NO: 20000 - DNA, 3594 bp, Artificial Sequence; identical to SEQ ID NO: 18647
  Description of Artificial Sequence: Synthetic coding sequence

SEQ ID NO: 20001 - DNA, 3594 bp, Artificial Sequence; identical to SEQ ID NO: 18647
  Description of Artificial Sequence: Synthetic coding sequence

SEQ ID NO: 20002 - DNA, 1047 bp, Artificial Sequence
  Description of Artificial Sequence: Synthetic coding sequence
atgagcctgccccgcttccagagggtgaactttggcccctatgacaactacatccctgtgtctgagctgagcaagaagtcctggaaccagcagcactttgccctgctcttccccaagccccagaggcctggcaccaagagaagaagcaagcccagccagatccgggacaacacagtgtccatcattgatgaggagcagctgcggggggaccggcggcagcccctgtggatgtaccgcagcctgatgaggatcagcgagcggcccagcgtgtacctggccgcccggcggcagcccctgaagcccaccaggacagtggaggtggacagcaaggctgctgagatcggcaagaagggggaggacaagaccacccagaaggacaccacagacagcgagagcgagctgaagcagggcaagaaggacagcaagaagggcaaggacatcgagaagggcaaggaggagaagctggatgccaagaaggacagcaagaagggcaagaaggatgctgagaagggcaaggacagcgccacagaaagtgaagatgagaagggcggggccaagaaggacaacaagaaggacaagaaggacagcaacaagggcaaggacagcgccacagagagcgagggggagaagggcggcacagagaaggacagcaagaagggcaagaaggacagcaagaagggcaaggacagcgccatcgagctgcaggccgtgaaggcagatgagaagaaggatgaagatggcaagaaggatgccaacaagggagatgagagcaaggatgccaagaaggatgccaaggagatcaagaagggcaagaaggacaagaagaagcccagcagcacagacagcgacagcaaggatgatgtgaagaaggagagcaagaaggatgccaccaaggatgccaagaaggtggccaagaaggacacagagaaggagagcgctgacagcaagaaggatgccaagaagaatgccaagaaggatgccaagaaggatgccaagaagaatgccaagaaggatgagaagaaggatgccaagaagaagggcaagtag

SEQ ID NO: 20003 - DNA, 1515 bp, Artificial Sequence
  Description of Artificial Sequence: Synthetic coding sequence
atgaacagccagccccagaccaggagccccttcttccagaggccccagatccagcccccccgggccaccatccccaacagcagccccagcatccggcctggggcccagacccccacagctgtgtaccaggccaaccagcacatcatgatggtgaaccacctgcccatgccctaccctgtgccccagggcccccagtactgcatcccccagtaccgccacagcggccccccctacgtgggccccccccagcagtaccctgtgcagcccccaggccctggccccttctacccaggccctggccctggggacttccccaatgcctacggcacccccttctaccccagccagcctgtgtaccagagcgcccccatcatcgtgcccacccagcagcagcccccaccagccaagcgggagaagaagaccatccgcatccgggaccccaaccagggcggcaaggacatcacagaggagatcatgtctgggggcggcagcaggaaccccaccccacccatcggccggcccaccagcacccccaccccaccccagcagctgcccagccaggtgcctgagcacagccctgtggtgtatggcaccgtggagagcgcccacctggccgccagcacccctgtgacagctgccagtgaccagaagcaggaggagaagcccaagccagaccctgtgctgaagagccccagccctgtgctgcggctggtgctgagcggggagaagaaggagcaggagggccagaccagcgagaccacagccatcgtgtccattgctgagctgcccctgccccccagccccaccaccgtgtcctctgtggcccggagcaccatcgccgcccccaccagcagcgccctgagcagccagcccatcttcaccacagccattgatgacagatgtgagctgagcagcccccgggaggacaccatccccatccccagcctgaccagctgcacagagaccagtgaccccctgcccaccaatgaaaatgatgatgacatctgcaagaagccctgcagcgtggccccaaatgacatccccctggtgagcagcaccaacctgatcaatgagatcaacggggtgtctgagaagctgagcgccacagagagcatcgtggagatcgtgaagcaggaggtgctgcccctgaccctggagctggagatcctggagaaccccccagaggagatgaagctggagtgcatcccagcccccatcacccccagcacagtgcccagcttcccccccaccccacccaccccaccagccagccccccccacacccctgtgattgtgcctgctgctgccaccaccgtgagcagccccagcgctgccatcaccgtgcagagggtgctggaggaggatgagagcatccgcacctgcctgtctgaagatgccaaggagatccagaacaagattgaggtggaggctgatggccagacagaggagatcctggacagccagaacctgaacagcagaagaagccctgtgcctgagaccagcaatgaatgttag

SEQ ID NO: 20004 - DNA, 744 bp, Artificial Sequence
  Description of Artificial Sequence: Synthetic coding sequence
atgctgaagttcctggtgtggttcctgcagtggtgtgtgtgtgtgctggtgcagcctgccaaggagctgctgcactgcctgaagatgcagatgaggatcagcaagtacaccaagtgcctgcaggcccagatcgccatcaccgtgcccaagacctggaagaagcccaaggacaggaccaggaccacagaggagatgctggaggccgagctggagctgaaggccgaggaggagctgagcattgacaaggtgctggagagcgagcaggacaagatgagccagggcttccaccctgagcgggaccccagcgacctgaagaaggtgaaggctgtggaggagaatggagaggaggccgagcctgtgagaaatggagctgagagcgtgtctgagggggagggcattgatgccaacagcggcagcacagacagcagtggagatggagtgaccttccccttcaagccagagagctggaagcccacagacacagagggcaagaagcagtatgaccgggagttcctgctggacttccagttcatgcctgcctgcatccagaagccagagggcctgccccccatcagtgatgtggtgctggacaagatcaaccagcccaagctgcccatgaggaccctggacccccgcatcctgccccggggccctgacttcaccccagcctttgctgactttggccggcagacccctgggggccggggcgtgcctgtgtctgccagcagcctgcagctgacctag

SEQ ID NO: 20005 - DNA, 3918 bp, Artificial Sequence
  Description of Artificial Sequence: Synthetic coding sequence
atgaacagccagccccagaccaggagccccttcttccagaggccccagatccagcccccccgggccaccatccccaacagcagccccagcatccggcctggggcccagacccccacagctgtgtaccaggccaaccagcacatcatgatggtgaaccacctgcccatgccctaccctgtgccccagggcccccagtactgcatcccccagtaccgccacagcggccccccctacgtgggccccccccagcagtaccctgtgcagcccccaggccctggccccttctacccaggccctggccctggggacttccccaatgcctacggcacccccttctaccccagccagcctgtgtaccagagcgcccccatcatcgtgcccacccagcagcagcccccaccagccaagcgggagaagaagaccatccgcatccgggaccccaaccagggcggcaaggacatcacagaggagatcatgtctgggggcggcagcaggaaccccaccccacccatcggccggcccaccagcacccccaccccaccccagcagctgcccagccaggtgcctgagcacagccctgtggtgtatggcaccgtggagagcgcccacctggccgccagcacccctgtgacagctgccagtgaccagaagcaggcccagatcgccatcaccgtgcccaagacctggaagaagcccaaggacaggaccaggaccacagaggagatgctggaggccgagctggagctgaaggccgaggaggagctgagcattgacaaggtgctggagagcgagcaggacaagatgagccagggcttccaccctgagcgggaccccagcgacctgaagaaggtgaaggctgtggaggagaatggagaggaggccgagcctgtgagaaatggagctgagagcgtgtctgagggggagggcattgatgccaacagcggcagcacagacagcagtggagatggagtgaccttccccttcaagccagagagctggaagcccacagacacagagggcaagaagcagtatgaccgggagttcctgctggacttccagttcatgcctgcctgcatccagaagccagagggcctgccccccatcagtgatgtggtgctggacaagatcaaccagcccaagctgcccatgaggaccctggacccccgcatcctgccccggggccctgacttcaccccagcctttgctgactttggccggcagaccccaggcggccggggcgtgcccctgctgaatgtgggcagccgccgcagccagcccggccagaggcgggagcccaggaagatcatcaccgtgtctgtgaaggaggatgtgcacctgaagaaggccgagaatgcctggaagcccagccagaagagggacagccaggctgatgatcctgagaacatcaagacccaggagctgttcaggaaggtgcgcagcatcctgaacaagctgaccccccagatgttcaaccagctgatgaagcaggtgtctggcctgactgtggacacagaggagcggctgaagggcgtcatcgacctggtgtttgagaaggccattgatgagcccagcttctctgtggcctatgccaacatgtgccgctgcctggtgaccctgaaggtgcccatggctgacaagccaggcaacacagtgaacttcaggaagctgctgctgaaccgctgccagaaggagtttgagaaggacaaggcagatgatgatgtgtttgagaagaagcagaaggagctggaggccgccagcgcccctgaggagaggacccggctgcatgatgagctggaggaggccaaggacaaggccaggagaagaagcatcggcaacatcaagttcatcggggagctgttcaagctgaagatgctgacagaggccatcatgcatgactgtgtggtgaagctgctgaagaaccatgatgaggagagcctggagtgcctgtgccgcctgctgaccaccatcggcaaggacctggactttgagaaggccaagcccaggatggaccagtacttcaaccagatggagaagatcgtgaaggagaggaagaccagcagccgcatccgcttcatgctgcaggatgtgattgacctgcggctgtgcaactgggtgtccagaagagctgaccagggccccaagaccatcgagcagatccacaaggaggccaagattgaggagcaggaggagcagaggaaggtgcagcagctgatgaccaaggagaagagaagacctggggtgcagagggtggatgaaggaggctggaacacagtgcagggcgccaagaacagccgggtgctggaccccagcaagttcctgaagatcaccaagcccaccattgatgagaagatccagctggtgcccaaggcccagctgggctcctggggcaagggcagcagcggcggggccaaggccagcgagacagatgccctgcggagcagcgccagcagcctgaaccgcttcagcgccctgcagcccccagcccccagcggcagcacccccagcacccctgtggagtttgacagcaggaggaccctgaccagccggggctccatgggccgggagaagaatgacaagcccctgcccagcgccacagcccggcccaacaccttcatgaggggcggcagcagcaaggacctgctggacaaccagagccaggaggagcagaggcgggagatgctggagaccgtgaagcagctgactggaggagtggatgtggagaggaacagcacagaagctgagaggaacaagacccgggagagcgccaagccagagatcagcgccatgtctgcccatgacaaggccgccctgtctgaggaggagctggagaggaagagcaagagcatcattgatgagttcctgcacatcaatgacttcaaggaggccatgcagtgtgtggaggagctgaatgcccagggcctgctgcacgtgtttgtgcgggtgggcgtggagagcaccctggagaggagccagatcacccgggaccacatgggccagctgctgtaccagctggtgcagagcgagaagctgagcaagcaggacttcttcaagggcttcagcgagaccctggagctggctgatgacatggccatcgacatcccccacatctggctgtacctggccgagctggtgacccccatgctgaaggagggcggcatctccatgagggagctgaccatcgagttcagcaagcccctgctgcctgtgggccgggccggcgtgctgctgtctgagatcctgcacctgctgtgcaagcagatgagccacaagaaggtgggcgccctgtggagggaggccgacctgtcctggaaggacttcctgcctgaaggagaagatgtgcacaacttcctgctggagcagaagctggacttcattgaaagtgacagcccctgcagcagcgaggccctgagcaagaaggagctgtctgctgaggagctgtacaagaggctggagaagctgatcatcgaggacaaggccaatgatgagcagatctttgactgggtggaggccaacctggatgagatccagatgagcagccccaccttcctgcgggccctgatgacagctgtgtgcaaggccgccatcatcgctgacagcagcaccttccgggtggacacagctgtgatcaagcagagggtgcccatcctgctgaagtacctggacagcgacacagagaaggagctgcaggccctgtatgccctgcaggccagcatcgtgaagctggaccagcctgccaacctgctgaggatgttctttgactgcctgtatgatgaggaggtgatcagtgaagatgccttctacaagtgggagagcagcaaggaccctgctgagcagaatggaaaaggagtggccctgaagtctgtgacagccttcttcacctggctgcgggaggccgaggaggagagcgaggacaactag

SEQ ID NO: 20006 - DNA, 4776 bp, Artificial Sequence
  Description of Artificial Sequence: Synthetic coding sequence
atgaacagccagccccagaccaggagccctgggggcttccggcccatccagttcttccagaggccccagatccagcccccccgggccaccatccccaacagcagccccagcatccggcctggggcccagacccccacagctgtgtaccaggccaaccagcacatcatgatggtgaaccacctgcccatgccctaccctgtgccccagggcccccagtactgcatcccccagtaccgccacagcggccccccctacgtgggccccccccagcagtaccctgtgcagcccccaggccctggccccttctacccaggccctggccctggggacttccccaatgcctacggcacccccttctaccccagccagcctgtgtaccagagcgcccccatcatcgtgcccacccagcagcagcccccaccagccaagcgggagaagaagaccatccgcatccgggaccccaaccagggcggcaaggacatcacagaggagatcatgtctgggggcggcagcaggaaccccaccccacccatcggccggcccaccagcacccccaccccaccccagctgcccagccaggtgcctgagcacagccctgtggtgtatggcaccgtggagagcgcccacctggccgccagcacccctgtgacagctgccagtgaccagaagcaggaggagaagcccaagccagaccctgtgctgaagagccccagccctgtgctgcggctggtgctgagcggggagaagaaggagcaggagggccagaccagcgagaccacagccatcgtgtccattgctgagctgcccctgccccccagccccaccaccgtgtcctctgtggcccggagcaccatcgccgcccccaccagcagcgccctgagcagccagcccatcttcaccacagccattgatgacagatgtgagctgagcagcccccgggaggacaccatccccatccccagcctgaccagctgcacagagaccagtgaccccctgcccaccaatgaaaatgatgatgacatctgcaagaagccctgcagcgtggccccaaatgacatccccctggtgagcagcaccaacctgatcaatgagatcaacggggtgtctgagaagctgagcgccacagagagcatcgtggagatcgtgaagcaggaggtgctgcccctgaccctggagctggagatcctggagaaccccccagaggagatgaagctggagtgcatcccagcccccatcacccccagcacagtgcccagcttcccccccaccccacccaccccaccagccagccccccccacacccctgtgattgtgcctgctgctgccaccaccgtgagcagccccagcgctgccatcaccgtgcagagggtgctggaggaggatgagagcatccgcacctgcctgtctgaagatgccaaggagatccagaacaagattgaggtggaggctgatggccagacagaggagatcctggacagccagaacctgaacagcagaagaagccctgtgcctgcccagatcgccatcaccgtgcccaagacctggaagaagcccaaggacaggaccaggaccacagaggagatgctggaggccgagctggagctgaaggccgaggaggagctgagcattgacaaggtgctggagagcgagcaggacaagatgagccagggcttccaccctgagcgggaccccagcgacctgaagaaggtgaaggctgtggaggagaatggagaggaggccgagcctgtgagaaatggagctgagagcgtgtctgagggggagggcattgatgccaacagcggcagcacagacagcagtggagatggagtgaccttccccttcaagccagagagctggaagcccacagacacagagggcaagaagcagtatgaccgggagttcctgctggacttccagttcatgcctgcctgcatccagaagccagagggcctgccccccatcagtgatgtggtgctggacaagatcaaccagcccaagctgcccatgaggaccctggacccccgcatcctgccccggggccctgacttcaccccagcctttgctgactttggccggcagaccccaggcggccggggcgtgcccctgctgaatgtgggcagccgccgcagccagcccggccagaggcgggagcccaggaagatcatcaccgtgtctgtgaaggaggatgtgcacctgaagaaggccgagaatgcctggaagcccagccagaagagggacagccaggctgatgatcctgagaacatcaagacccaggagctgttcaggaaggtgcgcagcatcctgaacaagctgaccccccagatgttcaaccagctgatgaagcaggtgtctggcctgactgtggacacagaggagcggctgaagggcgtcatcgacctggtgtttgagaaggccattgatgagcccagcttctctgtggcctatgccaacatgtgccgctgcctggtgaccctgaaggtgcccatggctgacaagccaggcaacacagtgaacttcaggaagctgctgctgaaccgctgccagaaggagtttgagaaggacaaggcagatgatgatgtgtttgagaagaagcagaaggagctggaggccgccagcgcccctgaggagaggacccggctgcatgatgagctggaggaggccaaggacaaggccaggagaagaagcatcggcaacatcaagttcatcggggagctgttcaagctgaagatgctgacagaggccatcatgcatgactgtgtggtgaagctgctgaagaaccatgatgaggagagcctggagtgcctgtgccgcctgctgaccaccatcggcaaggacctggactttgagaaggccaagcccaggatggaccagtacttcaaccagatggagaagatcgtgaaggagaggaagaccagcagccgcatccgcttcatgctgcaggatgtgattgacctgcggctgtgcaactgggtgtccagaagagctgaccagggccccaagaccatcgagcagatccacaaggaggccaagattgaggagcaggaggagcagaggaaggtgcagcagctgatgaccaaggagaagagaagacctggggtgcagagggtggatgaaggaggctggaacacagtgcagggcgccaagaacagccgggtgctggaccccagcaagttcctgaagatcaccaagcccaccattgatgagaagatccagctggtgcccaaggcccagctgggctcctggggcaagggcagcagcggcggggccaaggccagcgagacagatgccctgcggagcagcgccagcagcctgaaccgcttcagcgccctgcagcccccagcccccagcggcagcacccccagcacccctgtggagtttgacagcaggaggaccctgaccagccggggctccatgggccgggagaagaatgacaagcccctgcccagcgccacagcccggcccaacaccttcatgaggggcggcagcagcaaggacctgctggacaaccagagccaggaggagcagaggcgggagatgctggagaccgtgaagcagctgactggaggagtggatgtggagaggaacagcacagaagctgagaggaacaagacccgggagagcgccaagccagagatcagcgccatgtctgcccatgacaaggccgccctgtctgaggaggagctggagaggaagagcaagagcatcattgatgagttcctgcacatcaatgacttcaaggaggccatgcagtgtgtggaggagctgaatgcccagggcctgctgcacgtgtttgtgcgggtgggcgtggagagcaccctggagaggagccagatcacccgggaccacatgggccagctgctgtaccagctggtgcagagcgagaagctgagcaagcaggacttcttcaagggcttcagcgagaccctggagctggctgatgacatggccatcgacatcccccacatctggctgtacctggccgagctggtgacccccatgctgaaggagggcggcatctccatgagggagctgaccatcgagttcagcaagcccctgctgcctgtgggccgggccggcgtgctgctgtctgagatcctgcacctgctgtgcaagcagatgagccacaagaaggtgggcgccctgtggagggaggccgacctgtcctggaaggacttcctgcctgaaggagaagatgtgcacaacttcctgctggagcagaagctggacttcattgaaagtgacagcccctgcagcagcgaggccctgagcaagaaggagctgtctgctgaggagctgtacaagaggctggagaagctgatcatcgaggacaaggccaatgatgagcagatctttgactgggtggaggccaacctggatgagatccagatgagcagccccaccttcctgcgggccctgatgacagctgtgtgcaaggccgccatcatcgctgacagcagcaccttccgggtggacacagctgtgatcaagcagagggtgcccatcctgctgaagtacctggacagcgacacagagaaggagctgcaggccctgtatgccctgcaggccagcatcgtgaagctggaccagcctgccaacctgctgaggatgttctttgactgcctgtatgatgaggaggtgatcagtgaagatgccttctacaagtgggagagcagcaaggaccctgctgagcagaatggaaaaggagtggccctgaagtctgtgacagccttcttcacctggctgcgggaggccgaggaggagagcgaggacaactag

SEQ ID NO: 20007 - DNA, 1002 bp, Artificial Sequence
  Description of Artificial Sequence: Synthetic coding sequence
atgtctggagatgagatgatctttgaccccaccatgagcaagaagaagaagaagaagaagaagcccttcatgctggatgaggagggggacacccagacagaggagacccagcccagcgagaccaaggaggtggagcctgagcccacagaggacaaggacctggaggctgatgaggaggacaccaggaagaaggatgccagtgatgacctggatgacctgaacttcttcaaccagaagaagaagaagaagaagaccaagaagatctttgatattgatgaggccgaggagggcgtgaaggacctgaagattgaaagtgatgtgcaggagcccacagagccagaagatgacctggacatcatgctgggcaacaagaagaagaagaagaagaatgtgaagttcccagatgaagatgagatcctggagaaggatgaggccctggaggatgaggacaacaagaaggatgatggcatctccttcagcaaccagacaggccctgcctgggccggcagcgagcgggactacacctatgaggagctgctgaacagagtcttcaacatcatgagggagaagaacccagacatggtggccggggagaagaggaagtttgtgatgaagccaccccaggtggtgcgggtgggcaccaagaagaccagctttgtgaacttcacagacatctgcaagctgctgcaccggcagcccaagcacctgctggccttcctgctggccgagctgggcaccagcggcagcattgatggcaacaaccagctggtgatcaagggccgcttccagcagaagcagattgaaaatgtgctgcggcgctacatcaaggagtatgtgacctgccacacctgccgcagcccagacaccatcctgcagaaggacacccggctgtacttcctgcagtgtgagacctgccacagccgctgcagcgtggccagcatcaagacaggcttccaggccgtgacaggcaagagggcccagctgcgggccaaggccaactag

SEQ ID NO: 20008 - DNA, 2619 bp, Artificial Sequence
  Description of Artificial Sequence: Synthetic coding sequence
atgggagagggcggcctgcccccagccttccagctgctgctgcgggcctgtgaccagggcgacacagaaacagcccggcggctgctggagcctggagctgctgagcctgctgagagaggagctgagcctgaggccggggctgagcctgctggagctgaggtggccggccctggagctgctgctgctggagctgtgggcgcccctgtgcctgtggactgcagtgatgaagctggcaacacagccctgcagtttgctgctgctgggggccacgagcccctggtgcgcttcctgctgcggcggggggcctctgtgaacagcaggaaccactacggctggagcgccctgatgcaggccgccaggtttggacatgtgtctgtggcccacctgctgctggaccatggagcagatgtgaatgcccagaaccggctgggcgcctctgtgctgactgtggccagccggggcggccacctgggcgtggtgaagctgctgctggaggccggggcctttgtggaccaccaccaccccagcggggagcagctgggcctgggcggcagcagagatgagcccctggacatcacagccctgatggccgccatccagcacggccatgaagctgtggtgcggctgctgatggagtggggcgctgaccccaaccacgccgccaggacagtgggctggagccccctgatgctggccgccctgaccggccgcctgggcgtggcccagcagctggtggagaagggggccaacccagaccacctgtctgtgctggagaagacagcctttgaggtggccctggactgcaagcaccgggacctggtggactacctggaccccctgaccaccgtgcggcccaagacagatgaggagaagaggaggccagacatcttccacgccctgaagatgggcaacttccagctggtgaaggagattgctgatgaggaccccagccacgtgaacctggtgaatggagatggagccacccccctgatgctggccgctgtgacaggccagctggccctggtgcagctgctggtggagagacatgctgatgtggacaagcaggacagcgtgcacggctggacagccctgatgcaggccacctaccacggcaacaaggagatcgtgaagtacctgctgaaccagggcgcagatgtgaccctgcgggccaagaatggctacacagcctttgacctggtgatgctgctgaatgaccctgacacagagctggtgcggctgctggcctctgtgtgcatgcaggtgaacaaggacaagggccggcccagccaccagccccccctgccccacagcaaggtgcggcagccctggagcatccctgtgctgcctgatgacaagggcggcctgaagtcctggtggaacaggatgagcaaccgcttcaggaagctgaagctgatgcagaccctgccccggggcctgagcagcaaccagcccctgcccttcagtgatgagcctgagcccgccctggacagcaccatgagagctgccccccaggacaagaccagccgcagcgccctgcctgatgctgcccctgtgaccaaggacaatggacctggcagcaccagaggagagaaggaggacaccctgctgaccaccatgctgagaaatggagcccccctgacccggctgcccagcgacaagctgaaggccgtcatcccccccttcctgccccccagcagctttgagctgtggagcagtgacaggagcaggaccaggcacaacgggaaggctgaccccatgaagacagccctgccccagagggccagccggggccaccctgtgggcggcggcggcacagacaccacccctgtgcggcctgtgaagttccccagcctgcccaggagccctgccagcagcgccaacagcggcaacttcaaccacagcccccacagcagcggcggcagcagcggcgtgggcgtgtccagacatggaggagagctgctgaacagaagtggcggcagcattgacaacgtgctgagccagattgctgcccagaggaagaaggccgccggcctgctggagcagaagcccagccacaggagcagccctgtgggccctgcccctggcagcagccccagcgagctgcctgccagccctgctgggggcagcgcccctgtgggcaagcagaagctggagaccagcaagaggcctccttctggcaccagcaccaccagcaagagcaccagccccaccctgacccccagccccagccccaagggccacacagctgagagctctgtgagcagcagcagcagccaccggcagagcaagagcagcggcggcagcagcagcggcaccatcacagatgaagatgagctgaccggcatcctgaagaagctgagcctggagaagtaccagcccatctttgaggagcaggaggtggacatggaggccttcctgaccctgacagatggagacctgaaggagctgggcatcaagacagatggcagccggcagcagatcctggccgccatcagcgagctgaatgctgggaagggccgggagcggcagatcctgcaggagaccatccacaacttccacagcagctttgagagcagcgccagcaacacccgggcccctggcaacagcccctgtgcctag

SEQ ID NO: 20009 - DNA, 483 bp, Artificial Sequence
  Description of Artificial Sequence: Synthetic coding sequence
atggaggccgagcggccccaggaggaggaggatggagagcagggccccccccaggatgaggagggctggcccccacccaacagcaccacccggccctggaggtctgccccacccagccccccacctcctggcaccaggcacacagccctgggccccaggtctgccagcctgctgagcctgcagacagagctgctgctggacctggtggccgaggcccagagccggcggctggaggagcagagggccaccttctacaccccccagaaccccagcagcctggccccagcccccctgcggcccctggaggaccgggagcagctgtacagcaccatcctgagccaccagtgccagaggatggaggcccagaggtctgagccccccctgcccccaggcggccaggagctgctggagctgctgctgcgggtgcagggcggcggccgcatggaggagcagaggagcaggcctcccacccacacctgctag

SEQ ID NO: 20010 - DNA, 483 bp, Artificial Sequence; identical to SEQ ID NO: 20009
  Description of Artificial Sequence: Synthetic coding sequence

SEQ ID NO: 20011 - DNA, 2790 bp, Artificial Sequence
  Description of Artificial Sequence: Synthetic coding sequence
atgcagggcctgcctgacccccccagccagaggggcatcatcccccgggcctttgagcacgtgtttgagagcgtgcagtgtgccgagaacaccaagttcctggtgcgggccagctacctggagatctacaatgaagatgtgcgggacctgctgggcgctgacaccaagcagaagctggagctgaaggagcaccctgagaagggcgtgtatgtgaagggcctgtccatgcacacagtgcacagcgtggcccagtgtgagcacatcatggagaccggctggaagaacagatctgtgggctacaccctgatgaacaaggacagcagccgcagccacagcatcttcaccatcagcattgagatgtctgctgtggatgagcggggcaaggaccacctgcgggccggcaagctgaacctggtggacctggccggcagcgagcggcagagcaagacaggagccactggagagcggctgaaggaggccaccaagatcaacctgagcctgagcgccctgggcaatgtcatcagcgccctggtggatggccgctgcaagcacgtgccctacagagacagcaagctgacccggctgctgcaggacagcctgggcggcaacaccaagaccctgatggtggcctgcctgagccctgctgacaacaactatgatgagaccctgagcaccctgcgctatgccaacagagccaagaacatccggaacaagccccgcatcaatgaagaccccaaggatgccctgctgcgggagtaccaggaggagatcaagaagctgaaggccatcctgacccagcagatgagccccagcagcctgagcgccctgctgagccggcaggtgcccccagaccctgtgcaggtggaggagaagctgctgccccagcccgtcatccagcatgatgtggaggccgagaagcagctgatccgggaggagtatgaggagcggctggcccggctgaaggctgactacaaggccgagcaggagagccgggcccggctggaggaggacatcacagccatgaggaacagctatgatgtgcggctgagcaccctggaggagaacctgaggaaggagacagaggccgtgctgcaggtgggcgtgctgtacaaggccgaggtgatgagcagagctgagtttgccagcagcgctgagtaccccccagccttccagtatgagaccgtggtgaagcccaaggtgttcagcaccacagacaccctgcccagtgatgatgtgtccaagacccaggtgagcagcagatttgctgagctgcccaaggtggagcccagcaagtctgagatcagcctgggcagcagcgagagcagcagcctggaggagacctctgtgtctgaggccttccctggccctgaggagcccagcaatgtggaggtgtccatgcccacagaggagagccgcagccgctacttcctggatgaatgtctgggccaggaggccgccggccacctgctgggggagcagaactacctgccccaggaggagccccaggaggtgcccctgcagggcctgctgggcctgcaggacccctttgctgaggtggaggccaagctggcccggctgagcagcacagtggccaggacagatgccccccaggctgatgtgcccaaggtgcctgtgcaggtgcctgcccccacagacctgctggagcccagtgatgcccggcctgaggccgaggccgcagatgacttcccccccaggcctgaggtggacctggccagcgaggtggccctggaggtggtgaggacagctgagcccggggtgtggctggaggcccaggcccctgtggccctggtggcccagcctgagcccctgcctgccacagctggggtgaagcgggagagcgtgggcatggaggtggccgtgctgacagatgaccccctgcctgtggtggaccagcagcaggtgctggcccggctgcagctgctggagcagcaggtggtgggcggggagcaggccaagaacaaggacctgaaggagaagcacaagaggaggaagagatatgcagatgaaagaaggaagcagctggtggccgccctgcagaacagtgatgaggacagcggggactgggtgctgctgaatgtgtatgacagcatccaggaggaggtgcgggccaagagcaagctgctggagaagatgcagaggaagctgcgggctgctgaggtggagatcaaggacctgcagagcgagttccagctggagaagattgactacctggccaccatccggcggcaggagcgggacagcatgctgctgcagcagctgctggagcaggtgcagcccctcatcagaagagactgcaactacagcaacctggagaagatcctgcgggagagctgctgggatgaggacaatggcttctggaagatcccccaccctgtgatcaccaagaccagcctgcctgtggccgtgtccacaggcccccagaacaagccagccaggaagaccagcgctgctgacaacggggagcccaacatggaggatgaccgctaccgcctgatgctgagccgcagcaacagcgagaacatcgccagcaactacttccgcagcaagagggccagccagatcctgagcacagatgccaggaagagcctgacccaccacaacagccccccaggcctgagctgccccctgagcaacaacagcgccatcccccccacccaggcccctgagatgccccagccccggcccttccggctggagagcctggacatccccttcaccaaggccaagaggaagaagagcaagagcaactttggcagcgagcccctgtag

SEQ ID NO: 20012 - DNA, 426 bp, Artificial Sequence
  Description of Artificial Sequence: Synthetic coding sequence
atgaacaagcacgtgctgaagatccagaaggagctggaggaggccaaggagaagctggcccggcagcacaagagaagaagtgatgatgatgacaggagcagtgacaggaaggatggagtgctggaggagcagatcgagcggctgcaggagaaggtggagagcgcccagagcgagcagaagaacctcttcctggtgatcttccagcgcttcatcatgatcctgacagagcacctggtgcgctgtgaaacagatggcacctctgtgctgaccccctggtacaagaactgcatcgagcggctgcagcagatcttcctgcaggtgtgtggggagctgcggctgggcaacaacaccatcctgagccacaaggacttcagcctgaagaagatcctggtgaagtttgtgagaagactctacagcacctgctag

SEQ ID NO: 20013 - DNA, 2373 bp, Artificial Sequence
  Description of Artificial Sequence: Synthetic coding sequence
atgagcagaagaagacacagtgatgaaaatgatggcggccagccccacaagaggaggaagaccagtgatgccaatgaaacagaggaccacctggagagcctcatctgcaaggtgggggagaagagcgcctgcagcctggagagcaacctggagggcctggccggcgtgctggaggccgacctgcccaactacaagagcaagatcctgcggctgctgtgcaccgtggcccggctgctgcctgagaagctgaccatctacaccaccctggtgggcctgctgaatgccaggaactacaactttggaggagaatttgtggaggccatgatccggcagctgaaggagagcctgaaggccaacaactacaatgaggccgtgtacctggtgcgcttcctgagtgacctggtgaactgccacgtgattgctgcccccagcatggtggccatgtttgagaactttgtgtctgtgacccaggaggaggatgtgccccaggtgagaagagactggtacgtgtatgccttcctgagcagcctgccctgggtgggcaaggagctgtatgagaagaaggatgctgagatggaccgcatctttgccaacacagagagctacctgaagaggcggcagaagacccacgtgcccatgctgcaggtgtggacagctgacaagccccacccccaggaggagtacctggactgcctgtgggcccagatccagaagctgaagaaggaccgctggcaggagcggcacatcctgcggccctacctggcctttgacagcatcctgtgtgaggccctgcagcacaacctgccccccttcaccccaccaccccacacagaggacagcgtgtaccccatgcccagggtcatcttcaggatgtttgactacacagatgatcctgagggccctgtgatgcctggcagccacagcgtggagcgcttcgtcatcgaggagaacctgcactgcatcatcaagagccactggaaggagaggaagacctgtgccgcccagctggtgtcctacccaggcaagaacaagatccccctgaactaccacatcgtggaggtgatctttgctgagctgttccagctgcctgccccaccccacattgatgtgatgtacaccaccctgctgattgagctgtgcaagctgcagcccggcagcctgccccaggtgctggcccaggccacagagatgctgtacatgaggctggacaccatgaacaccacctgtgtggaccgcttcatcaactggttcagccaccacctgagcaacttccagttccgctggagctgggaggactggagcgactgcctgagccaggaccctgagagccccaagcccaagtttgtgcgggaggtgctggagaagtgcatgaggctgagctaccaccagaggatcctggacatcgtgccccccaccttcagcgccctgtgcccagccaaccccacctgcatctacaagtatggagatgagagcagcaacagcctgcccggccacagcgtggccctgtgcctggccgtggccttcaagagcaaggccaccaatgatgagatcttcagcatcctgaaggatgtgcccaaccccaaccaggatgatgatgatgatgagggcttctccttcaaccccctgaagattgaggtgtttgtgcagaccctgctgcacctggccgccaagagcttcagccacagcttcagcgccctggccaagttccacgaggtgttcaagaccctggccgagagtgatgagggcaagctgcacgtgctgcgggtgatgtttgaggtgtggaggaaccacccccagatgattgctgtgctggtggacaagatgatccgcacccagatcgtggactgtgccgctgtggccaactggatcttcagcagcgagctgagccgggacttcacccggctgtttgtgtgggagatcctgcacagcaccatcaggaagatgaacaagcacgtgctgaagatccagaaggagctggaggaggccaaggagaagctggcccggcagcacaagagaagaagtgatgatgatgacaggagcagtgacaggaaggatggagtgctggaggagcagatcgagcggctgcaggagaaggtggagagcgcccagagcgagcagaagaacctcttcctggtgatcttccagcgcttcatcatgatcctgacagagcacctggtgcgctgtgaaacagatggcacctctgtgctgaccccctggtacaagaactgcatcgagcggctgcagcagatcttcctgcagcaccaccagatcatccagcagtacatggtgaccctggagaacctgctcttcaccgctgagctggacccccacatcctggccgtgttccagcagttctgtgccctgcaggcctag

SEQ ID NO: 20014 - DNA, 699 bp, Artificial Sequence
  Description of Artificial Sequence: Synthetic coding sequence
atgagccaggtgctgagcatcctgggcatgcacaccctgatgagcaaccagcagtactaccaggccctgagcagcagcagcatcatgaacaaggagggcctgaacagcgtcatcaagcccacccagtacaagcctgtgcctgatgaggagcccaacagcacagatgtggaggagaccctggagcgcatcaagaacaatgaccccaagctggaggaggtgaacctgaacaacatccggaacatccccatccccaccctgaaggcctatgcagaggccctgaaggaaaattcctatgtgaagaagttcagcatcgtgggcaccaggagcaatgaccctgtggcctatgccctggccgagatgctgaaggagaacaaggtgctgaagaccctgaatgtggagagcaacttcatcagcggggccggcatcctgcggctggtggaggccctgccctacaacaccagcctggtggagatgaagattgacaaccagagccagcccctgggcaacaaggtggagatggagatcgtgtccatgctggagaagaatgccaccctgctgaagtttggctaccacttcacccagcagggcccccggctgcgggccagcaatgccatgatgaacaacaatgacctggtgaggaagaggcggctggccgacctgaccggccccatcatccccaagtgccgcagcggcgtgtag

SEQ ID NO: 20015 - DNA, 2403 bp, Artificial Sequence
  Description of Artificial Sequence: Synthetic coding sequence
atgagcagcctgggcgccagctttgtgcagatcaagtttgatgacctgcagttctttgagaactgtggcggcggcagctttggatctgtgtaccgggccaagtggatcagccaggacaaggaggtggccgtgaagaagctgctgaagattgagaaggaggccgagatcctgtctgtgctgagccacaggaacatcatccagttctatggagtcatcctggagccccccaactacggcatcgtgacagaatatgccagcctgggcagcctgtatgactacatcaacagcaacagaagtgaggagatggacatggaccacatcatgacctgggccacagatgtggccaagggcatgcactacctgcacatggaggcccctgtgaaggtgatccaccgggacctgaagagcagaaatgtggtgattgctgctgatggagtgctgaagatctgtgactttggagccagccgcttccacaaccacaccacccacatgagcctggtgggcaccttcccctggatggcccctgaggtgatccagagcctgcctgtgtctgagacctgtgacacctacagctatggagtggtgctgtgggagatgctgacccgggaggtgcccttcaagggcctggagggcctgcaggtggcctggctggtggtggagaagaatgaaaggctgaccatccccagcagctgccccaggagctttgctgagctgctgcaccagtgctgggaggctgatgccaagaagaggcccagcttcaagcagatcatcagcatcctggagagcatgagcaatgacaccagcctgcctgacaagtgcaacagcttcctgcacaacaaggccgagtggaggtgtgaaattgaggccaccctggagcggctgaagaagctggagcgggacctgtccttcaaggagcaggagctgaaggagcgggagcggcggctgaagatgtgggagcagaagctgacagagcagagcaacacccccctgctgcccagctttgagatcggggcctggacagaagatgatgtgtactgctgggtgcagcagctggtgaggaagggggacagcagcgctgagatgtctgtgtatgccagcctcttcaaggagaacaacatcaccgggaagaggctgctgctgctggaggaggaggacctgaaggacatgggcatcgtgtccaagggccacatcatccacttcaagagcgccatcgagaagctgacccatgactacatcaacctcttccacttccccccactcatcaaggacagcggcggggagcctgaggagaatgaggagaagatcgtgaacctggagctggtgtttggcttccacctgaagccaggcaccggcccccaggactgcaagtggaagatgtacatggagatggatggagatgagatcgccatcacctacatcaaggatgtgaccttcaacaccaacctgcctgatgctgagatcctgaagatgaccaagcccccatttgtgatggagaagtggatcgtgggcatcgccaagagccagacagtggagtgcaccgtgacctatgaaagtgatgtgaggacccccaagagcaccaagcacgtgcacagcatccagtggagcaggaccaagccccaggatgaggtgaaggctgtgcagctggccatccagaccctcttcaccaacagtgatggcaaccctggcagcagaagtgacagcagcgctgactgccagtggctggacaccctgaggatgaggcagatcgccagcaacaccagcctgcagaggagccagagcaaccccatcctgggcagccccttcttcagccactttgatggccaggacagctatgctgctgctgtgcggcggccccaggtgcccatcaagtaccagcagatcacccctgtgaaccagagccgcagcagcagccccacccagtatggcctgaccaagaacttcagcagcctgcacctgaacagccgggacagcggcttcagcagcggcaacacagacaccagcagcgagcggggccgctacagcgacaggagcaggaacaagtatggccggggcagcatcagcctgaacagcagcccccggggccgctacagcggcaagagccagcacagcacccccagccggggccgctacccaggcaagttctacagagtgtcccagagcgccctgaacccccaccagagcccagacttcaagaggagcccccgggacctgcaccagcccaacaccatccctggcatgcccctgcaccctgagacagacagccgggccagcgaggaggacagcaaggtgtctgagggcggctggaccaaggtggagtacaggaagaagccccaccggcccagccctgccaagaccaacaaggagcgggcccggggggaccaccggggctggaggaacttctag

SEQ ID NO: 20016 - DNA, 1071 bp, Artificial Sequence
  Description of Artificial Sequence: Synthetic coding sequence
atgaggcgcttcctgcggcccggccatgaccctgtgcgggagcggctgaagagggacctcttccagttcaacaagacagtggagcacggcttcccccaccagcccagcgccctgggctacagccccagcctgcgcatcctggccatcggcaccaggtctggggccatcaagctgtatggagcccctggggtggagttcatgggcctgcaccaggagaacaatgctgtgacccagatccacctgctgcccggccagtgccagctggtgaccctgctggatgacaacagcctgcacctgtggagcctgaaggtgaagggcggggccagcgagctgcaggaggatgagagcttcaccctgcggggccccccaggagctgcccccagcgccacccagatcaccgtggtgctgccccacagcagctgtgagctgctgtacctgggcacagagagcggaaatgtgtttgtggtgcagctgcctgccttccgggccctggaggacaggaccatcagcagtgatgctgtgctgcagaggctgcctgaggaggcccggcacagaagagtgtttgagatggtggaggccctgcaggagcacccccgggaccccaaccagatcctgattggctacagccggggcctggtggtgatctgggacctgcagggcagccgggtgctgtaccacttcctgagcagccagcagctggagaacatctggtggcagagagatggccgcctgctggtgtcctgccacagtgatggcagctactgccagtggcctgtgtcctctgaggcccagcagcctgagcccctgcggagcctggtgccctacggccccttcccctgcaaggccatcacccgcatcctgtggctgaccacccggcagggcctgcccttcaccatcttccagggcggcatgccccgggccagctatggagacagacactgcatcagcgtcatccatgatggccagcagacagcctttgacttcaccagccgggtgattggcttcaccgtgctgacagaagctgaccctgctgccagcagaagagccagcggcgtgggcgcccagggctag

SEQ ID NO: 20017 - DNA, 2526 bp, Artificial Sequence
  Description of Artificial Sequence: Synthetic coding sequence
atgggcgcccgggccgccggcaccagcagcggcggcggcccccggccctgcctggcccggggcctgagcgccagccccttccctgccaagcagcagcacccccaggccggggccagccctgctgagctgcagcagagggcctactaccgggcccggcaggatgctgccagccagcccggcctgggcttcctgatcagccccagcagctgcagctcctggggccctggcagcttcaccaggagctgtggctaccccaccctgtgcagctcctggatcagcaagcgggagcctggagagctgtctggagtgtggaccagcgcctggaggacccacgccgccttcaccggcagccaggacctgtgcctgtacaagggcctgggcagcatctatgaggacaagacagccctgagcctgctgggcctgggggaggagaccaatgaggaggatgaggaggagagtgacaaccagagcgtgcacagcagcagcgagcccctgaggaacctgcacctggacatcggggccctgggcggggactttgaatatgaggagagcctgcggaccagccagcctgaggagaagaaggatgtgtccctggacagtgatgctgctggcccccccaccccctgcaagcccagcagccctggagctgacagcagcctgagcagcgctgtgggcaagggccggcagggcagcggggcccggcccggcctgcctgagaaggaggagaatgagaagtctgagcccaagatctgcaggaacctggtgacccccaaggctgaccccaccggcagcgagcccgccaaggccagcgagaaggaggcccctgaggacacagtggatgctggggaggagggcagcagaagagaggaggccgccaaggagcccaagaagaaggccagcgccctggaggagggcagcagtgatgccagccaggagctggagatcagcgagcacatgaaggagccccagctgagtgacagcatcgccagtgaccccaagagcttccacggcctggactttggcttccgcagccgcatcagcgagcacctgctggatgtggatgtgctgagccctgtgctgggcggggcctgccggcaggcccagcagcccctgggcatcgaggacaaggatgacagccagagcagccaggatgagctgcagagcaagcagagcaagggcctggaggagcgctaccaccggctgagcccccccctgccccatgaggagcgggcccagagcccccccaggagcctggccacagaggaggagcccccccagggccctgagggccagcctgagtggaaggaggccgaggagctgggggaggacagcgctgccagcctgagcctgcagctgagcctgcagaggaggagcacagagcctgtggcccctcctgagcagctgtctgaggccgccctgaaggccatggaggaggccgtggcccaggtgctggagcaggaccagaggcacctgctggagagcaagcaggagaagatgcagcagctgcgggagaagctgtgccaggaggaggaggaggagatcctgcggctgcaccagcagaaggagcagagcctgagcagcctgcgggagcggctgcagaaggccatcgaggaggaggaggccaggatgagggaggaggagagccagaggctgtcctggctgcgggcccaggtgcagagcagcacccaggctgatgaggaccagatccgggcagagcaggaggccagcctgcagaagctgcgggaggagctggagagccagcagaaggccgagcgggccagcctggagcagaagaaccggcagatgctggagcagctgaaggaggagattgaggccagcgagaagtctgagcaggccgccctgaatgctgccaaggagaaggccctgcagcagctgcgggagcagctggagggggagaggaaggaggccgtggccaccctggagaaggagcacagcgctgagctggagcggctgtgcagcagcctggaggccaagcaccgggaggtggtgagcagcctgcagaagaagatccaggaggcccagcagaaggaggaggcccagctgcagaagtgcctgggccaggtggagcaccgggtgcaccagaagagctaccacgtggccggctatgaacatgagctgagcagcctgctgcgggagaagaggcaggaggtggagggggagcacgagcggcggctggacaagatgaaggaggagcaccagcaggtgatggccaaggcccgggagcagtatgaggccgaggagaggaagcagagagctgagctgctgggccacctgaccggggagctggagcggctgcagagggcccacgagcgggagctggagaccgtgcggcaggagcagcacaagaggctggaggacctgcggcggcggcaccgggagcaggagaggaagctgcaggacctggagctggacctggagacccgggccaaggatgtgaaggcccggctggccctgctggaggtgcaggtgcgggacctgcaggagagcctgaccagcgagagctag

SEQ ID NO: 20018 - DNA, 1053 bp, Artificial Sequence
  Description of Artificial Sequence: Synthetic coding sequence
atgatccggggctttgaggcccccatggctgaaaatcctcctcctcctcctcctcctgtgatcttctgccacgacagccccaagagggtgctggtgtctgtcatccgcaccacccccatcaagcccacctgtggcggcggcggggagcctgagcccccaccacccctcatccccaccagccctggcttcagtgacttcatggtgtacccctggcgctggggagaaaatgcccacaacgtgaccctgagccctggagctgctggagctgctgccagcgctgccctgcctgctgctgctgctgctgagcacagcggcctgcggggccgcggggcccctcctcctgctgccagcgccagcgctgctgccagcggcggggaggatgaggaggaggccagcagcccagacagcggccacctgaaggatggcatccggcggggccggcccagggctgacacagtgcgggacctgatcaatgaaggagagcacagcagcagccgcatccgctgcaacatctgcaacagagtcttcccccgggagaagagcctgcaggcccacaagaggacccacactggagagcggccctacctgtgtgactacccagactgtgggaaggcctttgtgcagagcggccagctgaagacccaccagaggctgcacactggagagaagccctttgtgtgcagtgaaaatggctgcctgagccgcttcacccacgccaacagacactgccccaagcacccctatgcccggctgaagcgggaggagcccacagacaccctgagcaagcaccaggccgctgacaacaaggctgctgctgagtggctggcccgctactgggagatgagggagcagaggacccccaccctgaagggcaagctggtgcagaaggctgaccaggagcagcaggaccccctggagtacctgcagagtgatgaagaagatgatgagaagagaggagcccagaggcggctgcaggagcagcgggagcggctgcacggggccctggccctgattgagctggccaacctgaccggggcccccctgcggcagtag

SEQ ID NO: 20019 - DNA, 1137 bp, Artificial Sequence
  Description of Artificial Sequence: Synthetic coding sequence
atgaacatgatctggaggaacagcatcagctgcctgcggctgggcaaggtgccccaccgctaccagagcggctaccaccctgtggcccccctgggcagccgcatcctgacagatcctgccaaggtgtttgagcacaacatgtgggaccacatgcagtggagcaaggaggaggaggccgccgccaggaagaaggtgaaggaaaattctgctgtgcgggtgctgctggaggagcaggtgaagtatgagcgggaggccagcaagtactgggacaccttctacaagatccacaagaacaagttcttcaaggacaggaactggctgctgcgggagttccctgagatcctgcctgtggaccagaagccagaggagaaggcccgggagagctcctgggaccacgtgaagaccagcgccaccaaccgcttcagcaggatgcactgccccaccgtgcctgatgagaagaaccactatgagaagagcagcggcagcagcgagggccagagcaagacagaaagtgacttcagcaacctggacagcgagaagcacaagaagggccccatggagaccggcctcttccctggcagcaatgccaccttccgcatcctggaggtgggctgtggggccggcaacagcgtcttccccatcctgaacaccctggagaacagccctgagagcttcctgtactgctgtgactttgccagcggggctgtggagctggtgaagagccacagcagctaccgggccacccagtgctttgcctttgtgcatgatgtgtgtgatgatggcctgccctaccccttcccagatggcatcctggatgtgatcctgctggtgtttgtgctgagcagcatccacccagacaggatgcagggcgtggtgaaccggctgagcaagctgctgaagccaggcggcatgctgctcttccgggactatggccgctatgacaagacccagctgcgcttcaagaagggccactgcctgtctgagaacttctacgtgagaggagatggcacccgggcctacttcttcaccaagggggaggtgcacagcatgttctgcaaggccagcctggatgagaagcagaacctggtggaccggcggctgcaggtgaacaggaagaagcaggtgaagatgcactag

SEQ ID NO: 20020 - DNA, 1797 bp, Artificial Sequence
  Description of Artificial Sequence: Synthetic coding sequence
atgggcctgcgggccagccggcccagcaagctgacctggaagaagtgggccaccacagctgccagcaacagctgcagccgctctgtgagcagctgccgccgctgcaccggcggccgcctgatgaaggagccctggaggcggcccagcagcagcatctgctacaccagccgcagcagcaccatcaagttcagcagcaacaagttcaagaccctgtctgtgctgctgagccacctgcacctgttccggctgcacgtgaagatcagccagcccagcctgcccatcagcagcagaggagctgccagcagcagccagttccagggcctgcccagccgcagcgccatcttccagcagcagcctgagaactgcagcagccccccaaatgtggccctgacctgcctgggcatgcagcagcctgcccagagccagcaggtgaccatccaggtgcaggagcctgtggacatgctgagcaacatgcctggaacagctgctggcagcagcggccggggcatcagcatcagccccagcgctggccagatgcagatgcagcacaggaccaacctgatggccaccctgtcctatggccaccggcccctgagcaagcagctgtctgctgacagcgctgaggcccacagcgcccaccagcagcccccccactacaccaccagcgccctgcagcaggccctgctgagccccaccccaccagactacaccaggcaccagcaggtgccccacatcctgcagggcctgctgagccccaggcacagcctgaccggccacagcgacatccggctgcccccaacagaatttgcccagctgatcaagaggcagcagcagcagaggcagcagcagcagcagcagcagcagcagcaggagtaccaggagctgttccgccacatgaaccagggagatgctggcagcctggcccccagcctgggcggccagagcatgacagagcggcaggccctgagctaccagaatgctgacagctaccaccaccacaccagcccccagcacctgctgcagatccgggcccaggagtgtgtgtcccaggccagcagccccaccccaccccacggctacgcccaccagcctgccctgatgcacagcgagagcatggaggaggactgcagctgtgagggcgccaaggatggcttccaggacagcaagagcagcagcaccctgaccaagggctgccacgacagccccctgctgctgagcactggaggccctggggaccctgagagcctgctgggcaccgtgagccacgcccaggagctgggcatccacccctacggccaccagcccacagctgccttcagcaagaacaaggtgcccagccgggagcctgtgattggcaactgcatggacaggagcagccctggccaggccgtggagctgcctgaccacaacggcctgggctacccagcccggcccagcgtgcatgagcaccaccggccccgggccctgcagaggcaccacaccatccagaacagtgatgatgcctacgtgcagctggacaacctgcccggcatgagcctggtggccggcaaggccctgagcagcgccaggatgtctgatgctgtgctgagccagagcagcctgatgggcagccagcagttccaggatggagaaaatgaagaatgtggggccagcctgggcggccacgagcacccagacctgagtgatggcagccagcacctgaacagcagctgctaccccagcacctgcatcacagacatcctgctgagctacaagcaccctgaggtgtccttctccatggagcaggccggcgtgtag

SEQ ID NO: 20021 - DNA, 3966 bp, Artificial Sequence
  Description of Artificial Sequence: Synthetic coding sequence
atggctgctgctgctgccagcggggccggcggcgctgctggagctggcactggaggagctggccctgctggccgcctgctgcccccaccagcccctggcagccctgctgccccagctgctgtgtccccagctgctggccagccccggcccccagccccagccagccggggccccatgcctgccagaattggctactatgaaattgacaggaccatcggcaagggcaactttgctgtggtgaagagggccacccacctggtgaccaaggccaaggtggccatcaagatcatcgacaagacccagctggatgaggagaacctgaagaagatcttccgggaggtgcagatcatgaagatgctgtgccacccccacatcatccggctgtaccaggtgatggagacagagaggatgatctacctggtgacagaatatgccagcggcggggagatctttgaccacctggtggcccacggccgcatggccgagaaggaggcccggaggaagttcaagcagatcgtgacagctgtgtacttctgccactgcaggaacatcgtgcaccgggacctgaaggccgagaacctgctgctggatgccaacctgaacatcaagattgctgactttggcttcagcaacctcttcaccccaggccagctgctgaagacctggtgtggcagccccccctatgctgcccctgagctgtttgagggcaaggagtatgatggccccaaggtggacatctggagcctgggcgtggtgctgtatgtgctggtgtgtggggccctgccctttgatggcagcaccctgcagaacctgcgggcccgggtgctgagcggcaagttccgcatccccttcttcatgagcacagaatgtgagcacctgatccgccacatgctggtgctggaccccaacaagaggctgtccatggagcagatctgcaagcacaagtggatgaagctgggagatgctgaccccaactttgaccggctgattgctgagtgccagcagctgaaggaggagcggcaggtggaccccctgaatgaagatgtgctgctggccatggaggacatgggcctggacaaggagcagaccctgcagagcctgcggagtgatgcctatgaccactacagcgccatctacagcctgctgtgtgacagacacaagaggcacaagaccctgcggctgggcgccctgcccagcatgccccgggccctggccttccaggcccctgtgaacatccaggccgagcaggccggcacagccatgaacatctctgtgccccaggtgcagctgatcaaccctgagaaccagatcgtggagccagatggcaccctgaacctggacagtgatgaaggagaggagcccagccctgaggccctggtgcgctacctgtccatgaggaggcacacagtgggcgtggccgaccccaggacagaggtgatggaggacctgcagaagctgctgcccggcttccctggggtgaacccccaggcccccttcctgcaggtggccccaaatgtgaacttcatgcacaacctgctgcccatgcagaacctgcagcccaccggccagctggagtacaaggagcagagcctgctgcagccccccaccctgcagctgctgaatggcatgggccccctgggccggcgggccagtgatggaggagccaacatccagctgcacgcccagcagctgctgaagaggccccggggccccagccccctggtgaccatgaccccagctgtgcctgctgtgacccctgtggatgaggagagcagtgatggagagccagaccaggaggccgtgcagagcagcacctacaaggacagcaacaccctgcacctgcccacagagcgcttcagccctgtgcggcgcttcagtgatggagctgccagcatccaggccttcaaggcccacctggagaagatgggcaacaacagcagcatcaagcagctgcagcaggagtgtgagcagctgcagaagatgtatggaggccagattgatgagaggaccctggagaagacccagcagcagcacatgctgtaccagcaggagcagcaccaccagatcctgcagcagcagatccaggacagcatctgccccccccagcccagcccccccctgcaggccgcctgtgagaaccagcctgccctgctgacccaccagctgcagaggctgcgcatccagcccagcagccccccacccaaccaccccaacaaccacctgttccggcagcccagcaacagccccccacccatgagcagcgccatgatccagccccacggggccgccagcagcagccagttccagggcctgcccagccgcagcgccatcttccagcagcagcctgagaactgcagcagcccccccaacgtggccctgacctgcctgggcatgcagcagcctgcccagagccagcaggtgaccatccaggtgcaggagcctgtggacatgctgagcaacatgcctggaacagctgctggcagcagcggccggggcatcagcatcagccccagcgctggccagatgcagatgcagcacaggaccaacctgatggccaccctgtcctatggccaccggcccctgagcaagcagctgtctgctgacagcgctgaggcccacagcctgaatgtgaaccgcttcagccctgccaactatgaccaggcccacctgcacccccacctgttcagtgaccagagccggggcagccccagcagctacagccccagcactggagtgggcttcagccccacccaggccctgaaggtgccccccctggaccagttccccaccttcccccccagcgcccaccagcagcccccccactacaccaccagcgccctgcagcaggccctgctgagccccaccccaccagactacaccaggcaccagcaggtgccccacatcctgcagggcctgctgagccccaggcacagcctgaccggccacagcgacatccggctgcccccaacagaatttgcccagctgatcaagaggcagcagcagcagaggcagcagcagcagcagcagcagcagcagcaggagtaccaggagctgttccgccacatgaaccagggagatgctggcagcctggcccccagcctgggcggccagagcatgacagagcggcaggccctgagctaccagaatgctgacagctaccaccaccacaccagcccccagcacctgctgcagatccgggcccaggagtgtgtgtcccaggccagcagccccaccccacctcatggctacgcccaccagcctgccctgatgcacagcgagagcatggaggaggactgcagctgtgagggcgccaaggatggcttccaggacagcaagagcagcagcaccctgaccaagggctgccacgacagccccctgctgctgagcactggaggccctggggaccctgagagcctgctgggcaccgtgtcccatgcccaggagctgggcatccacccctacggccaccagcccacagctgccttcagcaagaacaaggtgcccagccgggagcccgtcatcggcaactgcatggacaggagcagccctggccaggccgtggagctgcctgaccacaacggcctgggctacccagcccggcccagcgtgcatgagcaccaccggccccgggccctgcagaggcaccacaccatccagaacagtgatgatgcctacgtgcagctggacaacctgcccggcatgagcctggtggccggcaaggccctgagcagcgccaggatgtctgatgctgtgctgagccagagcagcctgatgggcagccagcagttccaggatggagaaaatgaggagtgtggggccagcctgggcggccacgagcacccagacctgagtgatggcagccagcacctgaacagcagctgctaccccagcacctgcatcacagacatcctgctgagctacaagcaccctgaggtgtccttctccatggagcaggccggcgtgtag

SEQ ID NO: 20022 - DNA, 1569 bp, Artificial Sequence
  Description of Artificial Sequence: Synthetic coding sequence
atgcccaggaagaaggctgctgctgctgcctgggaggagcccagcagtggaaatggaacagcccgggccggccccaggaagagaggaggccctgctggcaggaagcgggagaggcctgagcgctgcagcagcagcagcggcggcggcagcagtggagatgaagatggcctggagctggatggagcccctgggggcggcaagagagctgcccggcctgccacagctgggaaggccggcggcgctgctgtggtgatcacagagcctgagcacaccaaggagcgggtgaagctggagggcagcaaatgtaaaggccagctgctgatctttggagccaccaactgggacctgattggaaggaaggaggtgcccaagcagcaggccgcctacagaaacctgggccagaacctgtggggcccccacagatatggctgcctggccggcgtgcgggtgaggacagtggtgtctggcagctgtgccgcccacagcctgctgatcaccacagagggcaagctgtggagctggggcagaaatgagaagggccagctgggccacggggacaccaagagggtggaggcccccaggctcatcgagggcctgagccatgaagtcatcgtgtctgctgcctgtggcaggaaccacaccctggccctgacagagaccggctctgtgtttgccttcggggagaacaagatgggccagctgggcctgggcaaccagacagatgctgtgcccagccctgcccagatcatgtacaacggccagcccatcaccaagatggcctgtggggctgagttctccatgatcatggactgcaagggcaacctgtacagctttggctgcccagaatatggccagctgggccacaacagtgatggcaagttcatcgcccgggcccagagaattgaatatgactgtgagctggtgccccggcgggtggccatcttcatcgagaagaccaaggatggccagatcctgcctgtgcccaacgtggtggtgagagatgtggcctgtggggccaaccacaccctggtgctggacagccagaagagggtcttctcctggggctttggaggctacggccgcctgggccatgctgagcagaaggatgagatggtgccccggctggtgaagctgtttgacttccctggccgcggggccagccagatctatgccggctacacctgcagctttgctgtgtctgaggtgggcggcctcttcttctggggcgccaccaacaccagccgggagagcaccatgtaccccaaggctgtgcaggacctgtgtggctggaggatccgcagcctggcctgtgggaagagcagcatcatcgtggccgcagatgagagcaccatctcctggggccccagccccacctttggagagctgggctacggggaccacaagcccaagagcagcacagctgcccaggaggtgaagaccctggatggcatcttcagcgagcaggtggccatgggctacagccacagcctggtgattgccagagatgagagcgagacagagaaggagaagatcaagaagctgcctgagtacaaccccaggaccctgtag

SEQ ID NO: 20023 - DNA, 1569 bp, Artificial Sequence; identical to SEQ ID NO: 20022
  Description of Artificial Sequence: Synthetic coding sequence

SEQ ID NO: 20024 - DNA, 552 bp, Artificial Sequence
  Description of Artificial Sequence: Synthetic coding sequence
atgacagaccagacctactgtgaccggctggtgcaggacacccccttcctgaccggccacggccgcctgtctgagcagcaggtggaccgcatcatcctgcagctgaaccgctactacccccagatcctgaccaacaaggaggccgagaagttcaggaaccccaaggccagcctgcgggtgcggctgtgtgacctgctgagccacctgcagaggtctggagagcgggactgccaggagttctaccgggccctgtacatccacgcccagcccctgcacagccggctgcccagcagacatgccctgcagaacagcgactgcacagagctggacagcggcagccagagcggggagctgagcaacagaggccccatgtccttcctggccggcctgggcctggccgtgggcctggccctgctgctgtactgctaccccccagaccccaagggcctgcccggcacccggcgggtgctgggcttcagccctgtgatcatcgacagacatgtgagccgctacctgctggccttcctggctgatgacctgggcggcctgtag

SEQ ID NO: 20025 - DNA, 492 bp, Artificial Sequence
  Description of Artificial Sequence: Synthetic coding sequence
atgctggacctgctggacatcgagggcctgtaccccctgtacaacagagtggagcgctacctggaggagttccctgaggagaggaagaccctgcagattgatggcccctatgatgaggccttctaccagaagctgctggacctgagcacagaagatgatggcaccgtggcctttgccctgaccaaggtgcagcagtacagagtggccatgacagccaaggactgcagcatcatgattgccctgagcccctgcctgcaggatgccagcagtgaccagaggcctgtggtgcccagcagccgcagcagatttgccttctctgtgtctgtgctggacctggacctgaagccctatgagagcatcccccaccagtacaagctggatggcaagatcgtgaactactacagcaagacagtgcgggccaaggacaatgctgtgatgagcacccgcttcaaggagagcgaggactgcaccctggtgctgcacaaggtgtag

SEQ ID NO: 20026 - DNA, 777 bp, Artificial Sequence
  Description of Artificial Sequence: Synthetic coding sequence
atggcccggccccctgtgcccggctctgtggtggtgcccaactggcatgagagcgctgagggcaaggagtacctggcctgcatcctgaggaagaacagaagaagagtgtttggcctgctggagaggcctgtgctgctgccccctgtgtccattgacacagccagctacaagatctttgtgtctgggaagagcggcgtgggcaagacagccctggtggccaagctggccggcctggaggtgcctgtggtgcaccacgagaccaccggcatccagaccaccgtggtgttctggccagccaagctgcaggccagcagccgggtggtgatgttccgctttgagttctgggactgtggggagagcgccctgaagaagtttgaccacatgctgctggcctgcatggagaacacagatgccttcctgttcctgttctccttcacagaccgggccagctttgaggacctgcccggccagctggccagaattgctggggaggcccctggggtggtgaggatggtgattggcagcaagtttgaccagtacatgcacacagatgtgcctgagcgggacctgacagccttccggcaggcctgggagctgcccctgctgcgggtgaagtctgtgcccggccggcggctggctgatggccgcaccctggatggccgggccggcctggctgatgtggcccacatcctgaatggcctggccgagcagctgtggcaccaggaccaggtggccgccggcctgctgcccaaccccccagagagcgcccctgagtag

SEQ ID NO: 20027 - DNA, 333 bp, Artificial Sequence
  Description of Artificial Sequence: Synthetic coding sequence
atggctgacaaggtgctgaaggagaagaggaagcagttcatccgctctgtgggggagggcaccatcaatggcctgctgggggagctgctggagaccagggtgctgagccaggaggagattgagatcgtgaagtgtgaaaatgccaccgtgatggacaaggcccgggccctgctggacagcgtcatcaggaagggggccccagcctgccagatctgcatcacctacatctgtgaggaggacagccacctggccggcaccctgggcctgtctgctggccccaccagcggcaaccacctgaccacccaggacagccagatcgtgctgcccagctag

SEQ ID NO: 20028 - DNA, 924 bp, Artificial Sequence
  Description of Artificial Sequence: Synthetic coding sequence
atggagcccagcagcctggagctgcctgctgacacagtgcagagaattgctgctgagctgaagtgccaccccacagatgagcgggtggccctgcacctggatgaggaggacaagctgcggcacttccgggagtgcttctacatccccaagatccaggacctgccccctgtggacctgagcctggtgaacaaggatgaaaatgccatctacttcctgggcaacagcctgggcctgcagcccaagatggtgaagacctacctggaggaggagctggacaagtgggccaagattgctgcctacggccacgaggtgggcaagaggccctggatcactggagatgagagcatcgtgggcctgatgaaggacatcgtgggcgccaatgagaaggagatcgccctgatgaatgccctgactgtgaacctgcacctgctgatgctgtccttcttcaagcccacccccaagcgctacaagatcctgctggaggccaaggccttccccagcgaccactacgccatcgagagccagctgcagctgcacggcctgaacatcgaggagagcatgaggatgatcaagccccgggagggggaggagaccctgagaattgaggacatcctggaggtgattgagaaggagggggacagcattgctgtgatcctcttctctggagtgcacttctacacaggccagcacttcaacatcccagccatcaccaaggccggccaggccaagggctgctacgtgggctttgacctggcccatgctgtgggcaatgtggagctgtacctgcatgactggggcgtggactttgcctgctggtgcagctacaagtacctgaatgctggggccggcggcattgctggggccttcatccacgagaagcacgcccacaccatcaagccagcccggtctgagttcttcaactag

SEQ ID NO: 20029 - DNA, 3060 bp, Artificial Sequence
  Description of Artificial Sequence: Synthetic coding sequence
atggagcctggagaggtgaaggaccgcatcctggagaacatcagcctgtctgtgaagaagctgcagagctactttgctgcctgtgaagatgagatcccagccatccggaaccacgacaaggtgctgcagaggctgtgtgagcacctggaccacgccctgctgtatggcctgcaggacctgagcagcggctactgggtgctggtggtgcacttcacccggcgggaggccatcaagcagatcgaggtgctgcagcacgtggccaccaacctgggccgcagccgggcctggctgtacctggccctgaatgaaaacagcctggagagctacctgcggctcttccaggagaacctgggcctgctgcacaagtactacgtgaagaatgccctggtgtgcagccatgaccacctgaccctcttcctgaccctggtgtctggcctggagttcatccgctttgagctggacctggatgccccctacctggacctggccccctacatgccagactactacaagccccagtacctgctggactttgaagatcggctgcccagctctgtgcacggcagtgacagcctgagcctgaacagcttcaacagcgtgaccagcaccaacctggagtgggatgacagcgccatcgcccccagcagtgaagattatgactttggagatgtgtttcctgctgtgcccagcgtgcccagcacagactgggaggatggagacctgacagacacagtgtctggccccaggagcacagccagtgacctgaccagcagcaaggccagcaccaggagccccacccagaggcagaaccccttcaatgaggagcctgctgagaccgtgagcagcagtgacaccacccctgtgcacaccaccagccaggagaaggaggaggcccaggccctggaccccccagatgcctgcacagagctggaggtgatccgggtgaccaagaagaagaagattggcaagaagaagaagagcagaagtgatgaggaggccagccccctgcacccagcctgcagccagaagaagtgtgccaagcagggagatggagacagcagaaatggcagccccagcctgggccgggacagcccagacaccatgctggccagcccccaggaggagggggagggccccagcagcaccacagagagcagcgagaggtctgagcccggcctgctgatccctgagatgaaggacacctccatggagcggctgggccagcccctgagcaaggtgattgaccagctgaatggccagctggaccccagcacctggtgcagcagagctgagcccccagaccagagcttcagaacaggcagccctggagatgcccctgagaggcctcccctgtgtgacttcagcgagggcctgagcgcccccatggacttctaccgcttcaccgtggagagccccagcacagtgaccagcggcggcggccaccacgaccctgctggcctgggccagcccctgcacgtgcccagcagccctgaggccgccggccaggaggaggagggcggcggcggggagggccagaccccccggcccctggaggacaccacccgggaggcccaggagctggaggcccagctgagcctggtgcgggagggccctgtgtctgagcctgagcccggcacccaggaggtgctgtgccagctgaagagggaccagcccagcccctgcctgagcagcgctgaggacagcggcgtggatgagggccagggcagccccagcgagatggtgcacagcagcgagttccgggtggacaacaaccacctgctgctgctgatgattcatgtgttcagagaaaatgaggagcagctgttcaagatgatccgcatgagcacaggccacatggagggcaacctgcagctgctgtatgtgctgctgacagactgctacgtgtacctgctgaggaagggggccacagagaagccctacctggtggaggaggccgtgtcctacaatgagctggactatgtgtctgtgggcctggaccagcagacagtgaagctggtgtgcaccaacagaaggaagcagttcctgctggacacagcagatgtggccctggccgagttcttcctggccagcctgaagagcgccatgatcaagggctgccgggagcccccctaccccagcatcctgacagatgccaccatggagaagctggccctggccaagtttgtggcccaggagagcaaatgtgaggccagcgctgtgacagtgcgcttctacggcctggtgcactgggaggaccccacagatgagagcctgggccccaccccctgccactgcagccccccagagggcaccatcaccaaggagggcatgctgcactacaaggccggcaccagctacctgggcaaggagcactggaagacctgctttgtggtgctgagcaatggcatcctgtaccagtacccagacagaacagatgtgatccccctgctgtctgtgaacatgggcggggagcagtgtggcggctgccggcgggccaacaccacagaccggccccacgccttccaggtgatcctgagtgaccggccctgcctggagctgtctgctgagagcgaggccgagatggccgagtggatgcagcacctgtgccaggccgtgtccaagggcgtcatcccccagggcgtggcccccagcccctgcatcccctgctgcctggtgctgacagatgacaggctcttcacctgccacgaggactgccagaccagcttcttccgcagcctgggcacagccaagctgggggacatctctgctgtgtccacagagcccgggaaggagtactgtgtgctggagttcagccaggacagccagcagctgctgcccccctgggtgatctacctgagctgcaccagcgagctggaccggctgctgagcgccctgaacagcggctggaagaccatctaccaggtggacctgccccacacagccatccaggaggccagcaacaagaagaagtttgaagatgccctgagcctcatccacagcgcctggcagaggagtgacagcctgtgccggggccgggccagccgggacccctggtgctag

SEQ ID NO: 20030 - DNA, 318 bp, Artificial Sequence
  Description of Artificial Sequence: Synthetic coding sequence
atgaagccctttgaagatgccctgaagaaccagcccctgggccctgtgctgagcaaggccgcctctgtggagtgcatcagccctgtgagcccccgggccccagatgccaagatgctggaggagctgcaggccgagacctggtaccagggcgagatgagcaggaaggaggccgagggcctgctggagaaggatggagacttcctggtgaggaagagcaccaccaaccctggcagctttgtgctgaccggcatgcacaacggccaggccaagcacctgctgctggtggaccctgagggcaccaggagcaacagctactag

SEQ ID NO: 20031 - DNA, 318 bp, Artificial Sequence; identical to SEQ ID NO: 20030
  Description of Artificial Sequence: Synthetic coding sequence

SEQ ID NO: 20032 - DNA, 1785 bp, Artificial Sequence
  Description of Artificial Sequence: Synthetic coding sequence
atgctgcccaggaccaagtacaaccgcttcagaaatgacagcgtgacctctgtggatgacctgctgcacagcctgtctgtgtctgggggcggcggcaaggtgtctgctgcccgggccaccccagctgctgccccctacctggtgtctggagaggccctgaggaaggccccagatgatggccctggcagcctgggccacctgctgcacaaggtgagccacctgaagctgagcagcagcggcctgcggggcctgagcagcgctgcccgggagcgggccggggcccggctgagcggcagctgcagcgcccccagcctggccgccccagatggcagcgcccccagcgccccccgggccccagccatgtctgctgccaggaagggccggcctggagatgagcccctgcccaggcctcccaggggggcccctcatgccagtgaccaggtgctgggccctggggtgacctacgtggtgaagtacctgggctgcatcgaggtgctgcgctccatgaggagcctggacttcagcaccaggacccagatcacccgggaggccatcagccgggtgtgtgaggccgtgcctggggccaagggggccttcaagaagaggaagccacccagcaagatgctgagcagcatcctgggcaagagcaacctgcagtttgctggcatgagcatcagcctgaccatcagcacagccagcctgaacctgcggaccccagacagcaagcagatcatcgccaaccaccacatgaggagcatcagctttgccagcggcggggaccctgacaccacagattatgtggcctacgtggccaaggaccctgtgaacagaagagcctgccacatcctggagtgctgtgatggcctggcccaggacgtcatcggcagcatcggccaggcctttgagctgcgcttcaagcagtacctgcagtgccccaccaagatcccagccctgcatgacaggatgcagagcctggatgagccctggacagaggaggagggagatggcagtgaccacccctactacaacagcatccccagcaagatgcctcctcctgggggcttcctggacacccggctgaagccccggccccacgccccagacacagcccagtttgctgggaaggagcagacctactaccagggccgccacctgggggacacctttggagaggactggcagcagacccccctgcggcagggcagcagtgacatctacagcaccccagagggcaagctgcacgtggcccccaccggggaggcccccacctacgtgaacacccagcagatccccccccaggcctggccagctgctgtgtcctctgctgagagcagccccaggaaggacctgtttgacatgaagccctttgaagatgccctgaagaaccagcccctgggccctgtgctgagcaaggccgcctctgtggagtgcatcagccctgtgagcccccgggccccagatgccaagatgctggaggagctgcaggccgagacctggtaccagggcgagatgagcaggaaggaggccgagggcctgctggagaaggatggagacttcctggtgaggaagagcaccaccaaccctggcagctttgtgctgaccggcatgcacaacggccaggccaagcacctgctgctggtggaccctgagggcaccatccgcaccaaggacagagtgtttgacagcatcagccacctgatcaaccaccacctggagagcagcctgcccatcgtgtctgctggcagcgagctgtgcctgcagcagcctgtggagaggaagcagtag

SEQ ID NO: 20033 - DNA, 693 bp, Artificial Sequence
  Description of Artificial Sequence: Synthetic coding sequence
atgaacaccctgatggatgtgctgcggcaccggcccggctgggtggaggtgaaggatgaaggagagtgggacttctactggtgtgatgtgtcctggctgagagaaaattttgaccacacctacatggatgaacatgtgcgcatcagccacttcaggaaccactatgagctgaccaggaagaactacatggtgaagaacctgaagcgcttcaggaagcagctggagcgggaggccggcaagctggaggccgccaagtgtgacttcttccccaagacctttgagatgccctgtgagtaccacctgtttgtggaggagttcaggaagaaccctggcatcacctggatcatgaagccagacaccaggagcagtgatgaccagaaggatgacatccctgtggagaactacgtggcccagcgctacatcgagaacccctacctgattggaggcaggaagtttgacctgcgggtgtatgtgctggtgatgagctacatccccctgcgggcctggctgtacagagatggctttgcccgcttcagcaacacccgcttcaccctgaacagcattgatgaccagtatgtgcacctgaccaacgtggccgtgcagaagaccagcccagactaccaccccaagaaggtggcccctgggggccagtgtgtgcccatcacagacagccagcagcccggccgcctgtag

SEQ ID NO: 20034 - DNA, 1068 bp, Artificial Sequence
  Description of Artificial Sequence: Synthetic coding sequence
atgaacaccctgatggatgtgctgcggcaccggcccggctgggtggaggtgaaggatgaaggagagtgggacttctactggtgtgatgtgtcctggctgagagaaaattttgaccacacctacatggatgaacatgtgcgcatcagccacttcaggaaccactatgagctgaccaggaagaactacatggtgaagaacctgaagcgcttcaggaagcagctggagcgggaggccggcaagctggaggccgccaagtgtgacttcttccccaagacctttgagatgccctgtgagtaccacctgtttgtggaggagttcaggaagaaccctggcatcacctggatcatgaagccagacaccaggagcagtgatgaccagaaggatgacatccctgtggagaactacgtggcccagcgctacatcgagaacccctacctgattggaggcaggaagtttgacctgcgggtgtatgtgctggtgatgagctacatccccctgcgggcctggctgtacagagatggctttgcccgcttcagcaacacccgcttcaccctgaacagcattgatgaccagtatgtgcacctgaccaacgtggccgtgcagaagaccagcccagactaccaccccaagaagggctgcaagtggaccctgcagcgcttccggcagtacctggccagcaagcacggccctgaggccgtggagaccctcttccgggacatcgacaacatctttgtgaagagcctgcagagcgtgcagaaggtgatcatcagtgacaagcactgctttgagctgtatggctatgacatcctgattgaccaggacctgaagccctggctgctggaggtgaatgccagccccagcctgacagccagcagccaggaggactatgagctgaagacctgcctgctggaggacaccctgcacgtggtggacatggaggcccggctgcggcagaggtctgaggagaccacagaggccgccctgctgctgcccagcagcagcgaggagagcttccagctgatccccagctgccaggaggagatcagcctgagccggccctgtgtgtag

SEQ ID NO: 20035 - DNA, 840 bp, Artificial Sequence
  Description of Artificial Sequence: Synthetic coding sequence
atgagccggcccaagaaccagaactacaagggccacggcctgagcaagggcaaggagcgggagcagagggccagcatccgcttcaagaccaccctgatgaacaccctgatggatgtgctgcggcaccggcccggctgggtggaggtgaaggatgaaggagagtgggacttctactggtgtgatgtgtcctggctgagagaaaattttgaccacacctacatggatgaacatgtgcgcatcagccacttcaggaaccactatgagctgaccaggaagaactacatggtgaagaacctgaagcgcttcaggaagcagctggagcgggaggccggcaagctggaggccgccaagtgtgacttcttccccaagacctttgagatgccctgtgagtaccacctgtttgtggaggagttcaggaagaaccctggcatcacctggatcatgaagcctgtggcccggagccagggcaagggcatcttcctgttccggcggctgaaggacatcgtggactggaggaaggacaccaggagcagtgatgaccagaaggatgacatccctgtggagaactacgtggcccagcgctacatcgagaacccctacctgattggaggcaggaagtttgacctgcgggtgtatgtgctggtgatgtccatgttcaccagccccacctggctgtgcaagaagcacctgcccaccaccacccagaggcgggccgccagcggccgctgcagcgccagcggcagcacctggaggcccaacacaggcccccggcagtggaggcacagcagcggcaccagcaccaccagcctgagcaaggcctgccgggtgtgcagaagatag

SEQ ID NO: 20036 - DNA, 1116 bp, Artificial Sequence
  Description of Artificial Sequence: Synthetic coding sequence
atgagccggcccaagaaccagaactacaagggccacggcctgagcaagggcaaggagcgggagcagagggccagcatccgcttcaagaccaccctgatgaacaccctgatggatgtgctgcggcaccggcccggctgggtggaggtgaaggatgaaggagagtgggacttctactggtgtgatgtgtcctggctgcgggagaacctggagcgggaggccggcaagctggaggccgccaagtgtgacttcttccccaagacctttgagatgccctgtgagtaccacctgtttgtggaggagttcaggaagaaccctggcatcacctggatcatgaagcctgtggcccggagccagggcaagggcatcttcctgttccggcggctgaaggacatcgtggactggaggaaggacaccaggagcagtgatgaccagaaggatgacatccctgtggagaactacgtggcccagcgctacatcgagaacccctacctgattggaggcaggaagtttgacctgcgggtgtatgtgctggtgatgagctacatccccctgcgggcctggctgtacagagatggctttgcccgcttcagcaacacccgcttcaccctgaacagcattgatgaccagtatgtgcacctgaccaacgtggccgtgcagaagaccagcccagactaccaccccaagaagctgcaccccaccgtgggccccctgtgcatccacagcccagaaaatggcagcctgtctgtgaccccctggccctgggatgcccacatgggctgcaagtggaccctgcagcgcttccggcagtacctggccagcaagcacggccctgaggccgtggagaccctcttccgggacatcgacaacatctttgtgaagagcctgcagagcgtgcagaaggtgatcatcagtgacaagcactgctttgagctgtatggctatgacatcctgattgaccaggacctgaagccctggctgctggaggtgaatgccagccccagcctgacagccagcagccaggaggactatgagctgaagacctgcctgctggaggacaccctgcacgtggtggacatggaggccagcttcagccccatcatcccagctgaggtgtag

SEQ ID NO: 20037 - DNA, 1320 bp, Artificial Sequence
  Description of Artificial Sequence: Synthetic coding sequence
atggtgcccagccgggaggccctgctgggccctggcaccacagccatccgctgccccaagaagctgcagaaccagaactacaagggccacggcctgagcaagggcaaggagcgggagcagagggccagcatccgcttcaagaccaccctgatgaacaccctgatggatgtgctgcggcaccggcccggctgggtggaggtgaaggatgaaggagagtgggacttctactggtgtgatgtgtcctggctgagagaaaattttgaccacacctacatggatgaacatgtgcgcatcagccacttcaggaaccactatgagctgaccaggaagaactacatggtgaagaacctgaagcgcttcaggaagcagctggagcgggaggccggcaagctggaggccgccaagtgtgacttcttccccaagacctttgagatgccctgtgagtaccacctgtttgtggaggagttcaggaagaaccctggcatcacctggatcatgaagcctgtggcccggagccagggcaagggcatcttcctgttccggcggctgaaggacatcgtggactggaggaaggacaccaggagcagtgatgaccagaaggatgacatccctgtggagaactacgtggcccagcgctacatcgagaacccctacctgattggaggcaggaagtttgacctgcgggtgtatgtgctggtgatgtctgtgtttgctgaatgtctgctgtggagcggccaccggcggcaggatgtgcacctgaccaacgtggccgtgcagaagaccagcccagactaccaccccaagaagggctgcaagtggaccctgcagcgcttccggcagtacctggccagcaagcacggccctgaggccgtggagaccctcttccgggacatcgacaacatctttgtgaagagcctgcagagcgtgcagaaggtgatcatcagtgacaagcactgctttgagctgtatggctatgacatcctgattgaccaggacctgaagccctggctgctggaggtgaatgccagccccagcctgacagccagcagccaggaggactatgagctgaagacctgcctgctggaggacaccctgcacgtggtggacatggaggcccggctgaccggccgggagaagagggtgggcggctttgacctgatgtggaatgatggccctgtgtcccgggaggagggcgccccagacctgagcggcatgggcaactttgtgaccaacacccacctgggctgtgtgaatgacaggaagaagcagctgcggcagctgttctgcagcctgcaggtgcagaagaaggccagcagctag

SEQ ID NO: 20038 - DNA, 501 bp, Artificial Sequence
  Description of Artificial Sequence: Synthetic coding sequence
atgaaggagatgctggccaaggacctggaggagagccagggcggcaagagcagcgaggtgctgagcgccacagagctgcgggtgcagctggcccagaaggagcaggagctggcccgggccaaggaggccctgcaggccatgaaggctgacaggaagaggctgaagggggagaagacagacctggtgtcccagatgcagcagctgtatgccaccctggagagccgggaggagcagctgcgggacttcatccggaactatgagcagcacaggaaggagagtgaagatgctgtgaaggccctggccaaggagaaggacctgctggagcgggagaagtgggagctgcggcggcaggccaaggaggccacagaccacgccacagccctgcggagccagctggacctgaaggacaacaggatgaaggagctggaggccgagctggccatggccaagcagagcctggccaccctgaccaaggatgtgcccaagaggcacagcctgtag

SEQ ID NO: 20039 - DNA, 2328 bp, Artificial Sequence
  Description of Artificial Sequence: Synthetic coding sequence
atgatggaggacaacaagcagctggccctgagaattgatggagctgtgcagagcgccagccaggaggtgaccaacctgcgggcagagctgacagccaccaacagaaggctggccgagctgagcggcggcggcggccctggccctggccctggagctgctgccagcgccagcgctgctggggacagcgctgccaccaacatggagaacccccagctgggcgcccaggtgctgctgcgggaggaggtgtcccggctgcaggaggaggtgcacctgctgcggcagatgaaggagatgctggccaaggacctggaggagagccagggcggcaagagcagcgaggtgctgagcgccacagagctgcgggtgcagctggcccagaaggagcaggagctggcccgggccaaggaggccctgcaggccatgaaggctgacaggaagaggctgaagggggagaagacagacctggtgtcccagatgcagcagctgtatgccaccctggagagccgggaggagcagctgcgggacttcatccggaactatgagcagcacaggaaggagagtgaagatgctgtgaaggccctggccaaggagaaggacctgctggagcgggagaagtgggagctgcggcggcaggccaaggaggccacagaccacgccacagccctgcggagccagctggacctgaaggacaacaggatgaaggagctggaggccgagctggccatggccaagcagagcctggccaccctgaccaaggatgtgcccaagaggcacagcctggccatgcctggagagaccgtgctgaatggaaaccaggagtgggtggtgcaggccgacctgcccctgacagctgccatccggcagagccagcagaccctgtaccacagccaccccccccaccctgctgaccggcaggccgtgcgggtgagcccctgccacagccggcagcccagcgtcatcagtgatgccagcgctgctgagggggacaggagcagcacccccagcgacatcaacagccccaggcacaggacccacagcctgtgcaatggagacagccctggccctgtgcagaagaacctgcacaaccccatcgtgcagagcctggaggacctggaggaccagaagaggaagaagaagaaggagaagatgggcttcggcagcatcagccgggtgtttgcccggggcaagcagaggaagagcctggaccccggcctgtttgatgacagcgacagccagtgcagccccacccggcagagcctgagcctgtctgagggggaggagcagatggaccggctgcagcaggtggagctggtgaggaccacccccatgagccactggaaggccggcaccgtgcaggcctggctggaggtggtgatggccatgcccatgtatgtgaaggcctgcacagaaaatgtgaagagcggcaaggtgctgctgagcctgagtgatgaggacctgcagctgggcctgggcgtgtgcagcagcctgcacaggaggaagctgcggctggccatcgaggactacagagatgctgaggccggccgcagcctgagcaaggctgctgagctggaccaccactgggtggccaaggcctggctgaatgacatcggcctgagccagtacagccaggccttccagaaccacctggtggatggccgcatgctgaacagcctgatgaagagggacctggagaagcacctgaatgtgtccaagaagttccaccaggtgtccatcctgctgggcatcgagctgctgtaccaggtgaacttcagccgggaggccctgcaggagcggcgggcccgctgtgagacccagaacattgatcctgtggtgtggaccaaccagagggtgctgaagtgggtgcgggacatcgacctgaaggagtatgctgacaacctgaccaacagcggcgtgcatggagctgtgctggtgctggagcccaccttcaatgctgaggccatggccacagccctgggcatccccagcggcaagcacatcctgcggcggcacctggccgaggagatgtctgctgtgttccacccagccaacagcacaggcatccgggaggccgagagatttggcaccccacctggccgggccagctctgtgacccgggccggcaaggaggagaacagcagcggcctgaagtacaaggccggccgcctgcccctgggcaagattggccggggcttcagcagcaaggaccctgacttccatgatgattatggcagcctgcagaatgaagactgtggagatgatgacccccagagccggctggagcagtgccgcctggagggctacaacagcctggaggtgaccaacgtgtag

SEQ ID NO: 20040 - DNA, 861 bp, Artificial Sequence
  Description of Artificial Sequence: Synthetic coding sequence
atgtacagcctggaccgcatctttgctggcttccgcaccaggagccagatgctgctgggccacatcgaggagcaggacaaggtgctgcactgccagttcagtgacaacagtgatgatgaggagagcgagggccaggagaagagcggcacccgctgccgcagccgctcctggatccagaagccagattctgtgtgcagcctggtggagctgagtgacacccaggatgagacccagaagagtgacctggagaatgaagacctgaagattgactgcctgcaggagagccaggagctgaacctgcagaagctgaagaacagcgagcgcatcctgacagaggccaagcagaagatgagggagctgaccatcaacatcaagatgaaggaggacctgatcaaggagctgatcaagacaggaaatgatgccaagtctgtgtccaagcagtacagcctgaaggtgaccaagctggagcatgatgctgagcaggccaaggtggagctgattgagacccagaagcagctgcaggagctggagaacaaggacctgagtgatgtggccatgaaggtgaagctgcagaaggagttcaggaagaagatggatgctgccaagctgcgggtgcaggtgctgcagaagaagcagcaggacagcaagaagctggccagcctgagcatccagaatgagaagagggccaatgagctggagcagagcgtggaccacatgaagtaccagaagatccagctgcagaggaagctgcgggaggagaatgagaagaggaagcagctggatgctgtgatcaagagggaccagcagaagatcaaggtgatcctgagctacatcccagccaagtacaacatgaagtgctag

SEQ ID NO: 20041 - DNA, 1662 bp, Artificial Sequence
  Description of Artificial Sequence: Synthetic coding sequence
atgaacaagaacaccagcacagtggtgagccccagcctgctggagaaggaccctgccttccagatgatcaccatcgccaaggagaccggcctgggcctgaaggtgctgggcggcatcaacagaaatgaaggccccctggtgtacatccaggagatcatccctggaggagactgctacaaggatggccgcctgaagccaggggaccagctggtgtctgtgaacaaggagagcatgattggagtgtcctttgaggaggccaagagcatcatcactggagccaagctgcggctggagagcgcctgggagatcgccttcatccggcagaagagtgacaacatccagcctgagaacctgagctgcaccagcctcatcgaggccagcggggagtatggcccccaggccagcaccctgagcctcttcagcagccccccagagatcctgatccccaagaccagcagcacccccaagaccaacaatgacatcctgagcagctgtgagatcaagacaggctacaacaagacagtgcagatccccatcaccagcgagaacagcacagtgggcctgagcaacacagatgtggccagcgcctggacagaaaattatggcctgcaggagaagatcagcctgaaccccagcgtgcgcttcaaggccgagaagctggagatggccctgaactacctgggcatccagcccaccaaggagcagcaccaggccctgcggcagcaggtgcaggccgacagcaagggcaccgtgtcctttggagactttgtgcaggtggccaggaacctcttctgcctgcagctggatgaggtgaatgtgggcgcccacgagatcagcaacatcctggacagccagctgctgccctgtgacagcagcgaggctgatgagatggagcggctgaagtgtgaaagagatgatgccctgaaggaggtgaacaccctgaaggagaagctgctggagagtgacaagcagaggaagcagctgacagaggagctgcagaatgtgaagcaggaggccaaggctgtggtggaggagacccgggccctgcggagccgcatccacctggccgaggccgcccagaggcaggcccacggcatggagatggactatgaggaggtgatccggctgctggaggccaagatcacagagctgaaggcccagctggccgactacagcgaccagaacaaggagagcgtgcaggacctgaagaagaggatcatggtgctggactgccagctgaggaagtctgagatggccaggaagacctttgaggccagcacagagaagctgctgcactttgtggaggccatccaggaggtgttcagtgacaacagcacccccctgagcaacctgtctgagcggcgggctgtgctggccagccagaccagcctgacccccctgggcagaaatggccgcagcatcccagccaccctggccctggagagcaaggagctggtgaagtctgtgcgggccctgctggacatggactgcctgccctacggctgggaggaggcctacacagcagatggcatcaagtacttcatcaaccacgtgacccagaccacctcctggatccaccctgtgatgtctgtgctgaacctgagccgctcagaagaaaatgaggaggactgcagccgggagctgcccaaccagaagagctag

SEQ ID NO: 20042 - DNA, 564 bp, Artificial Sequence
  Description of Artificial Sequence: Synthetic coding sequence
atggccgcccctggggccctgctggtgatgggcgtgtctggcagcggcaagagcacagtgggcgccctgctggccagcgagctgggctggaagttctatgatgctgatgactaccaccctgaggagaacagaaggaagatgggcaagggcatccccctgaatgaccaggaccgcatcccctggctgtgcaacctgcatgacatcctgctgagagatgtggccagcggccagagggtggtgctggcctgcagcgccctgaagaagacctacagagacatcctgacccagggcaaggatggagtggccctgaagtgtgaggagagcggcaaggaggccaagcaggccgagatgcagctgctggtggtgcacctgagcggcagctttgaggtgatcagcggccgcctgctgaagcgggagggccacttcatgcctcctgagctgctgcagagccagtttgagaccctggagcccccagctgcccctgagaacttcatccagatctctgtggacaagaatgtgtctgagatcatcgccaccatcatggagaccctgaagatgaagtag

SEQ ID NO: 20043 - DNA, 1134 bp, Artificial Sequence
  Description of Artificial Sequence: Synthetic coding sequence
atggccaccatcccagactggaagctgcagctgctggcccggcggcggcaggaggaggcctctgtgcggggccgggagaaggccgagcgggagcggctgagccagatgcctgcctggaagaggggcctgctggagaggagaagagccaagctgggcctgagccctggagagcccagccctgtgctgggcaccgtggaggccggccccccagaccctgatgaatctgctgtgctgctggaggccatcggccctgtgcaccagaaccgcttcatccggcaggagcggcagcagcagcagcagcagcagcagaggtctgaggagctgctggccgagaggaagccaggccccctggaggcccgggagcggcggcccagccctggagagatgagggaccagagccccaagggccgggagagccgggaggagcggctgagcccccgggagacccgggagcggcggctgggcatcggcggggcccaggagctgagcctgcggcccctggaggcccgggactggaggcagagccctggagaggtgggggacaggagcagccggctgtctgaggcctggaagtggaggctgagccctggagagaccccagagaggagcctgcggctggccgagagccgggagcagagccccaggaggaaggaggtggagagccggctgagccctggagagagcgcctaccagaagctgggcctgacagaggcccacaagtggaggccagacagccgggagagccaggagcagagcctggtgcagctggaggccacagagtggaggctgcggtctggagaggagcggcaggactacagtgaagaatgtggcaggaaggaggagtggcctgtgcctggggtggcccccaaggagacagctgagctgtctgagaccctgacccgggaggcccagggcaacagcagcgctggggtggaggccgctgagcagaggcctgtggaggatggagagcggggcatgaagcccacagagggctggaagtggaccctcatcatgagcctggccgggaaaggaaaccagcacctggtgacctgcttcccccaccctgtgtctgggggccgggccaactgccccatcagcaccctcatccagagcccctggtgtggctggggctag

SEQ ID NO: 20044 - DNA, 2223 bp, Artificial Sequence
  Description of Artificial Sequence: Synthetic coding sequence
atggaggctgatggagatggagaggagctggcccggctgcggtctgtgtttgctgcctgtgatgccaacagaagtggccgcctggagcgggaggagttccgggccctgtgcacagagctgcgggtgcggccagcagatgctgaggccgtgttccagaggctggatgctgacagagatggagccatcaccttccaggagtttgcccggggcttcctgggcagcctgcggggcggcagaagaagagactggggccccctggaccctgccccagctgtgtctgaggccggccctgagacccatgacagcgaggaggatgaaggagatgaagatgctgctgctgccctggccaccagctgtggccctgccagccctggccgggcctggcaggacttccaggcccggctgggagatgaggccaagttcatcccccgggaggagcaggtgtccaccctgtaccagaacatcaacctggtggagcccaggctcatccagccctatgagcacgtgatcaagaacttcatccgggagatccggctgcagagcacagagatggagaacctggccatcgctgtgaagagggcccaggacaaggccgccatgcagctgtctgagctggaggaggagatggaccagaggatccaggccgctgagcacaagaccaggaaggatgagaagaggaaggccgaggaggccctgagtgacctgcggcggcagtatgaaacagaggtgggggacctgcaggtgaccatcaagaagctgaggaagctggaggagcagagcaagagggtgtcccagaaggaggatgtggccgccctgaagaagcagatctatgacctgtccatggagaaccagaaggtgaagaaggacctgctggaggcccagaccaacatcgccttcctgcagagcgagctggatgccctgaagagtgactatgctgaccagagcctgaacacagagcgggacctggagatcatccgggcctacacagaggacaggaacagcctggagcggcagatcgagatcctgcagacagccaacaggaagctgcatgacagcaatgatggcctgcggagcgccctggagaacagctacagcaagttcaacagaagcctgcacatcaacaacatcagccctggcaacaccatcagccgcagcagccccaagttcatcggccacagcccccagcccctgggctatgacaggagcagccgcagcagctatgtggatgaggactgtgacagcctggccctgtgtgaccccctgcagaggaccaactgtgaggtggacagcctgcctgagagctgctttgacagcggcctgagcaccctgcgggaccccaatgaatatgattctgaggtggagtacaagcaccagaggggcttccagaggagccatggagtgcaggagagctttggaggagatgccagtgacacagatgtgcctgacatcagagatgaggagaccttcggcctggaggatgtggcctctgtgctggactggaagccccagggctctgtgtctgagggcagcatcgtgagcagcagcaggaagcccatcagcgccctgagcccccagacagacctggtggatgacaatgccaagagcttcagcagccagaaggcctacaagatcgtgctggccggagatgctgctgtgggcaagagcagcttcctgatgaggctgtgcaagaatgagttccgggagaacatcagcgccaccctgggcgtggacttccagatgaagaccctcatcgtggatggagagaggacagtgctgcagctgtgggacacagctggccaggagcgcttccgcagcatcgccaagagctacttcaggaaggcagatggagtgctgctgctgtatgatgtgacctgtgagaagagcttcctgaacatccgggagtgggtggacatgattgaagatgctgcccacgagaccgtgcccatcatgctggtgggcaacaaggctgacatccgggacacagctgccacagagggccagaagtgtgtgcccggccactttggagagaagctggccatgacctacggggccctcttctgtgagaccagcgccaaggatggcagcaacatcgtggaggccgtgctgcacctggcccgggaggtgaagaagaggacagacaaggatgacagccgcagcatcaccaacctgaccggcaccaacagcaagaagagcccccagatgaagaactgctgcaatggatag

SEQ ID NO: 20045 - DNA, 4125 bp, Artificial Sequence
  Description of Artificial Sequence: Synthetic coding sequence
atggaggagaatgaaagccagaagtgtgagccctgcctgccctacagcgctgaccggcggcagatgcaggagcagggcaaaggaaacctgcacgtgaccagcccagaagatgctgaatgtagaaggaccaaggagcggctgagcaatggaaacagccggggctctgtgtccaagagcagcaggaacatccccaggaggcacaccctgggcggccccaggagcagcaaggagatcctgggcatgcagaccagcgagatggacaggaagcgggaggccttcctggagcacctgaagcagaagtacccccaccacgccagcgccatcatgggccaccaggagcggctgcgggaccagaccaggagccccaagctgagccacagcccccagccccccagcctgggggaccctgtggagcacctgtctgagaccagcgctgacagcctggaggccatgtctgaaggagatgcccccacccccttcagccggggcagcaggacccgggccagcctgcctgtggtgcgcagcaccaaccagaccaaggagaggagcctgggcgtgctgtacctgcagtatggagatgagaccaagcagctgaggatgcccaatgagatcaccagcgctgacaccatccgggccctgtttgtgtctgccttcccccagcagctgaccatgaagatgctggagagccccagcgtggccatctacatcaaggatgagagcagaaatgtgtactatgagctgaatgatgtgaggaacatccaggacaggagcctgctgaaggtgtacaacaaggaccctgcccacgccttcaaccacacccccaagaccatgaatggagacatgaggatgcagcgggagctggtgtatgcccggggagatggccctggggccccccggcccggcagcacagcccaccccccccacgccatccccaacagcccccccagcacccctgtgccccacagcatgccacccagccccagccgcatcccctacggcggcaccaggtccatggtggtgcctggaaatgccaccatcccccgggaccgcatcagcagcctgcctgtgtcccggcccatcagccccagccccagcgccatcctggagaggagagatgtgaagccagatgaggacatgtctgggaagaacatcgccatgtacagaaatgaaggcttctacgccgacccctacctgtaccacgagggccgcatgagcatcgccagcagccacggcggccaccccctggatgtgcctgaccacatcatcgcctaccacaggacagccatccgcagcgccagcgcctactgcaaccccagcatgcaggccgagatgcacatggagcagagcctgtaccggcagaagagcaggaagtacccagacagccacctgcccaccctgggcagcaagaccccaccagccagcccccaccgggtgtctgacctgaggatgattgacatgcacgcccactacaatgcccacggccccccccacaccatgcagcctgaccgggccagccccagccggcaggccttcaagaaggagcccggcaccctggtgtacatcgagaagcccaggtctgctgctggcctgagcagcctggtggacctgggcccccccctgatggagaagcaggtgtttgcctacagcacagccaccatccccaaggaccgggagaccagcgagaagatgatgaagaccacagccaacagaaaccacacagattctgctggcaccccccacgtgtctgggggcaagatgctgagcgccctggagagcacagtgccccccagccagcccccacctgtgggcaccagcgccatccacatgagcctgctggagatgagaagatctgtggccgagctgcggctgcagctgcagcagatgaggcagctgcagctgcagaaccaggagctgctgcgggccatgatgaagaaggccgagctggagatcagcggcaaggtgatggagaccatgaagaggctggaggaccctgtgcagaggcagagggtgctggtggagcaggagcggcagaagtacctgcacgaggaggagaagatcgtgaagaagctgtgtgagctggaggactttgtggaggacctgaagaaggacagcacagctgccagccggctggtgaccctgaaggatgtggaggatggagccttcctgctgcggcaggtgggggaggccgtggccaccctgaagggggagttccccaccctgcagaacaagatgagggccatcctgcgcatcgaggtggaggccgtgcgcttcctgaaggaggagccccacaagctggacagcctgctgaagagggtgcgctccatgacagatgtgctgaccatgctgcggagacatgtgacagatggcctgctgaagggcacagatgctgcccaggccgcccagtacatggccatggagaaggccacagctgctgaggtgctgaagagccaggaggaggccgcccacaccagcggccagcccttccacagcactggagcccctggagatgccaagtctgaggtggtgcccctgagcggcatgatggtgagacatgcccagagcagccctgtggtgatccagcccagccagcacagcgtggccctgctgaacccagcccagaacctgccccacgtggccagcagccctgctgtgccccaggaggccaccagcaccctgcagatgagccaggccccccagagcccccagatccccatgaatggcagcgccatgcagagcctcttcatcgaggagatccacagcgtgtctgccaagaacagagctgtgtccattgagaaggccgagaagaagtgggaggagaagaggcagaacctggaccactacaacgggaaggagtttgagaagctgctggaggaggcccaggccaacatcatgaagagcatccccaacctggagatgcccccagccaccggccccctgcccagaggagatgcccctgtggacaaggtggagctgagtgacagccccaacagcgagcaggacctggagaagctgggcggcaagagccccccacctcctcctcctcctccaagaagaagctacctgcccggcagcggcctgaccaccaccaggtctggagatgtggtgtacacaggcaggaaagaaaacatcacagccaaggccagcagtgaagatgctggccccagcccccagacccgggccaccaagtacccagctgaggagcccgccagcgcctggacccccagccccccacctgtgaccaccagcagcagcaaggatgaggaggaggaggaggaggagggggacaagatcatggccgagctgcaggccttccagaagtgcagcttcatggatgtgaacagcaacagccacgccgagcccagcagagctgacagccacgtgaaggacaccaggtctggggccaccgtgccccccaaggagaagaagaacctggagttcttccatgaagatgtgaggaagagtgatgtggagtatgaaaatggcccccagatggagttccagaagggcagcagcggggccccccagaccagcaggatgcctgtgcccatgtctgccaagaacagacctggcaccctggacaagccaggcaagcagagcaagctgcaggacccccggcagtaccggcaggccaatggaagtgccaagaagtctggaggagacttcaagcccaccagccccagcctgcctgccagcaagatcccagccctgagccccagcagcggcaagagcagcagcctgcccagcagcagcggggacagcagcaacctgcccaaccccccagccaccaagcccagcatcgccagcaaccccctgagcccccagacaggccccccagcccacagcgccagcctcatccccagcgtgtccaatggcagcctgaagttccagagcctgacccacacaggcaagggccaccacctgtccttcagcccccagagccagaatggccgggcccccccacccctgtccttcagcagcagcccccccagccctgccagctctgtgtccctgaaccagggcgccaagggcaccaggaccatccacacccccagcctgaccagctacaaggcccagaatggcagcagcagcaaggccacccccagcacagccaaggagaccagctag

SEQ ID NO: 20046 - DNA, 5832 bp, Artificial Sequence
  Description of Artificial Sequence: Synthetic coding sequence
atggaggagaatgaaagccagaagtgtgagccctgcctgccctacagcgctgaccggcggcagatgcaggagcagggcaaaggaaacctgcacgtgaccagcccagaagatgctgaatgtagaaggaccaaggagcggctgagcaatggaaacagccggggctctgtgtccaagagcagcaggaacatccccaggaggcacaccctgggcggccccaggagcagcaaggagatcctgggcatgcagaccagcgagatggacaggaagcgggaggccttcctggagcacctgaagcagaagtacccccaccacgccagcgccatcatgggccaccaggagcggctgcgggaccagaccaggagccccaagctgagccacagcccccagccccccagcctgggggaccctgtggagcacctgtctgagaccagcgctgacagcctggaggccatgtctgaaggagatgcccccacccccttcagccggggcagcaggacccgggccagcctgcctgtggtgcgcagcaccaaccagaccaaggagaggagcctgggcgtgctgtacctgcagtatggagatgagaccaagcagctgaggatgcccaatgagatcaccagcgctgacaccatccgggccctgtttgtgtctgccttcccccagcagctgaccatgaagatgctggagagccccagcgtggccatctacatcaaggatgagagcagaaatgtgtactatgagctgaatgatgtgaggaacatccaggacaggagcctgctgaaggtgtacaacaaggaccctgcccacgccttcaaccacacccccaagaccatgaatggagacatgaggatgcagcgggagctggtgtatgcccggggagatggccctggggccccccggcccggcagcacagcccaccccccccacgccatccccaacagcccccccagcacccctgtgccccacagcatgccacccagccccagccgcatcccctacggcggcaccaggtccatggtggtgcctggaaatgccaccatcccccgggaccgcatcagcagcctgcctgtgtcccggcccatcagccccagccccagcgccatcctggagaggagagatgtgaagccagatgaggacatgtctgggaagaacatcgccatgtacagaaatgaaggcttctacgccgacccctacctgtaccacgagggccgcatgagcatcgccagcagccacggcggccaccccctggatgtgcctgaccacatcatcgcctaccacaggacagccatccgcagcgccagcgcctactgcaaccccagcatgcaggccgagatgcacatggagcagagcctgtaccggcagaagagcaggaagtacccagacagccacctgcccaccctgggcagcaagaccccaccagccagcccccaccgggtgtctgacctgaggatgattgacatgcacgcccactacaatgcccacggccccccccacaccatgcagcctgaccgggccagccccagccggcaggccttcaagaaggagcccggcaccctggtgtacatcgagaagcccaggtctgctgctggcctgagcagcctggtggacctgggcccccccctgatggagaagcaggtgtttgcctacagcacagccaccatccccaaggaccgggagacccgggagaggatgcaggccatggagaagcagatcgccagcctgaccggcctggtgcagagcgccctcttcaagggccccatcaccagctacagcaaggatgccagcagcgagaagatgatgaagaccacagccaacagaaaccacacagacagcgctggcacccctcatgtgtctgggggcaagatgctgagcgccctggagagcacagtgccccccagccagcccccacctgtgggcaccagcgccatccacatgagcctgctggagatgagaagatctgtggccgagctgcggctgcagctgcagcagatgaggcagctgcagctgcagaaccaggagctgctgcgggccatgatgaagaaggccgagctggagatcagcggcaaggtgatggagaccatgaagaggctggaggaccctgtgcagaggcagagggtgctggtggagcaggagcggcagaagtacctgcacgaggaggagaagatcgtgaagaagctgtgtgagctggaggactttgtggaggacctgaagaaggacagcacagctgccagccggctggtgaccctgaaggatgtggaggatggagccttcctgctgcggcaggtgggggaggccgtggccaccctgaagggggagttccccaccctgcagaacaagatgagggccatcctgagaattgaggtggaggccgtgcgcttcctgaaggaggagccccacaagctggacagcctgctgaagagggtgcgctccatgacagatgtgctgaccatgctgcggcggcacgtgacagatggcctgctgaagggcacagatgctgcccaggccgcccagtacatggccatggagaaggccacagctgctgaggtgctgaagagccaggaggaggccgcccacaccagcggccagcccttccacagcactggagcccctggagatgccaagtctgaggtggtgcccctgagcggcatgatggtgagacatgcccagagcagccctgtggtgatccagcccagccagcacagcgtggccctgctgaacccagcccagaacctgccccacgtggccagcagccctgctgtgccccaggaggccaccagcaccctgcagatgagccaggccccccagagcccccagatccccatgaatggaagtgccatgcagagcctcttcatcgaggagatccacagcgtgtctgccaagaacagagctgtgtccattgagaaggccgagaagaagtgggaggagaagaggcagaacctggaccactacaacgggaaggagtttgagaagctgctggaggaggcccaggccaacatcatgaagagcatccccaacctggagatgcccccagccaccggccccctgcccagaggagatgcccctgtggacaaggtggagctgtctgaggacagccccaacagcgagcaggacctggagaagctgggcggcaagagccccccacctcctcctcctcctccaagaagaagctacctgcccggcagcggcctgaccaccaccaggtctggagatgtggtgtacacaggcaggaaagaaaacatcacagccaaggccagcagtgaagatgctggccccagcccccagacccgggccaccaagtacccagctgaggagcccgccagcgcctggacccccagccccccacctgtgaccaccagcagcagcaaggatgaggaggaggaggaggaggagggggacaagatcatggccgagctgcaggccttccagaagtgcagcttcatggatgtgaacagcaacagccacgccgagcccagcagagctgacagccacgtgaaggacaccaggtctggggccaccgtgccccccaaggagaagaagaacctggagttcttccatgaagatgtgaggaagagtgatgtggagtatgaaaatggcccccagatggagttccagaaggtgaccactggagctgtgcggcccagcgacccccccaagtgggagcggggcatggagaacagcatcagtgatgccagcaggaccagcgagtacaagacagagatcatcatgaaggaaaattccatcagcaacatgagcctgctgcgggacagcaggaactacagccaggagaccgtgcccaaggccagctttggcttcagcggcatcagccccctggaggatgagatcaacaagggcagcaagatcagcggcctgcagtacagcatcccagacacagagaaccagaccctgaactacggcaagaccaaggagatggagaagcagaacacagacaagtgccacgtgagcagccacacccggctgacagagagctctgtgcatgacttcaagacagaggaccaggaggtgatcaccacagactttggccaggtggtgctgcggcccaaggaggcccggcatgccaacgtgaaccccaatgaagatggagagagcagcagcagcagccccacagaggagaatgctgccacagacaacatcgccttcatgatcacagagaccaccgtgcaggtgctgagcagtggagaggtgcatgacatcgtgtcccagaagggggaggacatccagacagtgaacattgatgccaggaaggagatgaccccccggcaggagggcacagacaatgaagatcctgtggtgtgcctggacaagaagcctgtgatcatcatctttgatgagcccatggacatccgcagcgcctacaagaggctgagcaccatctttgaggagtgtgatgaggagctggagaggatgatgatggaggagaagattgaggaggaggaggaggaggagaatggagacagcgtggtgcagaacaacaacaccagccagatgagccacaagaaggtggcccctggcaacctgaggacaggccagcaggtggagaccaagagccagccccacagcctggccacagagaccagaaatcctgggggccaggagatgaacagaacagagctgaacaagttcagccacgtggacagccccaacagtgaatgtaaaggagaagatgccacagatgaccagtttgagagccccaagaagaagttcaagttcaagttccccaagaagcagctggccgccctgacccaggccatcagaacaggcaccaagacaggcaagaagaccctgcaggtggtggtgtatgaggaggaggaggaggatggcaccctgaagcagcacaaggaggccaagagatttgaaattgcccggagccagcctgaggacaccccagaaaatacagtgcggcggcaggagcagcccagcattgagagcaccagccccatcagcaggacagatgagatcaggaagaacacctaccgcaccctggacagcctggagcagaccatcaagcagctggagaacaccatcagcgagatgagccccaaggccctggtggacaccagctgcagcagcaacagagattctgtggccagcagcagccacatcgcccaggaggccagcccccggcccctgctggtgcctgatgagggccccacagccctggagccccccaccagcatccccagcgccagcaggaagggcagcagcggggccccccagaccagcaggatgcctgtgcccatgtctgccaagaaccggcccggcaccctggacaagccaggcaagcagagcaagctgcaggacccccggcagtaccggcaggccaacggcagcgccaagaagagcggcggggacttcaagcccaccagccccagcctgcctgccagcaagatcccagccctgagccccagcagcggcaagagcagcagcctgcccagcagcagcggggacagcagcaacctgcccaaccccccagccaccaagcccagcatcgccagcaaccccctgagcccccagacaggccccccagcccacagcgccagcctcatccccagcgtgtccaatggcagcctgaagttccagagcctgacccacacaggcaagggccaccacctgtccttcagcccccagagccagaatggccgggcccccccacccctgtccttcagcagcagcccccccagccctgccagctctgtgtccctgaaccagggcgccaagggcaccaggaccatccacacccccagcctgaccagctacaaggcccagaatggcagcagcagcaaggccacccccagcacagccaaggagaccagctag

SEQ ID NO: 20047 - DNA, 3795 bp, Artificial Sequence
  Description of Artificial Sequence: Synthetic coding sequence
atgcagaccagcgagatggacaggaagcgggaggccttcctggagcacctgaagcagaagtacccccaccacgccagcgccatcatgggccaccaggagcggctgcgggaccagaccaggagccccaagctgagccacagcccccagccccccagcctgggggaccctgtggagcacctgtctgagaccagcgctgacagcctggaggccatgtctgaaggagatgcccccacccccttcagccggggcagcaggacccgggccagcctgcctgtggtgcgcagcaccaaccagaccaaggagaggagcctgggcgtgctgtacctgcagtatggagatgagaccaagcagctgaggatgcccaatgagatcaccagcgctgacaccatccgggccctgtttgtgtctgccttcccccagcagctgaccatgaagatgctggagagccccagcgtggccatctacatcaaggatgagagcagaaatgtgtactatgagctgaatgatgtgaggaacatccaggacaggagcctgctgaaggtgtacaacaaggaccctgcccacgccttcaaccacacccccaagaccatgaatggagacatgaggatgcagcgggagctggtgtatgcccggggagatggccctggggccccccggcccggcagcacagcccaccccccccacgccatccccaacagcccccccagcacccctgtgccccacagcatgccacccagccccagccgcatcccctacggcggcaccaggtccatggtggtgcctggaaatgccaccatcccccgggaccgcatcagcagcctgcctgtgtcccggcccatcagccccagccccagcgccatcctggagaggagagatgtgaagccagatgaggacatgtctgggaagaacatcgccatgtacagaaatgaaggcttctacgccgacccctacctgtaccacgagggccgcatgagcatcgccagcagccacggcggccaccccctggatgtgcctgaccacatcatcgcctaccacaggacagccatccgcagcgccagcgcctactgcaaccccagcatgcaggccgagatgcacatggagcagagcctgtaccggcagaagagcaggaagtacccagacagccacctgcccaccctgggcagcaagaccccaccagccagcccccaccgggtgtctgacctgaggatgattgacatgcacgcccactacaatgcccacggccccccccacaccatgcagcctgaccgggccagccccagccggcaggccttcaagaaggagcccggcaccctggtgtacatcgagaagcccaggtctgctgctggcctgagcagcctggtggacctgggcccccccctgatggagaagcaggtgtttgcctacagcacagccaccatccccaaggaccgggagacccgggagaggatgcaggccatggagaagcagatcgccagcctgaccggcctggtgcagagcgccctcttcaagggccccatcaccagctacagcaaggatgccagcagcgagaagatgatgaagaccacagccaacagaaaccacacagacagcgctggcacccctcatgtgtctgggggcaagatgctgagcgccctggagagcacagtgccccccagccagcccccacctgtgggcaccagcgccatccacatgagcctgctggagatgagaagatctgtggccgagctgcggctgcagctgcagcagatgaggcagctgcagctgcagaaccaggagctgctgcgggccatgatgaagaaggccgagctggagatcagcggcaaggtgatggagaccatgaagaggctggaggaccctgtgcagaggcagagggtgctggtggagcaggagcggcagaagtacctgcacgaggaggagaagatcgtgaagaagctgtgtgagctggaggactttgtggaggacctgaagaaggacagcacagctgccagccggctggtgaccctgaaggatgtggaggatggagccttcctgctgcggcaggtgggggaggccgtggccaccctgaagggggagttccccaccctgcagaacaagatgagggccatcctgagaattgaggtggaggccgtgcgcttcctgaaggaggagccccacaagctggacagcctgctgaagagggtgcgctccatgacagatgtgctgaccatgctgcggcggcacgtgacagatggcctgctgaagggcacagatgctgcccaggccgcccagtacatggccatggagaaggccacagctgctgaggtgctgaagagccaggaggaggccgcccacaccagcggccagcccttccacagcactggagcccctggagatgccaagtctgaggtggtgcccctgagcggcatgatggtgagacatgcccagagcagccctgtggtgatccagcccagccagcacagcgtggccctgctgaacccagcccagaacctgccccacgtggccagcagccctgctgtgccccaggaggccaccagcaccctgcagatgagccaggccccccagagcccccagatccccatgaatggaagtgccatgcagagcctcttcatcgaggagatccacagcgtgtctgccaagaacagagctgtgtccattgagaaggccgagaagaagtgggaggagaagaggcagaacctggaccactacaacgggaaggagtttgagaagctgctggaggaggcccaggccaacatcatgaagagcatccccaacctggagatgcccccagccaccggccccctgcccagaggagatgcccctgtggacaaggtggagctgtctgaggacagccccaacagcgagcaggacctggagaagctgggcggcaagagccccccacctcctcctcctcctccaagaagaagctacctgcccggcagcggcctgaccaccaccaggtctggagatgtggtgtacacaggcaggaaagaaaacatcacagccaaggccagcagtgaagatgctggccccagcccccagacccgggccaccaagtacccagctgaggagcccgccagcgcctggacccccagccccccacctgtgaccaccagcagcagcaaggatgaggaggaggaggaggaggagggggacaagatcatggccgagctgcagggcagcagcggggccccccagaccagcaggatgcctgtgcccatgtctgccaagaacagacctggcaccctggacaagccaggcaagcagagcaagctgcaggacccccggcagtaccggcaggccaatggaagtgccaagaagtctggaggagacttcaagcccaccagccccagcctgcctgccagcaagatcccagccctgagccccagcagcggcaagagcagcagcctgcccagcagcagcggggacagcagcaacctgcccaaccccccagccaccaagcccagcatcgccagcaaccccctgagcccccagacaggccccccagcccacagcgccagcctcatccccagcgtgtccaatggcagcctgaagttccagagcctgacccacacaggcaagggccaccacctgtccttcagcccccagagccagaatggccgggcccccccacccctgtccttcagcagcagcccccccagccctgccagctctgtgtccctgaaccagggcgccaagggcaccaggaccatccacacccccagcctgaccagctacaaggcccagaatggcagcagcagcaaggccacccccagcacagccaaggagaccagctag

SEQ ID NO: 20048 - DNA, 531 bp, Artificial Sequence
  Description of Artificial Sequence: Synthetic coding sequence
atgggctgctgcggctgcagcggcggctgcggcagcggctgcggcggctgcggcagcggcagcggcggctgcggcagcggctgcggcggctgcggcagcagctgctgcgtgcccatctgctgctgcaagcctgtgtgctgctgcgtgcctgcctgcagctgcagcagctgtggcagctgtggcggcagcaagggcggctgcggcagctgtggcagcagcaagggcggctgcggcagctgtggctgcagccagagcaactgctgcaagccctgctgcagcagcagcggctgcggcagcttctgctgccagagcagctgcagcaagccctgctgctgccagagcagctgctgccagagcagctgctgcaagccctgctgctgccagagcagctgctgccagagcagctgcttcaagccctgctgctgccagagcagctgctgcgtgcctgtgtgctgccagagcagctgctgcaagccctgctgcagccagagcagctgctgcgtgcccatctgctgccagtacaagatctag

SEQ ID NO: 20049 - DNA, 513 bp, Artificial Sequence
  Description of Artificial Sequence: Synthetic coding sequence
atgggctgctgcggctgcagcggcggctgcggcagcggctgcggcggctgcggcagcggctgcggcggctgcggcagcggctgcggcggctacggcagcggctgcggcggctgcggcagcagctgctgcgtgcctgtgtgctgctgcaagcctgtgtgctgctgcgtgcctgcctgcagctgcagcagctgtggcagctgtggcggcagcaaaggagactgtggctgcggcagctgtggcggcagcaaaggaggctgcggcagctgtggctgcagccagtgcaactgctgcaagccctgctgctgcagcagcggctgcggcagctgctgccagagcagctgctgcaacccctgctgctgccagagcagctgctgcgtgcctgtgtgctgccagagcagctgctgcaagccctgctgctgccagagcagctgctgcgtgcccagcagctgctgccgcagctgctgcagcaagagcagctgctgcgtgcccatctgctgccagtacaagatctag

SEQ ID NO: 20050 - DNA, 2169 bp, Artificial Sequence
  Description of Artificial Sequence: Synthetic coding sequence
atgattgacagcgtgaagctgcggcgggacagcgctgctgacttcttcagccactatgagtacctgtgtgccctgcagaacagcgtgcccctgcctgctgtgcgggcctgcctgcgggagggcgtgctggacttcaatgctgaccggctgcggggcgtggactgggcccccctgctgagcaccctgaagatcaacaaggacctgcccctggtgtccatcaagagcttcttccagccctggctgggggacaccggcagtgacatgaacaagttctgccgcagccgggtgcctgccatccgctacaaggatgtgaccttccagctgtgcaaggccctgaagggctgcctgagcatcagctctgtgctgaagaacctggagctgaatggcctcatcctgcgggagcgggacctgaccatcctggccaagggcctgaacaagagcgccagcctggtgcacctgagcctggccaactgccccatcggagatggcggcctggagatcatctgccagggcatcaagagcagcatcaccctgaagacagtgaacttcaccggctgcaacctgacctggcagggcgctgaccacatggccaagatcctgaagtaccagaccatgagaagacatgaggagacctgggccgagagcctgcgctacagaagaccagacctggactgcatggccggcctgcggcgcatcaccctgaactgcaacaccctcatcggggacctgggcgcctgtgcctttgctgacagcctgtctgaggacctgtggctgcgggccctggacctgcagcagtgtggcctgaccaatgaaggagccaaggccctgctggaggccctggagaccaacaccaccctggtggtgctggacatcaggaagaaccccctgattgaccacagcatgatgaaggccgtcatcaagaaggtgctgcagaatggccgcagcgccaagtctgagtaccagtggatcaccagccccagcgtgaaggagcccagcaagacagccaagcagaagaggaggaccatcatcctgggcagcggccacaagggcaaggccaccatccgcatcgtgggcctggccaccaagaagcctgtgagcagcggcaggaagcacagcctgggcaaggagtactatgccccagcccccctgcccccaggagtgtctggcttcctgccctggaggacagctgagcgggccaagaggcaccggggcttccccctcatcaagacccgggacatctgcaaccagctgcagcagcccggcttccctgtgacagtgacagtggagagccccagcagcagcgaggtggaggaggtggatgacagcagcgagagcgtgcatgaggtgcctgagaagaccagcattgagcaggaggccctgcaggagaagctggaggagtgcctgaagcagctgaaggaggagagggtcatccggctgaaggtggacaagagggtgtctgagctggagcatgaaaatgcccagctgaggaacatcaacttcagcctgtctgaggccctgcacgcccagagcctgaccaacatgatcctggatgatgagggcgtgctgggcagcattgagaacagcttccagaagttccacgccttcctggacctgctgaaggatgctggcctgggccagctggccaccatggccggcatcgaccagagcgacttccagctgctgggccacccccagatgaccagcacagtgagcaacccccccaaggaggagaagaaggccctggaggatgagaagccagagcccaagcagaatgccctgggccagatgcagaacatccaggtgtccatctgcatgcagagcgcctacaatgaaggcaccctgatgaagttccagaagatcactggagatgcccgcatccccctgcccctggacagcttccctgtgcctgtgtccaccccagagggcctgggcaccagcagcaacaacctgggcgtgcctgccacagagcagaggcaggagagctttgagggcttcatcgccaggatgtgcagccccagcccagatgccaccagcggcaccggcagccagaggaaggaggaggagctgagcaggaacagccgcagcagcagcgagaagaagaccaagacaggagagtacaccaagaagcacagcgacaagcagcaccctgggaaggacctgcacagctag

SEQ ID NO: 20051 - DNA, 1122 bp, Artificial Sequence
  Description of Artificial Sequence: Synthetic coding sequence
atggccctgaatgtggcccctgtgcgggacaccaagtggctgaccctggaggtgtgccggcagttccagaggggcacctgcagcagaagtgatgaggagtgcaagtttgcccacccccccaagagctgccaggtggagaatggccgggtgattgcctgctttgacagcctgaagggccgctgcagccgggagaactgcaagtacctgcacccccccacccacctgaagacccagctggagatcaatggaagaaacaacctgatccagcagaagacagctgctgccatgctggcccagcagatgcagttcatgtttcctggcacccccctgcaccctgtgcccaccttccctgtgggccctgccatcggcaccaacacagccatcagctttgccccctacctggcccctgtgaccccaggagtgggcctggtgcccacagagatcctgcccaccacccctgtgattgtgcccggcagcccccctgtgacagtgcccggcagcacagccacccagaagctgctgaggacagacaagctggaggtgtgccgggagttccagaggggcaactgtgcccggggggagacagactgccgctttgcccaccctgctgacagcaccatgattgacaccagtgacaacacagtgacagtgtgcatggactacatcaagggccgctgcatgagggagaagtgcaagtacttccaccccccagcccacctgcaggccaagatcaaggccgcccagcaccaggccaaccaggccgctgtggccgcccaggccgctgctgctgctgccaccgtgatggccttccccccaggggccctgcaccccctgcccaagaggcaggccctggagaagagcaatggcaccagcgctgtgttcaaccccagcgtgctgcactaccagcaggccctgaccagcgcccagctgcagcagcacgccgccttcatccccactggatctgtgctgtgcatgaccccagccaccagcattgacaacagcgagatcatcagcagaaatggcatggagtgccaggagagcgccctgcgcatcaccaagcactgctactgcacctactaccctgtgagcagcagcattgagctgccccagacagcctgctag

SEQ ID NO: 20052 - DNA, 321 bp, Artificial Sequence
  Description of Artificial Sequence: Synthetic coding sequence
atgacccagagcacagccaaggccatgaagaggcccctggaggccaccgtggacctggccttccccccaggggccctgcaccccctgcccaagaggcaggccctggagaagagcaatggcaccagcgctgtgttcaaccccagcgtgctgcactaccagcaggccctgaccagcgcccagctgcagcagcacgccgccttcatccccaccgtgcccatgatgcacagcgccaccagcgccaccgtgtctgctgccaccaccccagccacctctgtgccctttgctgccacagccacagccaaccagctggtgtacagctag

SEQ ID NO: 20053 - DNA, 915 bp, Artificial Sequence
  Description of Artificial Sequence: Synthetic coding sequence
atggccaagattgagaagaatgcccccaccatggagaagaagccagagctgttcaacatcatggaggtggatggagtgcccaccctcatcctgagcaaggagtggtgggagaaggtgtgcaacttccaggccaagccagatgacctgatcctggccacctaccccaagagcggcaccacctggatgcatgagatcctggacatgatcctgaatgatggagatgtggagaagtgcaagagggcccagaccctggacagacatgccttcctggagctgaagttcccccacaaggagaagccagacctggagtttgtgctggagatgagcagcccccagctgatcaagacccacctgcccagccacctgatcccccccagcatctggaaggagaactgcaagatcgtgtatgtggccaggaaccccaaggactgcctggtgtcctactaccacttccacaggatggccagcttcatgccagacccccagaacctggaggagttctatgagaagttcatgtctgggaaggtggtgggcggctcctggtttgaccacgtgaagggctggtgggccgccaaggacatgcaccgcatcctgtacctgttctatgaggacatcaagaagaaccccaagcatgagatccacaaggtgctggagttcctggagaagacctggagcggagatgtgatcaacaagatcgtgcaccacaccagctttgatgtgatgaaggacaaccccatggccaaccacacagctgtgcctgcccacatcttcaaccacagcatcagcaagttcatgaggaagggcatgcctggggactggaagaaccacttcaccgtggccctgaatgaaaattttgacaagcactatgagaagaagatggccggcagcaccctgaacttctgcctggagatctag

SEQ ID NO: 20054 - DNA, 1188 bp, Artificial Sequence
  Description of Artificial Sequence: Synthetic coding sequence
atggccagcgctgcctctgtgaccagcctggctgatgaggtgaactgccccatctgccagggcaccctgcgggagcctgtgaccatcgactgtggccacaacttctgccgggcctgcctgacccgctactgtgagatccctggccctgacctggaggagagccccacctgccccctgtgcaaggagcccttccggcccggcagcttccggcccaactggcagctggccaacgtggtggagaacatcgagcggctgcagctggtgtccaccctgggcctgggggaggaggatgtgtgccaggagcacggggagaagatctacttcttctgtgaagatgatgagatgcagctgtgtgtggtgtgccgggaggccggggagcacgccacccacaccatgaggttcctggaggatgctgctgccccctaccgggagcagatccacaagtgcctgaagtgcctgaggaaggagcgggaggagatccaggagatccagagccgggagaacaagaggatgcaggtgctgctgacccaggtgtccaccaagaggcagcaggtgatcagcgagtttgcccacctgaggaagttcctggaggagcagcagagcatcctgctggcccagctggagagccaggatggagacatcctgcggcagagagatgaatttgacctgctggtggccggggagatctgccgcttcagcgccctgattgaggagctggaggagaagaatgaaagacctgcccgggagctgctgacagacatccgcagcaccctcatccgctgtgagaccaggaaatgtaggaagcctgtggccgtgtccccagagctgggccagaggatccgggacttcccccagcaggccctgcccctgcagcgggagatgaagatgttcctggagaagctgtgctttgagctggactatgagcccgcccacatcagcctggacccccagaccagccaccccaagctgctgctgtctgaggaccaccagagggcccagttctcctacaagtggcagaacagcccagacaacccccagagatttgaccgggccacctgtgtgctggcccacacaggcatcactggaggccgccacacctgggtgtggatggcccgggtgcctggggacagcggctgctgccagttctgcagccccccatctgtgctgggcacagaggtggccgcctag

SEQ ID NO: 20055 - DNA, 1446 bp, Artificial Sequence
  Description of Artificial Sequence: Synthetic coding sequence
atggccagcgctgcctctgtgaccagcctggctgatgaggtgaactgccccatctgccagggcaccctgcgggagcctgtgaccatcgactgtggccacaacttctgccgggcctgcctgacccgctactgtgagatccctggccctgacctggaggagagccccacctgccccctgtgcaaggagcccttccggcccggcagcttccggcccaactggcagctggccaacgtggtggagaacatcgagcggctgcagctggtgtccaccctgggcctgggggaggaggatgtgtgccaggagcacggggagaagatctacttcttctgtgaagatgatgagatgcagctgtgtgtggtgtgccgggaggccggggagcacgccacccacaccatgaggttcctggaggatgctgctgccccctaccgggagcagatccacaagtgcctgaagtgcctgaggaaggagcgggaggagatccaggagatccagagccgggagaacaagaggatgcaggtgctgctgacccaggtgtccaccaagaggcagcaggtgatcagcgagtttgcccacctgaggaagttcctggaggagcagcagagcatcctgctggcccagctggagagccaggatggagacatcctgcggcagagagatgaatttgacctgctggtggccggggagatctgccgcttcagcgccctgattgaggagctggaggagaagaatgaaagacctgcccgggagctgctgacagacatccgcagcaccctcatccgctgtgagaccaggaaatgtaggaagcctgtggccgtgtccccagagctgggccagaggatccgggacttcccccagcaggccctgcccctgcagcgggagatgaagatgttcctggagaacctgcccaaccacctggtgatccccacagcccacatcagcctggacccccagaccagccaccccaagctgctgctgtctgaggaccaccagagggcccagttctcctacaagtggcagaacagcccagacaacccccagagatttgaccgggccacctgtgtgctggcccacacaggcatcactggaggccgccacacctgggtggtgtccattgacctggcccatggaggcagctgcaccgtgggcgtggtgtctgaagatgtgcagaggaaaggagagctgcggctgcggcctgaggagggcgtgtgggccgtgcggctggcctggggctttgtgtctgccctgggcagcttccccacccggctgaccctgaaggagcagccccggcaggtgcgggtgtccctggactatgaggtgggctgggtgaccttcaccaatgctgtgacccgggagcccatctacaccttcaccgccagcttcaccaggaaggtgatccccttcttcggcctgtggggccggggcagcagcttcagcctgagcagctag

SEQ ID NO: 20056 - DNA, 2604 bp, Artificial Sequence; identical to SEQ ID NO: 19351
  Description of Artificial Sequence: Synthetic coding sequence

SEQ ID NO: 20057 - DNA, 279 bp, Artificial Sequence
  Description of Artificial Sequence: Synthetic coding sequence
atggccaccccacccaagagaagagctgtggaggccactggagagaaggtgctgcgctatgagaccttcatcagtgatgtgctgcagagggacctgaggaaggtgctggaccaccgggacaaggtgtatgagcagctggccaagtacctgcagctgagaaatgtcatcgagcggctgcaggtgaagaccatgggcctgggcaccatcttcctggtgtgtgtgggcaagggcggcaagtgggaggagcggctgcagacccagccctgccacctgacctag

SEQ ID NO: 20058 - DNA, 2532 bp, Artificial Sequence
  Description of Artificial Sequence: Synthetic coding sequence
atggctgtggaggacagcaccctgcaggtggtggtgcgggtgcggccccccaccccccgggagctggacagccagaggaggcctgtggtgcaggtggtggatgagcgggtgctggtgttcaaccctgaggagccagatggcggcttccctggcctgaagtggggcggcacccatgatggccccaagaagaagggcaaggacctgacctttgtgtttgacagagtgtttggagaggccgccacccagcaggatgtgttccagcacaccacccacagcgtgctggacagcttcctgcagggctacaactgcagcgtgtttgcctacggggccactggagctgggaagacccacaccatgctgggccgggagggggaccccggcatcatgtacctgaccaccgtggagctgtaccgccgcctggaggcccggcagcaggagaagcactttgaggtgctgatctcctaccaggaggtgtacaatgagcagatccatgacctgctggagcccaagggccccctggccatcagagaagatcctgacaagggcgtggtggtgcagggcctgtccttccaccagcctgccagcgctgagcagctgctggagatcctgacccggggcaacagaaacagaacccagcaccccacagatgccaatgccaccagcagccgcagccacgccatcttccagatctttgtgaagcagcaggacagagtgcccggcctgacccaggccgtgcaggtggccaagatgagcctgattgacctggccggcagcgagcgggccagcagcacccacgccaagggggagcggctgcgggagggcgccaacatcaacagaagcctgctggccctgatcaacgtgctgaatgccctggctgatgccaagggcaggaagacccacgtgccctacagagacagcaagctgacccggctgctgaaggacagcctgggcggcaactgcaggacagtgatgattgctgccatcagccccagcagcctgacctatgaggacacctacaacaccctgaagtatgctgaccgggccaaggagatccggctgagcctgaagagcaatgtgaccagcctggactgccacatcagccagtatgccaccatctgccagcagctgcaggccgaggtggccgccctgaggaagaagctgcaggtgtatgagggcggcggccagcccccaccccaggacctgcccggcagccccaagagcggccccccacctgagcacctgcccagcagccccctgcccccccacccccccagccagccctgcaccccagagctgcctgctggcccccgggccctgcaggaggagagcctgggcatggaggcccaggtggagcgggccatggagggcaacagcagtgaccaggagcagagcccagaagatgaagatgagggccctgctgaggaggtgcccacccagatgcctgagcagaaccccacccacgccctgcctgagagcccccggctgaccctgcagcccaagcctgtggtgggccacttcagcgcccgggagctggatggagacaggagcaagcagctggccctgaaggtgctgtgtgtggcccagaggcagtacagcctgctgcaggccgccaacctgctgaccccagacatgatcacagaatttgagaccctgcagcagctggtgcaggaggagaagattgagcccggggctgaggccctgcggaccagcggcctggcccggggggcccccctggcccaggagctgtgcagcgagagcatccctgtgcccagccccctgtgcccagagcccccaggctacacaggccctgtgaccaggaccatggcccggcggctgagcggccccctgcacaccctgggcatccccccaggccccaactgcaccccagcccagggcagccgctggcccatggagaagaagagaagaagaccttctgccctggaggccgacagccccatggcccccaagaggggcaccaagaggcagaggcagagcttcctgccctgcctgcggcggggcagcctgcctgacacccagcccagccagggccccagcacccccaagggggagcgggccagcagcccctgccacagcccccgggtgtgcccagccaccgtcatcaagagccgggtgcccctgggccccagcgccatgcagaactgcagcacccccctggccctgcccacccgggacctgaatgccacctttgacctgtctgaggagccccccagcaagcccagcttccacgagtgcatcggctgggacaagatcccccaggagctgagccggctggaccagcccttcatcccccgggcccctgtgcccctcttcaccatgaagggccccaagcccaccagcagcctgcccggcaccagcgcctgcaagaagaagagggtggccagcagctctgtgagccacggccgcagcagaattgcccggctgcccagcagcaccctgaagaggcctggccccctgtacagccaggtgacaggcacccgggaccgggacagcctgggccacggcggccgctag

SEQ ID NO: 20059 - DNA, 561 bp, Artificial Sequence
  Description of Artificial Sequence: Synthetic coding sequence
atggagcccccccggggccccccagccaacggggctgagcccagcagagctgtgggcaccgtgaaggtgtacctgcccaacaagcagaggacagtggtgacagtgagagatggcatgtctgtgtatgacagcctggacaaggccctgaaggtgcggggcctgaaccaggactgctgcgtggtgtaccgcctcatcaagggcaggaagacagtgacagcctgggacacagccatcgcccccctggatggagaggagctgattgtggaggtgctggaggatgtgcccctgaccatgcacaactttgtgaggaagaccttcttcagcctggccttctgtgacttctgcctgaagttcctgttccacggcttccgctgccagacctgtggctacaagttccaccagcactgcagcagcaaggtgcccaccgtgtgtgtggacatgagcaccaaccggcagcagttctaccacagcgtgcaggacctgagcggcggcagccggcagcacgaggcccccagcaaccggcccctgaatgagctgctgaccccccagggccccaggtag

SEQ ID NO: 20060 - DNA, 1821 bp, Artificial Sequence
  Description of Artificial Sequence: Synthetic coding sequence
atggagcccccccggggccccccagccaacggggctgagcccagcagagctgtgggcaccgtgaaggtgtacctgcccaacaagcagaggacagtggtgacagtgagagatggcatgtctgtgtatgacagcctggacaaggccctgaaggtgcggggcctgaaccaggactgctgcgtggtgtaccgcctcatcaagggcaggaagacagtgacagcctgggacacagccatcgcccccctggatggagaggagctgattgtggaggtgctggaggatgtgcccctgaccatgcacaactttgtgaggaagaccttcttcagcctggccttctgtgacttctgcctgaagttcctgttccacggcttccgctgccagacctgtggctacaagttccaccagcactgcagcagcaaggtgcccaccgtgtgtgtggacatgagcaccaaccggcagcagttctaccacagcgtgcaggacctgagcggcggcagccggcagcacgaggcccccagcaaccggcccctgaatgagctgctgaccccccagggccccagccccaggacccagcactgtgaccctgagcacttccccttccctgccccagccaatgcccccctgcagaggatccgcagcaccagcaccccaaatgtgcacatggtgtccaccacagcccccatggacagcaacctgatccagctgaccggccagagcttcagcacagatgctgctggcagccggggcggcagtgatggcaccccccggggcagccccagccctgcctctgtgagcagcggcaggaagagcccccacagcaagagccctgctgagcagcgggagaggaagagcctggctgatgacaagaagaaggtgaagaacctgggctacagagattctggctactactgggaggtgccccccagcgaggtgcagctgctgaagagaattggcaccggcagctttggaacagtgttccggggccgctggcatggagatgtggccgtgaaggtgctgaaggtgtcccagcccacagctgagcaggcccaggccttcaagaatgagatgcaggtgctgaggaagaccaggcatgtgaacatcctgctcttcatgggcttcatgacccggcccggctttgccatcatcacccagtggtgtgagggcagcagcctgtaccaccacctgcacgtggccgacaccaggtttgacatggtgcagctgattgatgtggcccggcagacagcccagggcatggactacctgcacgccaagaacatcatccaccgggacctgaagagcaacaacatcttcctgcacgagggcctgactgtgaagattggagactttggcctggccaccgtgaagacccgctggagcggggcccagcccctggagcagcccagcggctctgtgctgtggatggctgctgaggtgatccgcatgcaggaccccaacccctacagcttccagagtgatgtgtatgcctatggagtggtgctgtatgagctgatgacaggcagcctgccctacagccacatcggctgccgggaccagatcatcttcatggtgggccggggctacctgagcccagacctgagcaagatcagcagcaactgccccaaggccatgaggcggctgctgagtgactgcctgaagttccagcgggaggagcggcccctcttcccccagatcctggccaccatcgagctgctgcagaggagcctgcccaagattgaaagaagtgccagcgagcccagcctgcacaggacccaggctgatgagctgcctgcctgcctgctgtctgctgcccggctggtgccctag

SEQ ID NO: 20061 - DNA, 3036 bp, Artificial Sequence
  Description of Artificial Sequence: Synthetic coding sequence
atggtgtccagtgacaggcctgtgtccctggaggatgaggtgagccacagcatgaaggagatgattggaggctgctgcgtgtgcagtgatgagcggggctgggccgagaaccccctggtgtactgtgatggccacggctgcagcgtggccgtgcaccaggcctgctacggcatcgtgcaggtgcccaccggcccctggttctgcaggaaatgtgagagccaggagagagctgcccgggtgcgctgtgagctgtgcccccacaaggatggagccctgaagaggacagacaatggaggctgggcccacgtggtgtgtgccctgtacatccctgaggtgcagtttgccaacgtgtccaccatggagcccatcgtgctgcagagcgtgccccatgaccgctacaacaagacctgctacatctgtgatgagcagggccgggagagcaaggccgccactggagcctgcatgacctgcaacaagcacggctgccggcaggccttccacgtgacctgtgcccagtttgctggcctgctgtgtgaggaggagggcaatggagctgacaacgtgcagtactgcggctactgcaagtaccacttcagcaagctgaagaagagcaagaggggcagcaacagaagctatgaccagagcctgagtgacagcagcagccacagccaggacaagcaccacgagaaggagaagaagaagtacaaggagaaggacaagcacaagcagaagcacaagaagcagcctgagcccagccctgccctggtgcccagcctgactgtgaccacagagaagacctacaccagcaccagcaacaacagcatcagcggcagcctgaagaggctggaggacaccacagcccgcttcaccaatgccaacttccaggaggtgtctgcccacaccagcagcggcaaggatgtgtctgagacccggggcagcgagggcaagggcaagaagagcagcgcccacagcagcggccagaggggcaggaagccaggcggcggcaggaaccctggcaccaccgtgtctgctgccagccccttcccccagggcagcttcagcggcaccccaggctctgtgaagagcagcagcggcagctctgtgcagagcccccaggacttcctgtccttcacagacagcgacctgagaaatgacagctacagccacagccagcagagcagcgccaccaaggatgtgcacaagggggagagcggcagccaggagggcggcgtgaacagcttcagcaccctcatcggcctgcccagcaccagcgctgtgaccagccagcccaagagctttgagaacagccctggggacctgggcaacagcagcctgcccacagctggctacaagagggcccagaccagcggcatcgaggaggagaccgtgaaggagaagaagaggaaaggaaacaagcagagcaagcacggccctggccggcccaagggcaacaagaaccaggagaatgtgagccacctgtctgtgtcctctgccagccccaccagctctgtggccagcgctgctggcagcatcaccagcagcagcctgcagaagagccccaccctgctgagaaatggcagcctgcagagcctgtctgtgggcagcagccctgtgggcagcgagatctccatgcagtacagacatgatggagcctgccccaccaccaccttcagcgagctgctgaatgccatccacaacggcatctacaacagcaatgatgtggccgtgtccttccccaacgtggtgtctggcagcggcagcagcacccctgtgagcagcagccacctgccccagcagagcagcggccacctgcagcaggtgggcgccctgagccccagcgctgtgtcctctgctgccccagctgtggccaccacccaggccaacaccctgagcggcagcagcctgagccaggcccccagccacatgtatggcaacagaagcaacagctccatggccgccctgattgcccagagcgagaacaaccagacagaccaggacctgggggacaacagcaggaacctggtgggccggggcagcagcccccggggcagcctgagccccaggagccctgtgagcagcctgcagatccgctatgaccagcccggcaacagcagcctggagaacctgccccctgtggccgccagcattgagcagctgctggagcggcagtggagcgagggccagcagttcctgctggagcagggcacccccagcgacatcctgggcatgctgaagagcctgcaccagctgcaggtggagaacagaaggctggaggagcagatcaagaacctgacagccaagaaggagcggctgcagctgctgaatgcccagctgtctgtgcccttccccaccatcacagccaaccccagccccagccaccagatccacaccttcagcgcccagacagcccccaccacagacagcctgaacagcagcaagagcccccacatcggcaacagcttcctgcctgacaacagcctgcctgtgctgaaccaggacctgaccagcagcggccagagcaccagcagcagcagcgccctgagcaccccacctcctgctggccagagccctgcccagcagggcagcggcgtgtctggagtgcagcaggtgaatggagtgacagtgggcgccctggccagcggcatgcagcctgtgaccagcaccatcccagctgtgtctgctgtgggcggcatcattggagccctgcccggcaaccagctggccatcaatggcatcgtgggcgccctgaatggagtgatgcagacccctgtgaccatgagccagaaccccacccccctgacccacaccaccgtgcccccaaatgccacccaccccatgcctgccaccctgaccaacagcgccagcggcctgggcctgctgagtgaccagcagaggcagatcctgatccaccagcagcagttccagcagctgctgaacagccagcagctgacccctgtgcaccgccacccccacttcacccagctgccccccacccacttcagccccagcatggagatcatgcaggtgaggaagtag

SEQ ID NO: 20062 - DNA, 3084 bp, Artificial Sequence
  Description of Artificial Sequence: Synthetic coding sequence
atggtgtccagtgacaggcctgtgtccctggaggatgaggtgagccacagcatgaaggagatgattggaggctgctgcgtgtgcagtgatgagcggggctgggccgagaaccccctggtgtactgtgatggccacggctgcagcgtggccgtgcaccaggcctgctacggcatcgtgcaggtgcccaccggcccctggttctgcaggaaatgtgagagccaggagagagctgcccgggtgcgctgtgagctgtgcccccacaaggatggagccctgaagaggacagacaatggaggctgggcccacgtggtgtgtgccctgtacatccctgaggtgcagtttgccaacgtgtccaccatggagcccatcgtgctgcagagcgtgccccatgaccgctacaacaagacctgctacatctgtgatgagcagggccgggagagcaaggccgccactggagcctgcatgacctgcaacaagcacggctgccggcaggccttccacgtgacctgtgcccagtttgctggcctgctgtgtgaggaggagggcaatggagctgacaacgtgcagtactgcggctactgcaagtaccacttcagcaagctgaagaagagcaagaggggcagcaacagaagctatgaccagagcctgagtgacagcagcagccacagccaggacaagcaccacgagaaggagaagaagaagtacaaggagaaggacaagcacaagcagaagcacaagaagcagcctgagcccagccctgccctggtgcccagcctgactgtgaccacagagaagacctacaccagcaccagcaacaacagcatcagcggcagcctgaagaggctggaggacaccacagcccgcttcaccaatgccaacttccaggaggtgtctgcccacaccagcagcggcaaggatgtgtctgagacccggggcagcgagggcaagggcaagaagagcagcgcccacagcagcggccagaggggcaggaagccaggcggcggcaggaaccctggcaccaccgtgtctgctgccagccccttcccccagggcagcttcagcggcaccccaggctctgtgaagagcagcagcggcagctctgtgcagagcccccaggacttcctgtccttcacagacagcgacctgagaaatgacagctacagccacagccagcagagcagcgccaccaaggatgtgcacaagggggagagcggcagccaggagggcggcgtgaacagcttcagcaccctcatcggcctgcccagcaccagcgctgtgaccagccagcccaagagctttgagaacagccctggggacctgggcaacagcagcctgcccacagctggctacaagagggcccagaccagcggcatcgaggaggagaccgtgaaggagaagaagaggaaaggaaacaagcagagcaagcacggccctggccggcccaagggcaacaagaaccaggagaatgtgagccacctgtctgtgtcctctgccagccccaccagctctgtggccagcgctgctggcagcatcaccagcagcagcctgcagaagagccccaccctgctgagaaatggcagcctgcagagcctgtctgtgggcagcagccctgtgggcagcgagatctccatgcagtacagacatgatggagcctgccccaccaccaccttcagcgagctgctgaatgccatccacaatgacagaggagacagcagcaccctgaccaagcaggagctgaagttcatcggcatctacaacagcaatgatgtggccgtgtccttccccaacgtggtgtctggcagcggcagcagcacccctgtgagcagcagccacctgccccagcagagcagcggccacctgcagcaggtgggcgccctgagccccagcgctgtgtcctctgctgccccagctgtggccaccacccaggccaacaccctgagcggcagcagcctgagccaggcccccagccacatgtatggcaacagaagcaacagctccatggccgccctgattgcccagagcgagaacaaccagacagaccaggacctgggggacaacagcaggaacctggtgggccggggcagcagcccccggggcagcctgagccccaggagccctgtgagcagcctgcagatccgctatgaccagcccggcaacagcagcctggagaacctgccccctgtggccgccagcattgagcagctgctggagcggcagtggagcgagggccagcagttcctgctggagcagggcacccccagcgacatcctgggcatgctgaagagcctgcaccagctgcaggtggagaacagaaggctggaggagcagatcaagaacctgacagccaagaaggagcggctgcagctgctgaatgcccagctgtctgtgcccttccccaccatcacagccaaccccagccccagccaccagatccacaccttcagcgcccagacagcccccaccacagacagcctgaacagcagcaagagcccccacatcggcaacagcttcctgcctgacaacagcctgcctgtgctgaaccaggacctgaccagcagcggccagagcaccagcagcagcagcgccctgagcaccccacctcctgctggccagagccctgcccagcagggcagcggcgtgtctggagtgcagcaggtgaatggagtgacagtgggcgccctggccagcggcatgcagcctgtgaccagcaccatcccagctgtgtctgctgtgggcggcatcattggagccctgcccggcaaccagctggccatcaatggcatcgtgggcgccctgaatggagtgatgcagacccctgtgaccatgagccagaaccccacccccctgacccacaccaccgtgcccccaaatgccacccaccccatgcctgccaccctgaccaacagcgccagcggcctgggcctgctgagtgaccagcagaggcagatcctgatccaccagcagcagttccagcagctgctgaacagccagcagctgacccctgtgcaccgccacccccacttcacccagctgccccccacccacttcagccccagcatggagatcatgcaggtgaggaagtag

SEQ ID NO: 20063 - DNA, 567 bp, Artificial Sequence; identical to SEQ ID NO: 19160
  Description of Artificial Sequence: Synthetic coding sequence

SEQ ID NO: 20064 - DNA, 381 bp, Artificial Sequence
  Description of Artificial Sequence: Synthetic coding sequence
atggtgtccagtgacaggcctgtgtccctggaggatgaggtgagccacagcatgaaggagatgattggaggctgctgcgtgtgcagtgatgagcggggctgggccgagaaccccctggtgtactgtgatggccacggctgcagcgtggccgtgcaccaggcctgctacggcatcgtgcaggtgcccaccggcccctggttctgcaggaaatgtgagagccaggagagagctgcccgggtggccgagagccgctctgtggcccaggccaaggtgcagtggtgtgacctgagccccctgcagcccctgctgcccggcttcaagcgcttcagctgcctgagcctgcccaacggcatgcagttcctgctggtgtccctcatctag

SEQ ID NO: 20065 - DNA, 540 bp, Artificial Sequence
  Description of Artificial Sequence: Synthetic coding sequence
atggtgtccagtgacaggcctgtgtccctggaggatgaggtgagccacagcatgaaggagatgattggaggctgctgcgtgtgcagtgatgagcggggctgggccgagaaccccctggtgtactgtgatggccacggctgcagcgtggccgtgcaccaggcctgctacggcatcgtgcaggtgcccaccggcccctggttctgcaggaaatgtgagagccaggagagagctgcccgggtgatggtgtgcaacagctgctggctggccagcagtgaaaatgtgaccccaggctacatcgagcaccactgtgcctgtgccagcccccacccccgctgcctggtgtccaatgtgccccctgtgtctggggccctgatgcactgcttctgggcctgcctgaccacagctgccttcttcggcccccagagcttcaccacctgccacatgtccttcctggtgtcccgggacatcctcttctacatctacggcttcatgcccttcatctctgtggtgatctggaggttcaagaaggagcgctggtag

SEQ ID NO: 20066 - DNA, 540 bp, Artificial Sequence
  Description of Artificial Sequence: Synthetic coding sequence
atgggcctcatctttgccaagctgtggagcctcttctgcaaccaggagcacaaggtgatcatcgtgggcctggacaatgccggcaagaccaccatcctgtaccagttcctgatgaatgaggtggtgcacaccagccccaccatcggcagcaatgtggaggagatcgtggtgaagaacacccacttcctgatgtgggacattggaggccaggagagcctgcggagctcctggaacacctactacagcaacacagagttcatcatcctggtggtggacagcattgaccgggagcggctggccatcaccaaggaggagctgtacaggatgctggcccacgaggacctgaggaaggctgctgtgctgatctttgccaacaagcaggacatgaagggctgcatgacagctgctgagatcagcaagtacctgaccctgagcagcatcaaggaccacccctggcacatccagagctgctgtgccctgactggagagggcctgtgccagggcctggagtggatgaccagccgcatcggcgtgaggtag

SEQ ID NO: 20067 - DNA, 3345 bp, Artificial Sequence
  Description of Artificial Sequence: Synthetic coding sequence
atgagccagacccaggactatgagtgccgcagccacaacgtggacctgcctgagagccgcatccctggcagcaacacccggctggagtgggtggagatcatcgagcccaggacccgggagaggatgtatgccaacctggtgactggagaatgtgtgtgggaccccccagctggggtgcgcatcaagaggaccagcgagaaccagtggtgggagctgtttgaccccaacaccagccgcttctactactacaatgccagcacccagaggacagtgtggcaccggccccagggctgtgacatcatccccctggccaagctgcagaccctgaagcagaacacagagagcccccgggccagcgctgagagcagccctggccggggcagctctgtgtcccgggagggcagcaccagcagcagcctggagcctgagccagacacagagaaggcccaggagctgcctgcccgggccggccggcctgctgccttcggcaccgtgaaggaggacagcggcagcagcagccccccaggagtcttcctggagaaggactatgagatctacagagactacagcgcagatggccagctgctgcactaccgcaccagcagcctgcgctggaacagcggggccaaggagaggatgctgatcaaggtggccgaccgggagcccagcttcctggccgcccagggcaatggctacgccccagatggccccccaggagtgcgcagcagaagacccagcggcagccagcacagccccagcctgcagacctttgcccctgaggctgatggcaccatcttcttccctgagcggcggcccagccccttcctgaagagagctgagctgcccggcagcagcagccccctgctggcccagcccaggaagcccagcggggacagccagcccagcagccccaggtatggctatgagccccccctgtatgaggagccccctgtggagtaccaggcccccatctatgatgagccccccatggatgtgcagtttgaggccggcggcggctaccaggccggcagcccccagaggagccctggcaggaagccccggcccttcctgcagcccaacaagcagggcccccccagcccctgccagcagctggtgctgaccaagcagaagtgcccagagcgcttcctgagcctggagtacagccctgctgggaaggagtatgtgcggcagctggtgtatgtggagcaggccggcagcagccccaagctgcgggccggccccaggcacaagtatgcccccaaccctgggggcggcagctacagcctgcagcccagcccctgcctgctgcgggaccagaggctgggcgtgaagagcggggactacagcaccatggagggccctgagctgcggcacagccagccccccacccccctgccccaggcccaggaggatgccatgtcctggagcagccagcaggacaccctgagcagcacaggctacagccctggcaccaggaagaggaagagcaggaagcccagcctgtgccaggccaccagcgccacccccacagagggccctggggacctgctggtggagcagcccctggccgaggagcagcccccctgtggcaccagcctggcccctgtgaagagagctgagggggaggccgagggcgcccggggagctgctgagcccttcctggcccaggcccggctggcctgggaggcccagcaggcccacttccacatgaagcagaggagctcctgggacagccagcaggacggcagcggctatgaaagtgatggagccctgcccctgcccatgcctggccctgtggtgcgggccttctctgaagatgaggccctggcccagcaggagaacagacactggaggcggggcacctttgagaagctgggcttcccccagatcctgctggagaagtctgtgtctgtgcagaccaacctggccagccctgagccctacctgcaccccagccagagcgaggacctggccgcctgtgcccagtttgagagcagccggcagagccgctctggagtgcccagcagcagctgtgtgttccccaccttcaccctgaggaagcccagcagcgagacagacatcgagaactgggccagcaagcacttcaacaagcacacccagggcctcttccggaggaaggtgtccatcgccaacatgctggcctggagcagcgagagcatcaagaagcccatgattgtgaccagtgacagacatgtgaagaaggaggcctgtgagctgttcaagctgatccagatgtacatgggagacagaagagccaaggctgaccccctgcacgtggccctggaggtggccaccaagggctggagcgtgcagggcctgagagatgagctgtacatccagctgtgccggcagaccacagagaacttccggctggagagcctggcccggggctgggagctgatggccatctgcctggccttcttcccccccacccccaagttccacagctacctggagggctacatctaccgccacatggaccctgtgaatgacaccaaggtgacccagcacatcaaggagctgctggagaggaacaccaagaagaagagcaagctgaggaagaagcccaagccctacgtggaggagccagatggagtggccatcagcacctacgccaagtactgctaccacaagctgcagaaggccgccctgaccggggccaagaagggcctgaagaagcccaacgtggaggagatcagacatgccaagaatgctgtgttcagccccagcatgtttggaagtgccctgcaggaggtgatgggcatgcagcgggagcgctacccagagcggcagctgccctgggtgcagacccggctgtctgaggaggtgctggccctgaatggagaccagacagagggcatcttccgggtgcctggggacattgatgaggtgaatgccctgaagctgcaggtggaccagtggaaggtgcccaccggcctggaggacccccacgtgcctgccagcctgctgaagctgtggtaccgggagctggaggagcccctcatcccccatgagttctatgagcagtgcatcgcccactatgacagccctgaggccgctgtggccgtggtgcacgccctgccccgcatcaacaggatggtgctgtgctacctgatccgcttcctgcaggtgtttgtgcagcctgccaacgtggccgtgaccaagatggatgtgagcaacctggccatggtgatggcccccaactgcctgcgctgccagagtgatgaccccagggtcatctttgagaacaccaggaaggagatgtccttcctgcgggtgctgatccagcacctggacaccagcttcatggagggcgtgctgtag

SEQ ID NO: 20068 - DNA, 822 bp, Artificial Sequence; identical to SEQ ID NO: 19062
  Description of Artificial Sequence: Synthetic coding sequence

SEQ ID NO: 20069 - DNA, 3633 bp, Artificial Sequence
  Description of Artificial Sequence: Synthetic coding sequence
atgcccagaggagaggcccctggccctggaagaagaggagccaaggatgaggccctgggggaggagagcggggagcgctggagccctgagttccacctgcagaggaagctggccgacagcagccacagcgagcagcaggacaggaacagagtgtctgaggagctgatcatggtggtgcaggagatgaagaagtacttccccagcgagaggaggaacaagcccagcaccctggatgccctgaactatgccctgcgctgtgtgcacagcgtgcaggccaacagcgagttcttccagatcctgagccagaatggagccccccaggctgatgtgtccatgtacagcctggaggagctggccaccatcgccagcgagcacaccagcaagaacacagacacctttgtggccgtgttctccttcctgagcggccgcctggtgcacatcagcgagcaggccgccctgatcctgaacaggaagaaggatgtgctggccagcagccactttgtggacctgctggccccccaggacatgagggtcttctacgcccacacagcccgggcccagctgcccttctggaacaactggacccagagagctgctgcccgctatgaatgtgcccctgtgaagcccttcttctgccgcatccggggcggggaggacaggaagcaggagaagtgccacagccccttccgcatcatcccctacctgattcatgtgcaccacccagcccagcctgagctggagagcgagccctgctgcctgactgtggtggagaagatccacagcggctatgaggccccccgcatccctgtgaacaagaggatcttcaccaccacccacaccccaggctgtgtgttcctggaggtggatgagaaggctgtgcccctgctgggctacctgccccaggacctgattggcaccagcatcctgagctacctgcacccagaagatagaagcctgatggtggccatccaccagaaggtgctgaagtatgccggccaccccccatttgagcacagccccatccgcttctgcacccagaatggagactacatcatcctggacagctcctggagcagctttgtgaacccctggagcaggaagatctccttcatcatcggccgccacaaggtgaggaccagccccctgaatgaagatgtgtttgccaccaagatcaagaagatgaatgacaatgacaaggacatcacagagctgcaggagcagatctacaagctgctgctgcagcctgtgcacgtgtctgtgagcagcggctacggcagcctgggcagcagcggcagccaggagcagctggtgtccatcgccagcagcagcgaggccagcggccaccgggtggaggagaccaaggccgagcagatgaccctgcagcaggtgtatgcctctgtgaacaagatcaagaacctgggccagcagctgtacattgaatccatgaccaagagcagcttcaagcctgtgacaggcaccaggacagagcccaacggcggcggggagagcgccaatggaggaggagagtgcaagaccttcaccagcttccaccagaccctgaagaacaacagcgtgtacacagagccctgtgaggacctgagaaatgatgagcacagccccagctaccagcagatcaactgcatcgacagcgtcatccgctacctgaagagctacaacatcccagccctgaagaggaagtgcatcagctgcaccaacaccaccagcagcagcagcgaggaggacaagcagaaccacaaggcagatgatgtgcaggccctgcaggccggcctgcagatcccagccatccccaagtctgagatgcccaccaacggccgcagcattgacaccggcggcggggccccccagatcctgagcacagccatgctgagcctgggcagcggcatcagccagtgtggctacagcagcaccatcgtgcacgtgcccccacctgagacagccagagatgccaccctcttctgtgagccctggaccctgaacatgcagcctgcccccctgaccagcgaggagttcaagcacgtgggcctgacagctgctgtgctgagcgcccacacccagaaggaggagcagaactacgtggacaagttccgggagaagatcctgagcagcccctacagcagctacctgcagcaggagagccgcagcaaggccaagtacagctacttccagggcgacagcaccagcaagcagaccaggtctgctggctgcaggaagggcaagcacaagaggaagaagctgcctgagcccccagacagcagcagcagcaacacaggcagcggcccccggcggggggcccaccagaatgcccagccctgctgccccagcgctgccagcagcccccacaccagcagccccaccttccccccagctgccatggtgcccagccaggccccctacctggtgcctgccttccccctgcctgctgccaccagccctggccgggagtatgctgcccctggaacagcccctgagggcctgcacggcctgcccctgtctgagggcctgcagccctacccagccttccccttcccctacctggacaccttcatgacagtgttcctgcctgacccccctgtgtgccccctgctgagccccagcttcctgccctgccccttcctgggcgccacagccagcagcgccatcagccccagcatgagcagcgccatgagccccaccctggaccccccacccagcgtgaccagccagaggcgggaggaggagaagtgggaggcccagagcgagggccaccccttcatcaccagccgcagcagcagccccctgcagctgaacctgctgcaggaggagatgccccggcccagcgagagcccagaccagatgagaagaaacacctgcccccagacagagtaccagtgtgtgacaggcaacaatggaagtgagagcagccctgccaccaccggggccctgagcacaggcagccccccccgggagaaccccagccaccccacagccagcgccctgagcacaggcagcccccccatgaagaaccccagccaccccacagccagcgccctgagcacaggcagcccccccatgaagaaccccagccaccccacagccagcaccctgtccatgggcctgccccccagcaggacccccagccaccccacagccaccgtgctgagcacaggcagcccccccagcgagagccccagcaggacaggcagcgctgccagcggcagcagtgacagcagcatctacctgaccagctctgtgtacagcagcaagatcagccagaatggccagcagagccaggatgtgcagaagaaggagaccttccccaacgtggccgaggagcccatctggaggatgatccggcagaccccagagcgcatcctgatgacctaccaggtgcctgagcgggtgaaggaggtggtgctgaaggaggacctggagaagctggagagcatgaggcagcagcagccccagttcagccacggccagaaggaggagctggccaaggtgtacaactggatccagagccagacagtgacccaggagattgacatccaggcctgtgtgacctgtgaaaatgaagattctgcagatggagctgccaccagctgtggccaggtgctggtggaggacagctgctag

SEQ ID NO: 20070 - DNA, 1137 bp, Artificial Sequence
  Description of Artificial Sequence: Synthetic coding sequence
atgcccagaggagaggcccctggccctggaagaagaggagccaaggatgaggccctgggggaggagagcggggagcgctggagccctgagttccacctgcagaggaagctggccgacagcagccacagcgagcagcaggacaggaacagagtgtctgaggagctgatcatggtggtgcaggagatgaagaagtacttccccagcgagaggaggaacaagcccagcaccctggatgccctgaactatgccctgcgctgtgtgcacagcgtgcaggccaacagcgagttcttccagatcctgagccagaatggagccccccaggctgatgtgtccatgtacagcctggaggagctggccaccatcgccagcgagcacaccagcaagaacacagacacctttgtggccgtgttctccttcctgagcggccgcctggtgcacatcagcgagcaggccgccctgatcctgaacaggaagaaggatgtgctggccagcagccactttgtggacctgctggccccccaggacatgagggtcttctacgcccacacagcccgggcccagctgcccttctggaacaactggacccagagagctgcccgctatgaatgtgcccctgtgaagcccttcttctgccgcatcagaggaggagaggacaggaagcaggagaagtgccacagccccttccgcatcatcccctacctgatccacgtgcaccacccagcccagcctgagctggagagcgagccctgctgcctgactgtggtggagaagatccacagcggctatgaggccccccgcatccctgtgaacaagaggatcttcaccaccacccacaccccaggctgtgtgttcctggaggtggatgagaaggctgtgcccctgctgggctacctgccccaggacctgattggcaccagcatcctgagctacctgcaccctgaggacaggagcctgatggtggccatccaccagaaggtgctgaagtatgccggccaccccccatttgagcacagccccatccgcttctgcacccagaatggagactacatcatcctggacagctcctggagcagctttgtgaacccctggagcaggaagatctccttcatcatcggccgccacaaggtgaggacatag

SEQ ID NO: 20071 - DNA, 1794 bp, Artificial Sequence
  Description of Artificial Sequence: Synthetic coding sequence
atggagaggcctgcccccctggccgtgctgcccttcagtgaccctgcccacgccctgagcctgctgcggggcctgagccagctgcgggcagagaggaagttcctggatgtgaccctggaggccgccggcggccgggacttccctgcccacagagctgtgctggccgccgccagcccctacttccgggccatgtttgctggccagctgcgggagagcagagctgagcgggtgcggctgcacggcgtgcccccagacatgctgcagctgctgctggacttctcctacacaggccgggtggccgtgtctggggacaatgctgagcccctgctgcgggctgctgacctgctgcagtttcctgctgtgaaggaggcctgtggggccttcctgcagcagcagctggacctggccaactgcctggacatgcaggactttgctgaggccttcagctgcagcggcctggccagcgctgcccagcgcttcatcctgcggcacgtgggggagctgggcgctgagcagctggagcggctgcccctggcccggctgctgcgctacctgagagatgatggcctgtgtgtgcccaaggaggaggccgcctaccagctggccctgcgctgggtgcgggctgaccccccccggcgggccgcccactggccccagctgctggaggccgtgcggctgccctttgtgcggcgcttctacctgctggcccacgtggaggccgagcccctggtggcccgctgccccccctgcctgcggctgctgcgggaggcccgggacttccaggccgcccgctatgacagacatgaccggggcccctgccccaggatgaggccccggcccagcacaggcctggccgagatcctggtgctggtgggcggctgtgaccaggactgtgatgagctggtgacagtggactgctacaacccccagacaggccagtggagatacctggccgagttcccagaccacctgggcggcggctacagcatcgtggccctgggcaatgacatctacgtgactggaggcagtgatggcagccggctgtatgactgtgtgtggagatacaacagctctgtgaatgagtgggccgaggtggcccccatgctgaaggcccgggagtaccacagcagctctgtgctggatggcctgctgtatgtggtggccgctgacagcacagaaagatatgaccacaccacagacagctgggaggccctgcagcccatgacctaccccatggacaactgcagcaccacagcctgccggggccgcctgtatgccatcggcagcctggccggcaaggagaccatggtgatgcagtgctatgaccctgacacagacctgtggagcctggtggactgtggccagctgcccccctggagctttgcccccaagacagccaccctgaatggcctgatgtactttgtgagagatgattctgctgaggtggatgtgtacaaccccaccagaaatgagtgggacaagatccccagcatgaaccaggtgcacgtgggcggcagcctggccgtgctgggcggcaagctgtatgtgtctgggggctatgacaacacctttgagctgagtgatgtggtggaggcctatgaccctgagacccgggcctggagcgtggtgggccgcctgcctgagcccaccttctggcacggctctgtgtccatcttccggcagttcatgccccagaccttcagcggcggccggggctttgagctggacagcggcagtgatgacatggaccccggccggcccaggcctccccgggaccctgatgagctgcactag

SEQ ID NO: 20072 - DNA, 1620 bp, Artificial Sequence
  Description of Artificial Sequence: Synthetic coding sequence
atggagaggcctgcccccctggccgtgctgcccttcagtgaccctgcccacgccctgagcctgctgcggggcctgagccagctgcgggcagagaggaagttcctggatgtgaccctggaggccgccggcggccgggacttccctgcccacagagctgtgctggccgccgccagcccctacttccgggccatgtttgctggccagctgcgggagagcagagctgagcgggtgcggctgcacggcgtgcccccagacatgctgcagctgctgctggacttctcctacacaggccgggtggccgtgtctggggacaatgctgagcccctgctgcgggctgctgacctgctgcagtttcctgctgtgaaggaggcctgtggggccttcctgcagcagcagctggacctggccaactgcctggacatgcaggactttgctgaggccttcagctgcagcggcctggccagcgctgcccagcgcttcatcctgcggcacgtgggggagctgggcgctgagcagctggagcggctgcccctggcccggctgctgcgctacctgagagatgatggcctgtgtgtgcccaaggaggaggccgcctaccagctggccctgcgctgggtgcgggctgaccccccccggcgggccgcccactggccccagctgctggaggccgtgcggctgccctttgtgcggcgcttctacctgctggcccacgtggaggccgagcccctggtggcccgctgccccccctgcctgcggctgctgcgggaggcccgggacttccaggccgcccgctatgacagacatgaccggggcccctgccccaggatgaggccccggcccagcacaggcctggccgagatcctggtgctggtgggcggctgtgaccaggactgtgatgagctggtgacagtggactgctacaacccccagacaggccagtggagatacctggccgagttcccagaccacctgggcggcggctacagcatcgtggccctgggcaatgacatctacgtgactggaggcagtgatggcagccggctgtatgactgtgtgtggagatacaacagctctgtgaatgagtgggccgaggtggcccccatgctgaaggcccgggagtaccacagcagctctgtgctggatggcctgctgtatgtggtggccgctgacagcacagaaagatatgaccacaccacagacagctgggaggccctgcagcccatgacctaccccatggacaactgcagcaccacagcctgccggggccgcctgtatgccatcggcagcctggccggcaaggagaccatggtgatgcagtgctatgaccctgacacagacctgtggagcctggtggactgtggccagctgcccccctggagctttgcccccaagacagccaccctgaatggcctgatgtactttgtgagagatgattctgctgaggtggatgtgtacaaccccaccagaaatgagtgggacaagatccccagcatgaaccaggtgaacttccaggccggccagcactggaagcaccggctggtgctgatcctgcagcccaagtgccacagagatgaatgtctgggcagcacagccatgatgggcggcagccacctgaactag

SEQ ID NO: 20073 - DNA, 2067 bp, Artificial Sequence
  Description of Artificial Sequence: Synthetic coding sequence
atggatggcagctttgtgcagcacagcgtgcgggtgctgcaggagctgaacaagcagcgggagaagggccagtactgtgatgccaccctggatgtgggcggcctggtgttcaaggcccactggagcgtgctggcctgctgcagccacttcttccagagcctgtatggagatggcagcggcggctctgtggtgctgcctgctggctttgctgagatcttcggcctgctgctggacttcttctacacaggccacctggccctgaccagcggcaacagagaccaggtgctgctggccgcccgggagctgcgggtgcctgaggccgtggagctgtgccagagcttcaagcccaagacctctgtgggccaggccgccggcggccagagcggcctgggccccccagccagccagaatgtgaacagccacgtgaaggagcccgccggcctggaggaggaggaggtgtccaggaccctgggcctggtgccccgggaccaggagccccggggcagccacagcccccagaggccccagctgcacagccctgcccagagcgagggccccagcagcctgtgtgggaagctgaagcaggccctgaagccctgccccctggaggacaagaagccagaggactgcaaggtgcccccccggcccctggaggccgagggcgcccagctgcagggcggcagcaatgagtgggaggtggtggtgcaggtggaggatgatggagatggagactacatgtctgagcctgaggccgtgctgaccaggaggaagagcaatgtcatcaggaagccctgtgccgctgagcccgccctgtctgctggcagcctggccgctgagcctgctgagaacagaaaaggaacagctgtgcctgtggagtgccccacctgccacaagaagttcctgagcaagtactacctgaaggtgcacaacaggaagcacactggagagaagccctttgagtgccccaagtgtgggaagtgctacttcaggaaggagaacctgctggagcacgaggccaggaactgcatgaacagaagtgagcaggtgttcacctgcagcgtgtgccaggagaccttcagaagaaggatggagctgcgggtgcacatggtgagccacactggagagatgccctacaagtgcagcagctgcagccagcagttcatgcagaagaaggacctgcagagccacatgatcaagctgcatggagcccccaagccccacgcctgccccacctgtgccaagtgcttcctgagcaggacagagctgcagctgcacgaggccttcaagcacagaggagagaagctgtttgtgtgtgaggagtgtggccaccgggccagcagcagaaatggcctgcagatgcacatcaaggccaagcacagaaatgaaagacctcatgtgtgtgagttctgcagccacgccttcacccagaaggccaacctgaacatgcacctgcggacccacactggagagaagcccttccagtgccacctgtgtgggaagaccttccgcacccaggccagcctggacaagcacaacagaacccacactggagagcggcccttcagctgtgagttctgtgagcagcgcttcacagagaagggccccctgctgcggcacgtggccagccgccaccaggagggccggccccacttctgccagatctgtgggaagaccttcaaggctgtggagcagctgcgggtgcacgtgcggcggcacaagggcgtgaggaagtttgaatgtacagaatgtggctacaagttcacccggcaggcccacctgcggcggcacatggagatccatgacagagtggagaactacaacccccggcagaggaagctgaggaacctgatcattgaagatgagaagatggtggtggtggccctgcagcccccagctgagctggaggtgggcagcgctgaggtgattgtggagagcctggcccagggcggcctggccagccagctgcccggccagaggctgtgtgccgaggagagcttcaccggccctggggtgctggagcccagcctcatcatcacagctgctgtgcctgaggactgtgacacctag

SEQ ID NO: 20074 - DNA, 525 bp, Artificial Sequence
  Description of Artificial Sequence: Synthetic coding sequence
atgacccactgctgcagcccctgctgccagcccacctgctgcaggaccacctgctgcaggaccacctgctggaagcccaccaccgtgaccacctgcagcagcaccccctgctgccagcctgcctgctgcgtgagcagctgctgccagccctgctgccggcccacctgctgccagaacacctgctgcaggaccacctgctgccagcccacctgtgtgaccagctgctgccagcccagctgctgcagcaccccctgctgccagcccacctgctgcggcagcagctgctgcggccagaccagctgtggcagcagctgtggccagagcagcagctgtgcccctgtgtactgcaggaggacctgctactaccccaccaccgtgtgcctgcccggctgcctgaaccagagctgtggcagcaactgctgccagccctgctgcaggcctgcctgctgtgagaccacctgctgcaggaccacctgcttccagcccacctgtgtgagcagctgctgccagcccagctgctgctag

SEQ ID NO: 20075 - DNA, 597 bp, Artificial Sequence
  Description of Artificial Sequence: Synthetic coding sequence
atggtgagcagctgctgcggctctgtgtgcagcgaccagggctgcagccaggacctgtgccaggagacctgctgccggcccagctgctgccagaccacctgctgcaggaccacctgctaccggcccagctgctgcgtgagcagctgctgccggccccagtgctgccagagcgtgtgctgccagcccacctgctgcaggcctccccgctgctgcatcagcagctgctgccggcccagctgctgcatgagcagctgctgcaagccccagtgctgccagagcgtgtgctgccagcccaccaccacctgctgccacccccgctgctgcatcagcagctgctgccggcccagctgctgcgtgagcagctgctgcaagccccagtgctgccagagcgtgtgctgccagcccaactgctgccggcccagctgcagcatcagcagctgctgccggcccagctgctgtgagagcagctgctgccggccctgctgctgcgtgcggcctgtgtgtggccgggtgtcctgccacaccacctgctaccggcccacctgtgtgatcagcagctgcccccggcccctgtgctgtgccagcagctgctgctag

SEQ ID NO: 20076 - DNA, 1296 bp, Artificial Sequence
  Description of Artificial Sequence: Synthetic coding sequence
atgaccagtgactgcagcagcacccactgcagccctgagagctgtggcacagccagcggctgtgccccagccagcagctgcagcgtggagacagcctgcctgcccggcacctgtgccaccagccgctgccagacccccagcttcctgagccgcagccggggcctgaccggctgcctgctgccctgctacttcaccggcagctgcaacagcccctgcctggtgggcaactgtgcctggtgtgaagatggagtcttcaccagcaatgagaaggagaccatgcagttcctgaatgaccggctggccagctacctggagaaggtgcgcagcctggaggagaccaatgctgagctggagagccgcatccaggagcagtgtgagcaggacatccccatggtgtgcccagactaccagcgctacttcaacaccatcgaggacctgcagcagaagatcctgtgcaccaaggccgagaacagccggctggccgtgcagctggacaactgcaagctggccacagatgacttcaagagcaaatatgagagcgagctgagcctgcggcagctgctggaggccgacatcagcagcctgcacggcatcctggaggagctgaccctgtgcaagagtgacctggaggcccacgtggagagcctgaaggaggacctgctgtgcctgaagaagaaccacgaggaggaggtgaacctgctgcgggagcagctgggggaccggctgtctgtggagctggacacagcccccaccctggacctgaacagagtgctggatgagatgcgctgccagtgtgaaacagtgctggccaacaacagaagagaggccgaggagtggctggccgtgcagacagaggagctgaaccagcagcagctgagcagcgctgagcagctgcagggctgccagatggagatcctggagctgaagaggacagccagcgccctggagattgagctgcaggcccagcagagcctgacagagagcctggagtgcaccgtggccgagacagaggcccagtacagcagccagctggcccagatccagtgcctgattgacaacctggagaaccagctggccgagatccgctgtgacctggagcggcagaaccaggagtaccaggtgctgctggatgtgaaggcccggctggagggggagatcaacacctactggggcctgctggacagcgaggacagccggctgagctgcagcccctgcagcaccacctgcaccagcagcaacacctgtgagccctgcagcgcctacgtgatctgcaccgtggagaactgctgcctgtag

SEQ ID NO: 20077 - DNA, 1047 bp, Artificial Sequence
  Description of Artificial Sequence: Synthetic coding sequence
atggccggcagcctgcccccctgtgtggtggactgtggcaccggctacaccaagctgggctacgccggcaacacagagccccagttcatcatccccagctgcatcgccatccgggagagcgccaaggtggtggaccaggcccagaggagagtgctgcggggcgtggatgacctggacttcttcatcggagatgaggccatcgacaagcccacctacgccaccaagtggcccatccgccacggcatcatcgaggactgggacctgatggagcgcttcatggagcaggtggtgttcaagtacctgcgggcagagcctgaggaccactacttcctgatgacagagccccccctgaacaccccagaaaatcgggagtacctggccgagatcatgtttgagagcttcaacgtgcccggcctgtacatcgctgtgcaggccgtgctggccctggccgcctcctggaccagccggcaggtgggggagaggaccctgaccggcatcgtcatcgacagcggagatggagtgacccacgtgattcctgtggccgagggctacgtgattggcagctgcatcaagcacatccccatcgccggccgggacatcacctacttcatccagcagctgctgcgggagcgggaggtgggcatccccccagagcagagcctggagacagccaaggccatcaaggagaagtactgctacatctgcccagacatcgtgaaggagtttgccaagtatgatgtggaccccaggaagtggatcaagcagtacacaggcatcaatgccatcaaccagaagaagtttgtgattgatgtgggctatgagcgcttcctgggccctgagatcttcttccaccctgagtttgccaacccagacttcatggagagcatcagtgatgtggtggatgaagtcatccagaactgccccattgatgtgcggcggcccctgtacaagccagagttcttccaggtgtgccacaccaagaaggactatgaggagtatggccccagcatctgccgccacaaccctgtgtttggagtgatgtcctag

SEQ ID NO: 20078 - DNA, 273 bp, Artificial Sequence; identical to SEQ ID NO: 18343
  Description of Artificial Sequence: Synthetic coding sequence

SEQ ID NO: 20079 - DNA, 249 bp, Artificial Sequence
  Description of Artificial Sequence: Synthetic coding sequence
atggccagcagcagtggagctggagctgctgctgctgctgctgctgccaacctgaatgctgtgcgggagaccatggatgtgctgctggagatcagccgcatcctgaacacaggcctggacatggagaccctgagcatctgtgtgcggctgtgtgagcagggcatcaaccctgaggccctgagcagcgtcatcaaggagctgaggaaggccacagaggccctgaaggctgctgagaacatgaccagctag

SEQ ID NO: 20080 - DNA, 3732 bp, Artificial Sequence
  Description of Artificial Sequence: Synthetic coding sequence
atggagaccagggctgctgaaaatacagccatcttcatgtgcaagtgctgcaacctcttcagccccaaccagagcgagctgctgagccacgtgtctgagaagcacatggaggagggcgtgaatgtggatgagatcatcatccccctgcggcccctgagcaccccagagccccccaacagcagcaagacaggagatgagttcctggtgatgaagaggaagaggggccggcccaagggcagcaccaagaagagcagcacagaggaggagctggccgagaacatcgtgagccccacagaggacagccccctggcccctgaggagggcaacagcctgccccccagcagcctggagtgcagcaagtgctgcaggaagttcagcaacacccggcagctgaggaagcacatctgcatcatcgtgctgaacctgggggaggaggagggggaggccggaaatgaaagtgacctggagctggagaagaagtgcaaggaggatgaccgggagaaggccagcaagaggcccaggagccagaagacagagaaggtgcagaagatcagcggcaaggaggcccggcagctgagcggggccaagaagcccatcatctctgtggtgctgacagcccacgaggccatccctggggccaccaagatcgtgcctgtggaggccggccccccagagaccggggccaccaacagcgagaccaccagcgctgacctggtgccccggcggggctaccaggagtatgccatccagcagaccccctatgagcagcccatgaagagcagccggctgggccccacccagctgaagatcttcacctgtgagtactgcaacaaggtgttcaagttcaagcacagcctgcaggcccacctgcgcatccacaccaatgagaagccctacaagtgcccccagtgcagctatgccagcgccatcaaggccaacctgaatgtgcacctgaggaagcacactggagagaagtttgcctgtgactactgcagcttcacctgcctgagcaagggccacctgaaggtgcacatcgagcgggtgcacaagaagatcaagcagcactgccgcttctgcaagaagaagtacagtgatgtgaagaacctgatcaagcacatcagagatgcccatgacccccaggacaagaaggtgaaggaggccctggatgagctgtgcctgatgacccgggagggcaagaggcagctgctgtatgactgccacatctgtgagaggaagttcaagaatgagctggaccgggacagacacatgctggtgcacggggacaagtggccctttgcctgtgagctgtgtggccatggagccaccaagtaccaggccctggagctgcacgtgaggaagcacccctttgtgtatgtgtgtgctgtgtgcaggaagaagtttgtgagcagcatccggctgcggacccacatcaaggaggtgcatggagctgcccaggaggccctggtgttcaccagcagcatcaaccagagcttctgcctgctggagcctggaggagacatccagcaggaggccctgggggaccagctgcagctggtggaggaggagtttgccctgcagggcgtgaatgccctgaaggaggaggcctgccctggggacacccagctggaggagggcaggaaggagcctgaggcccctggagagatgcctgccccagctgtgcacctggccagcccccaggccgagagcacagccctgcccccctgtgagctggagaccaccgtggtgagcagcagtgacctgcacagccaggaggtggtgtctgatgacttcctgctgaagaatgacaccagcagcgctgaggcccacgccgcccctgagaagcccccagacatgcagcacaggagctctgtgcagacccagggcgaggtgatcaccctgctgctgagcaaggcccagagcgctggcagtgaccaggagagccacggggcccagagccccctgggggagggccagaacatggctgtgctgtctgctggggaccctgaccccagccgctgcctgcggagcaacccagctgaggccagtgacctgctgccccctgtggccggcggcggggacaccatcacccaccagcctgacagctgcaaggccgcccctgagcacaggagcggcatcacagccttcatgaaggtgctgaacagcctgcagaagaagcagatgaacaccagcctgtgtgagcgcatcaggaaggtgtatggagacctggagtgtgagtactgcggcaagctgttctggtaccaggtgcactttgacatgcacgtgaggacccacacccgggagcacctgtactactgcagccagtgccactacagcagcatcaccaagaactgcctgaagagacatgtgatccagaagcacagcaacatcctgctgaagtgccccacagatggctgtgactacagcaccccagacaagtacaagctgcaggcccacctgaaggtgcacacagccctggacaagaggagctacagctgccctgtgtgtgagaagagcttctctgaagatagactcatcaagagccacatcaagaccaaccaccctgaggtgtccatgagcaccatcagcgaggtgctgggcagaagagtgcagctgaagggcctgattggcaagagggccatgaagtgcccctactgtgacttctacttcatgaagaatggaagtgacctgcagaggcacatctgggcccatgaaggagtgaagcccttcaagtgcagcctgtgtgaatatgccaccaggagcaagagcaacctgaaggcccacatgaacagacacagcacagagaagacccacctgtgtgacatgtgtgggaagaagttcaagagcaagggcaccctgaagagccacaagctgctgcacacagcagatggcaagcagttcaagtgcaccgtgtgtgactacacagctgcccagaagccccagctgctgcggcacatggagcagcacgtgtccttcaagcccttccgctgtgcccactgccactacagctgcaacatcagcggcagcctgaagaggcactacaacaggaagcaccccaatgaggagtatgccaacgtgggcactggagagctggccgctgaggtgctgatccagcagggcggcctgaagtgccctgtgtgcagctttgtgtatggcaccaagtgggagttcaacagacacctgaagaacaagcacggcctgaaggtggtggagattgatggagaccccaagtgggagacagccacagaggcccctgaggagcccagcacccagtacctgcacatcacagaagcagaagaagatgtgcagggcacccaggccgctgtggccgccctgcaggacctgcgctacaccagcgagagcggggaccggctggaccccacagctgtgaacatcctgcagcagatcatcgagctgggcgctgagacccatgatgccacagccctggcctctgtggtggccatggcccctggcaccgtgacagtggtgaagcaggtgacagaggaggagcccagcagcaaccacacagtgatgatccaggagaccgtgcagcaggcctctgtggagctggccgagcagcaccacctggtggtgtccagtgatgatgtggagggcattgaaacagtgacagtgtacacccagggcggggaggccagcgagttcatcgtgtatgtgcaggaggccatgcagcctgtggaggagcaggccgtggagcagcctgcccaggagctgtag

SEQ ID NO: 20081 - DNA, 2274 bp, Artificial Sequence
  Description of Artificial Sequence: Synthetic coding sequence
atggccctgggggaggagaaggccgaggccgaggccagcgaggacaccaaggcccagagctatggccggggcagctgccgggagcgggagctggacatccctggccccatgtctggagagcagcccccccggctggaggccgagggcggcctcatcagccctgtgtggggcgctgagggcatcccagcccccacctgctggattggaacagaccccggcggccccagccgggcccaccagccccaggccagtgatgccaaccgggagcctgtggccgagaggtctgagcccgccctgagcggcctgcccccagccaccatgggcagcggggacctgctgctgtctggagagagccaggtggagaagaccaagctgagcagcagcgaggagttcccccagaccctgagcctgcccaggaccaccaccatctgcagcggccatgatgctgacacagaagatgaccccagcctggccgacctgccccaggccctggacctgagccagcagccccacagcagcggcctgagctgcctgagccagtggaagtctgtgctgagccctggcagcgctgcccagcccagcagctgcagcatcagcgccagcagcacaggcagcagcctgcagggccaccaggagcgggcagagccccggggcggcagcctggccaaggtgagcagcagcctggagcctgtggtgccccaggagcccagctctgtggtgggcctgggcccccggccccagtggagcccccagcccgtcttctctggaggagatgccagcggcctgggcagaagaaggctgtccttccaggccgagtactgggcctgtgtgctgcctgacagcctgccccccagcccagacagacacagccccctgtggaaccccaacaaggagtatgaggacctgctggactacacctaccccctgcggcccggcccccagctgcccaagcacctggacagccgggtgcctgctgaccctgtgctgcaggacagcggcgtggacctggacagcttctctgtgtccccagccagcaccctgaagagccccaccaacgtgagccccaactgccccccagctgaggccacagccctgcccttcagcggcccccgggagcccagcctgaagcagtggcccagccgggtgccccagaagcagggcggcatgggcctggcctcctggagccagctggccagcaccccccgggcccctggcagcagagatgcccgctgggagcggcgggagcccgccctgcggggggccaaggaccggctgaccatcggcaagcacctggacatgggcagcccccagctgcggacccgggaccggggctggcccagccccaggcctgagcgggagaagaggaccagccagagcgcccggcggcccacctgcacagagagccgctggaagtctgaggaggaggtggagagtgatgatgagtacctggccctgcctgcccggctgacccaggtgagcagcctggtgtcctacctgggcagcatcagcaccctggtgaccctgcccaccggggacatcaagggccagagccccctggaggtgtctgacagtgatggccctgccagcttccccagcagcagcagccagagccagctgcccccaggagctgccctgcagggcagcggggaccctgagggccagaacccctgcttcctgcggagctttgtgcgggcccatgacagcgctggggagggcagcctgggcagcagccaggccctgggcgtgagcagcggcctgctgaagacccggcccagcctgcctgcccggctggaccgctggcccttcagtgaccctgatgtggagggccagctgcccaggaagggcggggagcagggcaaggagagcctggtgcagtgtgtgaagaccttctgctgccagctggaggagctgatctgctggctgtacaacgtggctgatgtgacagaccacggcacagctgcccggagcaacctgaccagcctgaagagcagcctgcagctgtaccggcagttcaagaaggacattgatgagcaccagagcctgacagagagcgtgctgcagaagggggagatcctgctgcagtgcctgctggagaacacccctgtgctggaggatgtgctgggccgcatcgccaagcagagcggggagctggagagccatgctgaccggctgtatgacagcatcctggccagcctggacatgctggccggctgcaccctcatcccagacaagaagcccatggccgccatggagcacccctgtgagggcgtgtag

SEQ ID NO: 20082 - DNA, 540 bp, Artificial Sequence
  Description of Artificial Sequence: Synthetic coding sequence
atgaaccccagcatgaagcagaagcaggaggagatcaaggagaacatcaagaacagctctgtgcccaggaggaccctgaagatgatccagcccagcgccagcggcagcctggtgggcagagaaaatgagctgtctgctggcctgagcaagaggaagcacagaaatgaccacctgaccagcaccaccagcagccctggggtcatcgtgcctgagagcagcgagaacaagaacctgggcggcgtgacccaggagagctttgacctgatgatcaaggagaaccccagcagccagtactggaaggaggtggccgagaagaggaggaaggccctgtatgaggccctgaaggaaaatgagaagctgcacaaggagattgagcagaaggacaatgaaattgcccggctgaagaaggagaacaaggagctggccgaggtggccgagcacgtgcagtacatggccgagctgattgagcggctgaatggagagcccctggacaactttgagagcctggacaaccaggagtttgacagcgaggaggagtag

SEQ ID NO: 20083 - DNA, 309 bp, Artificial Sequence
  Description of Artificial Sequence: Synthetic coding sequence
atgaaccccagcatgaagcagaagcaggaggagatcaaggagaacatcaagaacagctctgtgcccaggaggaccctgaagatgatccagcccagcgccagcggcagcctggtgggcagagaaaatgagctgtctgctggcctgagcaagaggaagcacagaaatgaccacctgaccagcaccaccagcagccctggggtcatcgtgcctgagagcagcgagaacaagaacctgggcggcgtgacccaggagagctttgacctgatgatcaaggagaaccccagcagccagtactggaaggaggtgtag

SEQ ID NO: 20084 - DNA, 2259 bp, Artificial Sequence
  Description of Artificial Sequence: Synthetic coding sequence
atggccgagcccgcctctgtgacagtgacctttgatgatgtggccctgtacttcagcgagcaggagtgggagatcctggagaagtggcagaagcagatgtacaagcaggagatgaagaccaactatgagaccctggacagcctgggctacgccttcagcaagccagacctgatcacctggatggagcagggccgcatgctgctgatcagcgagcagggctgcctggacaagaccaggaggaccaccagccccccaacagatgagcagctgaacatgaagaacacaggcaagctgctgtgctttgatgatgagggcacccccaggaccaaggaggaggactgccgcctgaatggcccccagaagcaggacctgtgtgccgccctgcggggcaaggagaggaagatcctgctggcccagacagccaccttccagagccccagcctgcgggagacagagatcctgaacaagaaggtgtccatcacagcctatgaccctgacaagaaggacctgcggcacaagccccgggagaccccaggccgcctggagatccccaccggcccccgctgctacagctgctacgtgtgcaggaaggtgttccaggtgcggcgggacctgctgaagcacaagaggagccacagcaagagccagctgtgccgctaccccaagtacaagaacagcagccggggcaagtctgagctgcggaggacccagaggctgctgtgccagaagaagcgcttccagtgcagtgaatgtgagaagagctacttcctgaagggcagcctggtgacccaccaggtggtgcacacaggccagaggccctacccctgcccagaatgtgacaagaccttccgctaccgggccaacctgaagaagcacctgtgcctgcacagaggagagcggcccttctgctgcggggagtgtggccgggcctttgtgcagcagtgtgagctgacagagcacctgcggctgcacagcggggagaagcccttccagtgcccccagtgtgaccgctgcttccggctgaagaggggcatgaaggtgcacctgacccagcacagcggcaagaggcccttccactgcccagaatgtggccgctccttcagcaggaaggccgccctgaagacccaccagaggacccacagcgaggagaagcccttcagctgtggggagtgtggcaggaagttcatctacaagatcaagctggatgagcacatccgggtgcacactggagagaagcccttcagctgcccagagtgcaacaagagcttccggctgaagaggagcctgaaggcccacggcctgcagcacatcggcaagaggcccttccagtgcccagagtgcagccggggcttcttctggagaaatgccatgagggcccaccagaggctgcacagcgagcagaagcccttcccctgtgccgagtgtgggaagcgcttcacccggcccagcaagctggcctgccacaccagggtgcatgaccggcagaaggagttcccctgtggggagtgcaagaagaccttcagccagcagagccggctgacccagcacctgaaggtgcacaccacagagaagcccttcagctgtgccgagtgtggccgctccttcagaagaagagcccacctgacagagcacacccggctgcacagcggggaggagcccttccagtgcccagaatgtgacaagagcttctcctggaaggcctccatgaagttccaccagaggatgcacagagatgagaagccctttgcctgtggggagtgtgacaagacctacacccaccagagccagctgacagagcacctgcggctgcacagcggggagaagccctaccagtgcccagaatgtgagaagaccttccggctgaagggcaacctgaagagccacctgctgcagcacagcggccagaagcccttcagctgtgtgatgtgtgggaagagcttcacccagcagtaccgcctgacagagcacatccgggtgcacagcggggagaagcccttccagtgcccagaatgtgacaagagctactgcatccggggcagcctgaaggtgcacctgtacaagcacagcggggagcggcccttccagtgcccagaatgtgggaagggcttcctgcagaagaggagcctgaaggcccacctgtgcctgcacagcggggagcggcccttcagctgtgatgaatgtggccgctccttcacctacgtgggcgccctgaagacccacatcgctgtgcacgccaaggagaagcccagcagcctgtag

SEQ ID NO: 20085 - DNA, 1935 bp, Artificial Sequence
  Description of Artificial Sequence: Synthetic coding sequence
atgttcctgacctacatggagaccgtgaccaaggagctggtgtcctggatgaggggccacgagagctctgtgttcagcatctctgtgcacgccagcggcaagtatgccatcaccaccagcagtgacacagcccagctgtgggacctggacaccttccagaggaagaggaagctgaacatccggcagagcgtgggcatccagaaggtgttcttcctgcccctgagcaacaccatcctgagctgcttcaaggacaacagcatctttgcctgggagtgtgacaccctcttctgcaagtaccagctgcctgcccctcctgagagcagcagcatcctgtacaaggtgtttgctgtgaccagagatggccgcatcctggccgccggcggcaagagcaaccacctgcacctgtggtgcctggaggcccggcagctgttccgcatcatccagatgcccaccaaggtgcgggccatccgccacctggagttcctgcctgacagctttgatgctggcagcaaccaggtgctgggcgtgctgagccaggacggcatcatgaggttcatcaacatgcagacctgcaagctgctgtttgaaattggcagcctggatgagggcatcagcagcagcgccatcagcccccacggccgctacatcgccagcatcatggagaatggcagcctgaacatctacagcgtgcaggccctgacccaggagatcaacaagcccccaccacccctggtgaaggtgattgaggacctgcccaagaacaagctgagcagcagtgacctgaagatgaaggtgaccagcggccgggtgcagcagcctgccaagagccgggagagcaagatgcagacccgcatcctgaagcaggacctgactggagactttgagagcaagaagaatgagctgcctgatggcctgaacaagaagaggctgcagatcctgctgaagggctatggagagtaccccaccaagtacaggatgttcatctggaggagcctgctgcagctgcctgagaaccacacagccttcagcaccctgattgacaagggcacccacgtggccttcctgaacctgcagaagaagtaccccatcaagagcaggaagctgctgcgggtgctgcagaggaccctgagcgccctggcccactggagcgtcatcttcagtgacaccccctacctgcccctgctggccttcccctttgtgaagctgttccagaacaaccagctgatctgctttgaagtcatcgccaccctcatcatcaactggtgccagcactggtttgagtacttccccaacccccccatcaacatcctgtccatgattgaaaatgtgctggccttccatgacaaggagctgctgcagcacttcatcgaccatgacatcaccagccagctgtatgcctggcccctgctggagaccgtcttcagcgaggtgctgacccgggaggagtggctgaagctgtttgacaacatcttcagcaaccaccccagcttcctgctgatgacagtggtggcctacaacatctgcagcaggacccccctgctgagctgcaacctgaaggatgactttgagttcttcttccaccacaggaacaacctggacatcaacgtggtgatccggcaggtgtaccacctgatggagaccacccccacagacatccacccagacagcatgctgaatgtgtttgtggccctgaccaagggccagtaccctgtgttcaaccagtaccccaagttcatcgtggactaccagacccaggagcgggagcgcatcagaaatgatgagctggactacctgcgggagcggcagctgaagatctgcaagctgaagagcaccagcaaggagctgaagatgaagctgggcaccaggaacagaagctgctttgtgaagctgaagaagcaggaggagaagtgcagctacaagagaagaaggaagtag

SEQ ID NO: 20086 - DNA, 735 bp, Artificial Sequence
  Description of Artificial Sequence: Synthetic coding sequence
atgccccacaagattggatttgtggtggtgagcagcagcggccatgaagatggcttcagcgcccgggagctgatgattcatgcccccaccgtgtctggctggaggagcccccgcttctgccagttcccccaggagatcgtgctgcagatggtggagcgctgccgcatcaggaagctgcagctgctggcccaccagtacatgatcagcagcaagattgagttctacatcagcgagagcctgcctgagtactttgccccctaccaggccgagcgcttccggcggctgggctacgtgtccctgtgtgacaatgagaagacaggctgcaaggcccgggagctgaagtctgtgtatgtggatgctgtgggccagttcctgaagctgatcttccaccagaaccacgtgaacaagtacaacatctacaaccaggtggccctggtggccatcaacatcattggagaccctgctgacttcagtgatgagagcaacacagccagccgggagaagctgattgaccactacctgggccacaacagtgaagatcctgccctggagggcacctacgccagctctgtgaggactggaggagagagcacctttggagagctgaagggccctgctgtgcccagctctgtgaccctgtctgtgctgggcaccagcctgggccagtggttcccctgccacctgcctgctgtggatgacaatgaaggcacccccttccagcgctgcctggtgtag

SEQ ID NO: 20087 - DNA, 2778 bp, Artificial Sequence
  Description of Artificial Sequence: Synthetic coding sequence
atgccccacaagattggatttgtggtggtgagcagcagcggccatgaagatggcttcagcgcccgggagctgatgattcatgcccccaccgtgtctggctggaggagcccccgcttctgccagttcccccaggagatcgtgctgcagatggtggagcgctgccgcatcaggaagctgcagctgctggcccaccagtacatgatcagcagcaagattgagttctacatcagcgagagcctgcctgagtactttgccccctaccaggccgagcgcttccggcggctgggctacgtgtccctgtgtgacaatgagaagacaggctgcaaggcccgggagctgaagtctgtgtatgtggatgctgtgggccagttcctgaagctgatcttccaccagaaccacgtgaacaagtacaacatctacaaccaggtggccctggtggccatcaacatcattggagaccctgctgacttcagtgatgagagcaacacagccagccgggagaagctgattgaccactacctgggccacaacagtgaagatcctgccctggagggcacctacgccaggaagagtgactacatcagccccctggatgacctggcctttgacatgtaccaggaccctgaggtggcccagatcatcaggaagctggatgagaggaagcgggaggccgtgcagaaggagagatatgactatgccaagaagctgaagcaggccatcgctgacctgcagaaggtgggggagcggctgggccgctatgaggtggagaagagatgtgctgtggagaaggaggactatgacctggccaaggagaagaagcagcagatggagcagtacagagctgaggtgtatgagcagctggagctgcacagcctgctggatgctgagctgatgagaagaccatttgacctgcccctgcagcccctggcccggagcggcagcccctgccaccagaagcccatgcccagcctgccccagctggaggagcggggcacagagaaccagtttgctgagcccttcctgcaggagaagcccagcagctacagcctgaccatcagcccccagcacagcgctgtggaccccctgctgcctgccacagacccccaccccaagatcaatgctgagagcctgccctatgatgagcggcccctgcctgccatcaggaagcactatggagaggccgtggtggagcctgagatgagcaatgctgacatcagtgatgccaggagaggaggcatgctgggggagcctgagcccctgacagagaaggccctgcgggaggccagcagcgccattgatgtgctgggggagaccctggtggccgaggcctactgcaagacctggagctaccgggaggatgccctgctggccctgagcaagaagctgatggagatgcctgtgggcacccccaaggaggacctgaagaacaccctgcgggcctctgtgttcctggtgcggcgggccatcaaggacatcgtgacctctgtgttccaggccagcctgaagctgctgaagatgatcatcacccagtacatccccaagcacaagctgagcaagctggagacagcccactgtgtggagaggaccatccctgtgctgctgaccaggactggagacagcagcgcccggctgcgggtgacagctgccaacttcatccaggagatggccctcttcaaggaggtgaagagcctgcagatcatccccagctacctggtgcagcccctgaaggccaacagctctgtgcacctggccatgagccagatgggcctgctggcccggctgctgaaggacctgggcaccggcagcagcggcttcaccatcgacaacgtgatgaagttctctgtgtctgccctggagcaccgggtgtatgaggtgcgggagacagctgtgcgcatcatcctggacatgtaccggcagcaccaggccagcatcctggagtacctgcccccagatgacagcaacaccaggaggaacatcctgtacaagaccatctttgagggctttgccaagattgatggccgggccacagatgctgagatgagggcccggaggaaggccgccacagaggaggccgagaagcagaagaaggaggagatcaaggccctgcagggccagctggccgccctgaaggagatccaggccgaggtgcaggagaaggagagtgatgctgtgaagcccaagaaccaggacatccagggcggcaaggccgccccagctgaggccctgggcatcccagatgagcactacctggacaacctgtgcatcttctgtggggagaggtctgagagcttcacagaggagggcctggacctgcactactggaagcactgcctgatgctgacccgctgtgaccactgcaagcaggtggtggagatcagcagcctgacagagcacctgctgacagaatgtgacaagaaggatggctttgggaagtgctaccgctgcagcgaggccgtgttcaaggaggagctgcccaggcacatcaagcacaaggactgcaacccagccaagccagagaagctggccaaccgctgccccctgtgccacgagaacttcagccctggagaggaggcctggaaggcccacctgatgggccctgctggctgcaccatgaacctgaggaagacccacatcctgcagaaggccccagccctgcagcccgggaagagcagcgctgtggccgccagcggccccctgggcagcaaggccggcagcaagatccccacccccaagggcggcctgagcaagagcagcagcaggacctacgccaagaggtag

SEQ ID NO: 20088 - DNA, 2145 bp, Artificial Sequence
  Description of Artificial Sequence: Synthetic coding sequence
atggcccgggccggcagctgtggcggcgctgctgctggggccggccggcctgagccctgggagctgagcctggaggaggtgctgaaggcctatgagcagcccctgaatgaggagcaggcctgggccgtgtgcttccagggctgccggggcctgcggggcagccctggaagaaggctgcgggacaccggggacctgctgctgcggggagatggctctgtgggcgcccgggagcctgaggccgctgagcccgccaccatggtggtgcccctggccagcagcgaggcccagacagtgcagagcctgggctttgccatctaccgggccctggactggggcctggatgagagcgaggagcgggagctgagcccccagctggagcggctgattgacctgatggccaacaatgattctgaggacagcggctgtggggctgctgatgagggctatggaggccctgaggaggaggaggaggccgagggcgtgcccaggtctgtgaggacctttgcccaggccatgaggctgtgtgccgcccggctgacagaccccaggggggcccaggcccactaccaggccgtgtgccgggccctgtttgtggagaccctggagctgcgggccttcctggcccgggtgcgggaggccaaggagatgctgcagaagctgcgggaggatgagccccacctggagacccccagggctgagctggacagcctgggccacacagactgggcccggctgtgggtgcagctgatgagggagctgcggcggggcgtgaagctgaagaaggtgcaggagcaggagttcaaccccctgcccacagagttccagctgaccccatttgagatgctgatgcaggacatccgggccaggaactacaagctgaggaaggtgatggtggatggagacatccccccccgggtgaagaaggatgcccacgagctgatcctggacttcatccgcagccggccccccctgaagcaggtgtctgagcggcggctgcggcccctgccccccaagcagaggagcctgcacgagaagatcctggaggagatcaagcaggagcggcggctgcggcctgtgcggggggagggctgggccgcccggggcttcggcagcctgccctgcatcctgaatgcctgcagcggagatgccaagagcaccagctgcatcaacctgtctgtgacagatgctgggggcagcgcccagaggccccggccccgggtgctgctgaaggcccccaccctggccgagatggaggagatgaacaccagcgaggaggaggagagcccctgtggggaggtgaccctgaagagggacaggagcttcagcgagcatgacctggcccagctgcggtctgaggtggccagcggcctgcagagcgccacccaccccccaggcggcacagagcccccccggccccgggccggcagcgcccacgtgtggaggcctggcagccgggaccagggcacctgcccagcctctgtgtctgaccccagccaccccctgctgagcaacagaggcagcagcggggacaggcctgaggcctccatgaccccagatgccaagcacctgtggctggagttcagccaccctgtggagagcctggccctgactgtggaggaggtgatggatgtgagaagagtgctggtgaaggccgagatggagaagttcctgcagaacaaggagctgttcagcagcctgaagaagggcaagatctgctgctgctgccgggccaagttccccctcttctcctggccacccagctgcctcttctgcaagagagctgtgtgcaccagctgcagcatcaagatgaagatgcccagcaagaagtttggccacatccctgtgtacaccctgggctttgagagcccccagagggtgtctgctgccaagacagcccccatccagaggcgggacatcttccagagcctgcagggcccccagtggcagagcgtggaggaggccttcccccacatctacagccacggctgtgtgctgaaggatgtgtgcagtgaatgtaccagctttgtggctgatgtggtgcgcagcagcaggaagtctgtggatgtgctgaacaccaccccaagaagaagccggcagacccagagcctgtacatccccaacaccaggaccctggacttcaagtag

SEQ ID NO: 20089 - DNA, 1308 bp, Artificial Sequence
  Description of Artificial Sequence: Synthetic coding sequence
atgaacttcagcgaggtgttcaagctgagcagcctgctgtgcaagttctccccagatggcaagtacctggccagctgtgtgcagtaccgcctggtggtgagagatgtgaacaccctgcagatcctgcagctgtacacctgcctggaccagatccagcacatcgagtggagcgctgacagcctcttcatcctgtgtgccatgtacaagaggggcctggtgcaggtgtggagcctggagcagcctgagtggcactgcaagattgatgagggcagcgctggcctggtggccagctgctggagcccagatggccgccacatcctgaacaccacagagttccacctgcgcatcaccgtgtggagcctgtgcaccaagtctgtgtcctacatcaagtaccccaaggcctgcctgcagggcatcaccttcaccagagatggccgctacatggccctggccgagcggcgggactgcaaggactatgtgtccatctttgtgtgcagcgactggcagctgctgcggcactttgacacagacacccaggacctgaccggcatcgagtgggccccaaatggctgtgtgctggccgtgtgggacacctgcctggagtacaagatcctgctgtacagcctggatggccgcctgctgagcacctacagcgcctatgagtggagcctgggcatcaagtctgtggcctggagccccagcagccagttcctggccgtgggcagctatgatggcaaggtgcgcatcctgaaccacgtgacctggaagatgatcacagaatttggccaccctgctgccatcaatgaccccaagatcgtggtgtacaaggaggccgagaagagcccccagctgggcctgggctgcctgtccttccccccaccccgggccggggccggccccctgcccagcagcgagagcaaatatgagatcgcctctgtgcctgtgtccctgcagaccctgaagcctgtgacagaccgggccaaccccaagattggaattggcatgctggccttctccccagacagctacttcctggccaccagaaatgacaacatccccaatgctgtgtgggtgtgggacatccagaagctgcggctgtttgctgtgctggagcagctgagccctgtgcgggccttccagtgggacccccagcagccccggctggccatctgcaccggcggcagccggctgtacctgtggagccctgctggctgcatgtctgtgcaggtgcctggagagggcaagcacatccctgaggccacagatgtggccgccctgctgtgtgctgtgtggcaccacactggatag

SEQ ID NO: 20090 - DNA, 819 bp, Artificial Sequence
  Description of Artificial Sequence: Synthetic coding sequence
atgctgcagctgcgggacagcgtggacagcgctggcaccagccccacagctgtgctggccgccggggaggaggtgggcgccggcggcggccctgggggcggccggcctggggccggcacccccctgcggcagaccctgtggcccctgagcatccatgaccccacccggcgggcccgggtgaaggagtactttgtgttccggcccggcagcattgagcaggccgtggaggagatccgggtggtggtgcggcctgtggaggatggagagatccagggcgtgtggctgctgacagaggtggaccactggaacaatgagaaggagcggctggtgctggtgacagagcagagcctgctgatctgcaagtatgacttcatcagcctgcagtgccagcaggtggtgagaattgccctgaatgctgtggacaccatctcctatggagagttccagtttcctcccaagagcctgaacaagcgggagggcttcggcatccgcatccagtgggacaagcagagccggcccagcttcatcaaccgctggaacccctggagcaccaacgtgccctatgccaccttcacagagcaccccatggccggggctgatgagaagacagccagcctgtgccagctggagagcttcaaggccctgctgatccaggccgtgaagaaggcccagaaggagagccccctgcccggccaggccaacggggtgctgatcctggagcggcccctgctgattgagacctacgtgggcctgatgtccttcatcaacaatgaggccaagctgggctacagcatgacccggggcaagattggcttctag

SEQ ID NO: 20091 - DNA, 870 bp, Artificial Sequence
  Description of Artificial Sequence: Synthetic coding sequence
atgtggcccttccccagccgcagcctcttccccccacccacccaggcctggctgcagacagtgtccagtgaccctgaggcccagggctggggcgcctggaatgagaccaaggagatcctgggccctgagggcggggagggcaaggaggagaaggaggaggaggaggatgctgaggaggaccaggatggagatgctggcttcctgctgagcctgctggagcaggagaacctggctgaatgtcccctgcctgaccaggagctggaggccatcaagatgaaggtgtgtgccatggagcaggccgagggcaccccccggcccccaggagtgcagcagcaggccgaggaggaggagggcacagctgctggccagctgctgagccctgagaccgtgggctgccccctgagcggcaccccagaggagaaggtggaggccgaccacaggtctgtgtatgtgggcaatgtggactatggaggcagcgctgaggagctggaggcccacttcagccgctgtggggaggtgcaccgggtgaccatcctgtgtgacaagttcagcggccaccccaagggctacgcctacattgaatttgccaccaagggctctgtgcaggccgctgtggagctggaccagagcctcttccggggccgggtcatcaaggtgctgcccaagaggaccaacttccctggcatcagcagcacagacagaggaggcctgcggggccaccctggcagcagaggagcccccttcccccacagcggcctgcagggccggccccggctgcggccccagggccagaacagaacaccagctgccctgacccccctgtgggcccggcccctgccctgggtggtggtgagccacgtgatcaagtag

SEQ ID NO: 20092 - DNA, 1266 bp, Artificial Sequence
  Description of Artificial Sequence: Synthetic coding sequence
atgtttgagatcctgaccagcgagttctcctaccagcacagcctgagcatcctggtggaggagttcctgcagagcaaggagctgcgggccaccgtgacccagatggagcaccaccacctgttcagcaacatcctggatgtgctgggcgccagccagcgcttctttgaggacctggagcagaggcacaaggcccaggtgctggtggaggacatcagtgacatcctggaggagcacgccgagaagcacttccacccctacatcgcctactgcagcaatgaggtgtaccagcagaggaccctgcagaagctgatcagcagcaatgctgccttccgggaggccctgcgggagattgaaagaagacctgcctgtggcggcctgcccatgctgtccttcctgatcctgcccatgcagagggtgacccggctgcccctgctgatggacaccctgtgcctgaagacccagggccacagcgagcgctacaaggccgccagccgggccctgaaggccatcagcaagctggtgcggcagtgcaatgaaggagcccacaggatggagaggatggagcagatgtacaccctgcacacccagctggacttcagcaaggtgaagagcctgcccctcatcagcgccagccgctggctgctgaagagaggagagctgttcctggtggaggagaccggcctcttcaggaagatcgccagccggcccacctgctacctgttcctgttcaatgatgtgctggtggtgaccaagaagaagtctgaggagagctacatggtgcaggactatgcccagatgaaccacatccaggtggagaagattgagcccagcgagctgcccctgcccggcggcggcaacagaagcagctctgtgccccaccccttccaggtgaccctgctgagaaattctgagggccggcaggagcagctgctgctgagcagtgacagcgccagtgaccgggcccgctggatcgtggccctgacccacagcgagcggcagtggcagggcctgagcagcaagggggacctgccccaggtggagatcaccaaggccttctttgccaagcaggctgatgaggtgaccctgcagcaggctgatgtggtgctggtgctgcagcaggaggatggctggctgtatggagagcggctgagagatggagagaccggctggttcccagaagattttgcccgcttcatcaccagccgggtggccgtggagggcaatgtgcggaggatggagcggctgcgggtggagacagatgtgtag

SEQ ID NO: 20093 - DNA, 1266 bp, Artificial Sequence; identical to SEQ ID NO: 20092
  Description of Artificial Sequence: Synthetic coding sequence

SEQ ID NO: 20094 - DNA, 2130 bp, Artificial Sequence
  Description of Artificial Sequence: Synthetic coding sequence
atggcccagaggcacagcgacagcagcctggaggagaagctgctgggccaccgcttccacagcgagctgcggctggatgctgggggcaacccagccagcggcctgcccatggtgcggggcagcccccgggtgagagatgatgctgccttccagccccaggtgcctgccccaccccagccccggcccccaggccacgaggagccctggcccatcgtgctgagcacagagagccctgctgccctgaagctgggcacccagcagctgatccccaagagcctggccgtggccagcaaggccaagaccccagcccggcaccagagctttggagctgctgtgctgagccgggaggccgcccggcgggaccccaagctgctgcctgcccccagcttcagcctggatgacatggatgtggacaaggaccccggcggcatgctgcggaggaacctgaggaaccagagctaccgggccgccatgaagggcctgggcaagccaggcggccagggagatgccatccagctgagccccaagctgcaggccctggccgaggagcccagccagccccacaccaggagccctgccaagaacaagaagaccctgggcaggaagaggggccacaagggcagcttcaaggatgacccccagctgtaccaggagatccaggagcggggcctgaacaccagccaggagagtgatgatgacatcctggatgagagcagcagccctgagggcacccagaaggtggatgccaccatcgtggtgaagagctacagacctgcccaggtgacctggagccagctgcctgaggtggtggagctgggcatcctggaccagctgagcacagaggagaggaagaggcaggaggccatgtttgagatcctgaccagcgagttctcctaccagcacagcctgagcatcctggtggaggagttcctgcagagcaaggagctgcgggccaccgtgacccagatggagcaccaccacctgttcagcaacatcctggatgtgctgggcgccagccagcgcttctttgaggacctggagcagaggcacaaggcccaggtgctggtggaggacatcagtgacatcctggaggagcacgccgagaagcacttccacccctacatcgcctactgcagcaatgaggtgtaccagcagaggaccctgcagaagctgatcagcagcaatgctgccttccgggaggccctgcgggagattgaaagaagacctgcctgtggcggcctgcccatgctgtccttcctgatcctgcccatgcagagggtgacccggctgcccctgctgatggacaccctgtgcctgaagacccagggccacagcgagcgctacaaggccgccagccgggccctgaaggccatcagcaagctggtgcggcagtgcaatgaaggagcccacaggatggagaggatggagcagatgtacaccctgcacacccagctggacttcagcaaggtgaagagcctgcccctcatcagcgccagccgctggctgctgaagagaggagagctgttcctggtggaggagaccggcctcttcaggaagatcgccagccggcccacctgctacctgttcctgttcaatgatgtgctggtggtgaccaagaagaagtctgaggagagctacatggtgcaggactatgcccagatgaaccacatccaggtggagaagattgagcccagcgagctgcccctgcccggcggcggcaacagaagcagctctgtgccccaccccttccaggtgaccctgctgagaaattctgagggccggcaggagcagctgctgctgagcagtgacagcgccagtgaccgggcccgctggatcgtggccctgacccacagcgagcggcagtggcagggcctgagcagcaagggggacctgccccaggtggagatcaccaaggccttctttgccaagcaggctgatgaggtgaccctgcagcaggctgatgtggtgctggtgctgcagcaggaggatggctggctgtatggagagcggctgagagatggagagaccggctggttcccagaagattttgcccgcttcatcaccagccgggtggccgtggagggcaatgtgcggaggatggagcggctgcgggtggagacagatgtgtag

SEQ ID NO: 20095 - DNA, 1287 bp, Artificial Sequence
  Description of Artificial Sequence: Synthetic coding sequence
atggtgtggcaggtgctggagggcctgagccaggacagcgccaagaggctgcgctttgtggccggggtcatctttgtggatgaaggagctgcctgtggccagagcctggaggagaggagcaagaccctggccgaggtgaagcccatcctgcaggccaccggcttcccctggcacgtggtggccctggaggaggtgttcagcctgcccccatctgtgctgtggtgcagcgcccaggagctggtgggcagcgagggcgcctacaaggctgctgtggacagcttcctgcagcagcagcacgtgctgggcgccggcggcggccctggccccacccagggcgaggagcagcccccccagccccccctggacccccagaacctggcccggcccccagccccagcccagacagaggccctgagccagctgttctgcagcgtgaggaccctgacagccaaggaggagctgctgcagaccctgcggacccacctgatcctgcacatggcccgggcccacggctacagcaaggtgatgactggagacagctgcacccggctggccatcaagctgatgaccaacctggccctgggccgcggggccttcctggcctgggacaccggcttcagtgatgaaagacatggagatgtggtggtggtgcggcccatgagggaccacaccctgaaggaggtggccttctacaacagactcttctctgtgcccagcgtcttcaccccagctgtggacaccaaggcccctgagaaggccagcatccaccggctgatggaggccttcatcctgcggctgcagacccagttccccagcacagtgtccacagtgtaccgcaccagcgagaagctggtgaagggccccagagatggccctgctgctggggacagcggcccccgctgcctgctgtgcatgtgtgccctggatgtggatgctgctgacagcgccacagcctttggagcccagaccagcagccggctgagccagatgcagagccccatccccctgacagagaccaggaccccacctggcccctgctgcagccctggggtgggctgggcccagagatgtggccagggcgcctgcagaagagaggacccccaggcctgcatcgaggagcagctgtgctacagctgccgggtgaacatgaaggacctgcccagcctggaccccctgcccccctacatcctggccgaggcccagctgcggacccagagggcctggggcctgcaggagatccgggactgcctgattgaagattctgatgatgaagctggccagagctag

SEQ ID NO: 20096 - DNA, 417 bp, Artificial Sequence
  Description of Artificial Sequence: Synthetic coding sequence
atgggagagcaggctgatggcaaggacagcatcgcccggcaggtggcccctgagagccactggccagagctgcgggtgctgatcctggtggtgtctgctgagaagaagctgaccggcagcacagtgggcatgagggcctctgtggagaccagccccctgctgcgcttccgggcagagagcgtggtgcctgcccatggaggagatggccccctgcaccctggggcccggctgccccagctgcggcctgctgaccacgagggccagcagcctgtgcccaggcacctgcccaggcacctgccccccagcctgacctccatgcccagccctggggccagcagcacctggtgcacagccagcacccccaccaccggcaccccccgctggaggacccccctgacccgggcccccatgccctag

SEQ ID NO: 20097 - DNA, 597 bp, Artificial Sequence
  Description of Artificial Sequence: Synthetic coding sequence
atgagcacagtggacctggcccgggtgggcgcctgcatcctgaagcatgctgtgactggagaggccgtggagctgcggagcctgtggagggagcacgcctgtgtggtggccggcctgcggcgcttcggctgtgtggtgtgccgctggatcgcccaggacctgagcagcctggccggcctgctggaccagcacggcgtgcggctggtgggcgtgggccctgaggccctgggcctgcaggagttcctggatggagactactttgctggggagctgtacctggatgagagcaagcagctgtacaaggagctgggcttcaagcgctacaacagcctgagcatcctgcctgctgccctgggcaagcctgtgagagatgtggccgccaaggccaaggctgtgggcatccagggcaacctgagcggggacctgctgcagagcggcggcctgctggtggtgtccaaaggaggagacaaggtgctgctgcactttgtgcagaagagccctggggactatgtgcccaaggagcacatcctgcaggtgctgggcatctctgctgaggtgtgtgccagtgaccccccccagtgtgaccgggaggtgtag

SEQ ID NO: 20098 - DNA, 642 bp, Artificial Sequence
  Description of Artificial Sequence: Synthetic coding sequence
tgaagccgggagcggggcagccgctctgaggagcccggggccggcaaccgggagagcggcagccgggagcccggcctggccgctgctgccatgagcacagtggacctggcccgggtgggcgcctgcatcctgaagcatgctgtgactggagaggccgtggagctgcggagcctgtggagggagcacgcctgtgtggtggccggcctgcggcgcttcggctgtgtggtgtgccgctggatcgcccaggacctgagcagcctggccggcctgctggaccagcacggcgtgcggctggtgggcgtgggccctgaggccctgggcctgcaggagttcctggatggagactactttgctggggagctgtacctggatgagagcaagcagctgtacaaggagctgggcttcaagcgctacaacagcctgagcatcctgcctgctgccctgggcaagcctgtgagagatgtggccgccaaggccaaggctgtgggcatccagggcaacctgagcggggacctgctgcagagcggcggcctgctggtggtgtccaaggaggtgccccggcggctgcggccccagggcgcccaccctgctggccctggccacctgtgtggcggcctgtgccagaggcctgcctctgtgtag

SEQ ID NO: 20099 - DNA, 2553 bp, Artificial Sequence
  Description of Artificial Sequence: Synthetic coding sequence
atggccgaggtggaggccgtgcagctgaaggaggagggcaacagacacttccagctgcaggactacaaggccgccaccaacagctacagccaggccctgaagctgaccaaggacaaggccctgctggccaccctgtacagaaacagagctgcctgtggcctgaagacagagagctatgtgcaggccgccagtgatgccagccgggccatcgacatcaacagcagtgacatcaaggccctgtaccgccgctgccaggccctggagcacctgggcaagctggaccaggccttcaaggatgtgcagagatgtgccaccctggagcccaggaaccagaacttccaggagatgctgcggcggctgaacaccagcatccaggagaagctgcgggtgcagttcagcacagacagccgggtgcagaagatgtttgagatcctgctggatgagaacagcgaggccgacaagcgggagaaggccgccaacaacctgattgtgctgggccgggaggaggccggggctgagaagatcttccagaacaatggagtggccctgctgctgcagctgctggacaccaagaagccagagctggtgctggccgctgtgaggaccctgagcggcatgtgcagcggccaccaggcccgggccaccgtcatcctgcatgctgtgagaattgaccgcatctgcagcctgatggctgtggagaatgaggagatgagcctggccgtgtgcaacctgctgcaggccatcatcgacagcctgtctggagaggacaagcgggagcaccggggcaaggaggaggccctggtgctggacaccaagaaggacctgaagcagatcaccagccacctgctggacatgctggtgtccaagaaggtgtctggccagggccgggaccaggccctgaacctgctgaacaagaatgtgcccaggaaggacctggccatccatgacaacagcaggaccatctacgtggtggacaatggcctgaggaagatcctgaaggtggtgggccaggtgcctgacctgcccagctgcctgcccctgacagacaacaccaggatgctggccagcatcctgatcaacaagctgtatgatgacctgcgctgtgaccctgagcgggaccacttcaggaagatctgtgaggagtacatcaccgggaagtttgacccccaggacatggacaagaacctgaatgccatccagacagtgtctggcatcctgcagggcccctttgacctgggcaaccagctgctgggcctgaagggcgtgatggagatgatggtggccctgtgtggcagcgagcgggagacagaccagctggtggccgtggaggccctgattcatgccagcaccaagctgagccgggccaccttcatcatcaccaatggagtgtccctgctgaagcagatctacaagaccaccaagaatgagaagatcaagatccgcaccctggtgaccagtgacaagaccatcctgtacagcgtggccaccaccctggtgaactgcaccaacagctatgatgtgaaggaggtgattcctgagctggtgcagctggccaagttcagcaagcagcacgtgcctgaggagcaccccaaggacaagaaggacttcatcgacatgagggtgaagaggctgctgaaggccggggtcatcagcgccctggcctgcatggtgaaggctgacagcgccatcctgacagaccagaccaaggagctgctggcccgggtcttcctggccctgtgtgacaaccccaaggaccggggcaccatcgtggcccagggcggcggcaaggccctgatccccctggccctggagggcacagatgtgggcaaggtgaaggccgcccacgccctggccaagattgctgctgtgagcaacccagacatcgccttccctggagagcgggtgtatgaggtggtgcggcccctggtgcggctgctggacacccagagagatggcctgcagaactatgaggccctgctgggcctgaccaacctgagcggccgcagtgacaagctgcggcagaagatcttcaaggagcgggccctgcctgacatcgagaactacatgtttgaaaatcatgaccagctgcggcaggccgccacagagtgcatgtgcaacatggtgctgcacaaggaggtgcaggagcgcttcctggctgatggaaatgaccggctgaagctggtggtgctgctgtgtggggaggatgatgacaaggtgcagaatgctgctgctggggccctggccatgctgacagctgcccacaagaagctgtgcctgaagatgacccaggtgaccacccagtggctggagatcctgcagaggctgtgcctgcatgaccagctgtctgtgcagcaccggggcctggtgattgcctacaacctgctggccgcagatgctgagctggccaagaagctggtggagagcgagctgctggagatcctgactgtggtgggcaagcaggagccagatgagaagaaggccgaggtggtgcagacagccagagaatgtctcatcaagtgcatggactatggcttcatcaagcctgtgtcctag

SEQ ID NO: 20100 - DNA, 552 bp, Artificial Sequence; identical to SEQ ID NO: 19200
  Description of Artificial Sequence: Synthetic coding sequence

SEQ ID NO: 20101 - DNA, 366 bp, Artificial Sequence
  Description of Artificial Sequence: Synthetic coding sequence
atgttcaacaagtgcagcttccacagcagcatctacagacctgctgctgacaacagcgccagcagcctgtgtgccatcatctgcttcctgaacctggtgattgaatgtgacctggagaccaacagcgagatcaacaagctgatcatctacctgttcagccagaacaaccgcatccgcttcagcaagctgctgctgaagatcctcttctacatcagcatcttctcctacccagagctgatgtgtgagcagtatgtgaccttcatcaagccaggcatccactacggccaggtgtccaagaagcacatcatctacagcaccttcctgagcaagaacttcaagttccagctgctgcgggtgtgctggtag

SEQ ID NO: 20102 - DNA, 972 bp, Artificial Sequence
  Description of Artificial Sequence: Synthetic coding sequence
atggagagccgggtggctgatgctggcaccggggagacagcccgggctgctgggggcagccctgctgtgggctgcaccacccggggccctgtggtgtctgcccccctgggcgccgcccgctggaagctgctgcggcaggtgctgaagcagaagcacctggatgactgcctgcggcacgtgtctgtgagaagatttgagagcttcaacctcttctctgtgacagagggcaaggagcgggagacagaggaggaggtgggcgcctgggtgcagtacaccagcatcttctgcccagagtacagcatcagcctgcggcacaacagcggcagcctgaatgtggaggatgtgctgaccagctttgacaacacaggaaatgtgtgcatctggcccagcgaggaggtgctggcctactactgcctgaagcacaacaacatcttccgggccctggccgtgtgtgagctgggcggcggcatgacctgcctggccggcctgatggtggccatctctgcagatgtgaaggaggtgctgctgacagatggaaatgagaaggccatcagaaatgtgcaggacatcatcaccaggaaccagaaggccggggtcttcaagacccagaagatcagcagctgtgtgctgcgctgggacaatgaaacagatgtgtcccagctggagggccactttgatattgtgatgtgtgccgactgcctcttcctggaccagtaccgggccagcctggtggatgccatcaagaggctgctgcagccccggggcaaggccatggtgtttgccccccggcggggcaacaccctgaaccagttctgcaacctggccgagaaggccggcttctgcatccagagacatgagaactatgatgagcacatcagcaacttccacagcaagctgaagaaggagaacccagacatctatgaggagaacctgcactaccccctgctgctgatcctgaccaagcacggctag

SEQ ID NO: 20103 - DNA, 3120 bp, Artificial Sequence; identical to SEQ ID NO: 19482
  Description of Artificial Sequence: Synthetic coding sequence

SEQ ID NO: 20104 - DNA, 390 bp, Artificial Sequence
  Description of Artificial Sequence: Synthetic coding sequence
atgtaccggcagcgcttcctgtacagcctgtaccgccacacccactgggtgcgctgtgccaagttctccccagatggccgcctgattgtgtcctgcagcgaggacaagaccatcaagatctgggacaccaccaacaagcagtgtgtgaacaacttcagtgacagcgtgggggacctgagcctgctcttccacttccagaaggtggagagctacctgcaccaggaggtgcagacccacaggagctactatggaggcctgaccctgatgaactgcatcgtgaaggtgctgcccaaggagatcagcaaggactacatcctgatccaccaccacatcttcctgatcagcacccaggagcaccacatccccatgaggaagaagctgcggctgtag

SEQ ID NO: 20105 - DNA, 2178 bp, Artificial Sequence
  Description of Artificial Sequence: Synthetic coding sequence
atgcaccctgagcccagcgagcccgccaccggcggcgctgctgagctggactgtgcccaggagcccggggtggaggagagcgctggggaccacggcagcgctggccggggcggctgcaaggaggagatcaatgaccccaaggagatctgtgtgggcagcagtgacaccagctaccacagccagcagaagcagagcggggacaatggcagcggcggccactttgcccaccccagagaagatcgggaggaccggggccccaggatgaccaagagcagcctgcagaagctgtgcaagcagcacaagctgtacatcaccccagccctgaatgacaccctgtacctgcacttcaagggctttgacagaattgagaacctggaggagtacacaggcctgcgctgcctgtggctgcagagcaatggcatccagaagattgagaacctggaggcccagacagagctgcgctgcctcttcctgcagatgaacctgctgaggaagattgagaacctggagcccctgcagaagctggatgccctgaacctgagcaacaactacatcaagaccatcgagaacctgagctgcctgcctgtgctgaacaccctgcagatggcccacaaccacctggagaccgtggaggacatccagcacctgcaggagtgcctgcggctgtgtgtgctggacctgagccacaacaagctgagtgaccctgagatcctgagcatcctggagagcatgccagacctgcgggtgctgaacctgatgggcaaccctgtgatccggcagatccccaactacagaagaacagtgacagtgcggctgaagcacctgacctacctggatgacaggcctgtgttccccaaggaccgggcctgtgccgaggcctgggcccggggcggctacgccgctgagaaggaggagcggcagcagtgggagagccgggagaggaagaagatcacagacagcattgaggccctggccatgatcaagcagagagctgaggagaggaagaggcagcgggagagccaggagcggggggagatgaccagcagtgatgatggagaaaatgtgcctgccagcgctgagggcaaggaggagcccccaggggaccgggagacccggcagaagatggagctgtttgtgaaggagagctttgaggccaaggatgagctgtgcccagagaagcccagcggggaggagccccctgtggaggccaagcgggaggatggcggccctgagcctgagggcaccctgcctgctgagaccctgctgctgagcagccctgtggaggtgaagggggaggatggagatggagagcctgagggcaccctgcctgctgaggcccctcctcctcctcctcctgtggaggtgaagggggaggatggagaccaggagcctgagggcaccctgcctgctgagaccctgctgctgagcccccctgtgaaggtgaagggggaggatggagaccgggagcctgagggcaccctgcctgctgaggcccctcctcctccacccctgggcgccgcccgggaggagcccaccccccaggccgtggccacagagggcgtgtttgtgacagagctggatggcaccaggacagaggacctggagaccatccggctggagaccaaggagaccttctgcattgatgacctgcctgacctggaggatgatgatgaaacaggcaagagcctggaggaccagaacatgtgcttccccaagattgaagtcatcagcagcctgagtgatgacagcgaccctgagctggactacaccagcctgcctgtgctggagaacctgcccacagacaccctgagcaacatctttgctgtgtccaaggacaccagcaaggccgcccgggtgcccttcacagacatcttcaagaaggaggccaagagggacctggagatcaggaagcaggacaccaagagcccccggcccctcatccaggagctgagtgatgaggaccccagcggccagctgctgatgccacccacctgccagagagatgctgcccccctgaccagcagcggggaccgggacagcgacttcctggccgccagcagccctgtgcccacagaatctgctgccaccccacctgagacctgtgtgggcgtggcccagcccagccaggccctgcccacctgggacctgacagccttccctgcccccaaggccagctag

SEQ ID NO: 20106 - DNA, 957 bp, Artificial Sequence
  Description of Artificial Sequence: Synthetic coding sequence
tgaggcatcaatggaagtgaaggagatggagctgagattgctgagaagtttgtgttcttcatcggcagcaagaatggaggcaagaccaccatcatcctgcgctgcctggacagagatgagccccccaagcccaccctggccctggagtacacctacggccggcgggccaagggccacaacacccccaaggacatcgcccacttctgggagctgggcggcggcaccagcctgctggacctgatcagcatccccatcaccggggacaccctgcggaccttcagcctggtgctggtgctggacctgagcaagcccaatgacctgtggcccaccatggagaacctgctgcaggccaccaagagccacgtggacaaggtgatcatgaagctgggcaagaccaatgccaaggctgtgtctgagatgaggcagaagatctggaacaacatgcccaaggaccacccagaccacgagctgattgaccccttccctgtgcccctggtgatcatcggcagcaaatatgatgtgttccaggactttgagagcgagaagaggaaggtgatctgcaagaccctgcgctttgtggcccactactatggagccagcctgatgttcaccagcaagtctgaggccctgctgctgaagatccggggcgtcatcaaccagctggcctttggaattgacaagagcaagagcatctgtgtggaccagaacaagcccctcttcatcacagctggcctggacagctttggccagatcggcagcccccctgtgcctgaaaatgacatcggcaagctgcacgcccacagccccatggagctgtggaagaaggtgtatgagaagctgttcccccccaagagcatcaacaccctgaaggacatcaaggaccctgcccgggacccccagtatgcagaaaatgaggtggatgagatgaggatccagaaggacctggtgctgtcctag

SEQ ID NO: 20107 - DNA, 2559 bp, Artificial Sequence
  Description of Artificial Sequence: Synthetic coding sequence
atggaggccctgggccctggaggagaccgggccagccctgccagcagcaccagcagcctggacctgtggcacctgtccatgagagctgacagcgcctacagcagcttctctgctgccagcggcggccctgagcccaggacccagagccctggaacagacctgctgccctacctggactgggactatgtgcgggtggtgtggggcggccctggccctgcccccccagatgctgccctgtgcaccagcccccggcccaggcctgctgtggccgcccggagcggcccccagcccacagaggtgcccggcaccccaggccccctgaaccggcaggccacccccctgctgtatgccctggccgctgaggccgaggccgccgcccaggccgctgagccccccagccccccagccagcagagctgcctaccggcagaggctgcagggcgcccagaggagagtgctgcgggagaccagcttccagaggaaggagctgaggatgagcctgcctgcccggctgcggcccaccgtgcctgcccggcccccagccacccaccccaggtctgccagcctgagccaccctggaggagagggggagcccgcccggagccgggccccagcccctggaacagctggccggggccccctggccaaccagcagaggaagtggtgcttcagcgagcccgggaagctggacagagtgggccggggcggcggccctgccagagaatgtctgggggaggcctgcagcagcagcggcctgcccggccctgagcccctggagttccagcacccagccctggccaagtttgaagatcatgaggtgggctggctgcctgagacccagccccagggctccatgaacctggacagcggcagcctgaagctgggagatgccttccggcctgccagccgcagccgcagcgccagcggggaggtgctgggctcctggggcggcagcggcggcaccatccccatcgtgcaggccgtgccccagggcgctgagaccccccggcccctcttccagaccaagctgagccgcttcctgccccagaaggaggccgctgtgatgtacccagctgagctgccccagagcagccctgctgacagcgagcagagggtgtctgagacctgcatcgtgcctgcctggctgcccagcctgcctgatgaggtgttcctggaggaggcccccctggtgaggatgaggagccccccagacccccacgccagccagggccccccagcctctgtgcacgccagtgaccagccctacggcaccggcctgggccagaggacaggccaggtgacagtgcccacagagtaccccctgcatgaatgtcctggaacagctggagcagatgactgctggcagggcgtgaatggatctgtgggcatcagccggcccaccagccacacccccaccggcacagccaatgacaacatccccaccatcgaccccaccggcctgaccaccaaccccccaacagctgctgagagtgacctgctgaagcctgtgcctgcagatgccctgggcctgtctggaaatgacaccccaggccccagccacaacacagccctggcccggggcaccggccagcccggcagccggcccacctggcccagccagtgcctggaggagctggtgcaggagctggcccggctggaccccagcctgtgtgaccccctggccagccagcccagccctgagccccccctgggcctgctggatggcctcatccccctggccgaggtgcgggccgccatgaggcctgcctgtggggaggccggggaggaggccgccagcacctttgagcccggcagctaccagttctccttcacccagctgctgcctgccccccgggaggagacccggctggagaacccagccacccaccctgtgctggaccagccctgtggccagggcctgcctgcccccaacaacagcatccagggcaagaaggtggagctggccgcccggctgcagaagatgctgcaggacctgcacacagagcaggagcggctgcagggcgaggcccaggcctgggcccggcggcaggccgccctggaggccgctgtgcggcaggcctgtgccccccaggagctggagcgcttcagccgcttcatggctgacctggagcgggtgctgggcctgctgctgctgctgggcagccggctggcccgggtgagaagagccctggcccgggccgccagtgacagcgaccctgatgagcaggccagcctgctgcagaggctgcggctgctgcagaggcaggaggaggatgccaaggagctgaaggagcacgtggcccggcgggagagagctgtgcgggaggtgctggtgcgggccctgcctgtggaggagctgcgggtgtactgtgccctgctggccggcaaggctgctgtgctggcccagcagaggaacctggatgagcgcatccggctgctgcaggaccagctggatgccatcagagatgacctgggccaccacgcccccagccccagccctgcccggcccccaggcacctgcccccctgtgcagccccccttccccctgctgctgacctag

SEQ ID NO: 20108 - DNA, 1776 bp, Artificial Sequence
  Description of Artificial Sequence: Synthetic coding sequence
atggcccagggctctgtgtccttcaatgatgtgacagtggacttcacccaggaggagtggcagcacctggaccacgcccagaagaccctgtacatggatgtgatgctggagaactactgccacctgatctctgtgggctgccacatgaccaagccagatgtgatcctgaagctggagcggggggaggagccctggaccagctttgctggccacacctgcctggaggagaactggaaggccgaggacttcctggtgaagttcaaggagcaccaggagaagtacagccgctctgtggtgtccatcaaccacaagaagctggtgaaggagaagagcaagatctatgagaagaccttcaccctgggcaagaaccctgtgaacagcaagaacctgcccccagaatatgacacccacggccgcatcctgaagaatgtgtctgagctgatcatcagcaacctgaacccagccaggaagaggctgtctgagtacaacggctacggcaagagcctgctgagcaccaagcaggagaccacccaccctgaggtgaagagccacaaccagagcgcccgggccttcagccacaatgaggtgctgatgcagtaccagaagacagagaccccagcccagagctttggctacaatgactgtgagaagagcttcctgcagagaggaggcctcatcacccacagccggccctacaagggggagaaccccagcgtgtacaacaagaagaggcgggccaccaacatcgagaagaagcacacctgcaatgaatgtgggaagagcttctgcaggaagtctgtgctgatcctgcaccagggcatccacagcgaggagaagccctaccagtgccaccagtgtggaaatgccttccggaggaagagctacctgattgaccaccagaggacccacactggagagaagccctatgagtgcaatgactgtgggaagagcttccggcagaagaccaccctgagcctgcaccagaggatccacactggagagaagccctacatctgcaaggaatgtgggaagagcttccaccagaaggccaacctgactgtgcaccagaggacccacactggagagaagccctacatctgcaatgaatgtgggaagagcttcagccagaagaccaccctggccctgcacgagaagacccacaatgaggagaagccctacatctgcagtgaatgtgggaagagcttccggcagaagaccaccctggtggcccaccagaggacccacactggagagaagagctatgagtgcccccactgtgggaaggccttcaggatgaagagctacctgattgaccaccacaggacccacactggagagaagccctatgagtgcaatgaatgtgggaagagcttcagccagaagaccaacctgaacctgcaccagaggatccacactggagagaagccctacgtgtgcaatgaatgtgggaagagcttccggcagaaggccaccctgactgtgcaccagaagatccacacaggccagaagagctatgagtgcccccagtgtgggaaggccttcagcaggaagagctacctgatccaccaccagaggacccacactggagagaagccctacaagtgcagtgaatgtgggaagtgcttccggcagaagaccaacctgattgtgcaccagaggacccacactggagagaagccctacgtgtgcaatgaatgtgggaagagcttctcctacaagaggaacctgattgtgcaccagaggacccacaagggggagaacatcgagatgcagtag

SEQ ID NO: 20109 - DNA, 2934 bp, Artificial Sequence
  Description of Artificial Sequence: Synthetic coding sequence
atgggctggaagcccagcgaggcccggggccagagccagagcttccaggccagcggcctgcagcccaggagcctgaaggccgcccggcgggccaccggccgcccagacaggagccgggccgcccggcccaccatggaccccagcgcccacaggagccgggccgccccacccaacatggaccctgacccccaggccggcgtgcaggtgggcatgagggtggtgcggggcgtggactggaagtggggccagcaggatggaggagagggcggcgtgggcaccgtggtggagctgggccgccacggcagccccagcaccccagacagaacagtggtggtgcagtgggaccagggcaccaggaccaactaccgggccggctaccagggcgcccatgacctgctgctgtatgacaatgcccagatcggcgtgcgccaccccaacatcatctgtgactgctgcaagaagcacggcctgcggggcatgcgctggaagtgccgggtgtgcctggactatgacctgtgcacccagtgctacatgcacaacaagcatgagctggcccacgcctttgacagatatgaaacagcccacagcaggcctgtgaccctgagcccccggcagggcctgccccgcatccccctgcggggcatcttccagggcgccaaggtggtgcggggccctgactgggagtggggcagccaggatggaggagagggcaagccaggccgggtggtggacatccggggctgggatgtggagaccggccgctctgtggcctctgtgacctgggcagatggcaccaccaacgtgtacagagtgggccacaagggcaaggtggacctgaagtgtgtgggggaggccgccggcggcttctactacaaggaccacctgccccggctgggcaagccagctgagctgcagaggagagtgtctgctgacagccagcccttccagcacggggacaaggtgaagtgcctgctggacacagatgtgctgcgggagatgcaggagggccatggaggctggaaccccaggatggccgagcaccacagcttctgggtgggagatgtggtgcgggtgattggagacctggacacagtgaagaggctgcaggccggccacggggagtggacagatgacatggccccagccctgggccgggtgggcaaggtggtgaaggtgtttggagatggcaacctgcgggtggccgtggccggccagcgctggaccttcagccccagctgcctggtggcctacagaccagaagaagatgccaacctggatgtggccgagcgggcccgggagaacaagagcagcctgtctgtggccctggacaagctgcgggcccagaagagtgaccctgagcaccctggccgcctggtggtggaggtggccctgggcaatgctgcccgggccctggacctgctgcggcggcggcctgagcaggtggacaccaagaaccagggccgcacagccctgcaggtggccgcctacctgggccaggtggagctgatccggctgctgctgcaggcccgggccggcgtggacctgcctgatgatgagggcaacacagccctgcactatgctgccctgggcaaccagcctgaggccaccagggtgctgctgtctgctggctgcagagcagatgccatcaacagcacccagagcacagccctgcacgtggccgtgcagaggggcttcctggaggtggtgcgggccctgtgtgagcggggctgtgatgtgaacctgcctgatgcccacagcgacacccccctgcacagcgccatctctgctggcaccggggccagcggcatcgtggaggtgctgacagaggtgcccaacattgatgtgacagccaccaacagccagggcttcaccctgctgcaccacgccagcctgaagggccacgccctggccgtgaggaagatcctggcccgggcccggcagctggtggatgccaagaaggaggatggcttcaccgccctgcacctggccgccctgaacaaccaccgggaggtggcccagatcctgatccgggagggccgctgtgatgtgaatgtgaggaacaggaagctgcagagccccctgcacctggccgtgcagcaggcccacgtgggcctggtgcccctgctggtggatgctggctgcagcgtgaatgcagaagatgaggagggggacacagccctgcacgtggccctgcagaggcaccagctgctgcccctggtggctgatggagctggaggagaccccggccccctgcagctgctgagccggctgcaggccagcggcctgcccggcagcgctgagctgactgtgggcgctgctgtggcctgcttcctggccctggagggcgcagatgtgtcctacaccaaccaccggggccgcagccccctggacctggccgctgagggccgggtgctgaaggccctgcagggctgtgcccagcgcttccgggagcggcaggccggcggcggggccgcccctggcccccggcagaccctgggcacccccaacacagtgaccaacctgcacgtgggcgccgcccctggccctgaggccgcagaatgtctggtgtgcagcgagctggccctgctggtgctcttcagcccctgccagcacaggacagtgtgtgaagaatgtgcccggaggatgaagaagtgcatccgctgccaggtggtggtgtccaagaagctgcggccagatggcagcgaggtggccagcgctgccccagcccctggccccccccggcagctggtggaggagctgcagagccgctaccggcagatggaggagcgcatcacctgccccatctgcatcgacagccacatccggctggtgttccagtgtggccatggagcctgtgccccctgtggcagcgccctgagcgcctgccccatctgccggcagcccatccgggaccgcatccagatctttgtgtag

SEQ ID NO: 20110 - DNA, 2262 bp, Artificial Sequence
  Description of Artificial Sequence: Synthetic coding sequence
atggaccctgacccccaggccggcgtgcaggtgggcatgagggtggtgcggggcgtggactggaagtggggccagcaggatggaggagagggcggcgtgggcaccgtggtggagctgggccgccacggcagccccagcaccccagacagaacagtggtggtgcagtgggaccagggcaccaggaccaactaccgggccggctaccagggcgcccatgacctgctgctgtatgacaatgcccagatcggcgtgcgccaccccaacatcatctgtgactgctgcaagaagcacggcctgcggggcatgcgctggaagtgccgggtgtgcctggactatgacctgtgcacccagtgctacatgcacaacaagcatgagctggcccacgcctttgacagatatgaaacagcccacagcaggcctgtgaccctgagcccccggcagggcctgccccgcatccccctgcggggcatcttccagggcgccaaggtggtgcggggccctgactgggagtggggcagccaggacggcaagccagctgagctgcagaggagagtgtctgctgacagccagcccttccagcacggggacaaggtgaagtgcctgctggacacagatgtgctgcgggagatgcaggagggccacggcggctggaaccccaggatggccgagttcatcggccagacaggcaccgtgcaccgcatcacagacagaggagatgtgcgggtgcagttcaaccacgagacccgctggaccttccaccctggggccctgaccaagcaccacagcttctgggtgggagatgtggtgcgggtcatcggggacctggacacagtgaagaggctgcaggccggccatggagagtggacagatgacatggccccagccctgggccgggtgggcaaggtggtgaaggtgtttggagatggcaacctgcgggtggccgtggccggccagcgctggaccttcagccccagctgcctggtggcctacagacctgaggaggatgccaacctggatgtggccgagcgggcccgggagaacaagagcagcctgtctgtggccctggacaagctgcgggcccagaagagtgaccctgagcaccctggccgcctggtggtggaggtggccctgggcaatgctgcccgggccctggacctgctgcggcggcggcctgagcaggtggacaccaagaaccagggccgcacagccctgcaggtggccgcctacctgggccaggtggagctgatccggctgctgctgcaggcccgggccggcgtggacctgcctgatgatgagggcaacacagccctgcactacgccgccctgggcaaccagcctgaggccaccagggtgctgctgtctgctggctgcagagcagatgccatcaacagcacccagagcacagccctgcacgtggccgtgcagaggggcttcctggaggtggtgcgggccctgtgtgagcggggctgtgatgtgaacctgcctgatgcccacagcgacacccccctgcacagcgccatctctgctggcactggagccagcggcatcgtggaggtgctgacagaggtgcccaacattgatgtgacagccaccaacagccagggcttcaccctgctgcaccacgccagcctgaagggccacgccctggccgtgaggaagatcctggcccgggcccggcagctggtggatgccaagaaggaggatggcttcaccgccctgcacctggccgccctgaacaaccaccgggaggtggcccagatcctgatccgggagggccgctgtgatgtgaatgtgaggaacaggaagctgcagagccccctgcacctggccgtgcagcaggcccacgtgggcctggtgcccctgctggtggatgctggctgcagcgtgaatgcagaagatgaggagggggacacagccctgcacgtggccctgcagaggcaccagctgctgcccctggtggctgatggagctggaggagaccccggccccctgcagctgctgagccggctgcaggccagcggcctgcccggcagcgctgagctgactgtgggcgctgctgtggcctgcttcctggccctggagggcgcagatgtgtcctacaccaaccaccggggccgcagccccctggacctggccgctgagggccgggtgctgaaggccctgcagggctgtgcccagcgcttccgggtgcgggcccaggatgaggaggtgcaccaggtgcctgggggccggcagcaggagacagccccccggcggctgtag

SEQ ID NO: 20111 - DNA, 1161 bp, Artificial Sequence
  Description of Artificial Sequence: Synthetic coding sequence
atgggcaaggactactacaagatcctgggcatccccagcggggccaatgaagatgagatcaagaaggcctacaggaagatggccctgaagtaccacccagacaagaacaaggagcccaatgctgaggagaagttcaaggagattgctgaggcctatgatgtgctgagtgaccccaagaagaggggcctgtatgaccagtatggagaggagggcctgaagacaggaggcggcaccagcggcggcagcagcggcagcttccactacaccttccatggagacccccacgccacctttgccagcttcttcggcggcagcaacccctttgacatcttctttgccagcagccgcagcacccggcccttcagcggctttgatcctgatgacatggatgtggatgaagatgaggacccctttggagccttcggccgcttcggcttcaacggcctgagccggggcccccggcgggcccctgagcccctgtaccccaggaggaaggtgcaggacccccctgtggtgcatgagctgcgggtgtccctggaggagatctaccacggcagcaccaagaggatgaagatcacccggcggcggctgaacccagatggccgcacagtgaggacagaggacaagatcctgcacatcgtcatcaagaggggctggaaggagggcaccaagatcaccttccccaaggagggagatgccaccccagacaacatcccagctgacatcgtgtttgtgctgaaggacaagccccacgcccacttcagaagagatggcaccaacgtgctgtacagcgccctgatcagcctgaaggaggccctgtgtggctgcaccgtgaacatccccaccattgatggccgggtcatccccctgccctgcaatgatgtgatcaagccaggcaccgtgaagaggctgcggggggagggcctgcccttccccaaggtgcccacccagagaggagacctgattgtggagttcaaggtgcgcttcccagaccggctgaccccccagacccggcagatcctgaagcagcagtacccccagcacagcctgcacagcatgtgcacccagctggatgtgcactggaccctggccaccttcagcaagatgcagaagaaggccaccggcttccaggagaatgtgcctgtgcctgaccccttctag

SEQ ID NO: 20112 - DNA, 1008 bp, Artificial Sequence
  Description of Artificial Sequence: Synthetic coding sequence
atgctgggcagcggcttcaaggccgagcggctgcgggtgaacctgcggctggtgatcaaccggctgaagctgctggagaagaagaagacagagctggcccagaaggccaggaaggagattgctgactacctggccgccggcaaggatgagcgggcccgcatccgggtggagcacatcatccgggaggactacctggtggaggccatggagatcctggagctgtactgtgacctgctgctggccaggtttggcctcatccagagcatgaaggagctggacagcggcctggccgagagcgtgtccaccctcatctgggccgccccccggctgcagagcgaggtggccgagctgaagatcgtggccgaccagctgtgtgccaagtacagcaaggagtatggcaagctgtgcaggaccaaccagattggaacagtgaatgaccggctgatgcacaagctgtctgtggaggccccacccaagatcctggtggagcgctacctgattgaaattgccaagaactacaacgtgccctatgagccagattctgtggtgatggccgaggcccctcctggggtggagacagacctgattgatgtgggcttcacagatgatgtgaagaagggcggccctggccggggcggcagcggcggcttcaccgcccctgtgggcggcccagatggcaccgtgcccatgcccatgcccatgcccatgcccatgcccagcgccaacacccccttctcctaccccctgcccaagggccctgtggatgacatcaatgctgacaagaacatcagcagcgcccagatcgtgggccctggccccaagccagaggccagcgccaagctgcccagcaggcctgctgacaactatgacaactttgtgctgcctgagctgcccagcgtgcctgacaccctgcccacagccagcgctggggccagcaccagcgcctctgaagatattgactttgatgacctgagccgccgctttgaggagctgaagaagaagacctag

SEQ ID NO: 20113 - DNA, 1101 bp, Artificial Sequence
  Description of Artificial Sequence: Synthetic coding sequence
atgctgggcagcggcttcaaggccgagcggctgcgggtgaacctgcggctggtgatcaaccggctgaagctgctggagaagaagaagacagagctggcccagaaggccaggaaggagattgctgactacctggccgccggcaaggatgagcgggcccgcatccgggtggagcacatcatccgggaggactacctggtggaggccatggagatcctggagctgtactgtgacctgctgctggccaggtttggcctcatccagagcatgaaggagctggacagcggcctggccgagagcgtgtccaccctcatctgggccgccccccggctgcagagcgaggtggccgagctgaagatcgtggccgaccagctgtgtgccaagtacagcaaggagtatggcaagctgtgcaggaccaaccagattggaacagtgaatgaccggctgatgcacaagctgtctgtggaggccccacccaagatcctggtggagcgctacctgattgaaattgccaagaactacaacgtgccctatgagccagattctgtggtgatggccgaggcccctcctggggtggagacagacctgattgatgtgggcttcacagatgatgtgaagaagggcggccctggccggggcggcagcggcggcttcaccgcccctgtgggcggcccagatggcaccgtgcccatgcccatgcccatgcccatgcccatgcccagcgccaacacccccttctcctaccccctgcccaagggccccagcgacttcaacggcctgcccatgggcacctaccaggccttccccaacatccaccccccccagatcccagccaccccacccagctatgagagcgtggatgacatcaatgctgacaagaacatcagcagcgcccagatcgtgggccctggccccaagccagaggccagcgccaagctgcccagcaggcctgctgacaactatgacaactttgtgctgcctgagctgcccagcgtgcctgacaccctgcccacagccagcgctggggccagcaccagcgccagcgaggacatcgactttgatgacctgagcagaagatttgaggagctgaagaagaagacctag

SEQ ID NO: 20114 - DNA, 948 bp, Artificial Sequence
  Description of Artificial Sequence: Synthetic coding sequence
atggagaagtatgagaagctggccaagacaggagagggcagctatggagtggtgttcaagtgcaggaacaagaccagcggccaggtggtggccgtgaagaagtttgtggagagtgaagatgatcctgtggtgaagaagatcgccctgcgggagatccgcatgctgaagcagctgaagcaccccaacctggtgaacctgattgaggtgttccggaggaagaggaagatgcacctggtgtttgagtactgtgaccacaccctgctgaatgagctggagaggaaccccaacggggtggctgatggagtcatcaagtctgtgctgtggcagaccctgcaggccctgaacttctgccacatccacaactgcatccaccgggacatcaagccagagaacatcctgatcaccaagcagggcatcatcaagatctgtgactttggatttgcccagatcctgatccctggagatgcctacacagattatgtggccacccgctggtaccgggcccctgagctgctggtgggggacacccagtatggcagctctgtggacatctgggccatcggctgtgtgtttgctgagctgctgaccggccagcccctgtggccaggcaagagtgatgtggaccagctgtacctgatcatccgcaccctgggcaagctgatccccaggcaccagagcatcttcaagagcaatggcttcttccacggcatcagcatccctgagcctgaggacatggagaccctggaggagaagttcagtgatgtgcaccctgtggccctgaacttcatgaagggctgcctgaagatgaacccagatgaccggctgacctgcagccagctgctggagagcagctactttgacagcttccaggaggcccagatcaagaggaaggccagaaatgaaggaagaaacagaagacggcagcaggtgctgcccctgaagagctag

SEQ ID NO: 20115 - DNA, 948 bp, Artificial Sequence
  Description of Artificial Sequence: Synthetic coding sequence
atggccaatgaccccctggagggcttccacgaggtgaacctggccagccccaccagcccagacctgctgggcgtgtatgagagcggcacccaggagcagaccaccagccccagcgtcatctaccggccccaccccagcgccctgagctctgtgcccatccaggccaatgccctggatgtgtctgagctgcccacccagcctgtgtacagcagcccccggcggctgaactgtgccgagatcagcagcatctccttccacgtgacagatcctgccccctgcagcaccagcggcgtgacagctggcctgaccaagctgaccaccaggaaggacaactacaatgctgagcgggagttcctgcagggcgccaccatcacagaggcctgtgatggcagtgatgacatcttcggcctgagcacagacagcctgagccggctgcggagccccagcgtgctggaggtgcgggagaagggctatgaaaggctgaaggaggagctggccaaggcccagcgggagctgaagctgaaggatgaggagtgtgagcggctgagcaaggtgcgggaccagctgggccaggagctggaggagctgacagccagcctgtttgaggaggcccacaagatggtgcgggaggccaacatcaagcaggccacagctgagaagcagctgaaggaggcccagggcaagattgatgtgctgcaggccgaggtggccgccctgaagaccctggtgctgagcagcagccccaccagccccacccaggagcccctgcccggcggcaagacccccttcaagaagggccacaccaggaacaagagcaccagcagcgccatgagcggcagccaccaggacctgagcgtcatccagcccatcgtgaaggactgcaaggaggtgacccaccagggcctgagccccctgaccctgctgatcctggtgagcagccaccactag

SEQ ID NO: 20116 - DNA, 1074 bp, Artificial Sequence
  Description of Artificial Sequence: Synthetic coding sequence
atggcccgggagaatggagagagcagcagctcctggaagaagcaggccgaggacatcaagaagatctttgagttcaaggagaccctgggcactggagccttcagcgaggtggtgctggccgaggagaaggccaccgggaagctgtttgctgtgaagtgcatccccaagaaggccctgaagggcaaggagagcagcattgaaaatgaaattgctgtgctgaggaagatcaagcatgaaaatattgtggccctggaggacatctatgagagccccaaccacctgtacctggtgatgcagctggtgtctggaggagagctgtttgaccgcatcgtggagaagggcttctacacagagaaggatgccagcaccctcatccggcaggtgctggatgctgtgtactacctgcacaggatgggcatcgtgcaccgggacctgaagccagagaacctgctgtactacagccaggatgaggagagcaagatcatgatcagtgactttggcctgagcaagatggagggcaaaggagatgtgatgagcacagcctgtggcaccccaggctacgtggcccctgaggtgctggcccagaagccctacagcaaggctgtggactgctggagcattggagtcatcgcctacatcctgctgtgtggctacccacccttctatgatgaaaatgacagcaagctgtttgagcagatcctgaaggccgagtatgaatttgacagcccctactgggatgacatcagtgacagcgccaaggacttcatccggaacctgatggagaaggaccccaacaagcgctacacctgtgagcaggccgcccggcacccctggattgctggggacacagccctgaacaagaacatccacgagagcgtgtctgcccagatcaggaagaactttgccaagagcaagtggaggcaggccttcaatgccacagctgtggtgcgccacatgaggaagctgcacctgggcagcagcctggacagcagcaatgcctctgtgagcagcagcctgagcctggccagccagaaggactgtgcctacgtggccaagccagagagcctgtcctag

SEQ ID NO: 20117 - DNA, 1158 bp, Artificial Sequence
  Description of Artificial Sequence: Synthetic coding sequence
atggcccgggagaatggagagagcagcagctcctggaagaagcaggccgaggacatcaagaagatctttgagttcaaggagaccctgggcactggagccttcagcgaggtggtgctggccgaggagaaggccaccgggaagctgtttgctgtgaagtgcatccccaagaaggccctgaagggcaaggagagcagcattgaaaatgaaattgctgtgctgaggaagatcaagcatgaaaatattgtggccctggaggacatctatgagagccccaaccacctgtacctggtgatgcagctggtgtctggaggagagctgtttgaccgcatcgtggagaagggcttctacacagagaaggatgccagcaccctcatccggcaggtgctggatgctgtgtactacctgcacaggatgggcatcgtgcaccgggacctgaagccagagaacctgctgtactacagccaggatgaggagagcaagatcatgatcagtgactttggcctgagcaagatggagggcaaaggagatgtgatgagcacagcctgtggcaccccaggctacgtggcccctgaggtgctggcccagaagccctacagcaaggctgtggactgctggagcattggagtcatcgcctacatcctgctgtgtggctacccacccttctatgatgaaaatgacagcaagctgtttgagcagatcctgaaggccgagtatgaatttgacagcccctactgggatgacatcagtgacagcgccaaggacttcatccggaacctgatggagaaggaccccaacaagcgctacacctgtgagcaggccgcccggcacccctggattgctggggacacagccctgaacaagaacatccacgagagcgtgtctgcccagatcaggaagaactttgccaagagcaagtggaggcaggccttcaatgccacagctgtggtgcgccacatgaggaagctgcacctgggcagcagcctggacagcagcaatgcctctgtgagcagcagcctgagcctggccagccagaaggactgcctggcccccagcaccctgtgcagcttcatcagcagcagcagtggagtgtctggagtgggcgctgagcggcggccccggcccaccaccgtgacagctgtgcacagcggcagcaagtag

SEQ ID NO: 20118 - DNA, 888 bp, Artificial Sequence
  Description of Artificial Sequence: Synthetic coding sequence
atgaagaaggagcacgtgctgcactgccagttcagcgcctggtaccccttcttccggggcgtgaccatcaagagcgtcatcctgcccctgccccagaatgtgaaggactacctgctggatgatggcaccctggtggtgtctggaagagatgacccccccacccacagccagcctgacagtgatgatgaggccgaggagatccagtggagcgatgatgaaaatacagccaccctgacagcccctgagttccctgagtttgccaccaaggtgcaggaggccatcaacagcctgggcggcagcgtcttccccaagctgaactggagcgcccccagagatgcctactggatcgccatgaacagcagcctgaagtgcaagaccctgagtgacatcttcctgctcttcaagagcagtgacttcatcacccgggacttcacccagcccttcatccactgcacagatgacagcccagacccctgcatcgagtatgagctggtgctgaggaagtggtgtgagctgatccctggagctgagttccgctgctttgtgaaggagaacaagctgattgtggtgtttgacatctacagagacagccggggcaaggtgtggctgattgacttcaacccctttggagaggtgacagacagcctgctcttcacctgggaggagctgatcagcgagaacaacctgaatggagacttcagcgaggtggatgcccaggagcaggacagccctgccttccgctgcaccaacagcgaggtgacagtgcagcccagcccctacctgagctaccgcctgcccaaggactttgtggacctgagcactggagaagatgcccacaagctgattgacttcctgaagctgaagaggaaccagcaggaggatgactag

SEQ ID NO: 20119 - DNA, 3273 bp, Artificial Sequence
  Description of Artificial Sequence: Synthetic coding sequence
atggagcagcccaagggcgtggactggacagtcatcatcctgacctgccagtacaaggacagcgtgcaggtgttccagcgggagctggaggtgcggcagaagcgggagcagatcccagctggcaccctgctgctggccgtggaggaccctgagaagagggtgggcagcggcggggccaccctgaatgccctgctggtggccgctgagcacctgagcgcccgggccggcttcacctggatctgtgtgggcgtgtccctgtggatccggggctgccaccccccaggccgcctgcctgaggcctctgtgcaccgggccttccccctgctgcaggtggtgaccagtgatgtgctgcacagcgcctggatcctgatcctgcacatgggccgggacttcccctttgatgactgtggccgggccttcacctgcctgcctgtggagaaccctgaggcccctgtggaggccctggtgtgcaacctggactgcctgctggacatcatgacctaccgcctgggccctggcagccccccaggagtgtgggtgtgcagcacagacatgctgctgtctgtgcctgccaaccctggcatctcctgggacagcttccggggggcccgggtcatcgccctgcccggcagccctgcctatgcccagaaccacggcgtgtacctgacagacccccagggcctggtgctggacatctactaccagggcacagaagctgagatccagagatgtgtgcggccagatggccgggtgcccctggtgtctggagtggtgttcttctctgtggagacagctgagcggctgctggccacccacgtgtccccacccctggatgcctgcacctacctgggcctggacagcggggcccggcctgtgcagctgagcctcttctttgacatcctgcactgcatggccgagaatgtgacccgggaggacttcctggtgggccggcccccagagctgggccagggagatgctgatgtggccggctacctgcagagcgcccgggcccagctgtggagggagctgcgggaccagcccctgaccatggcctacgtgagcagcggcagctacagctacatgaccagcagcgccagcgagttcctgctgagcctgaccctgcccggggcccctggggcccagatcgtgcacagccaggtggaggagcagcagctgctggccgccggcagctctgtggtgtcctgcctgctggagggccctgtgcagctgggccctggctctgtgctgcagcactgccacctgcagggccccatccacatcggggccggctgcctggtgacaggcctggacacagcccacagcaaggccctgcacggccgggagctgcgggacctggtgctgcagggccaccacacccggctgcacggcagccctggccacgccttcaccctggtgggccgcctggacagctgggagcggcagggcgccggcacctacctgaatgtgccctggagcgagttcttcaagaggactggagtgcgggcctgggacctgtgggaccctgagaccctgcctgctgagtactgcctgcccagcgcccggctcttccctgtgctgcaccccagccgggagctgggcccccaggacctgctgtggatgctggaccaccaggaggatggaggagaggccctgcgggcctggagggcctcctggaggctgtcctgggagcagctgcagccctgcctggaccgggccgccaccctggccagccggcgggacctcttcttccggcaggccctgcacaaggcccggcacgtgctggaggcccggcaggacctgagcctgcggcccctcatctgggccgctgtgcgggagggctgccccggccccctgctggccaccctggaccaggtggccgccggggccggggaccccggggtggccgcccgggccctggcctgtgtggctgatgtgctgggctgcatggccgagggccggggcggcctgcggagcggccctgctgccaaccctgagtggatgaggcccttctcctacctggagtgtggggacctggccgccggcgtggaggccctggcccaggagcgggacaagtggctgagcaggcctgccctgctggtgcgggccgcccggcactatgagggcgccggccagatcctgatccggcaggccgtgatgtctgcccagcactttgtgtccacagagcaggtggagctgcccggccctggccagtgggtggtggccgagtgcccagcccgggtggacttcagcggcggctggagcgacaccccacccctggcctatgagctgggcggcgctgtgctgggcctggccgtgcgggtggatggaagaagacccatcggggcccgggcccggcgcatccctgagcctgagctgtggctggccgtgggcccccggcaggatgagatgacagtgaagatcgtgtgccgctgcctggccgacctgcgggactactgccagccccacgcccctggggccctgctgaaggccgccttcatctgtgccggcatcgtgcacgtgcacagcgagctgcagctgagcaccagcagcatcctggccggcacagccctggccgccctgcagagagctgctggccgggtggtgggcacagaggccctgattcatgctgtgctgcacctggagcaggtgctgaccaccggcggcggctggcaggaccaggtgggcggcctgatgcctggcatcaaggtgggccgcagccgggcccagctgcccctgaaggtggaggtggaggaggtgacagtgcctgagggctttgtgcagaagctgaatgaccacctgctgctggtgtacaccgggaagacccggctggccaggaacctgctgcaggatgtgctgcgctcctggtacgcccggctgcctgctgtggtgcagaatgcccacagcctggtgcggcagacagaagaatgtgccgagggcttccggcagggcagcctgcccctgctgggccagtgcctgaccagctactgggagcagaagaagctgatggcccctggctgtgagcccctgactgtgcggaggatgatggatgtgctggcccctcatgtgcacggccagagcctggccggggccggcggcggcggcttcctgtacctgctgaccaaggagccccagcagaaggaggccctggaggccgtgctggccaagacagagggcctgggcaactacagcatccacctggtggaggtggacacccagggcctgagcctgaagctgctgggcacagaggccagcacctgctgccccttcccctag

SEQ ID NO: 20120 - DNA, 318 bp, Artificial Sequence
  Description of Artificial Sequence: Synthetic coding sequence
atgctggagctggcccaggaccggctgcagtttgaaacagtggaggtgtctgagcccagcatgctgcagaagatcctgaccacccggcggcgggagactggaggaaatgagcccctgcctgtgcccaccctgcagcaccacctggcccccccagctgaggccaggaaggtgcccagcgccagccaggtgcaggccatcaagtgcttcctgagcaagtgctggagcctgaacatcagcaccaaggagtatgcctacctgaagggcaccgtgctcttcaaccctgggaagggcaaggaaaatgactgcaaccaccactag

SEQ ID NO: 20121 - DNA, 1413 bp, Artificial Sequence
  Description of Artificial Sequence: Synthetic coding sequence
atggccggggagaaccaccagtggcagggcagcatcctgtacaacatgctgatgtctgccaagcagaccagggctgcccctgaggcccctgagacccggctggtggaccagtgctggggctgcagctgtggagatgagcccggggtgggccgggagggcctgctgggcggcagaaatgtggccctgctgtaccgctgctgcttctgtgggaaggaccacccccggcagggcagcatcctgtacagcatgctgaccagcgccaagcagacctacgccgcccccaaggcccctgaggccaccctgggcccctgctggggctgcagctgtggcagtgaccccggggtgggccgggccggcctgcccggcggccggcctgtggccctgctgtaccgctgctgcttctgtggggaggaccacccccggcagggcagcatcctgtacagcctgctgaccagcagcaagcagacccacgtggccccagctgcccctgaggcccggcctggaggagcctggtgggacaggagctactttgcccagaggcctgggggcaaggaggccctgcccggcggccgggccacagccctgctgtaccgctgctgcttctgtggggaggaccacccccagcagggcagcaccctgtactgtgtgcccaccagcaccaaccaggcccaggccgcccctgaggagcggccccgggccccctggtgggacaccagcagcggggccctgcggcctgtggccctgaagagcccccaggtggtgtgtgaggccgccagcgctggcctgctgaagaccctgcgctttgtgaagtacctgccctgcttccaggtgctgcccctggaccagcagctggtgctggtgaggaactgctgggccagcctgctgatgctggagctggcccaggaccggctgcagtttgagaccgtggaggtgtctgagcccagcatgctgcagaagatcctgaccaccaggagaagagagaccggcggcaatgagcccctgcctgtgcccaccctgcagcaccacctggcccctcctgctgaggccaggaaggtgcccagcgccagccaggtgcaggccatcaagtgcttcctgagcaagtgctggagcctgaacatcagcaccaaggagtatgcctacctgaagggcaccgtgctcttcaacccagatgtgcccggcctgcagtgtgtgaagtacatccagggcctgcagtggggcacccagcagatcctgtctgagcacaccaggatgacccaccagggcccccatgaccgcttcatcgagctgaacagcaccctcttcctgctgcgcttcatcaatgccaacgtgattgctgagctgttcttccggcccatcattggaacagtgtccatggatgacatgatgctggagatgctgtgcaccaagatctag

SEQ ID NO: 20122 - DNA, 2028 bp, Artificial Sequence
  Description of Artificial Sequence: Synthetic coding sequence
atgctgcgggccacagccccctgctggttccccccaggctacccagaggccaagaaggtggccgaggaggccgccctggaggccagccgccacctgggcggggagcagagccaggccggggcccctgagggcagcaagatgctgcgggccacagccccctgctggttccggcccggctacccagaggccaagaaggtggccaaggaggccgcccctgaggccagccgccacctgggcgctgagcagagccctgctggggcccctgagggcagcaagatgctgcgggccacagccccctgctggttccccccaggctacccagaggccaagaaggtggccgaggaggccgccctggaggcccctgagttccccctgcccagccaccagcctgcccagagctttggcctgtgggtgccccagatgcacaagcaggccagcgcctttgtggacatccaggccgagccccagaacagaggccctgctgtgcccccagcctggcccaagatggtgacagagagctgctacttccctgcccagaggggcagcgcctgccgcctgcctgctgccccccggctgacagagcggcccagcggcgtgcgcatcagcgcccccaggaagaggaagaccatcgcccacagcagcagcccctgcctggtgacaggctacacagatgccaagaggaccagggtggccagcagcagccagaggagccggggcagcaaggtgggccggcagcccgggaagaccaggaacagaagtggcatggcctgcaagaccacagccaccaccagcagcaagagaattgtgcggcgggccagcctgcccagcctgagcctgaagaagcccatcatcctgcggagcagcggctgccaggtgcccaccgtgctgcggcggggctacctgcagctgttcacagaagaatgtctgaagttctgtgccagcaagcaggaggccgaggagaaggccctgaatgaggagaaggtggcctatgactgcagccccaacaagaaccgctacctgaatgtggtgctgaacaccctgaagaggctgaagggcctgacccccagctccatgcctggcctgagccgggccgccctgtacagccggctgcaggagttcctgctgacccaggaccagctgaaggaaaatggctaccccttcccccaccctgagaggcctggaggagctgtgctcttcaccggccagggcaagggccctggggacagcagctgccgggtgtgctgccgctgtggcacagagtacctggtgagcagcagcggccgctgtgtgcgggaccagctgtgctactaccactggggccgggtgcgcagcagccaggtggccggcggccgggtgtcccagtacacctgctgtgccgccgcccctggctctgtgggctgccaggtggccaagcagcacgtgagagatggcaggaaggagagcctggatggctttgtggagaccttcaagaaggagctgagcagagatgcctacccaggcatctatgccctggactgtgagatgtgctacaccacccacggcctggagctgaccagggtgacagtggtggatgctgacatgagggtggtgtatgacacctttgtgaagccagacaatgaaattgtggactacaacacccgcttctctggagtgacagaagcagatgtggccaagaccagcatcaccctgccccaggtgcaggccatcctgctgtccttcttcagcgcccagaccatcctgattggccacagcctggagagtgacctgctggccctgaagctgatccacagcacagtggtggacacagctgtgctcttcccccactacctgggcttcccctacaagaggagcctgaggaacctggccgctgactacctggcccagatcatccaggacagccaggacggccacaacagcagtgaagatgccagcgcctgcctgcagctggtgatgtggaaggtgcggcagagggcccagatccagcccaggcacaggtctgccagccctgctgccctggcctgcccctag

SEQ ID NO: 20123 - DNA, 711 bp, Artificial Sequence
  Description of Artificial Sequence: Synthetic coding sequence
atgcacaccacccagaaggacaccacctacaccaagatctttgtgggcggcctgccctaccacaccacagatgccagcctgaggaagtactttgaggtgtttggagaaattgaggaggccgtggtgatcacagaccggcagacaggcaagagccggggctacggctttgtgaccatggctgacagagctgctgctgagcgggcctgcaaggaccccaaccccatcattgatggcaggaaggccaacgtgaacctggcctacctgggcgccaagccccgcatcatgcagcccggctttgcctttggagtgcagcagctgcacccagccctgatccagaggcccttcggcatcccagcccactacgtgtacccccaggcctttgtgcagcccggggtggtgatcccccacgtgcagcccacagctgctgctgccagcaccaccccctacatcgactacacaggagctgcctatgcccagtacagcgctgctgctgctgctgctgctgctgctgctgcctatgaccagtacccctatgctgccagccctgctgctgctggctacgtgacagctgggggctacggctatgctgtgcagcagcccatcacagctgctgcccctggaacagctgctgctgctgctgctgctgctgctgctgctgctgccttcggccagtaccagccccagcagctgcagacagacaggatgcagtag

SEQ ID NO: 20124 - DNA, 4389 bp, Artificial Sequence
  Description of Artificial Sequence: Synthetic coding sequence
atggcccctgtgcatggagatgacagcctgagtgacagcggcagctttgtgagcagccgggcccggcgggagaagaagagcaagaagggccggcaggaggccctggagcggctgaagaaggccaaggccggggagaagtacaagtatgaggtggaggacttcaccggggtgtatgaggaggtggatgaggagcagtacagcaagctggtgcaggcccggcaggatgatgactggatcgtggatgatgatggcatcggctacgtggaggatggccgggagatctttgatgatgacctggaggatgatgccctggatgctgatgagaagggcaaggatggcaaggccaggaacaaggacaagagaaatgtgaagaagctggccgtgaccaagcccaacaacatcaagtccatgtttattgcctgtgccggcaagaagacagctgacaaggctgtggacctgagcaaggatggcctgctgggggacatcctgcaggacctgaacacagagaccccccagatcaccccacctcctgtgatgatcctgaagaagaagaggagcattggagccagccccaaccccttctctgtgcacacagccacagctgtgcccagcggcaagatcgccagccctgtgtccaggaaggagccccccctgacccctgtgcccctgaagagagctgagtttgctggagatgatgtgcaggtggagagcacagaggaggagcaggagagcggggccatggagtttgaagatggagactttgatgagcccatggaggtggaggaggtggacctggagcccatggccgccaaggcctgggacaaggagagcgagcctgctgaggaggtgaagcaggaggccgacagcgggaaaggaacagtgtcctacctgggcagcttcctgcctgatgtgtcctgctgggacatcgaccaggagggggacagcagcttctctgtgcaggaggtgcaggtggacagcagccacctgcccctggtgaagggagcagatgaggagcaggtgttccacttctactggctggatgcctatgaggaccagtacaaccagcccggggtggtgttcctgtttgggaaggtgtggattgaatctgctgagacccacgtgtcctgctgcgtgatggtgaagaacattgaaagaaccctgtacttcctgccccgggagatgaagattgacctgaacacaggcaaggagaccggcacccccatctccatgaaggatgtgtatgaggagtttgatgagaagatcgccaccaagtacaagatcatgaagttcaagagcaagcctgtggagaagaactatgcctttgagatcccagatgtgcctgagaagtctgagtacctggaggtgaagtacagcgctgagatgccccagctgccccaggacctgaagggggagaccttcagccacgtgtttggcaccaacaccagcagcctggagctgttcctgatgaacaggaagatcaagggcccctgctggctggaggtgaagagcccccagctgctgaaccagcctgtgtcctggtgcaaggtggaggccatggccctgaagccagacctggtgaatgtcatcaaggatgtgagccccccacccctggtggtgatggccttctccatgaagaccatgcagaatgccaagaaccaccagaatgagatcatcgccatggccgccctggtgcaccacagctttgccctggacaaggccgcccccaagccacccttccagagccacttctgtgtggtgtccaagcccaaggactgcatcttcccctatgccttcaaggaggtgattgagaagaagaatgtgaaggtggaggtggccgccacagagaggaccctgctgggcttcttcctggccaaggtgcacaagattgatcctgacatcatcgtgggccacaacatctacggctttgagctggaggtgctgctgcagaggatcaacgtgtgcaaggccccccactggagcaagattggccgcctgaagaggagcaacatgcccaagctgggcggccgcagcggctttggagagagaaatgccacctgtggccgcatgatctgtgatgtggagatcagcgccaaggagctgatccgctgcaagagctaccacctgtctgagctggtgcagcagatcctgaagacagagcgggtggtgatccccatggagaacatccagaacatgtacagcgagagcagccagctgctgtacctgctggagcacacctggaaggatgccaagttcatcctgcagatcatgtgtgagctgaatgtgctgcccctggccctgcagatcaccaacattgctggcaacatcatgagcaggaccctgatgggcggccgctcagaaagaaatgagttcctgctgctgcacgccttctatgagaacaactacatcgtgcctgacaagcagatcttcaggaagccccagcagaagctgggagatgaagatgaggagattgatggagacaccaacaagtacaagaagggcaggaagaaggccgcctatgctgggggcctggtgctggaccccaaggtgggcttctatgacaagttcatcctgctgctggacttcaacagcctgtaccccagcatcatccaggagttcaacatctgcttcaccaccgtgcagagggtggccagcgaggcccagaaggtgacagaagatggagagcaggagcagatccctgagctgcctgaccccagcctggagatgggcatcctgccccgggagatcaggaagctggtggagaggaggaagcaggtgaagcagctgatgaagcagcaggacctgaacccagacctgatcctgcagtatgacatccggcagaaggccctgaagctgacagccaacagcatgtatggctgcctgggcttctcctacagccgcttctacgccaagcccctggccgccctggtgacctacaagggccgggagatcctgatgcacaccaaggagatggtgcagaagatgaacctggaggtgatctacggggacacagacagcatcatgatcaacaccaacagcaccaacctggaggaggtgttcaagctgggcaacaaggtgaagtctgaggtgaacaagctgtacaagctgctggagattgatattgatggagtcttcaagagcctgctgctgctgaagaagaagaagtatgctgccctggtggtggagcccaccagtgatggcaactacgtgaccaagcaggagctgaagggcctggacatcgtgagaagagactggtgtgacctggccaaggacaccggcaacttcgtcatcggccagatcctgagtgaccagagccgggacaccatcgtggagaacatccagaagaggctgattgaaattggagaaaatgtgctgaatggatctgtgcctgtgtcccagtttgagatcaacaaggccctgaccaaggacccccaggactacccagacaagaagagcctgccccacgtgcacgtggccctgtggatcaacagccagggcggcaggaaggtgaaggccggggacacagtgtcctatgtgatctgccaggacggcagcaacctgacagccagccagagggcctatgcccctgagcagctgcagaagcaggacaacctgaccatcgacacccagtactacctggcccagcagatccaccctgtggtggcccgcatctgtgagcccattgatggcattgatgctgtgctgattgccacctggctgggcctggaccccacccagttccgggtgcaccactaccacaaggatgaggagaatgatgccctgctgggcggccctgcccagctgacagatgaggagaagtacagagactgtgagcgcttcaagtgcccctgccccacctgtggcacagagaacatctatgacaacgtgtttgatggcagcggcacagacatggagcccagcctgtaccgctgcagcaacatcgactgcaaggccagccccctgaccttcaccgtgcagctgagcaacaagctgatcatggacatccgccgcttcatcaagaagtactatgatggctggctgatctgtgaggagcccacctgcaggaacagaaccaggcacctgcccctgcagttcagcaggacaggccccctgtgcccagcctgcatgaaggccaccctgcagcctgagtacagcgacaagagcctgtacacccagctgtgcttctaccgctacatctttgatgctgaatgtgccctggagaagctgaccacagaccacgagaaggacaagctgaagaagcagttcttcacccccaaggtgctgcaggactacaggaagctgaagaacacagctgagcagttcctgagccgcagcggctacagcgaggtgaacctgagcaagctgtttgctggctgtgctgtgaagagctag

SEQ ID NO: 20125 - DNA, 2673 bp, Artificial Sequence
  Description of Artificial Sequence: Synthetic coding sequence
atgtctgccaacaacagccccccatctgcccagaagtctgtgctgcccacagccatcccagctgtgctgcctgctgccagcccctgcagcagccccaagacaggcctgagcgcccggctgagcaatggcagcttcagcgcccccagcctgaccaacagccggggctctgtgcacacagtgtccttcctgctgcagatcggcctgacccgggagagcgtgaccatcgaggcccaggagctgagcctgtctgctgtgaaggacctggtgtgcagcatcgtgtaccagaagttcccagaatgtggcttcttcggcatgtatgacaagatcctgctcttcagacatgacatgaacagcgagaacatcctgcagctgatcaccagcgcagatgagatccacgagggggacctggtggaggtggtgctgagcgccctggccaccgtggaggacttccagatccggccccacaccctgtatgtgcacagctacaaggcccccaccttctgtgactactgtggggagatgctgtggggcctggtgcggcagggcctgaagtgtgagggctgcggcctgaactaccacaagagatgtgccttcaagatccccaacaactgcagcggcgtgaggaagaggcggctgagcaatgtgtccctgcccggccctggcctgtctgtgccccggcccctgcagccagaatatgtggccctgcccagcgaggagagccacgtgcaccaggagcccagcaagaggatccccagctggagcggccggcccatctggatggagaagatggtgatgtgccgggtgaaggtgccccacacctttgctgtgcacagctacacccggcccaccatctgccagtactgcaagaggctgctgaagggcctcttccggcagggcatgcagtgcaaggactgcaagttcaactgccacaagagatgtgccagcaaggtgccccgggactgcctgggggaggtgaccttcaacggggagcccagcagcctgggcacagacacagacatccccatggacatcgacaacaatgacatcaacagcgacagcagccggggcctggatgacacagaggagcccagccccccagaggacaagatgttcttcctggaccccagcgacctggatgtggagagagatgaggaggccgtgaagaccatcagccccagcaccagcaacaacatccccctgatgagggtggtgcagagcatcaagcacaccaagaggaagagcagcaccatggtgaaggagggctggatggtgcactacaccagccgggacaacctgaggaagaggcactactggaggctggacagcaagtgcctgaccctcttccagaatgaaagtggcagcaagtactacaaggagatccccctgtctgagatcctgcgcatcagcagcccccgggacttcaccaacatcagccagggcagcaacccccactgctttgagatcatcacagacaccatggtgtactttgtgggagaaaataatggagacagcagccacaaccctgtgctggccgccactggagtgggcctggatgtggcccagagctgggagaaggccatccggcaggccctgatgcctgtgaccccccaggcctctgtgtgcaccagccctggccagggcaaggaccacaaggacctgagcaccagcatctctgtgagcaactgccagatccaggagaatgtggacatcagcacagtgtaccagatctttgctgatgaggtgctgggcagcggccagtttggaattgtgtatggaggcaagcacaggaagacaggaagagatgtggccatcaaggtgattgacaagatgaggttccccaccaagcaggagagccagctgagaaatgaggtggccatcctgcagaacctgcaccaccctggcatcgtgaacctggagtgcatgtttgagaccccagagcgggtgtttgtggtgatggagaagctgcacggggacatgctggagatgatcctgagcagcgagaagagccggctgcctgagcgcatcaccaagttcatggtgacccagatcctggtggccctgaggaacctgcacttcaagaacatcgtgcactgtgacctgaagccagaaaatgtgctgctggccagcgctgagcccttcccccaggtgaagctgtgtgactttggatttgcccgcatcattggagagaagagcttcagaagatctgtggtgggcaccccagcctacctggcccctgaggtgctgcggagcaagggctacaacagaagcctggacatgtggagcgtgggcgtcatcatctacgtgtccctgagcggcaccttccccttcaatgaagatgaggacatcaatgaccagatccagaatgctgccttcatgtacccacccaacccctggagggagatcagcggggaggccatcgacctgatcaacaacctgctgcaggtgaagatgaggaagcgctacagcgtggacaagagcctgagccacccctggctgcaggactaccagacctggctggacctgcgggagtttgagacccgcatcggggagcgctacatcacccatgaaagtgatgatgcccgctgggagatccacgcctacacccacaacctggtgtaccccaagcacttcatcatggcccccaacccagatgacatggaggaggacccctag

SEQ ID NO: 20126 - DNA, 4407 bp, Artificial Sequence
  Description of Artificial Sequence: Synthetic coding sequence
atggcccctgtgcatggagatgactgtgaaattggagccagcgccctgagtgacagcggcagctttgtgagcagccgggcccggcgggagaagaagagcaagaagggccggcaggaggccctggagcggctgaagaaggccaaggccggggagaagtacaagtatgaggtggaggacttcaccggggtgtatgaggaggtggatgaggagcagtacagcaagctggtgcaggcccggcaggatgatgactggatcgtggatgatgatggcatcggctacgtggaggatggccgggagatctttgatgatgacctggaggatgatgccctggatgctgatgagaagggcaaggatggcaaggccaggaacaaggacaagagaaatgtgaagaagctggccgtgaccaagcccaacaacatcaagtccatgtttattgcctgtgccggcaagaagacagctgacaaggctgtggacctgagcaaggatggcctgctgggggacatcctgcaggacctgaacacagagaccccccagatcaccccacctcctgtgatgatcctgaagaagaagaggagcattggagccagccccaaccccttctctgtgcacacagccacagctgtgcccagcggcaagatcgccagccctgtgtccaggaaggagccccccctgacccctgtgcccctgaagagagctgagtttgctggagatgatgtgcaggtggagagcacagaggaggagcaggagagcggggccatggagtttgaagatggagactttgatgagcccatggaggtggaggaggtggacctggagcccatggccgccaaggcctgggacaaggagagcgagcctgctgaggaggtgaagcaggaggccgacagcgggaaaggaacagtgtcctacctgggcagcttcctgcctgatgtgtcctgctgggacatcgaccaggagggggacagcagcttctctgtgcaggaggtgcaggtggacagcagccacctgcccctggtgaagggagcagatgaggagcaggtgttccacttctactggctggatgcctatgaggaccagtacaaccagcccggggtggtgttcctgtttgggaaggtgtggattgaatctgctgagacccacgtgtcctgctgcgtgatggtgaagaacattgaaagaaccctgtacttcctgccccgggagatgaagattgacctgaacacaggcaaggagaccggcacccccatctccatgaaggatgtgtatgaggagtttgatgagaagatcgccaccaagtacaagatcatgaagttcaagagcaagcctgtggagaagaactatgcctttgagatcccagatgtgcctgagaagtctgagtacctggaggtgaagtacagcgctgagatgccccagctgccccaggacctgaagggggagaccttcagccacgtgtttggcaccaacaccagcagcctggagctgttcctgatgaacaggaagatcaagggcccctgctggctggaggtgaagagcccccagctgctgaaccagcctgtgtcctggtgcaaggtggaggccatggccctgaagccagacctggtgaatgtcatcaaggatgtgagccccccacccctggtggtgatggccttctccatgaagaccatgcagaatgccaagaaccaccagaatgagatcatcgccatggccgccctggtgcaccacagctttgccctggacaaggccgcccccaagccacccttccagagccacttctgtgtggtgtccaagcccaaggactgcatcttcccctatgccttcaaggaggtgattgagaagaagaatgtgaaggtggaggtggccgccacagagaggaccctgctgggcttcttcctggccaaggtgcacaagattgatcctgacatcatcgtgggccacaacatctacggctttgagctggaggtgctgctgcagaggatcaacgtgtgcaaggccccccactggagcaagattggccgcctgaagaggagcaacatgcccaagctgggcggccgcagcggctttggagagagaaatgccacctgtggccgcatgatctgtgatgtggagatcagcgccaaggagctgatccgctgcaagagctaccacctgtctgagctggtgcagcagatcctgaagacagagcgggtggtgatccccatggagaacatccagaacatgtacagcgagagcagccagctgctgtacctgctggagcacacctggaaggatgccaagttcatcctgcagatcatgtgtgagctgaatgtgctgcccctggccctgcagatcaccaacattgctggcaacatcatgagcaggaccctgatgggcggccgctcagaaagaaatgagttcctgctgctgcacgccttctatgagaacaactacatcgtgcctgacaagcagatcttcaggaagccccagcagaagctgggagatgaagatgaggagattgatggagacaccaacaagtacaagaagggcaggaagaaggccgcctatgctgggggcctggtgctggaccccaaggtgggcttctatgacaagttcatcctgctgctggacttcaacagcctgtaccccagcatcatccaggagttcaacatctgcttcaccaccgtgcagagggtggccagcgaggcccagaaggtgacagaagatggagagcaggagcagatccctgagctgcctgaccccagcctggagatgggcatcctgccccgggagatcaggaagctggtggagaggaggaagcaggtgaagcagctgatgaagcagcaggacctgaacccagacctgatcctgcagtatgacatccggcagaaggccctgaagctgacagccaacagcatgtatggctgcctgggcttctcctacagccgcttctacgccaagcccctggccgccctggtgacctacaagggccgggagatcctgatgcacaccaaggagatggtgcagaagatgaacctggaggtgatctacggggacacagacagcatcatgatcaacaccaacagcaccaacctggaggaggtgttcaagctgggcaacaaggtgaagtctgaggtgaacaagctgtacaagctgctggagattgatattgatggagtcttcaagagcctgctgctgctgaagaagaagaagtatgctgccctggtggtggagcccaccagtgatggcaactacgtgaccaagcaggagctgaagggcctggacatcgtgagaagagactggtgtgacctggccaaggacaccggcaacttcgtcatcggccagatcctgagtgaccagagccgggacaccatcgtggagaacatccagaagaggctgattgaaattggagaaaatgtgctgaatggatctgtgcctgtgtcccagtttgagatcaacaaggccctgaccaaggacccccaggactacccagacaagaagagcctgccccacgtgcacgtggccctgtggatcaacagccagggcggcaggaaggtgaaggccggggacacagtgtcctatgtgatctgccaggacggcagcaacctgacagccagccagagggcctatgcccctgagcagctgcagaagcaggacaacctgaccatcgacacccagtactacctggcccagcagatccaccctgtggtggcccgcatctgtgagcccattgatggcattgatgctgtgctgattgccacctggctgggcctggaccccacccagttccgggtgcaccactaccacaaggatgaggagaatgatgccctgctgggcggccctgcccagctgacagatgaggagaagtacagagactgtgagcgcttcaagtgcccctgccccacctgtggcacagagaacatctatgacaacgtgtttgatggcagcggcacagacatggagcccagcctgtaccgctgcagcaacatcgactgcaaggccagccccctgaccttcaccgtgcagctgagcaacaagctgatcatggacatccgccgcttcatcaagaagtactatgatggctggctgatctgtgaggagcccacctgcaggaacagaaccaggcacctgcccctgcagttcagcaggacaggccccctgtgcccagcctgcatgaaggccaccctgcagcctgagtacagcgacaagagcctgtacacccagctgtgcttctaccgctacatctttgatgctgaatgtgccctggagaagctgaccacagaccacgagaaggacaagctgaagaagcagttcttcacccccaaggtgctgcaggactacaggaagctgaagaacacagctgagcagttcctgagccgcagcggctacagcgaggtgaacctgagcaagctgtttgctggctgtgctgtgaagagctag

SEQ ID NO: 20127 - DNA, 399 bp, Artificial Sequence
  Description of Artificial Sequence: Synthetic coding sequence
atggtggagcccttcctgggcacctggaagctggtgtccagtgaaaattttgaggactacatgaaggagctgggcgtgaactttgctgccaggaacatggccggcctggtgaagcccaccgtgaccatctctgtggatggcaagatgatgaccatcagaacagagagcagcttccaggacaccaagatctccttcaagctgggggaggagtttgatgagaccacagctgacaacaggaaggtgaagagcaccatcaccctggagaatggctccatgatccacgtgcagaagtggctgggcaaggagaccaccatcaagaggaagatcgtggatgagaagatggtggtggagtgcaagatgaacaacatcgtgtccacccgcatctatgagaaggtgtag

SEQ ID NO: 20128 - DNA, 555 bp, Artificial Sequence
  Description of Artificial Sequence: Synthetic coding sequence
atggacagaggagagcagggcctgctgaggacagatcctgtgcctgaggagggagaagatgtggccgccaccatcagcgccacagagaccctgtctgaggaggagcaggaggagctgcggcgggagctggccaaggtggaggaggagatccagaccctgagccaggtgctggccgccaaggagaagcacctggccgagatcaagaggaagctgggcatcaacagcctgcaggagctgaagcagaacatcgccaagggctggcaggatgtgacagccaccagcgcctacaagaagaccagcgagaccctgagccaggccggccagaaggccagcgctgccttcagctctgtgggcagcgtcatcaccaagaagctggaggatgtgaagaacagccccaccttcaagagctttgaggagaaggtggagaacctgaagagcaaggtgggcggcaccaagccagctggaggagactttggagaggtgctgaacagcgctgccaatgccagcgccaccaccacagagcccctgcctgagaagacccaggagagcctgtag

SEQ ID NO: 20129 - DNA, 675 bp, Artificial Sequence
  Description of Artificial Sequence: Synthetic coding sequence
atggactgccgggagatggacctgtatgaggactaccagagcccctttgattttgatgctggggtgaacaagagctacctgtacctgagccccagcggcaacagcagccccccaggcagccccaccctgcagaagtttggcctgctgaggacagatcctgtgcctgaggagggagaagatgtggccgccaccatcagcgccacagagaccctgtctgaggaggagcaggaggagctgcggcgggagctggccaaggtggaggaggagatccagaccctgagccaggtgctggccgccaaggagaagcacctggccgagatcaagaggaagctgggcatcaacagcctgcaggagctgaagcagaacatcgccaagggctggcaggatgtgacagccaccagcgcctacaagaagaccagcgagaccctgagccaggccggccagaaggccagcgctgccttcagctctgtgggcagcgtcatcaccaagaagctggaggatgtgaagaacagccccaccttcaagagctttgaggagaaggtggagaacctgaagagcaaggtgggcggcaccaagccagctggaggagactttggagaggtgctgaacagcgctgccaatgccagcgccaccaccacagagcccctgcctgagaagacccaggagagcctgtag

SEQ ID NO: 20130 - DNA, 285 bp, Artificial Sequence
  Description of Artificial Sequence: Synthetic coding sequence
cccagggctgcccggagccggggccctgctgtgtcccggccccgggcccccaggcctgagctgaccacagaagctggggagcccgcccggcgctgtgtgcccccctatgagcaccggcccggcatgcagtgtgctgtgaccaccccaccacccagctactacccctaccccaacctgcgctgggacaccagccacttcaagaagagcggcggcccccagaggaacaactacgtgatccaccctgagtttgtgtctgagacctacccagactaccgctgctggtag

SEQ ID NO: 20131 - DNA, 1110 bp, Artificial Sequence
  Description of Artificial Sequence: Synthetic coding sequence
atgcctgtggtgaccacagatgctgagagcgagaccggcatccccaagagcctgagcaatgagccccccagcgagaccatggaggagattgagcacacctgcccccagccccggctgaccctgacagccccagccccctttgctgatgagaccaactgccagtgccaggcccctcatgagaagctgaccatcgcccaggcccggctgggcaccccagctgacaggcctgtgcgggtgtatgcagatggcatctttgacctcttccacagcggccacgcccgggccctgatgcaggccaagaccctcttccccaacagctacctgctggtgggcgtgtgcagtgatgacctgacccacaagttcaagggcttcaccgtgatgaatgaggccgagagatatgaggccctgcggcactgccgctacgtggatgaagtcatcagagatgccccctggaccctgaccccagagttcctggagaagcacaagattgactttgtggcccatgatgacatcccctacagcagcgctggcagtgatgatgtgtacaagcacatcaaggaggccggcatgtttgtgcccacccagaggacagagggcatcagcaccagtgacatcatcaccagaattgtgcgggactatgatgtgtatgcccggaggaacctgcagaggggctacacagccaaggagctgaatgtgtccttcatcaatgagaagcgctaccgcttccagaaccaggtggacaagatgaaggagaaggtgaagaatgtggaggagaggagcaaggagtttgtgaacagagtggaggagaagagccatgacctgatccagaagtgggaggagaagagccgggagttcatcggcaacttcctggagctgtttggaccagatggagcctggaagcagatgttccaggagaggagcagcaggatgctgcaggccctgagccccaagcagagccctgtgagcagccccaccaggagccgcagccccagccgcagccccagccccaccttctcctggctgcccctgaagaccagcccccccagcagccccaaggccgccagcgccagcatcagctccatgtctgaaggagatgaagatgagaagtag

SEQ ID NO: 20132 - DNA, 1056 bp, Artificial Sequence
  Description of Artificial Sequence: Synthetic coding sequence
atggtgggccaccaggagtgcatcatggaggaggacaacagagccccccagctgtggaggaagaccctgacagccccagccccctttgctgatgagaccaactgccagtgccaggcccctcatgagaagctgaccatcgcccaggcccggctgggcaccccagctgacaggcctgtgcgggtgtatgcagatggcatctttgacctcttccacagcggccacgcccgggccctgatgcaggccaagaccctcttccccaacagctacctgctggtgggcgtgtgcagtgatgacctgacccacaagttcaagggcttcaccgtgatgaatgaggccgagagatatgaggccctgcggcactgccgctacgtggatgaagtcatcagagatgccccctggaccctgaccccagagttcctggagaagcacaagattgactttgtggcccatgatgacatcccctacagcagcgctggcagtgatgatgtgtacaagcacatcaaggaggccggcatgtttgtgcccacccagaggacagagggcatcagcaccagtgacatcatcaccagaattgtgcgggactatgatgtgtatgcccggaggaacctgcagaggggctacacagccaaggagctgaatgtgtccttcatcaatgagaagcgctaccgcttccagaaccaggtggacaagatgaaggagaaggtgaagaatgtggaggagaggagcaaggagtttgtgaacagagtggaggagaagagccatgacctgatccagaagtgggaggagaagagccgggagttcatcggcaacttcctggagctgtttggaccagatggagcctggaagcagatgttccaggagaggagcagcaggatgctgcaggccctgagccccaagcagagccctgtgagcagccccaccaggagccgcagccccagccgcagccccagccccaccttctcctggctgcccctgaagaccagcccccccagcagccccaaggccgccagcgccagcatcagctccatgtctgaaggagatgaagatgagaagtag

SEQ ID NO: 20133 - DNA, 600 bp, Artificial Sequence
  Description of Artificial Sequence: Synthetic coding sequence
atggctgacaagagcaagttcatcgagtacattgatgaggccctggagaagagcaaggagacagccctgagccacctgttcttcacctaccagggcatcccctaccccatcaccatgtgcaccagcgagaccttccaggccctggacacctttgaggcccggcatgatgacatcgtgctggccagctaccccaagtgtggcagcaactggatcctgcacatcgtgtctgagctgatctatgctgtgtccaagaagaagtacaagtacccagagttccctgtgctggagtgtggggacagcgagaagtaccagaacctggccgccggcatcaagcagattgctgagttcctgggcttcttcctgaccggggagcagatccagaccatctctgtgcagagcaccttccaggccatgagggccaagagccaggacacccacggggctgtgggccccttcctgttcaggaagggggaggtgggggactggaagaacctcttcagcgagatccagaaccaggagatggatgagaagttcaaggagtgcctggccggcaccagcctgggcgccaagctgaagtatgagagctactgccagggctag

SEQ ID NO: 20134 - DNA, 1527 bp, Artificial Sequence
  Description of Artificial Sequence: Synthetic coding sequence
atgcgctgccccaagtctgctgtgaccatgagaaatgaggagctgctgctgagcaatggaacagccaacaagatgaatggagccctggaccacagcgaccagcctgaccctgatgccatcaagatgtttgtgggccagatccccaggtcctggagcgagaaggagctgaaggagctgtttgagccctatggagctgtgtaccagatcaacgtgctgcgggacaggagccagaaccccccccagagcaagggctgctgctttgtgaccttctacaccaggaaggccgccctggaggcccagaatgccctgcacaacatcaagaccctgcccggcatgcaccaccccatccagatgaagccagctgacagcgagaagagcaatgctgtggaggacaggaagctgttcatcggcatggtgtccaagaagtgcaatgaaaatgacatccgggtgatgttcagccccttcggccagatcgaggagtgccgcatcctgcggggcccagatggcctgagccggggctgtgcctttgtgaccttcagcacccgggccatggcccagaatgccatcaaggccatgcaccagagccagaccatggagggctgcagcagccccatcgtggtgaagtttgctgacacccagaaggacaaggagcagaggcggctgcagcagcagctggcccagcagatgcagcagctgaacacagccacctggggcaacctgaccggcctgggcggcctgaccccccagtacctggccctgctgcagcaggccaccagcagcagcaacctgggcgccttcagcggcatccagcagatggccggcatgaatgccctgcagctgcagaacctggccaccctggccgctgctgctgctgctgcccagaccagcgccaccagcaccaatgccaaccccctgagcaccaccagcagcgccctgggcgccctgaccagccctgtggccgccagcacccccaacagcacagctggggccgccatgaacagcctgaccagcctgggcaccctgcagggcctggccggggccaccgtgggcctgaacaacatcaatgccctggccggcatggccgccctgaatggaggcctgggcgccaccggcctgaccaacggcacagctggcaccatggatgccctgacccaggcctacagcggcatccagcagtatgctgctgctgccctgcccaccctgtacagccagagcctgctgcagcagcagagcgctgctggcagccagaaggagggccctgagggcgccaacctcttcatctaccacctgccccaggagtttggagaccaggacatcctgcagatgttcatgccctttggaaatgtcatcagcgccaaggtgttcatcgacaagcagaccaacctgagcaagtgcttcggctttgtgtcctatgacaaccctgtgtctgcccaggccgccatccaggccatgaatggcttccagatcggcatgaagaggctgaaggtgcagctgaagaggagcaagaatgacagcaagccctactag

SEQ ID NO: 20135 - DNA, 1215 bp, Artificial Sequence
  Description of Artificial Sequence: Synthetic coding sequence
atgggcagcagccaggaggagggcctgcgctgccagcccagccagcctgaccatgatgctgatggccactgcggccctgacctggagggcgctgagcgggccagcgccaccccaggccccccaggcctgctgaacagccacaggcctgctgacagtgatgacaccaatgctgctggccccagcgctgccctgctggagggcctgctgctgggcggcggcaagcccagcccccacagcacccggcccggccccttcttctacatcggcggcagcaatggagccaccatcatcagcagctactgcaagagcaagggctggcagagaattcatgacagcagaagagatgactacaccctgaagtggtgtgaggtgaagagccgggacagctatggcagcttccgggagggggagcagctgctgtaccagctgcccaacaacaagctgctgaccaccaagattggcctgctgagcaccctgcggggccgggcccgggccatgagcaaggccagcaaggtgcctggaggagtgcaggcccggctggagaaggatgctgctgccccagccctggaggacctgccctggaccagccctggctacctgcggccccagagggtgctgaggatggaggagttcttccctgagacctaccgcctggacctgaagcatgagcgggaggccttcttcaccctgtttgatgagacccagatctggatctgcaagcccacagccagcaaccagggcaagggcatcttcctgctgaggaaccaggaggaggtggccgccctgcaggccaagaccaggtccatggaggatgaccccatccaccacaagacccccttccggggcccccaggcccgggtggtgcagcgctacatccagaaccccctgctggtggatggcaggaagtttgatgtgcgcagctacctgctgattgcctgcaccaccccctacatgatcttctttggacatggctacgcccggctgaccctgagcctgtatgacccccacagcagtgacctgggcggccacctgaccaaccagttcatgcagaagaagagccccctgtacatgctgctgaaggagcacacagtgtggagcatggagcacctgaaccgctacatcagtgacaccttctggaaggcccggggcctggccaaggactgggtgttcaccaccctgaaggtgcggcccctgtgcccccctgtgtgggagtag

SEQ ID NO: 20136 - DNA, 2022 bp, Artificial Sequence
  Description of Artificial Sequence: Synthetic coding sequence
atggaccacagctgcacccgcttcatccacagaagaggcccccccaccaggacccgggccggcttcaagaggggcaagaggccccgcatccagcagaggccccgggcccgggtgtctggcaccatcccagccagccggctgcacccagccccagccagccagcccggcccctgcccagcccctggccactgccctgtgggccctgcccacgagcggcccatgggcagcagccaggaggagggcctgcgctgccagcccagccagcctgaccatgatgctgatggccactgcggccctgacctggagggcgctgagcgggccagcgccaccccaggccccccaggcctgctgaacagccacaggcctgctgacagtgatgacaccaatgctgctggccccagcgctgccctgctggagggcctgctgctgggcggcggcaagcccagcccccacagcaccaggcctggccccttcttctacatcggcggcagcaatggagccaccatcatcagcagctactgcaagagcaagggctggcagagaattcatgacagcagaagagatgactacaccctgaagtggtgtgaggtgaagagccgggacagctatggcagcttccgggagggggagcagctgctgtaccagctgcccaacaacaagctgctgaccaccaagattggcctgctgagcaccctgcggggccgggcccgggccatgagcaaggccagcaaggtgcctgggggcgtgcaggcccggctggagaaggatgctgctgccccagccctggaggacctgccctggaccagccctggctacctgcggccccagagggtgctgaggatggaggagttcttccctgagacctaccgcctggacctgaagcatgagcgggaggccttcttcaccctgtttgatgagacccagatctggatctgcaagcccacagccagcaaccagggcaagggcatcttcctgctgaggaaccaggaggaggtggccgccctgcaggccaagaccaggtccatggaggatgaccccatccaccacaagacccccttccggggcccccaggcccgggtggtgcagcgctacatccagaaccccctgctggtggatggcaggaagtttgatgtgcgcagctacctgctgattgcctgcaccaccccctacatgatcttcttcggccacggctacgcccggctgaccctgagcctgtatgacccccacagcagtgacctgggcggccacctgaccaaccagttcatgcagaagaagagccccctgtacatgctgctgaaggagcacacagtgtggagcatggagcacctgaaccgctacatcagtgacaccttctggaaggcccggggcctggccaaggactgggtgttcaccaccctgaagaagaggatgcagcagatcatggcccactgcttcctggccgccaagcccaagctggactgcaagctgggctactttgacctgattggctgtgacttcctgattgatgacaacttcaaggtgtggctgctggagatgaacagcaacccagccctgcacaccaactgtgaggtgctgaaggaggtgattcctggggtggtgattgagaccctggacctggtgctggagaccttcaggaagagcctgcggggccagaagatgctgcccctgctgagccagaggagatttgtgctgctgcacaatggagaggccgacccccggccccacctgggcggcagctgcagcctgcggcgctggccacccctgcccacccggcaggccaagagcagcggcccccccatgccccacgccccagaccagcccggggcccggcggcctgcccccccacccctggtgccccagaggccccggcccccaggccctgacctggacagcgcccatgatggagagccccaggcccctggaacagagcagagcggcactggaaacagacacccagcccaggagcccagccctggaacagccaaggaggagcgggaggagccagaaaatgcccggccctag

SEQ ID NO: 20137 - DNA, 2022 bp, Artificial Sequence; identical to SEQ ID NO: 20136
  Description of Artificial Sequence: Synthetic coding sequence

SEQ ID NO: 20138 - DNA, 393 bp, Artificial Sequence
  Description of Artificial Sequence: Synthetic coding sequence
atgacagaggacagccagaggaacttccgctctgtgtactatgagaaggtgggcttccggggcgtggaggagaagaagagcctggagatcctgctgaaggatgaccggctggacacagagaagctgtgcaccttcagccagcgcttccccctgcccagcatgtaccgggccctggtgtggaaggtgctgctgggcatcctgcccccccaccacgagagccacgccaaggtgatgatgtacaggaaggagcagtacctggatgtgctgcacgccctgaaggtggtgcgctttgtgtctgatgccaccccccaggccgaggtgtacctgaggatgtaccagctggagagcggcaagctgcccaggagccccagcttccccctggagccagactag

SEQ ID NO: 20139 - DNA, 882 bp, Artificial Sequence; identical to SEQ ID NO: 19447
  Description of Artificial Sequence: Synthetic coding sequence

SEQ ID NO: 20140 - DNA, 801 bp, Artificial Sequence
  Description of Artificial Sequence: Synthetic coding sequence
atgacagaggacagccagaggaacttccgctctgtgtactatgagaaggtgggcttccggggcgtggaggagaagaagagcctggagatcctgctgaaggatgaccggctgggcatcctgcccccccaccacgagagccacgccaaggtgatgatgtacaggaaggagcagtacctggatgtgctgcacgccctgaaggtggtgcgctttgtgtctgatgccaccccccaggccgaggtgtacctgaggatgtaccagctggagagcggcaagctgcccaggagccccagcttccccctggagccagatgatgaggtgttcctggccatcgccaaggccatggaggagatggtggaggacagcgtggactgctactggatcaccaggagatttgtgaaccagctgaacaccaagtacagagacagcctgccccagctgcccaaggcctttgagcagtacctgaacctggaggatggccgcctgctgacccacctgaggatgtgcagcgctgcccccaagctgccctatgacctgtggttcaagcgctgctttgctggctgcctgcctgagagcagcctgcagagggtgtgggacaaggtggtgtctggcagctgcaagatcctggtgtttgtggccgtggagatcctgctgaccttcaagatcaaggtgatggccctgaacagcgctgagaagatcaccaagttcctggagaacatcccccaggacagcagtgatgccatcgtgtccaaggccatcgacctgtggcacaagcactgcggcacccctgtgcacagcagctag

SEQ ID NO: 20141 - DNA, 3672 bp, Artificial Sequence
  Description of Artificial Sequence: Synthetic coding sequence
atgatgagcctgtctgtgcggccccagaggcggctgctgagcgcccgggtgaacagaagccagagctttgctggggtgctgggcagccatgagcggggccccagcctgtccttccgctccttccctgtgttcagccccccaggcccccccaggaagcccccagccctgagccgggtgtccaggatgttttctgtggcccaccctgctgccaaggtgccccagcctgagcggctggacctggtgtacacagccctgaagaggggcctgacagcctacctggaggtgcaccagcaggagcaggagaagctgcagggccagatccgggagagcaagaggaacagccggctgggcttcctgtatgacctggacaagcaggtgaagagcattgagcgcttcctgcggcggctggagttccacgccagcaagattgatgagctgtatgaggcctactgtgtgcagaggcggctgagagatggagcctacaacatggtgcgggcctacaccaccggcagccctggcagccgggaggcccgggacagcctggccgaggccacccggggccaccgggagtacacagagagcatgtgcctgctggagagcgagctggaggcccagctgggggagttccacctgaggatgaagggcctggccggctttgcccggctgtgtgtgggggaccagtatgagatctgcatgaagtatggccggcagcgctggaagctgcggggcagaattgagggcagcggcaagcaggtgtgggacagcgaggagaccatcttcctgcccctgctgacagagttcctgagcatcaaggtgacagagctgaagggcctggccaaccacgtggtggtgggctctgtgtcctgtgagaccaaggacctgtttgctgccctgccccaggtggtggccgtggacatcaatgacctgggcaccatcaagctgagcctggaggtgacctggagcccctttgacaaggatgaccagcccagcgctgccagctctgtgaacaaggccagcacagtgaccaagcgcttcagcacctacagccagagccccccagacacccccagcctgcgggagcaggccttctacaacatgctgcggcggcaggaggagctggagaatggaacagcctggagcctgagcagcgagagcagtgatgacagcagcagcccccagctgtctggaacagcccggcacagccctgccccccggcccctggtgcagcagcctgagcccctgcccatccaggtggccttcagaagacctgagacccccagcagcggccccctggatgaggagggcgctgtggcccctgtgctggccaatggacatgccccctacagcaggaccctgagccacatcagcgaggcctctgtggatgctgccctggccgaggcctctgtggaggccgtgggccctgagagcctggcctggggccccagcccccccacccacccagcccccacccatggagagcaccccagccctgtgcccccagccctggaccccggccacagcgccaccagcagcaccctgggcaccaccggctctgtgcccaccagcacagatcctgcccccagcgcccacctggacagcgtgcacaagagcacagacagcggccccagcgagctgcccggccccacccacaccaccaccggcagcacctacagcgccatcaccaccacccacagcgcccccagccccctgacccacaccaccaccggcagcacccacaagcccatcatcagcaccctgaccaccaccggccccaccctgaacatcatcggccctgtgcagaccaccaccagccccacccacaccatgcccagccccacccacaccacagccagccccacccacaccagcaccagccccacccacacccccaccagccccacccacaagacctccatgagcccccccaccaccaccagccccacccccagcggcatgggcctggtgcagacagccaccagccccacccaccccaccaccagccccacccaccccaccaccagccccatcctgatcaacgtgagccccagcaccagcctggagctggccaccctgagcagccccagcaagcacagcgaccccaccctgcctggaacagacagcctgccctgcagcccccctgtgagcaacagctacacccaggccgaccccatggcccccaggaccccccaccccagccctgcccacagcagcaggaagcccctgaccagccctgccccagaccccagcgagagcacagtgcagagcctgagccccacccccagcccccccaccccagccccccagcacagcgacctgtgcctggccatggctgtgcagacccctgtgcccacagctgctgggggcagcggggacaggagcctggaggaggccctgggcgccctgatggccgccctggatgactaccggggccagtttcctgagctgcagggcctggagcaggaggtgacccggctggagagcctgctgatgcagaggcagggcctgaccaggagccgggccagcagcctgagcatcaccgtggagcacgccctggagagcttctccttcctgaatgaagatgaagatgaagataatgatgtgcctggggaccggccccccagcagccctgaggccggggctgaagattccattgacagccccagcgcccggcccctgagcacaggctgcccagccctggatgctgccctggtgcgccacctgtaccactgcagccggctgctgctgaagctgggcaccttcggccccctgcgctgccaggaggcctgggccctggagcggctgctgcgggaggcccgggtgctggaggccgtgtgtgagttcagccgccgctgggagatcccagccagcagcgcccaggaggtggtgcagttcagcgccagcaggcctggcttcctgaccttctgggaccagtgcacagagcggctgagctgcttcctgtgccctgtggagcgggtgctgctgaccttctgcaaccagtacggggcccggctgagcctgcggcagcccggcctggccgaggccgtgtgtgtgaagttcctggaggatgccctgggccagaagctgccccggcggccccagcccggccctggagagcagctgactgtgttccagttctggagctttgtggagaccctggacagccccaccatggaggcctacgtgacagaaacagctgaggaggtgctgctggtgaggaacctgaacagtgatgaccaggccgtggtgctgaaggccctgcggctggcccctgagggccgcctgcggagagatggcctgcgggccctgagcagcctgctggtgcacggcaacaacaaggtgatggctgctgtgtccacccagctgcggagcctgagcctgggccccaccttccgggagcgggccctgctgtgcttcctggaccagctggaggatgaagatgtgcagaccagggtggccggctgcctggccctgggctgcatcaaggcccctgagggcatcgagcccctggtgtacctgtgccagacagacacagaagctgtgcgggaggccgcccggcagagcctgcagcagtgtggggaggagggccagagcgcccaccggcggctggaggagagcctggatgccctgccccgcatctttggacctggctccatggccagcacagccttctag

SEQ ID NO: 20142 - DNA, 123 bp, Artificial Sequence
  Description of Artificial Sequence: Synthetic coding sequence
atggctgatgaggagctggaggccctgcggcggcagaggctggccgagctgcaggccaagcatggagaccctggagatgctgcccagcaggaggccaagcacagcagcacagaggagaagtag

SEQ ID NO: 20143 - DNA, 414 bp, Artificial Sequence
  Description of Artificial Sequence: Synthetic coding sequence
atgaagcccccagctgcccagggcagccctgctgctgctgctgctgctgccccagccctggacagcgctgctgctgaggacctgagtgatgccctgtgtgaatttgatgctgtgctggccgactttgccagccccttccacgagcggcacttccactatgaggagcacctggagaggatgaagaggaggagcagcgcctctgtgtctgacagcagcggcttcagtgacagcgagagcgctgacagcctgtacagaaattccttctccttcagtgatgagaagctgaacagccccacagacagcaccccagccctgctgagcgccaccgtgaccccccagaaggccaagctgggggacaccaaggagctggaggccttcatcgctgacctggacaagaccctggcctccatgtag

SEQ ID NO: 20144 - DNA, 1593 bp, Artificial Sequence
  Description of Artificial Sequence: Synthetic coding sequence
atgcccaacgtgctgctgccccccaaggagagcaacctcttcaagaggatcctgaagtgctatgagcagaagcagtacaagaatggcctgaagttctgcaagatgatcctgagcaaccccaagtttgctgagcacggggagaccctggccatgaagggcctgaccctgaactgcctgggcaagaaggaggaggcctatgaatttgtgaggaagggcctgagaaatgatgtgaagagccacgtgtgctggcacgtgtatggcctgctgcagaggagtgacaagaagtatgatgaggccatcaagtgctacagaaatgccctgaagctggacaaggacaacctgcagatcctgcgggacctgagcctgctgcagatccagatgagggacctggagggctaccgggagacccgctaccagctgctgcagctgcggcccacccagagggcctcctggattggctacgccatcgcctaccacctgctgaaggactatgacatggccctgaagctgctggaggagttccggcagacccagcaggtgccccccaacaagattgattatgagtacagcgagctgatcctgtaccagaaccaggtgatgagggaggccgacctgctgcaggagagcctggagcacatcgagatgtatgagaagcagatctgtgacaagctgctggtggaggagatcaagggggagatcctgctgaagctgggccgcctgaaggaggccagcgaggtgttcaagaacctgattgacagaaatgctgagaactggtgctactatgagggcctggagaaggccctgcagatcagcaccctggaggagcggctgcagatctatgaggagatcagcaagcagcaccccaaggccatcaccccccggcggctgcccctgaccctggtgcctggagagcgcttccgggagctgatggacaagttcctgcgggtgaacttcagcaagggctgccccccactcttcaccaccctgaagagcctgtactacaacacagagaaggtgtccatcatccaggagctggtgaccaactatgaggccagcctgaagacctgtgacttcttcagcccctatgaaaatggagagaaggagccccccaccaccctgctgtgggtgcagtacttcctggcccagcactttgacaagctgggccagtacagcctggccctggactacatcaatgctgccatcgccagcacccccaccctcatcgagctgttctacatgaaggccaagatctacaagcacatcggcaacctgaaggaggccgccaagtggatggatgaggcccagagcctggacacagctgaccgcttcatcaacagcaaatgtgccaagtacatgctgcgggccaacatgatcaaggaggccgaggagatgtgcagcaagttcacccgggagggcaccagcgccatggagaacctgaatgagatgcagtgcatgtggttccagacagagtgcatcagcgcctaccagaggctgggccgctatggagatgccctgaagaagtgccacgaggtggagcggcacagccccagcacctggaccactggaggcaaggagccccagatgcacccctag

SEQ ID NO: 20145 - DNA, 2595 bp, Artificial Sequence
  Description of Artificial Sequence: Synthetic coding sequence
atgcccaacgtgctgctgccccccaaggagagcaacctcttcaagaggatcctgaagtgctatgagcagaagcagtacaagaatggcctgaagttctgcaagatgatcctgagcaaccccaagtttgctgagcacggggagaccctggccatgaagggcctgaccctgaactgcctgggcaagaaggaggaggcctatgaatttgtgaggaagggcctgagaaatgatgtgaagagccacgtgtgctggcacgtgtatggcctgctgcagaggagtgacaagaagtatgatgaggccatcaagtgctacagaaatgccctgaagctggacaaggacaacctgcagatcctgcgggacctgagcctgctgcagatccagatgagggacctggagggctaccgggagacccgctaccagctgctgcagctgcggcccacccagagggcctcctggattggctacgccatcgcctaccacctgctgaaggactatgacatggccctgaagctgctggaggagttccggcagacccagcaggtgccccccaacaagattgattatgagtacagcgagctgatcctgtaccagaaccaggtgatgagggaggccgacctgctgcaggagagcctggagcacatcgagatgtatgagaagcagatctgtgacaagctgctggtggaggagatcaagggggagatcctgctgaagctgggccgcctgaaggaggccagcgaggtgttcaagaacctgattgacagaaatgctgagaactggtgctactatgagggcctggagaaggccctgcagatcagcaccctggaggagcggctgcagatctatgaggagatcagcaagcagcaccccaaggccatcaccccccggcggctgcccctgaccctggtgcctggagagcgcttccgggagctgatggacaagttcctgcgggtgaacttcagcaagggctgccccccactcttcaccaccctgaagagcctgtactacaacacagagaaggtgtccatcatccaggagctggtgaccaactatgaggccagcctgaagacctgtgacttcttcagcccctatgaaaatggagagaaggagccccccaccaccctgctgtgggtgcagtacttcctggcccagcactttgacaagctgggccagtacagcctggccctggactacatcaatgctgccatcgccagcacccccaccctcatcgagctgttctacatgaaggccaagatctacaagcacatcggcaacctgaaggaggccgccaagtggatggatgaggcccagagcctggacacagctgaccgcttcatcaacagcaaatgtgccaagtacatgctgcgggccaacatgatcaaggaggccgaggagatgtgcagcaagttcacccgggagggcaccagcgccatggagaacctgaatgagatgcagtgcatgtggttccagacagagtgcatcagcgcctaccagaggctgggccgctatggagatgccctgaagaagtgccacgaggtggagcggcacttctttgagatcacagatgaccagtttgacttccacacctactgcatgaggaagatgaccctgcgggcctacgtggacctgctgcggctggaggacatcctgcggagacatgccttctacttcaaggccgcccggagcgccatcgagatctacctgaagctgtatgacaaccccctgaccaatgaaagcaagcagcaggagatcaacagcgagaacctgagcgccaaggagctgaagaagatgctgagcaagcagaggcgggcccagaagaaggccaagctggaggaggagaggaagcatgctgagcgggagcggcagcagaagaaccagaagaagaagagagatgaggaggaggaggaggccagcggcctgaaggaggagctgatccctgagaagctggagcgggtggagaaccccctggaggaggccgtgaagttcctgatccccctgaagaacctggtggccgacaacatcgacacccacctgctggcctttgagatctacttcaggaagggcaagttcctgctgatgctgcagagcgtgaagagggcctttgccatcaacagcaacaacccctggctgcacgagtgcctgatccgcttcagcaagtctgtgagcaaccacagcaacctgcctgacatcgtgtccaaggtgctgagccaggagatgcagaagatctttgtgaagaaggacctggagagcttcaatgaagacttcctgaagagaaatgccaccagcctgcagcacctgctgagcggggccaagatgatgtacttcctggacaagagccggcaggagaaggccatcgccatcgccacccggctggatgagaccatcaaggacaaggatgtgaagaccctcatcaaggtgtctgaggccctgctggatggcagctttggaaactgcagcagccagtatgaggagtacaggatggcctgccacaacctgctgcccttcaccagcgccttcctgcctgctgtgaatgaggtggacaaccccaacgtggccctgaaccacacagccaactatgatgtgctggccaatgagatctag

SEQ ID NO: 20146 - DNA, 1668 bp, Artificial Sequence; identical to SEQ ID NO: 18807
  Description of Artificial Sequence: Synthetic coding sequence

SEQ ID NO: 20147 - DNA, 630 bp, Artificial Sequence
  Description of Artificial Sequence: Synthetic coding sequence
atggcccctgtgggcgtggagaagaagctgctgctgggccccaatggacctgctgtggccgccgccggggacctgaccagcgaggaggaggagggccagagcctgtggagcagcatcctgtctgaggtgtccacccgggcccggagcaagctgcccagcggcaagaacatcctggtgtttggagaagatggcagcggcaagaccaccctgatgaccaagctgcagggcgctgagcacggcaagaagggccggggcctggagtacctgtacctgtctgtgcatgatgaggacagagatgaccacacccgctgcaatgtgtggatcctggatggagacctgtaccacaagggcctgctgaagtttgctgtgtctgctgagagcctgcctgagaccctggtgatctttgtggccgacatgagccggccctggacagtgatggagagcctgcagaagtgggcctctgtgctgcgggagcacatcgacaagatgaagatccccccagagaagatgagggagctggagaggaagtttgtgaaggacttccaggactacatggagcctgaggagggctgccaggagggccccctgagcaacagagtggagcagatgaggcccaggaaccactggtag

SEQ ID NO: 20148 - DNA, 858 bp, Artificial Sequence
  Description of Artificial Sequence: Synthetic coding sequence
aactggaacctggcctcctggaaccccagcaacccagaatgtctgctgctggtggtgaaggagctggtgcagcagtaccaccagttccagtgcagccggctgcgggagagcagccggctgatgtttgagtaccagaccctgctggaggagccccagtatggagagaacatggagatctatgccggcaagaagaacaactggacaggagagttcagcgcccgcttcctgctgaagctgcctgtggacttcagcaacatccccacctacctgctgaaggatgtgaatgaagaccccggggaggatgtggccctgctgtctgtgtcctttgaggacacagaggccacccaggtgtaccccaagctgtacctgagccccagaattgaacatgccctgggcggcagcagcgccctgcacatcccagccttccctgggggcggctgcctgattgattatgtgccccaggtgtgccacctgctgaccaacaaggtgcagtatgtgatccagggctaccacaagagaagagagtacatcgccgccttcctgagccacttcggcaccggggtggtggagtatgatgctgagggcttcaccaagctgaccctgctgctgatgtggaaggacttctgcttcctggtgcacatcgacctgcccctcttcttcccccgggaccagcccaccctgaccttccagagcgtgtaccacttcaccaacagcggccagctgtacagccaggcccagaagaactacccctacagcccccgctgggatggaaatgagatggccaagagggccaaggcctacttcaagacctttgtgccccagttccaggaggccgcctttgccaacgggaagctgtag

SEQ ID NO: 20149 - DNA, 1152 bp, Artificial Sequence; identical to SEQ ID NO: 19282
  Description of Artificial Sequence: Synthetic coding sequence

SEQ ID NO: 20150 - DNA, 1131 bp, Artificial Sequence; identical to SEQ ID NO: 19601
  Description of Artificial Sequence: Synthetic coding sequence

SEQ ID NO: 20151 - DNA, 312 bp, Artificial Sequence
  Description of Artificial Sequence: Synthetic coding sequence
atgatccgggccttccccaccaccacccccaggagcctgcacctgttcaccagcagcaccttcctggcccgggccctgcccggggccttccccaccggggcctgtgaggagcggctgtctgtgcctgagagcacccccttcaccgctgtgctgaagtttgctgctgaggagttcaaggtgcctgctgccaccagcgccatcatcaccaatgatggcatcggcatcaacccagcccagacagctggaaatgtgttcctgaagcacggcagcgagctgcgcatcatcccccgggacagagtgggcagctgctag

SEQ ID NO: 20152 - DNA, 1968 bp, Artificial Sequence
  Description of Artificial Sequence: Synthetic coding sequence
atggccacccctgtggtgaccaagacagcctggaagctgcaggagatcgtggcccacgccagcaatgtgagcagcctggtgctgggcaaggccagcggccgcctgctggccactggaggagatgactgccgggtgaacctgtggagcatcaacaagcccaactgcatcatgagcctgaccggccacaccagccctgtggagagcgtgcggctgaacaccccagaggagctgattgtggccggcagccagagcggcagcatccgggtgtgggacctggaggccgccaagatcctgcggaccctgatgggccacaaggccaacatctgcagcctggacttccacccctacggggagtttgtggccagcggcagccaggacaccaacatcaagctgtgggacatccggaggaagggctgtgtgttccgctaccggggccacagccaggccgtgcgctgcctgcgcttctccccagatggcaagtggctggccagcgctgctgatgaccacacagtgaagctgtgggacctgacagctgggaagatgatgtctgagttccctggccacactggacctgtgaatgtggtggagttccaccccaatgagtacctgctggccagcggcagcagtgacaggaccatccgcttctgggacctggagaagttccaggtggtgtcctgcattgaaggagagcccggccctgtgcgctctgtgctcttcaacccagatggctgctgcctgtacagcggctgccaggacagcctgcgggtgtatggctgggagcctgagcgctgctttgatgtggtgctggtgaactggggcaaggtggccgacctggccatctgcaatgaccagctgattggagtggccttcagccagagcaatgtgtcctcctatgtggtggacctgaccagggtgaccaggacaggcaccgtggcccgggaccctgtgcaggaccaccggcccctggcccagcccctgcccaaccccagcgcccccctgcggcgcatctatgagcggcccagcaccacctgcagcaagccccagagggtgaagcagaacagcgagagcgagcggcgcagccccagcagtgaagatgacagagatgagcgggagagcagagctgagatccagaatgctgaggactacaatgagatcttccagcccaagaacagcatcagcaggaccccaccccggcgctctgagcccttccctgcccccccagaagatgatgctgccacagccaaggaggccgccaagcccagccctgccatggatgtgcagtttcctgtgcccaacctggaggtgctgcccaggcctcctgtggtggccagcaccccagcccccaaggccgagcccgccatcatcccagccaccagaaatgagcccatcggcctgaaggccagtgacttcctgcctgctgtgaagatcccccagcaggccgagctggtggatgaagatgccatgagccagatcagaaaaggacatgacaccatgtgtgtggtgctgaccagccgccacaagaacctggacacagtgcgggctgtgtggaccatgggagacatcaagacctctgtggacagcgctgtggccatcaatgacctgtctgtggtggtggacctgctgaacatcgtgaaccagaaggccagcctgtggaagctggacctgtgcaccaccgtgctgccccagatcgagaagctgctgcagagcaaatatgagagctatgtgcagacaggctgcaccagcctgaagctgatcctgcagcgcttcctgcccctcatcacagacatgctggccgccccacccagcgtgggcgtggacatcagccgggaggagcggctgcacaagtgccgcctgtgctacaagcagctgaagagcatcagcggcctggtgaagagcaagagcggcctgagcggccgccacggcagcaccttccgggagctgcacctgctgatggccagcctggactag

SEQ ID NO: 20153 - DNA, 165 bp, Artificial Sequence
  Description of Artificial Sequence: Synthetic coding sequence
atgttcctgtctgctgtgttctttgccaagagcaagagcaatgagaccaagagccccctgcggggcaaggagaagaacaccctgcccctgaatggaggcctgaagatgaccctcatctacaaggagaagacagagggcggggacacagattctgagatcctgtag

SEQ ID NO: 20154 - DNA, 2457 bp, Artificial Sequence
  Description of Artificial Sequence: Synthetic coding sequence
atgaagaagcagttcaacaggatgaggcagctggccaaccagacagtgggccgggcagagaagacagaggtgctgtctgaggacctgctgcaggtggagaagaggctggagctggtgaagcaggtgagccacagcacccacaagaagctgacagcctgcctgcagggccagcagggcgctgaggccgacaagaggagcaagaagctgcccctgaccaccctggcccagtgcctgatggagggcagcgccatcctgggagatgacaccctgctgggcaagatgctgaagctgtgtggggagacagaggacaagctggcccaggagctgatccactttgagctgcaggtggagagagatgtgattgagcccctcttcctgctggccgaggtggagatccccaacatccagaagcagaggaagcacctggccaagctggtgctggacatggacagcagcaggacccgctggcagcagaccagcaagagcagcggcctgagcagcagcctgcagcctgctggggccaaggcagatgccctgcgggaggagatggaggaggccgccaacagagtggagatctgccgggaccagctgtctgctgacatgtacagctttgtggccaaggagattgattatgccaactacttccagaccctgattgaggtgcaggccgagtaccacaggaagagcctgaccctgctgcaggccgtgctgccccagatcaaggcccagcaggaggcctgggtggagaagcccagctttgggaagcccctggaggagcacctgaccatcagcggccgggagatcgccttccccatcgaggcctgtgtgaccatgctgctggagtgtggcatgcaggaggagggcctcttccgggtggcccccagcgccagcaagctgaagaagctgaaggccgccctggactgctgcgtggtggatgtgcaggagtacagcgctgacccccacgccatcgccggggccctgaagagctacctgcgggagctgcctgagcccctgatgacctttgagctgtatgatgagtggatccaggccagcaatgtgcaggagcaggacaagaagctgcaggccctgtggaatgcctgtgagaagctgcccaaggccaaccacaacaacatccgctacctgatcaagttcctgagcaagctgtctgagtaccaggatgtgaacaagatgacccccagcaacatggccatcgtgctgggccccaacctgctgtggccccaggccgagggcaacatcacagagatgatgaccaccgtgtccctgcagatcgtgggcatcatcgagcccatcatccagcacgccgactggttcttccctggagaaattgagttcaacatcaccggcaactacggcagccctgtgcacgtgaaccacaatgccaactacagctccatgcccagcccagacatggaccctgctgaccggcggcagcctgagcaggcccggcggcccctgtctgtggccacagacaacatgatgctggagttctacaagaaggatggcctgaggaagatccagagcatgggcgtgcgggtgatggacaccaactgggtggcccggcggggcagcagcgctggcaggaaggtgtcctgtgccccacccagcatgcagcccccagcccccccagctgagctggccgcccccctgcccagccccctgcctgagcagcccctggacagccctgctgccccagccctgagccccagcggcctgggcctgcagcccggccctgagaggaccagcaccaccaagagcaaggagctgagccctggcagcgcccagaagggcagccctggcagcagccagggcacagcctgtgccggcacccagcccggggcccagcccggggcccagcccggggccagccccagccccagccagcccccagctgaccagagcccccacaccctgaggaaggtgtccaagaagctggcccccatcccccccaaggtgcccttcggccagcccggggccatggctgaccagagcgctggccagcccagccctgtgtccctgagccccaccccacccagcacccccagcccctacggcctgagctacccccagggctacagcctggccagcggccagctgagccctgctgctgccccacccctggccagccccagcgtcttcaccagcaccctgagcaagagccggcccacccccaagccccggcagaggcccaccctgcccccaccccagcccccaacagtgaacctgagcgccagcagcccccagagcacagaggcccccatgctggatggcatgagccctggagagagcatgagcacagacctggtgcactttgacatccccagcatccacatcgagctgggcagcaccctgcggctgagccccctggagcacatgagaagacacagcgtgacagacaagagggacagcgaggaggagagcgagagcacagccctgtag

SEQ ID NO: 20155 - DNA, 1014 bp, Artificial Sequence
  Description of Artificial Sequence: Synthetic coding sequence
atgaccaacaacagcggcagcaaggccgagctggtggtgggcggcaagtacaagctggtgaggaagattggcagcggcagctttggagatgtgtacctgggcatcaccaccaccaatggagaagatgtggccgtgaagctggagagccagaaggtgaagcacccccagctgctgtatgagagcaagctgtacaccatcctgcagggcggcgtgggcatcccccacatgcactggtacggccaggagaaggacaacaacgtgctggtgatggacctgctgggccccagcctggaggacctcttcaacttctgcagccgccgcttcaccatgaagacagtgctgatgctggccgaccagatgatcagccgcatcgagtatgtgcacaccaagaacttcctgcaccgggacatcaagccagacaacttcctgatgggcaccggccgccactgcaacaagctgttcctgattgactttggcctggccaagaagtacagagacaacagaacccggcagcacatcccctaccgggaggacaagcacctgattggcaccgtgcgctatgccagcatcaatgcccacctgggcatcgagcagagcagaagagatgacatggagagcctgggctacgtgttcatgtacttcaacagaaccagcctgccctggcagggcctgcgggccatgaccaagaagcagaagtatgagaagatcagcgagaagaagatgagcacccctgtggaggtgctgtgcaagggcttccctgctgagtttgccatgtacctgaactactgccggggcctgcgctttgaggaggtgcctgactacatgtacctgcggcagctgttccgcatcctcttccgcaccctgaaccaccagtatgactacacctttgactggaccatgctgaagcagaaggccgcccagcaggccgccagcagcagcggccagggccagcaggcccagacccagacaggcaagcagacagagaagaacaagaacaacgtgaaggacaactag

SEQ ID NO: 20156 - DNA, 1608 bp, Artificial Sequence
  Description of Artificial Sequence: Synthetic coding sequence
atgtctgagggggagagccagacagtgctgagcagcggcagtgaccccaaggtggagagcagcagcagcgcccctggcctgacctctgtgagcccccctgtgaccagcaccaccagcgctgccagccctgaggaggaggaggagagtgaagatgaaagtgagatcctggaggagagcccctgtggccgctggcagaagagaagagaggaggtgaaccagagaaatgtgcccggcattgattctgcctacctggccatggacacagaggagggcgtggaggtggtgtggaatgaggtgcagttcagcgagaggaagaactacaagctgcaggaggagaaggtgcgggctgtgtttgacaacctgatccagctggagcacctgaacatcgtgaagttccacaagtactgggccgacatcaaggagaacaaggcccgggtcatcttcatcacagagtacatgagcagcggcagcctgaagcagttcctgaagaagaccaagaagaaccacaagaccatgaatgagaaggcctggaagcgctggtgcacccagatcctgagcgccctgagctacctgcacagctgtgacccccccatcatccacggcaacctgacctgtgacaccatcttcatccagcacaacggcctcatcaagattggctctgtggccccagacaccatcaacaaccacgtgaagacctgccgggaggagcagaagaacctgcacttctttgccccagaatatggagaggtgaccaacgtgaccacagctgtggacatctacagctttggcatgtgtgccctggagatggctgtgctggagatccagggcaatggagagagcagctatgtgccccaggaggccatcagcagcgccatccagctgctggaggaccccctgcagcgggagttcatccagaagtgcctgcagagcgagcccgcccggcggcccacagcccgggagctgctcttccacccagccctgtttgaggtgcccagcctgaagctgctggccgcccactgcatcgtgggccaccagcacatgatcccagaaaatgccctggaggagatcaccaagaacatggacaccagcgctgtgctggccgagatcccagctggccctggccgggagcctgtgcagaccctgtacagccagagccctgccctggagctggacaagttcctggaggatgtgagaaatggcatctaccccctgacagccttcggcctgccccggccccagcagccccagcaggaggaggtgaccagccctgtggtgccccccagcgtgaagacccccaccccagagcctgctgaggtggagaccaggaaggtggtgctgatgcagtgcaacattgaatctgtggaggagggcgtgaagcaccacctgaccctgctgctgaagctggaggacaagctgaacagacacctgagctgtgacctgatgcccaatgaaaacatccctgagctggccgctgagctggtgcagctgggcttcatcagcgaggccgaccagagccggctgaccagcctgctggaggagaccctgaacaagttcaactttgccaggaacagcaccctgaacagcgctgctgtgacagtgagcagctag

SEQ ID NO: 20157 - DNA, 2169 bp, Artificial Sequence
  Description of Artificial Sequence: Synthetic coding sequence
atggagaccagtgacatccagatcttctaccaggaggaccctgagtgccagaacctgtctgagaacagctgccccccatctgaggtgtctgacaccaacctgtacagccccttcaagcccaggaactaccagctggagctggccctgcctgccatgaagggcaagaacaccatcatctgtgcccccaccggctgcggcaagacctttgtgtccctgctgatctgtgagcaccacctgaagaagttcccccagggccagaagggcaaggtggtgttctttgccaaccagatccctgtgtatgagcagcagaagtctgtgttcagcaagtactttgagcggcacggctacagagtgacaggcatcagcggggccacagcagaaaatgtgcctgtggagcagatcgtggagaacaatgacatcatcatcctgaccccccagatcctggtgaacaacctgaagaagggcaccatccccagcctgagcatcttcaccctgatgatctttgatgagtgccacaacaccagcaagcagcacccctacaacatgatcatgttcaactacctggaccagaagctgggcggcagcagcggccccctgccccaggtgattggcctgacagcctctgtgggcgtgggagatgccaagaacacagatgaggccctggactacatctgcaagctgtgtgccagcctggatgccagcgtcatcgccaccgtgaagcacaacctggaggagctggagcaggtggtgtacaagccccagaagttcttcaggaaggtggagagccgcatcagtgacaagttcaagtacatcatcgcccagctgatgagggacacagagagcctggccaagaggatctgcaaggacctggagaacctgagccagatccagaaccgggagtttggcacccagaagtatgagcagtggatcgtgacagtgcagaaggcctgcatggtgttccagatgccagacaaggatgaggagagccgcatctgcaaggccctcttcctgtacaccagccacctgaggaagtacaatgatgccctgatcatcagcgagcacgccaggatgaaggatgccctggactacctgaaggacttcttcagcaatgtgcgggccgccggctttgatgaaattgagcaggacctgacccagagatttgaggagaagctgcaggagctggagagcgtgtcccgggaccccagcaatgaaaaccccaagctggaggacctgtgcttcatcctgcaggaggagtaccacctgaaccctgagaccatcaccatcctgtttgtgaagacccgggccctggtggatgccctgaagaactggattgagggcaaccccaagctgtccttcctgaagccaggcatcctgaccggccggggcaagaccaaccagaacacaggcatgaccctgcctgcccagaagtgcatcctggatgccttcaaggccagcggggaccacaacatcctgattgccacctctgtggctgatgagggcattgatattgcccagtgcaacctggtgatcctgtatgaatatgtgggcaatgtcatcaagatgatccagacccggggccggggccgggcccggggcagcaagtgcttcctgctgaccagcaatgctggggtgattgagaaggagcagatcaacatgtacaaggagaagatgatgaatgacagcatcctgcggctgcagacctgggatgaagctgtgttccgggagaagatcctgcacatccagacccatgagaagttcatccgggacagccaggagaagcccaagcctgtgcctgacaaggagaacaagaagctgctgtgcaggaagtgcaaggccctggcctgctacacagcagatgtgcgggtgattgaggagtgccactacacagtgctgggagatgccttcaaggaatgttttgtgtcccggccccaccccaagcccaagcagttcagcagctttgagaagagggccaagatcttctgtgcccggcagaactgcagccatgactggggcatccacgtgaagtacaagacctttgagatccctgtgatcaagattgagagctttgtggtggaggacatcgccaccggggtgcagaccctgtacagcaagtggaaggacttccactttgagaagatcccctttgatcctgctgagatgagcaagtag

SEQ ID NO: 20158 - DNA, 2643 bp, Artificial Sequence
  Description of Artificial Sequence: Synthetic coding sequence
atgaccacagagcagaggaggagcctgcaggccttccaggactacatcaggaagaccctggaccccacctacatcctgagctacatggccccctggttccgggagggctacagcggcctgtatgaggccatcgagagctgggacttcaagaagattgagaagctggaggagtaccgcctgctgctgaagaggctgcagcctgagttcaagacccgcatcatccccacagacatcatcagtgacctgtctgagtgcctgatcaaccaggagtgtgaggagatcctgcagatctgcagcaccaagggcatgatggccggggctgagaagctggtggagtgcctgctgcggagtgacaaggagaactggcccaagaccctgaagctggccctggagaaggagaggaacaagttcagcgagctgtggatcgtggagaagggcatcaaggatgtggagacagaggacctggaggacaagatggagaccagtgacatccagatcttctaccaggaggaccctgagtgccagaacctgtctgagaacagctgccccccatctgaggtgtctgacaccaacctgtacagccccttcaagcccaggaactaccagctggagctggccctgcctgccatgaagggcaagaacaccatcatctgtgcccccaccggctgcggcaagacctttgtgtccctgctgatctgtgagcaccacctgaagaagttcccccagggccagaagggcaaggtggtgttctttgccaaccagatccctgtgtatgagcagcagaagtctgtgttcagcaagtactttgagcggcacggctacagagtgacaggcatcagcggggccacagcagaaaatgtgcctgtggagcagatcgtggagaacaatgacatcatcatcctgaccccccagatcctggtgaacaacctgaagaagggcaccatccccagcctgagcatcttcaccctgatgatctttgatgagtgccacaacaccagcaagcagcacccctacaacatgatcatgttcaactacctggaccagaagctgggcggcagcagcggccccctgccccaggtgattggcctgacagcctctgtgggcgtgggagatgccaagaacacagatgaggccctggactacatctgcaagctgtgtgccagcctggatgccagcgtcatcgccaccgtgaagcacaacctggaggagctggagcaggtggtgtacaagccccagaagttcttcaggaaggtggagagccgcatcagtgacaagttcaagtacatcatcgcccagctgatgagggacacagagagcctggccaagaggatctgcaaggacctggagaacctgagccagatccagaaccgggagtttggcacccagaagtatgagcagtggatcgtgacagtgcagaaggcctgcatggtgttccagatgccagacaaggatgaggagagccgcatctgcaaggccctcttcctgtacaccagccacctgaggaagtacaatgatgccctgatcatcagcgagcacgccaggatgaaggatgccctggactacctgaaggacttcttcagcaatgtgcgggccgccggctttgatgaaattgagcaggacctgacccagagatttgaggagaagctgcaggagctggagagcgtgtcccgggaccccagcaatgaaaaccccaagctggaggacctgtgcttcatcctgcaggaggagtaccacctgaaccctgagaccatcaccatcctgtttgtgaagacccgggccctggtggatgccctgaagaactggattgagggcaaccccaagctgtccttcctgaagccaggcatcctgaccggccggggcaagaccaaccagaacacaggcatgaccctgcctgcccagaagtgcatcctggatgccttcaaggccagcggggaccacaacatcctgattgccacctctgtggctgatgagggcattgatattgcccagtgcaacctggtgatcctgtatgaatatgtgggcaatgtcatcaagatgatccagacccggggccggggccgggcccggggcagcaagtgcttcctgctgaccagcaatgctggggtgattgagaaggagcagatcaacatgtacaaggagaagatgatgaatgacagcatcctgcggctgcagacctgggatgaagctgtgttccgggagaagatcctgcacatccagacccatgagaagttcatccgggacagccaggagaagcccaagcctgtgcctgacaaggagaacaagaagctgctgtgcaggaagtgcaaggccctggcctgctacacagcagatgtgcgggtgattgaggagtgccactacacagtgctgggagatgccttcaaggaatgttttgtgtcccggccccaccccaagcccaagcagttcagcagctttgagaagagggccaagatcttctgtgcccggcagaactgcagccatgactggggcatccacgtgaagtacaagacctttgagatccctgtgatcaagattgagagctttgtggtggaggacatcgccaccggggtgcagaccctgtacagcaagtggaaggacttccactttgagaagatcccctttgatcctgctgagatgagcaagtag

SEQ ID NO: 20159 - DNA, 2778 bp, Artificial Sequence
  Description of Artificial Sequence: Synthetic coding sequence
atgaccacagagcagaggaggagcctgcaggccttccaggactacatcaggaagaccctggaccccacctacatcctgagctacatggccccctggttccgggaggaggaggtgcagtacatccaggccgagaagaacaacaagggccccatggaggccgccaccctcttcctgaagttcctgctggagctgcaggaggagggctggttccggggcttcctggatgccctggaccacgccggctacagcggcctgtatgaggccattgaatcctgggacttcaagaagattgagaagctggaggagtaccgcctgctgctgaagaggctgcagcctgagttcaagacccgcatcatccccacagacatcatcagtgacctgtctgaatgtctcatcaaccaggagtgtgaggagatcctgcagatctgcagcaccaagggcatgatggccggggctgagaagctggtggagtgcctgctgcggagtgacaaggagaactggcccaagaccctgaagctggccctggagaaggagaggaacaagttcagcgagctgtggatcgtggagaagggcatcaaggatgtggagacagaggacctggaggacaagatggagaccagtgacatccagatcttctaccaggaggaccctgagtgccagaacctgtctgagaacagctgcccccccagcgaggtgtctgacaccaacctgtacagccccttcaagcccaggaactaccagctggagctggccctgcctgccatgaagggcaagaacaccatcatctgtgcccccaccggctgtgggaagacctttgtgtccctgctgatctgtgagcaccacctgaagaagttcccccagggccagaagggcaaggtggtgttctttgccaaccagatccctgtgtatgagcagcagaagagcgtcttcagcaagtactttgaaagacatggctacagagtgacaggcatcagcggggccacagcagaaaatgtgcctgtggagcagatcgtggagaacaatgacatcatcatcctgaccccccagatcctggtgaacaacctgaagaagggcaccatccccagcctgagcatcttcaccctgatgatctttgatgagtgccacaacaccagcaagcagcacccctacaacatgatcatgttcaactacctggaccagaagctgggcggcagcagcggccccctgccccaggtgattggcctgacagcctctgtgggcgtgggagatgccaagaacacagatgaggccctggactacatctgcaagctgtgtgccagcctggatgcctctgtgattgccaccgtgaagcacaacctggaggagctggagcaggtggtgtacaagccccagaagttcttcaggaaggtggagagccgcatcagtgacaagttcaagtacatcatcgcccagctgatgagggacacagagagcctggccaagaggatctgcaaggacctggagaacctgagccagatccagaaccgggagtttggcacccagaagtatgagcagtggatcgtgacagtgcagaaggcctgcatggtgttccagatgccagacaaggatgaggagagccgcatctgcaaggccctcttcctgtacaccagccacctgaggaagtacaatgatgccctgatcatcagcgagcacgccaggatgaaggatgccctggactacctgaaggacttcttcagcaatgtgcgggctgctggctttgatgaaattgagcaggacctgacccagagatttgaggagaagctgcaggagctggagagcgtgtcccgggaccccagcaatgaaaaccccaagctggaggacctgtgcttcatcctgcaggaggagtaccacctgaaccctgagaccatcaccatcctgtttgtgaagacccgggccctggtggatgccctgaagaactggattgagggcaaccccaagctgtccttcctgaagccaggcatcctgaccggccggggcaagaccaaccagaacacaggcatgaccctgcctgcccagaagtgcatcctggatgccttcaaggccagcggggaccacaacatcctgattgccacctctgtggctgatgagggcatcgacatcgcccagtgcaacctggtgatcctgtatgaatatgtgggcaatgtcatcaagatgatccagacccggggccggggccgggcccggggcagcaagtgcttcctgctgaccagcaatgctggggtcatcgagaaggagcagatcaacatgtacaaggagaagatgatgaatgacagcatcctgcggctgcagacctgggatgaggccgtgttccgggagaagatcctgcacatccagacccatgagaagttcatccgggacagccaggagaagcccaagcctgtgcctgacaaggagaacaagaagctgctgtgcaggaagtgcaaggccctggcctgctacacagcagatgtgcgggtcatcgaggagtgccactacacagtgctgggagatgccttcaaggagtgctttgtgtcccggccccaccccaagcccaagcagttcagcagctttgagaagagggccaagatcttctgtgcccggcagaactgcagccatgactggggcatccacgtgaagtacaagacctttgagatccctgtgatcaagattgagagctttgtggtggaggacatcgccactggagtgcagaccctgtacagcaagtggaaggacttccactttgagaagatcccctttgatcctgctgagatgagcaagtag

SEQ ID NO: 20160 - DNA, 987 bp, Artificial Sequence
  Description of Artificial Sequence: Synthetic coding sequence
atggatggagaggacatcccagacttcagcagcctgaaggaggagacagcctactggaaggagctgagcctgaagtacaagcagagcttccaggaggccagagatgagctggtggagttccaggagggcagccgggagctggaggccgagctggaggcccagctggtgcaggccgagcagaggaacagagacctgcaggccgacaaccagaggctgaagtatgaggtggaggccctgaaggagaagctggagcaccagtatgcccagagctacaagcaggtgtctgtgctggaggatgacctgagccagacccgggccatcaaggagcagctgcacaagtatgtgcgggagctggagcaggccaatgatgacctggagcgggccaagagggccaccatcgtgtccctggaggactttgagcagaggctgaaccaggccattgaaagaaatgccttcctggagagcgagctggatgagaaggagagcctgctggtgtctgtgcagaggctgaaggatgaggcccgggacctgcggcaggagctggccgtgcgggagcggcagcaggaggtgaccaggaagagcgcccccagcagccccaccctggactgtgagaagatggacagcgctgtgcaggccagcctgagcctgcctgccacccctgtgggcaaaggaacagagaacaccttccccagccccaaggccatccccaatggatttggcaccagccccctgaccccatctgcccgcatcagcgccctgaacatcgtgggggacctgctgaggaaggtgggcgccctggagagcaagctggccgcctgcaggaactttgccaaggaccaggccagcaggaagagctacatctctggaaatgtgaactgtggggtgctgaatggaaatggcaccaagttcagccgcagcggccacaccagcttctttgacaagggccaggagaaggtgatcttccccaccctcttcatgggccagtag

SEQ ID NO: 20161 - DNA, 2898 bp, Artificial Sequence
  Description of Artificial Sequence: Synthetic coding sequence
atggccctgctgtgtggcctgggccaggtgaccctgcgcatctgggtgtccctgcccagccagagtgaaaatggcatcggcttcctggccgcccgggccttcctgcggagcggcggcatggaggccctgaccacccagctgggccctggccgggagggcagcagcagccccaacagcaagcaggagctgcagccctacagcggcagcagcgccctgaagcccaaccaggtgggggagaccagcctgtatggagtgcccatcgtgtccctggtgattgatggccaggagcggctgtgcctggcccagatcagcaacaccctgctgaagaactacagctacaatgagatccacaacagaagagtggccctgggcatcacctgtgtgcagtgcacccctgtgcagctggagatcctgcggcgggccggggccatgcccatcagcagcagaagatgtggcatgatcaccaagcgggaggccgagcggctgtgcaagagcttcctgggggagcacaagccacccaagctgcctgaaaattttgcctttgatgtggtgcatgaatgtgcctggggcagccggggcagcttcatcccagcccgctacaacagcagccgggccaagtgcatcaagtgtggctactgcagcatgtacttcagccccaacaagttcatcttccacagccacaggaccccagatgccaagtacacccagccagatgctgccaacttcaacagctggaggaggcacctgaagctgagtgacaagagcgccacagatgagctgagccacgcctgggaggatgtgaaggccatgttcaacggcggcaccaggaagaggaccttcagcctgcagggcggcggcggcggcggggccaatggaggcagcggcggccagggcaaaggaggagctgggggcggcggcggcggcggccctggctgtggggctgagatggcccctggccccccaccccacaagagcctgcgctgtggggaggatgaagctgctggccccccaggccccccaccaccccacccccagaggggcctgggcctggccaccggggccagcggccctgctggccctgggggccctgggggcggggccggcgtgcgcagctaccctgtgattcctgtgcccagcaagggcttcggcctgctgcagaagctgcccccacccctcttcccccacccctacggcttccccacagccttcggcctgtgccccaagaaggatgatcctgtgctgggcgctggggagcccaagggcggccctggcactggaagtggcggcggcggggccggcaccggcggcggggccggcggccctggggccagccacctgcccccaggggccggggccggccctgggggcggggccatgttctggggccaccagcccagcggggccgccaaggatgctgctgctgtggccgctgctgctgctgctgccaccgtgtaccccaccttccccatgttctggccagctgctggcagcctgcctgtgcccagctacccagctgcccagagccaggccaaggctgtggccgctgctgtggccgctgctgctgctgctgctgctgctgctgctggcagcggggcccctgagcccctggatggagctgagcccgccaaggagagcggcctgggcgctgaggagcgctgccccagcgccctgagccggggccccctggatgaagatggaacagatgaggccctgcccccacccctggcccccctgcccccacctcctcctcctccagccaggaagggcagctatgtgtctgccttccggcctgtggtgaaggacacagagagcatcgccaagctgtatggcagcgcccgggaggcctacggggccggccctgcccggggccctggccctggggccggcagcggcggctacgtgtccccagacttcctgtctgagggcagcagcagctacaacagcgccagcccagatgtggacacagcagatgagcctgaggtggatgtggagagcaaccgcttcccagatgatgaagatgcccaggaggagacagagcccagcgcccccagcgctgggggcggcccagatggagagcagcccactggacctccttctgccaccagcagtggagcagatggccctgccaacagcccagatggcggcagcccccggccccggcggcggctgggccccccacctgctggccgcccagcctttggagacctggccgctgaggacctggtgagaagacctgagaggagccccccatctgggggcggcggctatgagctgcgggagccctgtggccccctgggcggccctgccccagccaaggtgtttgcccctgagagagatgaacatgtgaagtctgctgctgtggccctgggccctgctgccagctatgtgtgcaccccagaggcccacgagccagacaaggaggacaaccacagccctgcagatgacctggagaccaggaagagctacccagaccagaggagcatcagccagcccagccctgccaacacagacagaggagaagatggcctgaccctggatgtgacaggcacccacctggtggagaaggacatcgagaacctggcccgggaggagctgcagaagctgctgctggagcagatggagctgaggaagaagctggagcgggagttccagagcctgaaggacaacttccaggaccagatgaagcgggagctggcctaccgggaggagatggtgcagcagctgcagatcgtgcgggacaccctgtgcaatgagctggaccaggagaggaaggcccgctatgccatccagcagaagctgaaggaggcccatgatgccctgcaccacttcagctgcaagatgctgacccccaggcactgcaccggcaactgcagcttcaagccacccctgctgccctag

SEQ ID NO: 20162 - DNA, 1803 bp, Artificial Sequence
  Description of Artificial Sequence: Synthetic coding sequence
atggccagcaaccacaagagcagcgctgcccggcctgtgtcccggggcggcgtgggcctgaccggccggccccccagcggcatccggcccctgagcggcaacatccgggtggccacagccatgcctcctggaacagcccggcccggcagccggggctgccccatcggcactggaggagtgctgagcagccagatcaaggtggcccacaggcctgtgacccagcagggcctgaccggcatgaagacaggcaccaagggcccccagaggcagatcctggacaagagctactacctgggcctgctgcggagcaagatcagcgagctgaccacagaggtgaacaagctgcagaagggcatcgagatgtacaaccaggagaacagcgtgtacctgtcctatgagaagagagctgagaccctggccgtggagatcaaggagctgcagggccagctggccgactacaacatgctggtggacaagctgaacaccaacacagagatggaggaggtgatgaatgactacaacatgctgaaggcccagaatgaccgggagacccagagcctggatgtgatcttcacagagcggcaggccaaggagaagcagatccgctctgtggaggaggagattgagcaggagaagcaggccacagatgacatcatcaagaacatgagctttgagaaccaggtgaagtacctggagatgaagaccaccaatgagaagctgctgcaggagctggacaccctgcagcagcagctggacagccagaacatgaagaaggagagcctggaggccgagatcgcccacagccaggtgaagcaggaggccgtgctgctgcacgagaagctgtatgagctggagagccaccgggaccagatgattgctgaggacaagagcatcggcagccccatggaggagcgggagaagctgctgaagcagatcaaggatgacaaccaggagatcgcctccatggagcggcagctgacagacaccaaggagaagatcaaccagttcatcgaggagatccggcagctggacatggacctggaggagcaccagggcgagatgaaccagaagtacaaggagctgaagaagcgggaggagcacatggacaccttcatcgagacctttgaggagaccaagaaccaggagctgaagaggaaggcccagatcgaggccaacatcgtggccctgctggagcactgcagcaggaacatcaacagaattgagcagatcagcagcatcaccaaccaggagctgaagatgatgcaggatgacctgaacttcaagagcacagaggtgcagaagagccagagcacagcccagaacctgaccagtgacatccagaggctgcagctggacctgcagaagatggagctgctggagagcaagatgacagaggagcagcacagcctgaagagcaagatcaagcagatgaccacagacctggagatctacaatgacctgcctgccctgaagagcagtggagaggagaagatcaagaagctgcaccaggagaggatgatcctgagcacccacagaaatgccttcaagaagatcatggagaagcagaacatcgagtatgaggccctgaagacccagctgcaggagaatgagacccacagccagctgaccaacctggagaggaagtggcagcacctggagcagaacaactttgccatgaaggagttcatcgccaccaagagccaggagagtgactaccagcccatcaagaagaatgtgaccaagcagattgctgagtacaacaagaccatcgtggatgccctgcacagcaccagcggcaactag

SEQ ID NO: 20163 - DNA, 582 bp, Artificial Sequence
  Description of Artificial Sequence: Synthetic coding sequence
atgctggtggccggaaatgacagagtgcaggccgtcatcacccagatggaggaggtgtgccagaccatcgaggacaacagccggcggcagaagcagctgctgaaccagagatttgagagcctgtgtgctgtgctggaggagaggaaaggagagctgctgcaggccctggcccgggagcaggaggagaagctgcagagggtgcggggcctcatccggcagtacggggaccacctggaggccagcagcaagctggtggagagcgccatccagagcatggaggagccccagatggccctgtacctgcagcaggccaaggagctgatcaacaaggtgggcgccatgagcaaggtggagctggccggccggcctgagcccggctatgaatccatggagcagttcaccgtgcgggtggagcacgtggccgagatgctgcggaccatcgacttccagcccggggccagcggggaggaggaggaggtggccccagatggagaggagggcagcgctggccctgaggaggagaggccagatggccccctgggcccctacagcgcctacgtgtccctgtgtggggccccctag

SEQ ID NO: 20164 - DNA, 1077 bp, Artificial Sequence
  Description of Artificial Sequence: Synthetic coding sequence
atgaacttcaccgtgggcttcaagcccctgctgggagatgcccacagcatggacaacctggagaagcagctgatctgccccatctgcctggagatgttcagcaagcctgtggtgatcctgccctgccagcacaacctgtgcaggaaatgtgccaatgatgtgttccaggccagcaaccccctgtggcagagccggggcagcaccaccgtgagcagcggcggccgcttccgctgccccagctgcagacatgaggtggtgctggacagacatggagtgtatggcctgcagaggaacctgctggtggagaacatcatcgacatctacaagcaggagagcagccggcccctgcacagcaaggccgagcagcacctgatgtgtgaggagcacgaggaggagaagatcaacatctactgcctgagctgtgaggtgcccacctgcagcctgtgcaaggtgtttggagcccacaaggactgtgaggtggcccccctgcccaccatctacaagaggcagaagtctgagctgagtgatggcatcgccatgctggtggccggaaatgacagagtgcaggccgtcatcacccagatggaggaggtgtgccagaccatcgaggacaacagccggcggcagaagcagctgctgaaccagagatttgagagcctgtgtgctgtgctggaggagaggaagggggagctgctgcaggccctggcccgggagcaggaggagaagctgcagagggtgcggggcctcatccggcagtatggagaccacctggaggccagcagcaagctggtggagagcgccatccagagcatggaggagccccagatggccctgtacctgcagcaggccaaggagctgatcaacaaggtgggcgccatgagcaaggtggagctggccggccggcctgagcccggctatgagagcatggagcagttcaccgtgcgggtggagcacgtggccgagatgctgcggaccatcgacttccagcccggggccagcggggaggaggaggaggtggccccagatggagaggagggcagcgctggccctgaggaggagaggccagatggcccctag

SEQ ID NO: 20165 - DNA, 756 bp, Artificial Sequence
  Description of Artificial Sequence: Synthetic coding sequence
atggccgccagcaccatgagcatctgcagcagcgcctgcacagacagctggagggtggtggactgcccagagagctgctgtgagccctgctgctgtgccccagcccccagcctgaccctggtgtgcacccctgtgtcctgtgtgagcagcccctgctgccagacagcctgtgagcccagcgcctgccagagcggctacaccagcagctgcaccaccccctgctaccagcagagcagctgccagcctgactgctgcaccagcagcccctgccagcaggcctgctgcgtgcctgtgtgctgcgtgcctgtgtgctgcgtgcctgtgtgcaacaagcctgtgtgctttgtgcccacctgcagcgagagcagccccagctgctgccagcagagcagctgccagcccacctgctgcaccagcagcccctgccagcaggcctgctgcgtgcctgtgtgcagcaagtctgtgtgctacgtgcctgtgtgcagcggggccagcaccagctgctgccagcagagcagctgccagcctgcctgctgcacagccagctgctgccggcccagcagctctgtgtccctgctgtgccaccctgtgtgcaagagcacctgctgcgtgcctgtgcccagctgtggggccagcgccagcagctgccagcccagctgctgcaggacagccagctgtgtgtccctgctgtgcaggcctgtgtgcagcaggcctgcctgctacagcctgtgcagcggccagaagagcagctgctag

SEQ ID NO: 20166 - DNA, 1128 bp, Artificial Sequence
  Description of Artificial Sequence: Synthetic coding sequence
atggccgccagcaccatgtctgtgtgcagcagtgacctgtcctatggcagccgggtgtgcctgcccggcagctgtgacagctgcagcgacagctggcaggtggatgactgcccagagagctgctgtgagcccccctgctgtgcccccagctgctgtgccccagccccctgcctgagcctggtgtgcacccctgtgtcccgggtgagcagcccctgctgccctgtgacctgtgagcccagcccctgccagagcggctgcaccagcagctgcacccccagctgctgccagcagagcagctgccagctggcctgctgtgccagcagcccctgccagcaggcctgctgcatgcctgtgtgctgcaagacagtgtgctgcaagcctgtgtactgtgtgcctgtgtgcagcggggacagcagctgctgccagcagagcagctgccagagcgcctgctgcaccagcagcccctgccagcaggcctgctgcgtgcccatctgctgcaagcctgtgtgcagcggcatcagcagcagctgctgccagcagagcagctgtgtgtcctgtgtgagcagcccctgctgccaggccgtgtgtgagcccagcccctgccagagcggctgcatcagcagctgcacccccagctgctgccagcagagcagctgccagcctgcctgctgcaccagcagcccctgccagcaggcctgctgcgtgcctgtgtgctgcaagcctgtgtgctgcgtgcccacctgcagtgatgacagcggcagctgctgccagcctgcctgctgcaccagcagccagagccagcagggctgctgcgtgcctgtgtgctgcaagcctgtgtgctgcgtgcctgtgtgcagcggggccagcagcagctgctgccagcagagcagctgccagcctgcctgctgcaccaccagctgctgccggcccagcagctctgtgtccctgctgtgcaggcctgtgtgccggcccacctgctgcgtgcctgtgcccagctgctgtgcccccaccagcagctgccaggccagctgctgcaggcctgccagctgtgtgtccctgctgtgcaggcctgcctgcagcaggcctgcctgctgcggccccaccagcacccagaagagcagctgctag

SEQ ID NO: 20167 - DNA, 1587 bp, Artificial Sequence
  Description of Artificial Sequence: Synthetic coding sequence
atggccaccagggtggaggaggccgcccggggccggggcggcggcgctgaggaggccacagaggccggccggggcggcagaagaagaagcccccggcagaagtttgaaattggcaccatggaggaggccggcatctgtggcctgggcgtgaaggctgacatgctgtgcaacagccagagcaatgacatcctgcagcaccagggcagcaactgtggcggcaccagcaacaagcacagcctggaggaggatgagggcagtgacttcatcacagaaaatagaaacctggtgtccccagcctactgcacccaggagagccgggaggagatccctggaggagaggccaggacagaccccccagatggccagcaggacagcgagtgcaacagaaacaaggagaagaccctgggcaaggaggtgctgctgctgatgcaggccctgaacaccctgagcaccccagaggagaagctggccgccctgtgcaagaagtatgctgacctgctggaggagagccgctctgtgcagaagcagatgaagatcctgcagaagaagcaggcccagatcgtgaaggagaaggtgcacctgcagagcgagcacagcaaggccatcctggcccggagcaagctggagagcctgtgccgggagctgcagaggcacaacaagaccctgaaggaggagaacatgcagcaggcccgggaggaggaggagaggaggaaggaggccacagcccacttccagatcaccctgaatgagatccaggcccagctggagcagcacgacatccacaatgccaagctgcggcaggagaacatcgagctgggggagaagctgaagaagctgattgagcagtatgccctgcgggaggagcacatcgacaaggtgttcaagcacaaggagctgcagcagcagctggtggatgccaagctgcagcagaccacccagctgatcaaggaggctgatgagaagcaccagcgggagcgggagttcctgctgaaggaggccacagagagccgccacaagtatgagcagatgaagcagcaggaggtgcagctgaagcagcagctgagcctgtacatggacaagtttgaggagttccagaccaccatggccaagagcaatgagctgttcaccaccttccggcaggagatggagaagatgaccaagaagatcaagaagctggagaaggagaccatcatctggaggaccaagtgggagaacaacaacaaggccctgctgcagatggccgaggagaagacagtgcgggacaaggagtacaaggccctgcagatcaagctggagcggctggagaagctgtgccgggccctgcagacagaaagaaatgagctgaatgagaaggtggaggtgctgaaggagcaggtgtccatcaaggccgccatcaaggccgccaacagagacctggccacccctgtgatgcagccctgcacagccctggacagccacaaggagctgaacaccagcagcaagagggccctgggcgcccacctggaggccgagcccaagagccagaggtctgctgtgcagaagccacccagcacaggcagcgccccagccatcgagagcgtggactag

SEQ ID NO: 20168 - DNA, 399 bp, Artificial Sequence
  Description of Artificial Sequence: Synthetic coding sequence
atgagggccagcccctgcatcagccagcctgctgcctcctggcacccccggcccagcgccctgcggcccacagctggcagcggccctgacaccaggaccccaggcaccgtggaggatggcagcgccccctgcccagccttccgcagccctgctgtgagcccctgtggggaggagccctgctgcttccagatcagccctgctgaggagaccctggagctgggccgcctggtgtccccaggcaactgtgacaccctgagccccagggctgctggcttctacgcctgccacgtgcgcagcctcatcccctgccgcagcaccaagggccgctggcccctgacagccagcgctgctggcctgagcagacatgcccagtgtggccccagcctgggcctgggctag

SEQ ID NO: 20169 - DNA, 1944 bp, Artificial Sequence
  Description of Artificial Sequence: Synthetic coding sequence
atggccgagttccgggtgcgggtgtccactggagaggccttcggggccggcacctgggacaaggtgtctgtgtccatcgtgggcaccagaggagagagcccccccctgcccctggacaacctgggcaaggagttcaccgctggagctgaggaggacttccaggtgaccctgcctgaagatgtgggccgggtgctgctgctgcgggtgcacaaggcccctcctgtgctgcccctgctgggccccctggccccagatgcctggttctgccgctggttccagctgaccccaccccggggcggccacctgctcttcccctgctaccagtggctggagggcgccggcaccctggtgctgcaggagggcacagccaaggtgtcctgggccgaccaccaccctgtgctgcagcagcagaggcaggaggagctgcaggcccggcaggagatgtaccagtggaaggcctacaaccctggctggccccactgcctggatgagaagacagtggaggacctggagctgaacatcaagtacagcacagccaagaatgccaacttctacctgcaggccggcagcgcctttgctgagatgaagatcaagggcctgctggacaggaagggcctgtggaggagcctgaatgagatgaagaggatcttcaacttccggaggaccccagctgctgagcacgcctttgagcactggcaggaggatgccttctttgccagccagttcctgaatggcctgaaccctgtgctgatccgccgctgccactacctgcccaagaacttccctgtgacagatgccatggtggcctctgtgctgggccctggcaccagcctgcaggccgagctggagaagggcagcctcttcctggtggaccacggcatcctgagcggcatccagaccaacgtcatcaacgggaagccccagttctctgctgcccccatgaccctgctgtaccagagccctggctgcggccccctgctgcccctggccatccagctgagccagaccccaggccccaacagccccatcttcctgcccacagatgacaagtgggactggctgctggccaagacctgggtgagaaatgctgagttctccttccacgaggccctgacccacctgctgcacagccacctgctgcctgaggtgttcaccctggccaccctgcggcagctgccccactgccaccccctcttcaagagcacaggcatcggcatcgagggcttcagcgagctgatccagaggaacatgaagcagctgaactacagcctgctgtgcctgcctgaggacatccgcacccggggcgtggaggacatccctggctactactacagagatgatggcatgcagatctggggcgctgtggagagatttgtgtctgagatcatcggcatctactaccccagtgatgagagcgtgcaggatgaccgggagctgcaggcctgggtgcgggagatcttcagcaagggcttcctgaaccaggagagcagcggcatccccagcagcctggagacccgggaggccctggtgcagtatgtgaccatggtgatcttcacctgcagcgccaagcatgctgctgtgtctgctggccagtttgacagctgtgcctggatgcccaacctgccccccagcatgcagctgcccccacccaccagcaagggcctggccacctgtgagggcttcatcgccaccctgccccctgtgaatgccacctgtgatgtgatcctggccctgtggctgctgagcaaggagcccggggaccagaggcccctgggcacctacccagatgagcacttcacagaggaggcccccaggaggagcatcgccaccttccagagccggctggcccagatcagccggggcatccaggagaggaaccagggcctggtgctgccctacacctacctggacccccccctgattgagaacagcgtgtccatctag

SEQ ID NO: 20170 - DNA, 2031 bp, Artificial Sequence
  Description of Artificial Sequence: Synthetic coding sequence
atggccgagttccgggtgcgggtgtccactggagaggccttcggggccggcacctgggacaaggtgtctgtgtccatcgtgggcaccagaggagagagcccccccctgcccctggacaacctgggcaaggagttcaccgctggagctgaggaggacttccaggtgaccctgcctgaagatgtgggccgggtgctgctgctgcgggtgcacaaggcccctcctgtgctgcccctgctgggccccctggccccagatgcctggttctgccgctggttccagctgaccccaccccggggcggccacctgctcttcccctgctaccagtggctggagggcgccggcaccctggtgctgcaggagggcacagccaaggtgtcctgggccgaccaccaccctgtgctgcagcagcagaggcaggaggagctgcaggcccggcaggagatgtaccagtggaaggcctacaaccctggctggccccactgcctggatgagaagacagtggaggacctggagctgaacatcaagtacagcacagccaagaatgccaacttctacctgcaggccggcagcgcctttgctgagatgaagatcaagggcctgctggacaggaagggcctgtggaggagcctgaatgagatgaagaggatcttcaacttccggaggaccccagctgctgagcacgcctttgagcactggcaggaggatgccttctttgccagccagttcctgaatggcctgaaccctgtgctgatccgccgctgccactacctgcccaagaacttccctgtgacagatgccatggtggcctctgtgctgggccctggcaccagcctgcaggccgagctggagaagggcagcctcttcctggtggaccacggcatcctgagcggcatccagaccaacgtcatcaacgggaagccccagttctctgctgcccccatgaccctgctgtaccagagccctggctgcggccccctgctgcccctggccatccagctgagccagaccccaggccccaacagccccatcttcctgcccacagatgacaagtgggactggctgctggccaagacctgggtgagaaatgctgagttctccttccacgaggccctgacccacctgctgcacagccacctgctgcctgaggtgttcaccctggccaccctgcggcagctgccccactgccaccccctcttcaagctgctgatcccccacacccgctacaccctgcacatcaacaccctggcccgggagctgctgattgtgcccggccaggtggtggacaggagcactggaattggaattgagggcttcagcgagctgatccagaggaacatgaagcagctgaactacagcctgctgtgcctgcctgaggacatccgcacccggggcgtggaggacatccctggctactactacagagatgatggcatgcagatctggggcgctgtggagagatttgtgtctgagatcatcggcatctactaccccagtgatgaatctgtgcaggatgaccgggagctgcaggcctgggtgcgggagatcttcagcaagggcttcctgaaccaggagagcagcggcatccccagcagcctggagacccgggaggccctggtgcagtatgtgaccatggtgatcttcacctgcagcgccaagcacgccgctgtgtctgctggccagtttgacagctgtgcctggatgcccaacctgcccccatccatgcagctgcccccacccaccagcaagggcctggccacctgtgagggcttcatcgccaccctgccccctgtgaatgccacctgtgatgtgatcctggccctgtggctgctgagcaaggagcccggggaccagaggcccctgggcacctacccagatgagcacttcacagaggaggccccccggcgcagcatcgccaccttccagagccggctggcccagatcagccggggcatccaggagaggaaccagggcctggtgctgccctacacctacctggacccccccctgattgaaaattctgtgtccatctag

SEQ ID NO: 20171 - DNA, 1665 bp, Artificial Sequence
  Description of Artificial Sequence: Synthetic coding sequence
atggccaccagcgctgacagccccagcagccccctgggcgctgaggacctgctgagtgacagcagcgagcccccaggcctgaaccaggtgagcagcgaggtgaccagccagctgtatgccagcctgcggctgagccggcaggccgaggccacagcccgggcccagctgtacctgcccagcaccagcccccctcatgagggcctggatggctttgcccaggagctgagccgcagcctgtctgtgggcctggagaagaacctgaagaagaaggatggcagcaagcacatctttgagatggagagcgtgcggggccagctgcagaccatgctgcagaccagccgggacacagcctacagagaccccctcatccctggggccggcagcgagcggcgggaggaggacagctttgacagcgacagcacagccaccctgctgaacacccggcccctgcaggacctgagccccagcagcagcgcccaggccctggaggagctgttcccccgctacaccagcctgcggcccggcccccccctgaaccccccagacttccagggcctgagagatgccctggacagcgagcacaccaggaggaagcactgtgagcggcacatccagagcctgcagaccagggtgctggagctgcagcagcagctggccgtggccgtggccgctgacaggaagaaggacaccatgattgagcagctggacaagaccctggcccgggtggtggagggctggaacagacatgaagctgagaggacagaggtgctgcggggcctgcaggaggagcaccaggccgctgagctgaccaggagcaagcagcaggagaccgtgacccggctggagcagagcctgtctgaggccatggaggccctgaaccgggagcaggagagcgcccggctgcagcagcgggagcgggagaccctggaggaggagcggcaggccctgaccctgcggctggaggccgagcagcagcgctgctgcgtgctgcaggaggagagagatgctgcccgggccggccagctgtctgagcaccgggagctggagaccctgcgggccgccctggaggaggagcggcagacctgggcccagcaggagcaccagctgaaggagcactaccaggccctgcaggaggagagccaggcccagctggagcgggagaaggagaagagccagcgggaggcccaggccgcctgggagacccagcaccagctggccctggtgcagagcgaggtgcggcggctggagggggagctggacacagcccggcgggagagagatgccctgcagctggagatgagcctggtgcaggcccgctatgagagccagaggatccagctggagagcgagctggccgtgcagctggagcagagggtgacagagcggctggcccaggcccaggagagcagcctgcggcaggccgccagcctgcgggagcaccacaggaagcagctgcaggacctgagcggccagcaccagcaggagctggccagccagctggcccagttcaaggtggagatggccgagcgggaggagcggcagcagcaggtggctgaagattatgagctgcggctgctgctgctggaccccccagcccctggcctgcggagccccaggagaagaagaggaggcagcggcctgtgcctgccctggccctggccctag

SEQ ID NO: 20172 - DNA, 2778 bp, Artificial Sequence
  Description of Artificial Sequence: Synthetic coding sequence
atggccaccagcgctgacagccccagcagccccctgggcgctgaggacctgctgagtgacagcagcgagcccccaggcctgaaccaggtgagcagcgaggtgaccagccagctgtatgccagcctgcggctgagccggcaggccgaggccacagcccgggcccagctgtacctgcccagcaccagcccccctcatgagggcctggatggctttgcccaggagctgagccgcagcctgtctgtgggcctggagaagaacctgaagaagaaggatggcagcaagcacatctttgagatggagagcgtgcggggccagctgcagaccatgctgcagaccagccgggacacagcctacagagaccccctcatccctggggccggcagcgagcggcgggaggaggacagctttgacagcgacagcacagccaccctgctgaacacccggcccctgcaggacctgagccccagcagcagcgcccaggccctggaggagctgttcccccgctacaccagcctgcggcccggcccccccctgaaccccccagacttccagggcctgagagatgccctggacagcgagcacaccaggaggaagcactgtgagcggcacatccagagcctgcagaccagggtgctggagctgcagcagcagctggccgtggccgtggccgctgacaggaagaaggacaccatgattgagcagctggacaagaccctggcccgggtggtggagggctggaacagacatgaagctgagaggacagaggtgctgcggggcctgcaggaggagcaccaggccgctgagctgaccaggagcaagcagcaggagaccgtgacccggctggagcagagcctgtctgaggccatggaggccctgaaccgggagcaggagagcgcccggctgcagcagcgggagcgggagaccctggaggaggagcggcaggccctgaccctgcggctggaggccgagcagcagcgctgctgcgtgctgcaggaggagagagatgctgcccgggccggccagctgtctgagcaccgggagctggagaccctgcgggccgccctggaggaggagcggcagacctgggcccagcaggagcaccagctgaaggagcactaccaggccctgcaggaggagagccaggcccagctggagcgggagaaggagaagagccagcgggaggcccaggccgcctgggagacccagcaccagctggccctggtgcagagcgaggtgcggcggctggagggggagctggacacagcccggcgggagagagatgccctgcagctggagatgagcctggtgcaggcccgctatgagagccagaggatccagctggagagcgagctggccgtgcagctggagcagagggtgacagagcggctggcccaggcccaggagagcagcctgcggcaggccgccagcctgcgggagcaccacaggaagcagctgcaggacctgagcggccagcaccagcaggagctggccagccagctggcccagttcaaggtggagatggccgagcgggaggagcggcagcagcaggtggctgaagattatgagctgcggctggcccgggagcaggcccgggtgtgtgagctgcagagcggcaaccagcagctggaggagcagagggtggagctggtggagcggctgcaggccatgctgcaggcccactgggatgaggccaaccagctgctgagcaccaccctgcccccacccaaccccccagcccccccagctggccccagcagccctggcccccaggagcctgagaaggaggagaggagagtgtggaccatgccacccatggctgtggccctgaagcctgtgctgcagcagagccgggaggccagagatgagctgcccggggcccctcctgtgctgtgcagcagcagcagtgacctgagcctgctgctgggccccagcttccagagccagcacagcttccagcccctggagcccaagccagacctgaccagcagcacagctggggccttcagcgccctgggcgccttccacccagaccacagagctgagcggcccttcccagaagaagatcctggcccagatggagagggcctgctgaagcagggcctgcccccagcccagctggagggcctgaagaacttcctgcaccagctgctggagaccgtgccccagaacaatgaaaaccccagcgtggacctgctgccccccaagagcggccccctgactgtgcccagctgggaggaggccccccaggtgccccgcatccccccacctgtgcacaagaccaaggtgcccctggccatggccagcagcctcttccgggtgcctgagccccccagcagccacagccagggcagcggccccagcagcggcagccctgagagaggaggagatggcctgaccttcccccggcagctgatggaggtgtcccagctgctgcggctgtaccaggcccggggctggggcgccctgcctgctgaggacctgctgctgtacctgaagaggctggagcacagcggctacaagccaggcaggaaggaggagggcttcagcggctggaagctggactatggagagtggagcggcacagatggccgcggggacaacgtgcccaggaggaacacagacagccggctgggggagatccccaggaaggagatccccagccaggccgtgccccggcggctggccacagcccccaagacagagaagcccccagccaggaagaagagcggccacccagcccccagctccatgaggagcagaggaggagtgtggaggtag

SEQ ID NO: 20173 - DNA, 2961 bp, Artificial Sequence
  Description of Artificial Sequence: Synthetic coding sequence
atgtacttctgctggggcgctgacagccgggagctgcagaggagaagaacagctggcagccctggagctgagctgctgcaggccgccagcggggagcggcacagcctgctgctgctgaccaaccaccgggtgctgagctgtggggacaacagccggggccagctgggcagaagaggagcccagagaggagagctgcctgagcccatccaggccctggagaccctcatcgtggacctggtgtcctgtgggaaggagcacagcctggccgtgtgccacaagggccgggtgtttgcctggggcgccggcagcgagggccagctgggcattggagagttcaaggagatctccttcacccccaagaagatcatgaccctgaatgacatcaagatcatccaggtgtcctgtggccactaccacagcctggccctgagcaaggacagccaggtgttctcctggggcaagaacagccacggccagctgggcctgggcaaggagttccccagccaggccagcccccagagggtgcgcagcctggagggcatccccctggcccaggtggccgccggcggggcccacagctttgccctgagcctgtgtggcaccagctttggctggggcagcaacagcgctggccagctggccctgagcggcagaaatgtgcctgtgcagagcaacaagcccctgtctgtgggcgccctgaagaacctgggcgtggtgtacatcagctgtggagatgcccacacagctgtgctgacccaggacggcaaggtgttcaccttcggggacaacagaagtggccagctgggctacagccccaccccagagaagaggggcccccagctggtggagagaattgatggcctggtgtcccagattgactgtggcagctaccacaccctggcctacgtgcacaccaccggccaggtggtgtcctttggccacggccccagcgacaccagcaagcccacccaccctgaggccctgacagagaactttgacatcagctgcctgatctctgcagaagattttgtggatgtgcaggtgaagcacatctttgctggcacctacgccaactttgtgaccacccaccaggacaccagcagcacccgggcccctgggaagaccctgcctgagatcagccgcatcagccagagcatggccgagaagtggattgctgtgaagagaagaagcacagagcacgagatggccaagtctgagatccgcatgatcttcagcagccctgcctgcctgacagccagcttcctgaagaagaggggcactggagagaccaccagcattgatgtggacctggagatggcccgggacaccttcaagaagctgaccaagaaggagtggatcagctccatgatcaccacctgcctggaggatgacctgctgcgggccctgccctgccacagcccccaccaggaggccctgagcgtcttcctgctgctgcctgaatgtcctgtgatgcatgacagcaagaactggaagaacctggtggtgccctttgccaaggctgtgtgtgagatgagcaagcagagcctgcaggtgctgaagaagtgctgggccttcctgcaggagagcagcctgaaccccctcatccagatgctgaaggccgccatcatcagccagctgctgcaccagaccaagacagagcaggaccactgcaatgtgaaggccctgctgggcatgatgaaggagctgcacaaggtgaacaaggccaactgccgcctgcctgagaacaccttcaacatcaatgagctgagcaacctgctgaacttctacatcgaccggggccggcagctgttccgggacaaccacctgatgtctgagaagaaggcctacatgctgatgcatgagaccatcctgcagaagaaggatgagttcccccccagcccccgcttcatcctgcgggtgagaagaagccggctggtgaaggatgccctgcggcagctgagccaggccgaggccacagacttctgcaaggtgctggtggtggagttcatcaatgagatctgcccagagagcggaggagtgagcagcgagttcttccactgcatgtttgaggagatgaccaagccagaatatggcatgttcatgtacccagagatgggcagctgcatgtggttccctgccaagcccaagccagagaagaagcgctacttcctgtttggcatgctgtgtggcctgagcctcttcaacctgaatgtggccaacctgcccttccccctggccctgtacaagaagctgctggaccagaagcccagcctggaggacctgaaggagctgagcccccggctgggcaagagcctgcaggaggtgctggatgatgctgctgatgacattggagatgccctgtgcatccgcttcagcatccactgggaccagaatgatgtggacctgatccccaacggcatcagcatccctgtggaccagaccaacaagagggactatgtgtccaagtacatcgactacatcttcaacgtgtctgtgaaggctgtgtatgaggagttccagaggggcttctacagagtgtgtgagaaggagatcctgcggcacttctacccagaggagctgatgacagccatcatcggcaacacagattatgactggaagcagtttgagcagaacagcaaatatgagcagggctaccagaagagccaccccaccatccagctgttctggaaggccttccacaagctgaccctggatgagaagaagaagttcctgttcttcctgaccggccgggaccggctgcacgcccggggcatccagaagatggagatcgtgttccgctgcccagagaccttcagcgagcgggaccaccccaccagcatcacctgccacaacatcctgagcctgcccaagtacagcaccatggagaggatggaggaggccctgcaggtggccatcaacaacaacagaggatttgtgagccccatgctgacccagagctag

SEQ ID NO: 20174 - DNA, 435 bp, Artificial Sequence
  Description of Artificial Sequence: Synthetic coding sequence
atgaccacccggcaggccaccaaggaccccctgctgcggggcgtgagccccacccccagcaagatccctgtgcgcagccagaagaggacccccttccccaccgtgaccagctgtgctgtggaccaggagaaccaggacccccggcgctgggtgcagaagccacccctgaacatccagaggcccctggtggacagcgctggcccccggcccaaggcccggcaccaggccgagaccagccagaggctggtgggcatcagccagcccaggaaccccctggaggagctgcggcccagcccccggggccagaatgtgggccctggccccccagcccagacagtgctggtgcctgcccctgggaagctgtttgccctgcggcgcagccccttccccccagccaagtgccacctggcccgctgccacggcctgtacctgtag

SEQ ID NO: 20175 - DNA, 327 bp, Artificial Sequence
  Description of Artificial Sequence: Synthetic coding sequence
atggctgacccccgggtgcggcagatcaagatcaagacaggagtggtgaagaggctggtgaaggagaaggtgatgtatgagaaggaggccaagcagcaggaggagaagattgagaagatgagagcagaagatggagagaactatgacatcaagaagcaggccgagatcctgcaggagagcaggatgatgatcccagactgccagaggcggctggaggccgcctacctggacctgcagaggatcctggagaatgagaaggacctggaggaggccgaggagtacaaggaggcccggctggtgctggacagcgtgaagctggaggcctag

SEQ ID NO: 20176 - DNA, 1341 bp, Artificial Sequence
  Description of Artificial Sequence: Synthetic coding sequence
atgagagaatgtctgagcatccacatcggccaggccggcatccagattggagatgcctgctgggagctgtactgcctggagcacggcatccagcccaatggagtggtgctggacacccagcaggaccagctggagaatgccaagatggagcacaccaatgccagctttgacaccttcttctgtgagaccagggctgggaagcacgtgccccgggccctgtttgtggacctggagcccaccgtgattgatggcatcagaacaggccagcacaggagcctcttccaccctgagcagctgctgagcggcaaggaggatgctgccaacaactatgcccggggccgctacagcgtgggcagcgaggtgattgacctggtgctggagaggaccaggaagctggccgagcagtgtggcggcctgcagggcttcctgatcttccgcagctttggaggcggcaccggcagcggcttcaccagcctgctgatggagcggctgactggagagtacagcaggaagaccaagctggagttctctgtgtacccagccccccgcatcagcacagctgtggtggagccctacaacagcgtgctgaccacccacagcaccacagagcacacagactgcaccttcatggtggacaatgaagctgtgtatgacatctgccacaggaagctgggcgtggagtgccccagccacgccagcatcaaccggctggtggtgcaggtggtgagcagcatcacagccagcctgcgctttgagggccccctgaatgtggacctgattgagttccagaccaacctggtgccctacccccgcatccacttccccatgacagcctttgcccccatcgtgtctgctgacaaggcctaccacgagcagttctctgtgtctgacatcaccacagcctgctttgagagcagcaaccagctggtgaagtgtgacccccggctgggcaagtacatggcctgctgcctgctgtacagaggagatgtggtgcccaaggaggtgaatgctgccatcgccgccaccaagagccgccacagcgtgcagtttgtggactggtgccccaccggcttcaaggtgggcatcaacaaccggccccccaccgtgatgcctggaggagacctggccaaggtgcacaggagcatctgcatgctgagcaacaccacagccatcgtggaggcctgggcccggctggaccacaagtttgacctgatgtatgccaagagggccttcctgcactggtacctgcgggagggcatggaggaggccgagttcctggaggcccgggaggacctggccgccctggagcgggactatgaggaggtggcccagagcttctag

SEQ ID NO: 20177 - DNA, 873 bp, Artificial Sequence
  Description of Artificial Sequence: Synthetic coding sequence
atgggcagcagcaagaaggtgaccctgtctgtgctgagccgggagcagagcgagggcgtgggcgcccgggtgagaagaagcatcggccggcctgagctgaagaacctggaccccttcctgctgtttgatgagttcaagggcggccggcctgggggcttcccagaccacccccaccggggctttgaaacagtgtcctacctgctggagggcggctccatggcccacgaggacttctgtggccacacaggcaagatgaaccctggggacctgcagtggatgacagctggccggggcatcctgcacgccgagatgccctgcagcgaggagcccgcccacggcctgcagctgtgggtgaacctgcggagcagcgagaagatggtggagccccagtaccaggagctgaagtctgaggagatccccaagcccagcaaggatggagtgacagtggccgtcatctctggagaggccctgggcatcaagagcaaggtgtacaccaggacccccaccctgtacctggacttcaagctggaccccggggccaagcacagccagcccatccccaagggctggaccagcttcatctacaccatctctggagatgtgtacatcggcccagatgatgcccagcagaagattgagccccaccacacagctgtgctgggggagggggacagcgtgcaggtggagaacaaggaccccaagaggagccactttgtgctgattgctggggagcccctgcgggagcctgtgatccagcacggcccctttgtgatgaacaccaatgaggagatcagccaggccatcctggacttcagaaatgccaagaatggatttgagcgggccaagacctggaagagcaagattggcaactag

SEQ ID NO: 20178 - DNA, 873 bp, Artificial Sequence; identical to SEQ ID NO: 20177
  Description of Artificial Sequence: Synthetic coding sequence

SEQ ID NO: 20179 - DNA, 1200 bp, Artificial Sequence
  Description of Artificial Sequence: Synthetic coding sequence
atggacttcttcagcagccacctgctggccgacagcagcagccctgccaccaacagcagccacacagatgcccacgagatcctggtgtctgacttcctggtgtctgatgagaacctgcagaagatggagaatgtgctggacctgtggagcagcggcctgaagaccaacatcatcagcgagctgagcaagtggaggctgaacttcatcgactggcacaggatggagatgaggaaggagaaggagaagcacgccgcccacctgaagcagctgtgcaaccagatcaatgagctgaaggagctgcagaagacctttgagatcagcatcggcaggaaggatgaggtgatcagcagcctgagccacgccatcggcaagcagaaggagaagattgagctgatgaggaccttcttccactggagaattggccacgtgcgggcccggcaggatgtgtatgagggcaagctggccgaccagtactaccagaggaccctgctgaagaaggtgtggaaggtgtggaggtctgtggtgcagaagcagtggaaggatgtggtggagcgggcctgccaggcccgggcagaggaggtgtgcatccagatcagcaatgactatgaggccaaggtggccatgctgagcggggccctggagaatgccaaggccgagatccagaggatgcagcacgagaaggagcactttgaagattccatgaagaaggccttcatgagaggagtgtgtgccctgaacctggaggccatgaccatcttccagaacagaaatgatgctggcatcgacagcaccaacaacaagaaggaggagtatggccctggggtgcagggcaaggagcacagcgcccacctggaccccagcgccccacccatgcccctgcctgtgaccagccccctgctgcccagccccccagctgctgtgggcggggccagcgccacagctgtgcccagcgctgcctccatgaccagcacccgggccgccagcgccagctctgtgcacgtgcctgtgtctgccctgggcgccggcagcgctgccacagctgccagcgaggagatgcagaccatcccccaggccacagctgccaagtaccccaggaccatccaccctgagagcagcaccagcgccagccgcagcctgggcaccaggtctgcccacacccagagcctgacctctgtgcacagcatcaaggtggtggactag

SEQ ID NO: 20180 - DNA, 729 bp, Artificial Sequence
  Description of Artificial Sequence: Synthetic coding sequence
atggctgctgtgaaggccagcaccagcaaggccacccggccctggtacagccaccctgtgtatgcccgctactggcagcactaccaccaggccatggcctggatgcagagccaccacaatgcctacaggaaggctgtggagagctgcttcaacctgccctggtacctgcccagcgccctgctgccccagagcagctatgacaatgaggccgcctacccccagagcttctatgaccaccacgtggcctggcaggactacccctgcagcagcagccacttccgccgcagcggccagcacccccgctacagcagccgcatccaggccagcaccaaggaggaccaggccctgagcaaggaggaggagatggagacagaaagtgatgctgaggtggagtgtgacctgagcaacatggagatcacagaggagctgcggcagtactttgctgagacagagcggcaccgggaggagcggcggcggcagcagcagctggatgctgagcggctggacagctatgtgaatgctgaccatgacctgtactgcaacaccaggagatctgtggaggcccccacagagaggcctggagagcggcggcaggccgagatgaagaggctgtatggagacagcgctgccaagatccaggccatggaggccgctgtgcagctgagctttgacaagcactgtgacaggaagcagcccaagtactggcctgtgatccccctgaagttctag

SEQ ID NO: 20181 - DNA, 1482 bp, Artificial Sequence
  Description of Artificial Sequence: Synthetic coding sequence
atggagaggagcccagatgtgtccccaggccccagccgctccttcaaggaggagctgctgtgtgctgtgtgctatgaccccttcagagatgctgtgaccctgcgctgtggccacaacttctgccggggctgtgtgagccgctgctgggaggtgcaggtgagccccacctgccctgtgtgcaaggaccgggccagccctgctgacctgcggaccaaccacaccctgaacaacctggtggagaagctgctgcgggaggaggccgagggcgcccgctggaccagctaccgcttcagccgggtgtgccgcctgcaccggggccagctgagcctcttctgcctggaggacaaggagctgctgtgctgcagctgccaggccgaccccaggcaccagggccaccgggtgcagcctgtgaaggacacagcccatgacttccgggtgcgcagcctgattgctgaggagaggaggaacttcctgcccacccaccagtggatcgtgaccaagacccggctgcagaccagcagccccaacctgcagagccggcggcagggccaggtgcaggagcacggggcctgcacagctggggagggccagggcctgctgggccatgctgccctgctggatgccatggccgaggagacccggcagaagcagctgctggctgatgagaagatgaagcagctgacagaggagacagaggtgctggcccacgagattgaaaggctgcagatggagatgaaggaggatgatgtgtccttcctgatgaagcacaagagcaggaagagaagactcttctgcaccatggagcctgagcctgtgcagcccggcatgctgattgatgtgtgcaagtacctgggcagcctgcagtacagagtgtggaagaagatgctggcctctgtggagagcgtgcccttctcctttgaccccaacacagctgctggctggctgtctgtgtctgatgacctgacctctgtgaccaaccacggctacagagtgcaggtggagaaccctgagcgcttcagcagcgccccctgcctgctgggcagcagggtcttcagccagggcagccacgcctgggaggtggccctgggcggcctgcagagctggagggtgggcgtggtgcgggtgcggcaggacagcggggctgagggccacagccacagctgctaccatgacaccaggagcggcttctggtacgtgtgcaggacccagggcgtggagggggaccactgtgtgaccagtgaccctgccaccagccccctggtgctggccatcccccggcggctgcgggtggagctggagtgtgaggagggggagctgtccttctatgatgctgagcggcactgccacctgtacaccttccacgccaggtttggagaggtgcggccctacttctacctgggcggggcccggggggccggccccccagagcccctgcgcatctgccccctgcacatctctgtgaaggaggagctggatggatag

SEQ ID NO: 20182 - DNA, 1473 bp, Artificial Sequence
  Description of Artificial Sequence: Synthetic coding sequence
atgaacctggccgagatctgtgacaatgccaagaagggccgggagtatgccctgctgggcaactatgacagctccatggtgtactaccagggcgtgatgcagcagatccagaggcactgccagagcgtgcgggaccctgccatcaagggcaagtggcagcaggtgcggcaggagctgctggaggagtatgagcaggtgaagagcatcgtgtccaccctggagagcttcaagattgacaagcccccagacttccctgtgtcctgccaggatgagcccttccgggaccctgctgtgtggcccccacctgtgcctgctgagcaccgggccccaccccagatccggcggcccaaccgggaggtgcggcccctgaggaaggagatggccggcgtgggcgcccggggccctgtgggccgggcccaccccatcagcaagtctgagaagcccagcaccagccgggacaaggactaccgggcccggggcagagatgacaagggcaggaagaacatgcaggatggagccagtgatggagagatgcccaagtttgatggagctggctatgacaaggacctggtggaggccctggagcgggacatcgtgtccaggaaccccagcatccactgggatgacattgctgacctggaggaggccaagaagctgctgcgggaggccgtggtgctgcccatgtggatgccagacttcttcaagggcatccggcggccctggaagggcgtgctgatggtgggccccccaggcaccgggaagaccatgctggccaaggctgtggccacagaatgtggcaccaccttcttcaacgtgagcagcagcaccctgaccagcaagtacagaggagagagcgagaagctggtgcggctgctgtttgagatggcccgcttctacgcccccaccaccatcttcattgatgaaattgacagcatctgcagcagaagaggcaccagtgatgagcacgaggccagccggcgggtgaagtctgagctgctgatccagatggatggagtgggcggggccctggagaatgatgaccccagcaagatggtgatggtgctggccgccaccaacttcccctgggacattgatgaggccctgcggcggcggctggagaagaggatctacatccccctgcccacagccaagggccgggcagagctgctgaagatcaacctgcgggaggtggagctggaccctgacatccagctggaggacattgctgagaagattgagggctacagcggggctgacatcaccaacgtgtgcagagatgccagcctgatggccatgagaagacgcatcaatggcctgagccctgaggagatccgggccctgagcaaggaggagctgcagatgcctgtgaccaagggggactttgagctggccctgaagaagatcgccaagtctgtgtctgctgctgacctggagaagtatgagaagtggatggtggagtttggaagtgcctag

SEQ ID NO: 20183 - DNA, 1473 bp, Artificial Sequence; identical to SEQ ID NO: 20182
  Description of Artificial Sequence: Synthetic coding sequence

SEQ ID NO: 20184 - DNA, 1068 bp, Artificial Sequence
  Description of Artificial Sequence: Synthetic coding sequence
atggacttcatcttccacgagaagcaggagggcttcctgtgtgcccagcactgcctgaacaacctgctgcagggcgagtacttcagccctgtggagctggccagcatcgcccaccagctggatgaggaggagaggatgaggatggccgagggcggcgtgaccagcgaggagtacctggccttcctgcagcagcccagcgagaacatggatgacaccggcttcttcagcatccaggtgatcagcaatgccctgaagttctggggcctggagatcatccacttcaacaaccctgagtaccagaagctgggcatcgaccccatcaatgaaagaagcttcatctgcaactacaagcagcactggttcaccatcaggaagtttgggaagcactggttcaacctgaacagcctgctggccggccctgagctgatcagtgacacctgcctggccaacttcctggcccggctgcagcagcaggcctacagcgtgtttgtggtgaagggggacctgcctgactgtgaggccgaccagctgctgcagatcatctctgtggaggagatggacacccccaagctgaatggcaagaagctggtgaagcagaaggagcaccgggtgtacaagacagtgctggagaaggtgtctgaggagagtgatgaaagtggcaccagtgaccaggatgaggaggacttccagagggccctggagctgagccggcaggagaccaacagagaagatgagcacctgcggagcaccatcgagctgtccatgcagggcagcagcggcaacaccagccaggacctgcccaagaccagctgtgtgaccccagccagcgagcagcccaagaagatcaaggaggactactttgagaagcaccagcaggagcagaagcagcagcagcagcagagcgacctgcccggccacagcagctacctgcacgagcggcccaccaccagcagccgggccattgaaagtgacctgagtgatgacatcagcgagggcaccgtgcaggccgctgtggacaccatcctggagatcatgaggaagaacctgaagatcaagggggagaagtag

SEQ ID NO: 20185 - DNA, 5910 bp, Artificial Sequence
  Description of Artificial Sequence: Synthetic coding sequence
atggccgcccggagcgcccccagctgccacctgcggctggagtgggtgtatggctaccggggccaccagtgcaggaacaacctgtactacacagctgccaaggagatcgtgtactttgtggccggcgtgggcgtggtgtacagcccccgggagcaccggcagaagttctaccggggccacagtgatgacatcatcagcctggccctgcaccctgagcgggtgctggtggccaccggccaggtgggcaaggagccctacatctgcatctgggacagctacacagtgcagaccatctctgtgctgaaggatgtgcacacccatggaattgcctgcctggcctttgacctggatggccagaggctggtgtctgtgggcctggacagcaagaatgctgtgtgtgtgtgggactggaagaggggcaagatgctgtccatggcccctggccacacagaccgcatctttgacatctcctgggacctgtaccagcccaacaagctggtgtcctgtggggtgaagcacatcaagttctggagcctgtgtggaaatgccctgacccccaagaggggcgtgtttgggaagacaggagacctgcagaccatcctgtgcctggcctgtgccagagatgagctgacctacagcggggccctgaatggagacatctacgtgtggaagggcatcaacctgatccgcaccatccagggcgcccatgctgctggcatcttctccatgaatgcctgtgaggagggctttgccaccggcggcagagatggctgcatccggctgtgggacctgaccttcaagcccatcaccgtcatcgacctgcgggagacagaccagggctacaagggcctgtctgtgcgctctgtgtgctggaggggggaccacatcctggtgggcacccaggacagcgagatctttgagatcgtggtgcaggagaggaacaagcccttcctgatcatgcagggccactgtgagggggagctgtgggccctggccgtgcaccccaccaagcccctggccgtgacaggcagtgatgacagatctgtgcgcatctggagcctggtggaccacgccctgattgcccgctgcaacatggaggagcccatccgctgtgccgctgtgaatgctgatggcatccacctggccctgggcatgaaggatggcagcttcaccgtgctgcgggtgcgggacatgacagaggtggtgcacatcaaggacaggaaggaggccatccacgagctgaagtacagcccagatggcacctacctggccgtgggctgcaatgacagctctgtggacatctatggagtggcccagcgctacaagaaggtgggggagtgcctgggcagcctgtccttcatcacccacctggactggagcagtgacagccgctacctgcagaccaatgatggaaatggcaagaggctcttctacaggatgcctgggggcaaggaggtgaccagcacagaggagatcaagggcgtgcactgggcctcctggacctgtgtgtctggcctggaggtgaatggcatctggcccaagtacagcgacatcaatgacatcaacagcgtggatggcaactacatcggccaggtgctggtgacagcagatgattatggcatcatcaagctgttccgctacccctgcctgaggaagggggccaagttcaggaagtacatcggccacagcgcccacgtgaccaacgtgcgctggagccatgactaccagtgggtgatcagcattggaggagctgaccacagcgtcttccagtggaagttcatccctgagaggaagctgaaggatgctgtgcacatcgccccccaggagagcctggccgacagccacagtgatgaaagtgacagcgacctgagtgatgtgcctgagctggacagcgagattgagcaggagacccagctgacctaccgccggcaggtgtacaaggaggacctgccccagctgaaggagcagtgcaaggagaagcagaagagcgccaccagcaagaggcgggagcgggcccctggcaacagcatccggctgcactttgtgcacggctaccggggctatgactgccgcagcaacctcttctacacccagattggagagatcgtgtaccacgtggccgctgtgggcgtcatctacaaccggcagcagaacacccagcgcttctacctgggccatgatgatgacatcctgtgcctgaccatccaccccctgaaggactatgtggccaccggccaggtgggccgggaccccagcatccacatctgggacacagagaccatcaagcccctgagcatcctgaagggccaccaccagtatggagtgtctgctgtggacttcagcgcagatggcaagaggctggcctctgtgggcattgatgacagccacacagtggtgctgtgggactggaagaagggggagaagctgagcatcgcccggggcagcaaggacaagatctttgtggtgaagatgaacccctacgtgcctgacaagctgatcacagctggcatcaagcacatgaagttctggaggaaggccggcggcggcctgattggaaggaagggctacatcggcaccctgggcaagaatgacaccatgatgtgtgctgtgtatggctggacagaggagatggccttcagcggcaccagcactggagatgtgtgcatctggagggacatcttcctggtgaagacagtgaaggcccatgatggccctgtgttctccatgcacgccctggagaagggctttgtgactggaggcaaggatggcatcgtggccctgtgggatgacagctttgagcgctgcctgaagacctacgccatcaagagagctgccctggcccctggcagcaagggcctgctgctggaggacaaccccagcatccgggccatcagcctgggccacggccacatcctggtgggcaccaagaatggagagatcctggaggtggacaagagcggccccatcaccctgctggtgcagggccacatggagggggaggtgtggggcctggccacccacccctacctgcccatctgtgccaccgtgtctgatgacaagaccctgcgcatctgggacctgagccccagccactgcatgctggccgtgaggaagctgaagaagggcggccgctgctgctgcttctccccagatggcaaggccctggccgtgggcctgaatgatggcagcttcctgatggccaatgctgacaccctggaggacctggtgtccttccaccacaggaaggacatgatcagtgacatccgcttcagccctggcagcggcaagtacctggccgtggccagccatgacagcttcatcgacatctacaacgtgatgagcagcaagagggtgggcatctgcaagggggccaccagctacatcacccacatcgactgggacatccggggcaagctgctgcaggtgaacacaggagccaaggagcagctgttctttgaggccccccggggcaagaagcagaccatccccagcgtggaggtggagaagatcgcctgggcctcctggacctctgtgctgggcctgtgctgtgagggcatctggcctgtgattggagaggtgacagatgtgacagccagctgcctgaccagtgacaagatggtgctggccactggagatgacctgggctttgtgaagctgttccgctaccccaccaagggcaagtttgggaagttcaagcgctacgtggcccacagcacccacgtgaccaacgtgcgctggacctatgatgacagcatgctggtgaccctgggcggcacagacatgagcctgatggtgtggaccaatgagatggagggctaccgggagaagaggccctgtgacagcgaggagagtgacatcgacagcgaggaggatggcggctatgacagtgatgtgaccagagaaaatgagatctcctacaccatccgggccctgagcaccaacatccggcccatgctgggcatcaagccccacctgcagcagaaggagcccagcattgatgagcggccccctgtgtcccgggccccaccccagcctgagaagctgcagaccaacaacgtgggcaagaagaagaggcccatcgaggacctggtgctggagctgatcttcggctaccggggccgggactgcagaaataatgtgcactacctgaatgatggagatgacatcatctaccacacagcctctgtgggcatcctgcacaacgtggccaccggcagccagagcttctaccaggagcacaatgatgacatcctgtgcctgactgtgaaccagcaccccaagttcatcaacatcgtggccaccggccaggtgggggacagcgctgacatgtctgccacagcccccagcatccacatctgggatgccatgaacaagcagaccctgagcatcctgcgctgctaccacagcaagggcgtgtgcagcgtgtccttcagcgccaccgggaagctgctgctgtctgtgggcctggaccctgagcacaccatcaccatctggcgctggcaggagggcgccaagatcgccagccgggccggccacaaccagaggatctttgtggccgagttccggccagacagcgacacccagtttgtgtctgtgggcgtgaagcacgtgaagttctggaccctggccggccgggccctgctgagcaagaagggcctgctgagcaccctggaggatgccaggatgcagaccatgctggccatcgccttcggggccaacaacctgaccttcaccggcaccatctctggagatgtgtgtgtgtggaaggaccacatcctgtgccgcatcgtggcccgggcccacaacggccctgtgtttgccatgtacaccaccctgagagatggcctgattgtgactggaggcaaggagcggcccagcaaggagggcggcgctgtgaagctgtgggaccaggagctgcggcgctgccgggccttccggctggagaccggccaggccacagactgtgtgcgctctgtgtgccggggcaagggcaagatcctggtgggcaccagaaatgctgagatcatcgaggtgggggagaagaatgctgcctgcaacatcctggtgaatggccacgtggatggccccatctggggcctggccacccaccccagccgggacttcttcctgtctgctgctgaagatggcaccgtgcggctgtgggacattgctgacaagaagatgctgaacaaggtgaacctgggccatgctgccaggacagtgtgctacagccctgagggggacatggtggccatcggcatgaagaatggagagttcatcatcctgctggtgagcagcctgaagatctggggcaagaagagggaccggcgctgtgccatccatgacatccgcttctccccagacagccgctacctggccgtgggcagcagcgagaacagcgtggacttctatgacctgaccctgggccccaccctgaaccgcatctcctactgcaaggacatccccagctttgtgatccagatggacttctctgctgacagcagctacctgcaggtgagcagcggctgctacaagagacatgtgtatgaggtgcccagcggcaagcacctgatggaccatgctgccatcgaccgcatcacctgggccacctggaccagcatcctgggagatgaggtgctgggcatctggagcagacatgctgagaaggcagatgtgaactgtgcctgtgtgagccacagcggcatcagcctggtgactggagatgactttggcatggtgaagctgtttgacttcccctgcccagagaagtttgccaagcacaagcgcttcctgggccacagcccccacgtgaccaacatccgcttcaccagcggggacagacatgtggtgtctgctggaggagatgactgcagcctgtttgtgtggaagtgtgtgcacaccccccactag

SEQ ID NO: 20186 - DNA, 1146 bp, Artificial Sequence
  Description of Artificial Sequence: Synthetic coding sequence
atgcccctgcaggtgtctgactacagctggcagcagaccaagacagctgtgttcctgagcctgcccctgaagggcgtgtgtgtgcgggacacagatgtgttctgcacagagaactacctgaaggtgaacttcccccccttcctgtttgaggccttcctgtatgcccccattgatgatgagagcagcaaggccaagattggaaatgacaccatcgtgttcaccctgtacaagaaggaggccgccatgtgggagaccctgtctgtgactggagtggacaaggagatgatgcagaggatccgggagaagagcatcctgcaggcccaggagcgggccaaggaggccacagaggccaaggccgccgccaagcgggaggaccagaagtatgccctgtctgtgatgatgaagattgaggaggaggagaggaagaagattgaggacatgaaggaaaatgaaagaatcaaggccaccaaggccctggaggcctggaaggagtaccagaggaaggccgaggagcagaagaagatccagcgggaggagaagctgtgccagaaggagaagcagatcaaggaggagaggaagaagatcaagtacaagagcctgaccaggaacctggccagcaggaacctggcccccaagggcaggaacagcgagaacatcttcacagagaagctgaaggaggacagcatcccagcccccaggtctgtgggcagcatcaagatcaacttcacccccagggtcttccccacagccctgcgggagagccaggtggccgaggaggaggagtggctgcacaagcaggccgaggcccggcgggccatgaacacagacattgctgagctgtgtgacctgaaggaggaggagaagaaccctgagtggctgaaggacaagggcaacaagctgtttgccacagagaactacctggccgccatcaatgcctacaacctggccatccggctgaacaacaagatgcccctgctgtacctgaacagagctgcctgccacctgaagctgaagaacctgcacaaggccatcgaggacagcagcaaggagttctgcagcctggagggcatcgagtgccaggccagcgagcccaagctgagccaccacatccccagcgacctgcacgtgtacatccagatggcctag

SEQ ID NO: 20187 - DNA, 1344 bp, Artificial Sequence
  Description of Artificial Sequence: Synthetic coding sequence
atggccggggccggcggcggcaatgacatccagtggtgcttcagccaggtgaagggagctgtggatgatgatgtggccgaggccgacatcatcagcacagtggagttcaaccacagcggggagctgctggccactggagacaagggcggccgggtggtgatcttccagcaggagcaggagaacaagatccagagccacagcagaggagagtacaacgtgtacagcaccttccagagccatgagcctgagtttgactacctgaagagcctggagattgaggagaagatcaacaagatccgctggctgccccagaagaatgctgcccagttcctgctgagcaccaatgacaagaccatcaagctgtggaagatcagcgagcgggacaagaggcctgagggctacaacctgaaggaggaggatggccgctacagagaccccaccaccgtgaccaccctgcgggtgcctgtgttccggcccatggacctgatggtggaggccagcccccggcgcatctttgccaatgcccacacctaccacatcaacagcatcagcatcaacagcgactatgagacctacctgtctgcagatgacctgcgcatcaacctgtggcacctggagatcacagaccgctccttcaacatcgtggacatcaagccagccaacatggaggagctgacagaggtgatcacagctgctgagttccaccccaacagctgcaacacctttgtgtacagcagcagcaagggcaccatccggctgtgtgacatgagggccagcgccctgtgtgacagacacagcaagctgtttgaggagcctgaggaccccagcaacagaagcttcttcagcgagatcatcagcagcatcagtgatgtgaagttcagccacagcggccgctacatgatgacccgggactacctgtctgtgaagatctgggacctgaacatggagaacagacctgtggagacctaccaggtgcatgagtacctgcggagcaagctgtgcagcctgtatgaaaatgactgcatctttgacaagtttgagtgctgctggaatggaagtgacagcgtggtgatgacaggcagctacaacaacttcttcaggatgtttgacaggaacaccaagagggacatcaccctggaggccagccgggagaacaacaagcccaggacagtgctgaagcccaggaaggtgtgtgccagcggcaagaggaagaaggatgagatctctgtggacagcctggacttcaacaagaagatcctgcacacagcctggcaccccaaggagaacatcatcgctgtggccaccaccaacaacctgtacatcttccaggacaaggtgaactag

SEQ ID NO: 20188 - DNA, 1413 bp, Artificial Sequence
  Description of Artificial Sequence: Synthetic coding sequence
atggacctgcgggaccaggagctggtgaagatcgtgggcatccgctatgaggtgggcccccccaccctgtgctgcctgaagctggccttcattgatcctgccaccgggaagctgatggacaagagcttcagcatccgctaccatgacatgccagatgtgattgacttcctggtgctgcggcagttctatgatgaggcccggcagaggaactggcagagctgtgaccgcttccgcagcatcattgatgatgcctggtggtttggaacagtgctgagccaggagccctaccagccccagtacccagacagccacttccagtgctacatcgtgcgctgggacaacacagaaattgagaagctgagcccctgggacatggagcccatcccagacaacgtggaccccccagaggagctgggcgccagcatctctgtgaccacagatgagctggagaagctgctgtacaagccccaggccggggagtggggccagaagagcagagatgaagaatgtgaccgcatcatctctggaattgaccagctgctgaacctggacattgctgctgcctttgctggccctgtggacctgtgcacctaccccaagtactgcaccgtggtggcctaccccacagacctgtacaccatccgcatgaggctggtgaaccgcttctaccgccgcctgagcgccctggtgtgggaggtgcgctacatcgagcacaatgcccggaccttcaatgaacctgagagcgtcatcgcccggagcgccaagaagatcacagaccagctgctgaagttcatcaagaaccagcactgcaccaacatcagcgagctgagcaacaccagtgaaaatgatgagcagaatgctgaggacctggatgacagcgacctgcccaagaccagcagcggcagaagaagagactacagagacatcatcgacacccccatggactttggcaccgtgcgggagaccctggatgctggcaactatgacagccccctggagttctgcaaggacatccgcctcatcttcagcaatgccaaggcctacacccccaacaagaggagcaagatctacagcatgaccctgcggctgagcgccctgtttgaggagaagatgaagaagatcagcagtgacttcaagattggccagaagttcaatgagaagctgcggcgcagccagcgcttcaagcagaggcagaactgcaagggggacagccagcccaacaagagcatccggaacctgaagcccaagaggctgaagagccagaccaagatcatccctgagctggtgggcagccccacccagagcaccagcagcaggacagcctacctgggcacccacaagaccagcgctggcatcagcagcggcgtgaccagcggcctcttccgcttcagccgcatcatcaggaaggagtag

SEQ ID NO: 20189 - DNA, 516 bp, Artificial Sequence
  Description of Artificial Sequence: Synthetic coding sequence
atgtgtggccgggcccctcctcctgagatcaccggccgggagcccggctaccacctggtggagcagagctgctggctgaagcccctgcccaggaacctgggccacagcctcttctggacagtgtggaagcccaggcctgtgtcccagctggtggcccagcaggtgacccagcagtttgtgccccccacccagagcaagaaggagaagaaggacaaggtggagaaggagaagtctgagaaggagaccaccagcaagaagaacagccacaagaagacccggccccggctgaagaatgtggacaggagcagcgcccagcacctggaggtgacagtgggggacctgaccgtcatcatcacagacttcaaggagaagaccaagagccccccagccagcagcgctgccagcgctgaccagcacagccagagcggcagcagcagtgacaacacagagcggggcatgagccgcagcagcagccccagaggagaggccagcagcctgaatggagagagccactag

SEQ ID NO: 20190 - DNA, 417 bp, Artificial Sequence
  Description of Artificial Sequence: Synthetic coding sequence
atgggagacaagaagagccccaccaggaagcccaggcctgtgtcccagctggtggcccagcaggtgacccagcagtttgtgccccccacccagagcaagaaggagaagaaggacaaggtggagaaggagaagtctgagaaggagaccaccagcaagaagaacagccacaagaagacccggccccggctgaagaatgtggacaggagcagcgcccagcacctggaggtgacagtgggggacctgaccgtcatcatcacagacttcaaggagaagaccaagagccccccagccagcagcgctgccagcgctgaccagcacagccagagcggcagcagcagtgacaacacagagcggggcatgagccgcagcagcagccccagaggagaggccagcagcctgaatggagagagccactag

SEQ ID NO: 20191 - DNA, 1047 bp, Artificial Sequence
  Description of Artificial Sequence: Synthetic coding sequence
atgggccactgctgctgcaagccctacaactgcctgcagtgcctggacaagaccaatgaaagtgccctggtgaaggagaaggagctgagcattgagctggccaacatcagagatgaggtggccttccacacagccaagtgtgagaagctgcagaaggagaaggaggagctggagaggagatttgaagatgaggtgaagaggctgggctggcagcagcaggccgagctgcaggagctggaggagcggctgcagctgcagtttgaagctgagatggcccggctgcaggaggagcacggggaccagctgctgagcatccgctgccagcaccaggagcaggtggaggacctgacagccagccatgatgctgccctgctggagatggagaacaaccacacagtggccatcaccatcctgcaggatgaccatgaccacaaggtgcaggagctgatgagcacccatgagctggagaagaaggagctggaggagaactttgagaagctgcggctgagcctgcaggaccaggtggacaccctgaccttccagagccagagcctgcgggaccgggccaggagatttgaggaggccctgaggaagaacacagaggagcagctggagatcgccctggccccctaccagcacctggaggaggacatgaagagcctgaagcaggtgctggagatgaagaaccagcagatccacgagcaggagaagaagatcctggagctggagaagctggccgagaagaacatcatcctggaggagaagatccaggtgctgcagcagcagaatgaagacctgaaggccagaattgaccagaacacagtggtgacccggcagctgtctgaagaaaatgccaacctgcaggagtatgtggagaaggagacccaggagaagaagaggctgagcaggaccaatgaggagctgctgtggaagctgcagacaggagaccccaccagccccatcaagctgagccccaccagccctgtgtaccggggcagcagcagcggccccagcagccctgcccgggtgtccaccacccccaggtag

SEQ ID NO: 20192 - DNA, 2664 bp, Artificial Sequence
  Description of Artificial Sequence: Synthetic coding sequence
atgaacagcggcggcggcctgcccccaccttctgctgctgccagccccagcagcagcagcctggccgctgctgtggccgtggtggcccctcctggggtgggcggcgtgcctggaggagctgctgtgggcgtgaagctgaagtactgccgctactatgccaaggacaagacctgcttctacggggaggagtgccagttcctgcatgaagatcctgctgctggagctgcccctggcctgggcctgcacagcaacagcgtgcccctggccctggccggggcccctgtggccggcttccccccaggagctgtggccggcggcggggccggccccccacctggccccaagaagccagacctgggggaccccggcaccggggctgctgctgggggcggcggcagcagcggcggcctggatggcccccggctggccatccctggcatggatggaggagccctgacagacaccagcctgacagacagctacttcagcaccagcttcatcggcgtgaatggcttcggcagccctgtggagaccaagtaccccctgatgcagaggatgaccaacagcagcagcagccccagcctgctgaatgattctgccaagccctacagcgcccatgaccccctgaccagccctgccagcagcctcttcaatgactttggagccctgaacatcagccagaggaggaagcccaggaagtaccgcctgggcatgctggaggagcggctggtgcccatgggcagcaaggccaggaaggccaagaaccccatcggctgcctggccgaccgctgcaagagcggcgtgcccatcaacatggtgtggtggaacagagtgacagagaacaacctgcagacccccaaccccacagccagcgagttcatccccaagggcggcagcaccagccggctgagcaatgtgtcccagagcaacatgtctgccttcagccaggtgttcagccaccccagcatgggcagccctgccacagctggcctggcccctggcatgagcctgtctgctggcagcagccccctgcacagccccaagatcaccccccacaccagccctgcccccaggagaagaagccacacccccaacccagccagctacatggtgcccagcagcgccagcacctctgtgaacaaccctgtgtcccagacccccagcagcggccaggtgatccagaaggagaccgtgggcggcaccacctacttctacacagacaccaccccagcccccctgaccggcatggtgttccccaactaccacatctacccacccacagccccccacgtggcctacatgcagcccaaggccaatgcccccagcttcttcatggctgatgagctgcggcaggagctgatcaacagacacctgatcaccatggcccagattgaccaggccgacatgcctgctgtgcccacagaggtggacagctaccacagcctcttccccctggagcccctgcccccacccaaccgcatccagaagagcagcaactttggctacatcaccagctgctacaaggctgtgaacagcaaggatgacctgccctactgcctgcggcgcatccacggcttccggctggtgaacaccaagtgcatggtgctggtggacatgtggaagaagatccagcacagcaacatcgtgaccctgcgggaggtgttcaccaccaaggcctttgctgagcccagcctggtgtttgcctatgacttccacgccggcggggagaccatgatgagccgccacttcaatgaccccaatgctgatgcctacttcaccaagaggaagtggggccagcacgagggccccctgccccggcagcacgccggcctgctgcctgagagcctcatctgggcctacatcgtgcagctgagcagcgccctgcggaccatccacacagctggcctggcctgccgggtgatggaccccaccaagatcctgatcaccgggaagacccggctgcgggtgaactgtgtgggcgtgtttgatgtgctgacctttgacaacagccagaacaacaaccccctggccctgatggcccagtaccagcaggccgacctgatcagcctgggcaaggtggtgctggccctggcctgcaacagcctggccggcatccagcgggagaacctgcagaaggccatggagctggtgaccatcaactacagcagtgacctgaagaacctgatcctgtacctgctgacagaccagaacaggatgaggtctgtgaatgacatcatgcccatgattggagcccgcttctacacccagctggatgctgcccagatgagaaatgatgtgattgaggaggacctggccaaggaggtgcagaatggccgcctcttccggctgctggccaagctgggcaccatcaatgaaagacctgagttccagaaggaccccacctggagcgagactggagaccgctacctgctgaagctgttccgggaccacctgttccaccaggtgacagaagctggggccccctggattgacctgagccacatcatcagctgcctgaacaagctggatgctggggtgcctgagaagatcagcctcatcagcagagatgagaagtctgtgctggtggtgacctacagcgacctgaagcgctgctttgagaacaccttccaggagctgattgctgctgccaacggccagctgtag

SEQ ID NO: 20193 - DNA, 1710 bp, Artificial Sequence
  Description of Artificial Sequence: Synthetic coding sequence
atggccaccctggtggtgaacaagctgggcgccggcgtggacagcggccggcagggcagccggggcacagctgtggtgaaggtgctggagtgtggggtgtgtgaagatgtgttcagcctgcagggcgacaaggtgccccggctgctgctgtgtggccacacagtgtgccacgactgcctgacccggctgcccctgcacggccgggccatccgctgcccctttgaccggcaggtgacagacctgggggacagcggcgtgtggggcctgaagaagaactttgccctgctggagctgctggagcggctgcagaatggccccatcggccagtacggggctgctgaggagagcatcggcatcagcggggagagcatcatccgctgtgatgaagatgaggcccacctggcctctgtgtactgcaccgtgtgtgccacccacctgtgcagtgaatgttcccaggtgacccacagcaccaagaccctggccaagcaccggcgggtgcccctggccgacaagccccatgagaagaccatgtgcagccagcaccaggtgcacgccatcgagtttgtgtgcctggaggagggctgccagaccagccccctgatgtgctgcgtgtgcaaggagtatggcaagcaccagggccacaagcacagcgtgctggagcctgaggccaaccagatccgggccagcatcctggacatggcccactgcatccgcaccttcacagaggagatcagtgactacagcaggaagctggtgggcatcgtgcagcacatcgagggcggggagcagatcgtggaggatggcatcggcatggcccacacagagcacgtgcccggcacagcagaaaatgcccggagctgcatccgggcctacttctatgacctgcacgagaccctgtgccggcaggaggagatggccctgtctgtggtggatgcccacgtgcgggagaagctgatctggctgcggcagcagcaggaggacatgaccatcctgctgtctgaggtgtctgctgcctgcctgcactgtgagaagaccctgcagcaggatgactgccgggtggtgctggccaagcaggagatcacccggctgctggagaccctgcagaagcagcagcagcagttcacagaggtggccgaccacatccagctggatgccagcatccctgtgaccttcaccaaggacaacagagtgcacatcggccccaagatggagatccgggtggtgaccctgggcctggatggagctgggaagaccaccatcctcttcaagctgaagcaggatgagttcatgcagcccatccccaccatcggcttcaacgtggagaccgtggagtacaagaacctgaagttcaccatctgggatgtgggcggcaagcacaagctgcggcccctgtggaagcactactacctgaacacccaggccgtggtgtttgtggtggacagcagccaccgggaccgcatcagcgaggcccacagcgagctggccaagctgctgacagagaaggagctgagagatgccctgctgctgatctttgccaacaagcaggatgtggccggggccctgtctgtggaggagatcacagagctgctgagcctgcacaagctgtgctgcggccgctcctggtacatccagggctgtgatgcccggagcgtcttccagatcatctgtgaccagtacaccgggaaggaggtggtgacagagaagggctag

SEQ ID NO: 20194 - DNA, 2061 bp, Artificial Sequence
  Description of Artificial Sequence: Synthetic coding sequence
atgggccgcatccaccaggccatggtgaccagcctgaatgaagataatgaatctgtgacagtggagtggattgaaaatggagacaccaagggcaaggagattgacctggagagcatcttcagcctgaacccagacctggtgcctgatgaggagattgagcccagccctgagaccccacctcctccagccagcagcgccaaggtgaacaagatcgtgaagaacagaagaacagtggccagcatcaagaatgacccccccagccgggacaacagagtggtgggcagcgcccgggcccggcccagccagtttcctgagcagagcagcagcgcccagcagaatggatctgtgtctgacatcagccctgtgcaggccgccaagaaggagtttggaccacccagcaggaggaagagcaactgtgtgaaggaggtggagaagctgcaggagaagcgggagaagaggcggctgcagcagcaggagctgcgggagaagagggcccaggatgtggatgccaccaaccccaactatgagatcatgtgcatgatccgggacttccggggcagcctggactaccggcccctgaccacagctgaccccattgatgagcaccgcatctgtgtgtgtgtgaggaagaggcccctgaacaagaaggagacccagatgaaggacctggatgtgatcaccatccccagcaaggatgtggtgatggtgcatgagcccaagcagaaggtggacctgacccgctacctggagaaccagaccttccgctttgattatgcctttgatgattctgccccaaatgagatggtgtaccgcttcaccgcccggcccctggtggagaccatctttgagcggggcatggccacctgctttgcctacggccagacaggcagcggcaagacccacaccatgggcggggacttcagcggcaagaaccaggactgcagcaagggcatctatgccctggccgccagagatgtgttcctgatgctgaagaagcccaactacaagaagctggagctgcaggtgtatgccaccttctttgagatctacagcggcaaggtgtttgacctgctgaacaggaagaccaagctgcgggtgctggaggatggcaagcagcaggtgcaggtggtgggcctgcaggagcgggaggtgaagtgtgtggaggatgtgctgaagctgattgacatcggcaacagctgcaggaccagcggccagaccagcgccaatgcccacagcagccgcagccatgctgtgttccagatcatcctgcggaggaagggcaagctgcacggcaagttcagcctgattgacctggccggaaatgaaagaggagctgacaccagcagcgctgaccggcagacccggctggagggcgctgagatcaacaagagcctgctggccctgaaggagtgcatccgggccctgggcaggaacaagccccacacccccttccgggccagcaagctgacccaggtgctgcgggacagcttcatcggggagaacagcaggacctgcatgattgccaccatcagccctggcatggccagctgtgagaacaccctgaacaccctgcgctatgccaacagagtgaaggagctgactgtggaccccacagctgctggagatgtgcggcccatcatgcaccacccccccaaccagattgatgacctggagacccagtggggcgtgggcagcagcccccagagagatgacctgaagctgctgtgtgagcagaatgaggaggaggtgagcccccagctgttcaccttccatgaagctgtgtcccagatggtggagatggaggagcaggtggtggaggaccacagagctgtgttccaggagagcatccgctggctggaggatgagaaggccctgctggagatgacagaggaggtggactatgatgtggacagctatgccacccagctggaggccatcctggagcagaagattgacatcctgacagagctgcgggacaaggtgaagagcttccgggccgccctgcaggaggaggagcaggccagcaagcagatcaaccccaagaggccccgggccctgtag

SEQ ID NO: 20195 - DNA, 618 bp, Artificial Sequence
  Description of Artificial Sequence: Synthetic coding sequence
atgtctgtggaccccatgacctatgaggcccagttcttcggcttcaccccccagacctgcatgctgcgcatctacatcgccttccaggactacctgtttgaggtgatgcaggccgtggagcaggtgatcctgaagaagctggatggcatcccagactgtgacatcagccctgtgcagatcaggaagtgcacagagaagttcctgtgcttcatgaagggccactttgacaacctcttcagcaagatggagcagctgttcctgcagctgatcctgcgcatccccagcaacatcctgctgcctgaggacaagtgcaaggagaccccctacagcgaggaggacttccagcacctgcagaaggagattgagcagctgcaggagaagtacaagacagagctgtgcaccaagcaggccctgctggccgagctggaggagcagaagatcgtgcaggccaagctgaagcagaccctgaccttctttgatgagctgcacaacgtgggccgggaccacggcaccagtgacttccgggagagcctggtgtccctggtgcagaacagcaggaagctgcagaacatccgggacaacgtggagaaggagagcaagaggctgaagatctcctag

SEQ ID NO: 20196 - DNA, 1866 bp, Artificial Sequence
  Description of Artificial Sequence: Synthetic coding sequence
atggtgctgtgccctgtgattggcaagctgctgcacaagagggtggtgctggccagcgccagcccccggcggcaggagatcctgagcaatgccggcctgcgctttgaggtggtgcccagcaagttcaaggagaagctggacaaggccagctttgccaccccctacggctacgccatggagacagccaagcagaaggccctggaggtggccaacagactctaccagaaggacctgcgggccccagatgtggtgattggagctgacaccatcgtgacagtgggcggcctcatcctggagaagcctgtggacaagcaggatgcctacaggatgctgagccggctgagcggccgggagcacagcgtcttcaccggggtggccatcgtgcactgcagcagcaaggaccaccagctggacaccagggtgtctgagttctatgaggagaccaaggtgaagttcagcgagctgtctgaggagctgctgtgggagtatgtgcacagcggggagcccatggacaaggccggcggctacggcatccaggccctgggcggcatgctggtggagagcgtgcacggggacttcctgaatgtggtgggcttccccctgaaccacttctgcaagcagctggtgaagctgtactacccacccaggcctgaggacctgcggcgctctgtgaagcatgacagcatcccagctgctgacacctttgaggacctgagtgatgtggagggcggcggcagcgagcccacccagagagatgctggcagcagagatgagaaggccgaggccggggaggccggccaggccacagctgaggccgagtgccacaggacccgggagaccctgccccccttccccacccggctgctggagctgattgagggcttcatgctgagcaagggcctgctgacagcctgcaagctgaaggtgtttgacctgctgaaggatgaggccccccagaaggctgctgacatcgccagcaaggtggatgccagcgcctgtggcatggagcggctgctggacatctgtgccgccatgggcctgctggagaagacagagcagggctacagcaacacagaaacagccaacgtgtacctggccagtgatggagagtacagcctgcacggcttcatcatgcacaacaatgacctgacctggaacctcttcacctacctggagtttgccatccgggagggcaccaaccagcaccaccgggccctgggcaagaaggcagaagatctcttccaggatgcctactaccagagccctgagacccggctgcgcttcatgagggccatgcacggcatgaccaagctgacagcctgccaggtggccacagccttcaacctgagccgcttcagcagcgcctgtgatgtgggcggctgcaccggggccctggcccgggagctggcccgggagtaccccaggatgcaggtgacagtgtttgacctgcctgacatcatcgagctggccgcccacttccagcccccaggcccccaggccgtgcagatccactttgctgctggggacttcttccgggaccccctgcccagcgctgagctgtatgtgctgtgccgcatcctgcatgactggccagatgacaaggtgcacaagctgctgagccgggtggccgagagctgcaagccaggggccggcctgctgctggtggagaccctgctggatgaggagaagagggtggcccagagggccctgatgcagagcctgaacatgctggtgcagacagagggcaaggagaggagcctgggggagtaccagtgcctgctggagctgcacggcttccaccaggtgcaggtggtgcacctgggcggcgtgctggatgccatcctggccaccaaggtggccccctag

SEQ ID NO: 20197 - DNA, 2541 bp, Artificial Sequence; identical to SEQ ID NO: 18854
  Description of Artificial Sequence: Synthetic coding sequence

SEQ ID NO: 20198 - DNA, 1818 bp, Artificial Sequence
  Description of Artificial Sequence: Synthetic coding sequence
atggtgctgtgccctgtgattggcaagctgctgcacaagagggtggtgctggccagcgccagcccccggcggcaggagatcctgagcaatgccggcctgcgctttgaggtggtgcccagcaagttcaaggagaagctggacaaggccagctttgccaccccctacggctacgccatggagacagccaagcagaaggccctggaggtggccaacagactctaccagacagtgggcggcctcatcctggagaagcctgtggacaagcaggatgcctacaggatgctgagccggctgagcggccgggagcacagcgtcttcaccggggtggccatcgtgcactgcagcagcaaggaccaccagctggacaccagggtgtctgagttctatgaggagaccaaggtgaagttcagcgagctgtctgaggagctgctgtgggagtatgtgcacagcggggagcccatggacaaggccggcggctacggcatccaggccctgggcggcatgctggtggagagcgtgcacggggacttcctgaatgtggtgggcttccccctgaaccacttctgcaagcagctggtgaagctgtactacccacccaggcctgaggacctgcggcgctctgtgaagcatgacagcatcccagctgctgacacctttgaggacctgagtgatgtggagggcggcggcagcgagcccacccagagagatgctggcagcagagatgagaaggccgaggccggggaggccggccaggccacagctgaggccgagtgccacaggacccgggagaccctgccccccttccccacccggctgctggagctgattgagggcttcatgctgagcaagggcctgctgacagcctgcaagctgaaggtgtttgacctgctgaaggatgaggccccccagaaggctgctgacatcgccagcaaggtggatgccagcgcctgtggcatggagcggctgctggacatctgtgccgccatgggcctgctggagaagacagagcagggctacagcaacacagaaacagccaacgtgtacctggccagtgatggagagtacagcctgcacggcttcatcatgcacaacaatgacctgacctggaacctcttcacctacctggagtttgccatccgggagggcaccaaccagcaccaccgggccctgggcaagaaggcagaagatctcttccaggatgcctactaccagagccctgagacccggctgcgcttcatgagggccatgcacggcatgaccaagctgacagcctgccaggtggccacagccttcaacctgagccgcttcagcagcgcctgtgatgtgggcggctgcaccggggccctggcccgggagctggcccgggagtaccccaggatgcaggtgacagtgtttgacctgcctgacatcatcgagctggccgcccacttccagcccccaggcccccaggccgtgcagatccactttgctgctggggacttcttccgggaccccctgcccagcgctgagctgtatgtgctgtgccgcatcctgcatgactggccagatgacaaggtgcacaagctgctgagccgggtggccgagagctgcaagccaggggccggcctgctgctggtggagaccctgctggatgaggagaagagggtggcccagagggccctgatgcagagcctgaacatgctggtgcagacagagggcaaggagaggagcctgggggagtaccagtgcctgctggagctgcacggcttccaccaggtgcaggtggtgcacctgggcggcgtgctggatgccatcctggccaccaaggtggccccctag

SEQ ID NO: 20199 - DNA, 696 bp, Artificial Sequence
  Description of Artificial Sequence: Synthetic coding sequence
atgacagtgggcaagagcagcaagatgctgcagcacatcgactacaggatgcgctgcatcctgcaggacggccgcatcttcatcggcaccttcaaggcctttgacaagcacatgaacctgatcctgtgtgactgtgatgagttcaggaagatcaagcccaagaacagcaagcaggccgagcgggaggagaagagggtgctgggcctggtgctgctgcggggggagaacctggtgtccatgacagtggagggccccccacccaaggacaccggcatcgcccgggtgcccctggccggggctgctgggggccctggcatcggccgggccgccggccggggcatcccagctggggtgcccatgccccaggccccagctggcctggccggccctgtgcggggcgtgggcggccccagccagcaggtgatgaccccccagggccggggcaccgtggccgctgctgctgctgctgccacagccagcattgctggggcccccacccagtacccacctggccggggcggccccccaccacccatgggccgcggggcccctcctcctggcatgatgggccccccacctggcatgaggcctcccatgggcccccccatgggcatccccccaggccggggcacccccatgggcatgcctcctcctggcatgaggcctcctcctcctggcatgaggggcctgctgtag

SEQ ID NO: 20200 - DNA, 855 bp, Artificial Sequence
  Description of Artificial Sequence: Synthetic coding sequence
atgtggaggggcctggccctggcccgggccatcggctgtgccgcccggggccggggccagtgggccgtgcgggctgctgactgtgcccagagcggccgccaccctggccctgctgtggtgtgtggcagaagactcatctctgtgctggagcagatccgccactttgtgatgatgcctgagatcaacaccaaccacctggacaagcagcaggtgcagctgctggccgagatgtgcatcctgattgatgaaaatgacaacaagatcggggctgagaccaagaagaactgccacctgaatgaaaacatcgagaagggcctgctgcaccgggccttcagcgtcttcctgttcaacacagagaacaagctgctgctgcagcagaggagtgatgccaagatcaccttccctggctgcttcaccaacacctgctgcagccaccccctgagcaacccagctgagctggaggagagtgatgccctgggcgtgcggcgggccgcccagaggcggctgaaggccgagctgggcatccccctggaggaggtgcccccagaggagatcaactacctgacccgcatccactacaaggcccagagtgatggcatctggggcgagcacgagattgactacatcctgctggtgaggaagaatgtgaccctgaacccagaccccaatgagatcaagagctactgctacgtgtccaaggaggagctgaaggagctgctgaagaaggccgccagcggggagatcaagatcaccccctggttcaagatcatcgccgccaccttcctgttcaagtggtgggacaacctgaaccacctgaaccagtttgtggaccacgagaagatctacaggatgtag

SEQ ID NO: 20201 - DNA, 180 bp, Artificial Sequence; identical to SEQ ID NO: 18361
  Description of Artificial Sequence: Synthetic coding sequence

SEQ ID NO: 20202 - DNA, 3039 bp, Artificial Sequence
  Description of Artificial Sequence: Synthetic coding sequence
atggaggagtatgagaagttctgtgagaagagcctggcccgcatccaggaggccagcctgagcacagagagcttcctgcctgcccagagcgagagcatcagcctcatccgcttccatggagtggccatcctgagccccctgctgaacatcgagaagaggaaggagatgcagcaggagaagcagaaggccctggatgtggaggccaggaagcaggtgaacaggaagaaggccctgctgaccagggtgcaggagatcctggacaacgtgcaggtgaggaaggccccaaatgccagtgactttgaccagtgggagatggagaccgtgtacagcaacagcgaggtgaggaacctgaatgtgcctgccaccttccccaacagcttccccagccacacagagcacagcacagctgccaagctggacaagattgctggcatcctgcccctggacaatgaagaccagtgcaagacagatggcatcgacctggcccgggacagcgagggcttcaacagccccaagcagtgtgacagcagcaacatcagccacgtggagaatgaggccttccccaagaccagcagcgccaccccccaggagaccctcatcagtgatggccccttctctgtgaatgagcagcaggacctgcccctgctggccgaggtgatcccagacccctacgtgatgagcctgcagaacctgatgaagaagagcaaggagtacatcgagcgggagcagagcagaagaagcctgcggggcagcatcaacagaattgtgaatgaaagccacctggacaaggagcatgatgctgtggaggtggccgactgtgtgaaggagaagggccagctgaccgggaagcactgtgtgtctgtcatcccagacaagcccagcctgaacaagagcaatgtgctgctgcagggcgccagcacccaggccagctccatgtccatgcctgtgctggccagcttcagcaaggtggacatccccatcagaacaggccaccccaccgtgctggagagcaacagcgacttcaaggtgatccccacctttgtgacagagaacaacgtcatcaagagcctgaccggcagctatgccaagctgcccagccctgagcccagcatgagccccaagatgcacagaagaagaagcaggaccagcagcgcctgccacatcctgatcaacaaccccatcaatgcctgtgagctgagccccaagggcaaggagcaggccatggacctgatcatccaggacacagatgagaacaccaacgtgcctgagatcatgcccaagctgcccacagacctggccggcgtgtgcagcagcaaggtgtatgtgggcaagaacaccagcgaggtgaaggaggatgtggtgctgggcaagagcaaccaggtgtgccagagcagcggcaaccacctggagaacaaggtgacccacggcctggtgacagtggagggccagctgaccagtgatgagcggggggcccacatcatgaacagcacctgtgccgccatgcccaagctgcacgagccctatgccagcagccagtgcatcgccagccccaactttggaacagtgtctggcctgaagccagcctccatgctggagaagaactgcagcctgcagacagagctgaacaagagctatgatgtgaagaaccccagccccctgctgatgcagaaccagaacacccggcagcagatggacacccccatggtgtcctgtggaaatgagcagttcctggacaacagctttgagaaggtgaagaggcggctggacctggacattgatggcctgcagaaggagaactgcccctacgtgatcaccagcggcatcacagagcaggagcggcagcacctgcctgagaagcgctaccccaagggcagcggctttgtgaacaagaacaagatgctgggcaccagcagcaaggagagcgaggagctgctgaagagcaagatgctggcctttgaggagatgaggaagaggctggaggagcagcacgcccagcagctgagcctgctgattgctgagcaggagcgggagcaggagcggctgcagaaggagattgaggagcaggagaagatgctgaaggagaagaaggccatgacagctgaggccagcgagctggacatcaacaatgctgtggagctggagtggaggaagatcagtgacagcagcctgctggagaccatgctgagccaggccgacagcctgcacaccagcaacagcaacagcagcggcttcaccaacagcgccatgcagtacagctttgtgtctgccaatgaggcccccttctacctgtggggcagcagcaccagcggcctgaccaagctgtctgtgacccggcccttcggccgggccaagacccgctggagccaggtgttcagcctggagatccaggccaagttcaacaagatcacagctgtggccaagggcttcctgacccggcggctgatgcagacagacaagctgaagcagctgcggcagacagtgaaggacaccatggagttcatccgctccttccagagcgaggcccccctgaagaggggcatcgtgtctgcccaggatgccagcctgcaggagcgggtgctggcccagctgcgggccgccctgtatggcatccatgacatcttctttgtgatggatgctgctgagaggatgagcatcctgcaccacgaccgggaggtgaggaaggagaagatgctgcggcagatggacaagatgaagagcccccgggtggccctgtctgctgccacccagaagagcctggacaggaagaagtacatgaaggctgctgagatgggcatgcccaacaagaagttcctggtgaagcagaaccccagcgagaccagggtgctgcagcccaaccagggccagaatgcccctgtgcaccggctgctgagccggcagggcacccccaagacctctgtgaagggcgtggtgcagaaccggcagaagcccagccagagccgggtgcccaacagagtgcctgtgtctggagtgtatgccggcaagatccagaggaagaggcccaacgtggccaccatctag

SEQ ID NO: 20203 - DNA, 267 bp, Artificial Sequence
  Description of Artificial Sequence: Synthetic coding sequence
atggccagcgccagcgcccggggcaaccaggacaaggatgcccacttccccccacccagcaagcagagcctgctcttctgccccaagagcaagctgcacatccacagagctgagatcagcaagatcatgagggagtgccaggaggagagcttctggaagagggccctgcccttcagcctggtgtccatgctggtgacccagggcctggtgtaccagggctacctggccgccaacagcagatttggcagcctgcccaaggtggcctag

SEQ ID NO: 20204 - DNA, 738 bp, Artificial Sequence; identical to SEQ ID NO: 18499
  Description of Artificial Sequence: Synthetic coding sequence

SEQ ID NO: 20205 - DNA, 1551 bp, Artificial Sequence
  Description of Artificial Sequence: Synthetic coding sequence
atgagctacccagcagatgattatgagagcgaggccgcctatgacccctatgcctaccccagcgactatgacatgcacactggagaccccaagcaggacctggcctatgaaaggcagtatgagcagcagacctaccaggtgattcctgaggtgatcaagaacttcatccagtacttccacaagacagtgtctgacctgattgaccagaaggtgtatgagctgcaggccagccgggtgtccagtgatgtgattgaccagaaggtgtatgagatccaggacatctatgagaacagctggaccaagctgacagagcgcttcttcaagaacaccccctggccagaggccgaggccatcgccccccaggtgggcaatgatgctgtgttcctgatcctgtacaaggagctgtactaccgccacatctatgccaaggtgtccttccagagcttcagccagtaccgctgcaagacagccaagaagtctgaggaggagattgacttcctgcggagcaaccccaagatctggaatgtgcacagcgtgctgaatgtgctgcacagcctggtggacaagagcaacatcaaccggcagctggaggtgtacaccagcggcggggaccctgagagcgtggccggggagtatggccgccacagcctgtacaagatgctgggctacttcagcctggtgggcctgctgcggctgcacagcctgctgggggactactaccaggccatcaaggtgctggagaacatcgagctgaacaagaagtccatgtacagccgggtgcctgagtgccaggtgaccacctactactacgtgggctttgcctacctgatgatgaggcgctaccaggatgccatccgggtgtttgccaacatcctgctgtacatccagaggaccaagtccatgttccagaggaccacctacaagtatgagatgatcaacaagcagaatgagcagatgcacgccctgctggccatcgccctgaccatgtaccccatgagaattgatgagagcatccacctgcagctgcgggagaagtacggggacaagatgctgaggatgcagaagggggacccccaggtgtatgaggagctgttctcctacagctgccccaagttcctgagccctgtggtgcccaactatgacaacgtgcaccccaactaccacaaggagcccttcctgcagcagctgaaggtgttcagtgatgaggtgcagcagcaggcccagctgagcaccatccgctccttcctgaagctgtacaccaccatgcctgtggccaagctggccggcttcctggacctgacagagcaggagttccgcatccagctgctggtgttcaagcacaagatgaagaacctggtgtggaccagcggcatcagcgccctggatggagagttccagagcgccagcgaggtggacttctacatcgacaaggacatgatccacatcgctgacaccaaggtggccaggagatatggagacttcttcatccggcagatccacaagtttgaggagctgaacagaaccctgaagaagatgggccagaggccctag

SEQ ID NO: 20206 - DNA, 2502 bp, Artificial Sequence
  Description of Artificial Sequence: Synthetic coding sequence
ctgagcagaagagtgccctgtgtgagaagaggctgccggccccccctgccccccctgcccggcagccagagccgggcctggagccgggaccgggaggcccccctggaccccggccggcctgcccagagcggcagaagacccaccagccgctctgtgagccacgcctgctcctggaatggaggcagcctggaccccctggagggcaccccagccctgctgcggtctgctgagcggctgatgaggaaggtgaagaagctgcggctggacaaggaaaatacaggctcctggaggagcttcagcctgaacagcgagggcgctgagcgcatcaccagctatgacttccacagcgagagcggcctcttcctgttccaggccagcaacagcctcttccactgcagagatggcggcaagaatggcttcatggtgagccccatgaagcccctggagatcaagacccagtgcagcggccccaggatggaccccaagatctgcccagctgaccctgccttcttctccttcatcaacaacagcgacctgtgggtggccaacatcgagaccggggaggagcggcggctgaccttctgccaccagggcctgagcaatgtgctggatgaccccaagtctgctggggtggccaccttcgtcatccaggaggagtttgaccgcttcaccggctactggtggtgccccacagcctcctgggagggcagcgagggcctgaagaccctgcgcatcctgtatgaggaggtggatgaaagtgaggtggaggtgattcatgtgcccagccctgccctggaggagaggaagacagacagctaccgctaccccaggacaggcagcaagaaccccaagatcgccctgaagctggccgagttccagacagacagccagggcaagatcgtgtccacccaggagaaggagctggtgcagcccttcagcagcctcttccccaaggtggagtacatcgcccgggccggctggaccagagatggcaagtatgcctgggccatgttcctggaccggccccagcagtggctgcagctggtgctgctgcccccagccctcttcatccccagcacagaaaatgaggagcagaggctggccagcgcccgggctgtgcccagaaatgtgcagccctacgtggtgtatgaggaggtgaccaacgtgtggatcaacgtgcatgacatcttctaccccttcccccagagcgagggggaggatgagctgtgcttcctgcgggccaatgaatgcaagacaggcttctgccacctgtacaaggtgacagctgtgctgaagagccagggctatgactggagcgagcccttcagccctggagaagatgagttcaagtgccccatcaaggaggagatcgccctgaccagcggggagtgggaggtgctggcccggcacggcagcaagatctgggtgaatgaggagaccaagctggtgtacttccagggcaccaaggacacccccctggagcaccacctgtatgtggtgtcctatgaggccgccggggagatcgtgcggctgaccaccccaggcttcagccacagctgcagcatgagccagaactttgacatgtttgtgagccactacagctctgtgtccaccccaccctgtgtgcacgtgtacaagctgagcggcccagatgatgaccccctgcacaagcagccccgcttctgggcctccatgatggaggccgccagctgccccccagactatgtgcccccagagatcttccacttccacaccaggagtgatgtgcggctgtatggcatgatctacaagccccacgccctgcagcccgggaagaagcaccccaccgtgctgtttgtgtatggaggcccccaggtgcagctggtgaacaacagcttcaagggcatcaagtacctgcggctgaacaccctggccagcctgggctatgctgtggtggtgattgatggccggggcagctgccagaggggcctgcgctttgaaggagccctgaagaaccagatgggccaggtggagattgaggaccaggtggagggcctgcagtttgtggccgagaagtatggcttcatcgacctgagccgggtggccatccacggctggagctatggaggcttcctgagcctgatgggcctcatccacaagccccaggtgttcaaggtggccatcgccggggcccctgtgacagtgtggatggcctatgacaccggctacacagagcgctacatggatgtgcctgagaacaaccagcacggctatgaagctggctctgtggccctgcacgtggagaagctgcccaatgagcccaaccggctgctgatcctgcacggcttcctggatgaaaatgtgcacttcttccacaccaacttcctggtgtcccagctgatccgggccggcaagccctaccagctgcagatctacccaaatgaaagacacagcatccgctgcccagagagcggggagcactatgaggtgaccctgctgcacttcctgcaggagtacctgtag

SEQ ID NO: 20207 - DNA, 5073 bp, Artificial Sequence
  Description of Artificial Sequence: Synthetic coding sequence
atggactgcctgctggagctgagcgccacagacaccaagattgaggagagcagcagccagagctttgtggccagcgagaaccaggtgggcgctgctgagagcaagatcatggagaagaggcctgaggaggagagcgaggacagcaagatggacagcttcctggacatgcagctgacagaggacctggacagcctcatccagaatgcctttgagaagctgaacagcagcccagatgaccaggtgtacagcttcctgcccagccaggatgtgaacagcttcaatgacagcagcgagttcatcaacccagacagcagcaacatgacccccatcttcagcacccagaacatgaacctgaatggagagaacctggagaacagcggcagcaccctgagcctgaaccccctgcccagccacagcgtgctgaatgaaagcaagtgcttcatcaaggacaacaccctggccctggagagcaactacccagaggacagcctgctgagcagcagcctgaatgtggccagtgacagcattgctggctgcagcagcctgaaccagaagcagaaggagctgctggagagtgaatgtgtggaggcccagttcagcgaggcccctgtggacctggatgccagcgagccccaggcctgcctgaacctgcccggcctggacctgcccggcactggaggagaccagaagagcaccagggtgtctgatgtgttcctgcccagcgagggcttcaacttcaagccccacaagcaccctgagctgcccaccaagggcaaggatgtgtcctactgccctgtgctggcccccctgcccctgctgctgcccccacctcctcctccacccatgtggaaccccatgatcccagcctttgacctcttccagggcaaccacggctttgtggcccctgtggtgaccacagctgcccactggaggtctgtgaactacaccttcccccccagcgtcatcagccacaccagccccaccaaggtgtggaggaacaaggatggcaccagcgcctaccaggtgcaggagacccctgtgtcccaggtggtgaggaagaagaccagctatgtgggcctggtgctggtgctgctgcggggcctgcccggcagcggcaagagcttcctggcccggaccctgcaggaggacaaccccagcggggtcatcctgagcacagatgactacttctacatcaatggccagtaccagtttgatgtgaagtacctgggggaggcccacgagtggaaccagaacagagccaaggaggcctttgagaagaagatcagccccatcatcatcgacaacaccaacctgcaggcctgggagatgaagccctacgtggccctgagccagaagcacaagtacaaggtgctcttccgggagccagacacctggtggaagttcaagcccaaggagctggcccggaggaacatccatggagtgtccaaggagaagatcaccaggatgctggagcactaccagagatttgtgtctgtgcccatcatcatgagcagctctgtgcctgagaagattgagcgcatcgagctgtgtgcctacagctgtgaggacaggagcaccagccccagagatgatgaggacatcatcagcgagaaggaggagaacatcctgagcctgagcctgaagcacctggagttcacagaggagaagaacctggatgtgaccaaggagaccatgctgcctgaaaatgtggcctacctgagcaatgctgacctgaacaagaggaggaaggagatcagtgacatgaaccccagcatccagagcgccctgatcctggagaccccccacatgtacttcagtgacagcgagagcaagctgcaggccacagacaagtcagaaaatgagcagatcgagatggtggccgtgaagggctacagcaagacagacacagacagctccatggagcgggtgagccccagcacctgctgcagcgagaacaaccaggaggactgtgacctggccaacagcggccccctgcagaatgagaagagcagccctggagaaattgtggaggagcgggccaccgtgaccaagaaggccttcggcaagcagaagagcaagagcaccctggagaagttccccaggcatgagctgagcaactttgtgggggactggcctgtggacaagaccatcggccagaggaccaagaggaacaggaagacagagaagaccagctctgtgcagagcgacaagaagtacaactacccccagagccacaagctggtgaacagcgtgtctgtgaacacagactgtgtgcagcagaggggcagcccccatgaatctgtggaggatggcaggaagagccagtgtgatgatgccagcgagcccctgaacagctacaagtatgatgcctacaagaacatcgacaagaacagcttcaacatcatgggagactggcccagcagtgacagcctggcccagcgggagcacaggagcaggatgcccaagacaggcctgtctgagcccaacctggagatcggcaccaatgacaagatgaatgagatcagcctgagcacagcccacgaggcctgctggggcaccagcagccagaagctgaagaccctgggcagcagcaacctgggcagcagcgagatgctgctgtctgagatgacctgtgagagccagacctgcctgagcaagaagagccacggccagcacaccagcctgcccctgaccttcaccaacagcgcccccaccgtgtctggagtggtggagccccagaccctggccgagtgccaggagcagatgcccaagagggaccccgggaaggaggtgggcatgtgcacccagacagagccccaggactttgccctgctgtggaagattgagaagaacaagatcagcatcagtgacagcatcaaggtgctgaccggccgcctggatggcttcaagcccaaggtgttcaacatcaacaccaagagtgatgtgcaggaggccatcccctacagagtgatgtatgacaagagcacctttgtggaggagagcgagctgaccagcgcagatgaaagtgagaacctgaacatcctgtgcaagctgtttggcagcttcagcctggaggccctgaaggacctgtatgagcgctgcaacaaggacatcatctgggccaccagcctgctgctggacagcgagaccaagctgtgtgaggacacagaatttgagaacttccagaagagctgtgatggcagccagatcggccccttcagcctgggcctgaacctgaaggagatcatcagccagaggggcaccctggagaacagcaacagccctgtgcctgagttcagccatggaattggcatcagcaatgctgacagccagagcacctgtgatgctgagcggggcaacagcgagcaggccgagatgagagctgtgaccccagagaaccacgagagcatgaccagcatcttccccagcgctgctgtgggcctgaagaacaacaatgacatcctgcccaacagccaggaggagctgctgtacagcagcaagcagagcttccctggcatcctgaaggccaccacccccaaggacatgtctgaaacagagaagaacctggtggtgacagagaccggggacaacatccacagccccagccacttcagtgacatcttcaactttgtgagcagcaccagcaacctggagctgaatgaggagatctacttcacagacagcctggagatcaagagaaatgaaaacttccccaaggactatgtgaagttcagtgatgaggaggagttcatgaatgaagatgagaaggagatgaaggagatcctgatggccggcagcagcctgtctgctggggtgtctggagaggacaagacagagatcctgaaccccaccccagccatggccaagagcctgaccatcgactgcctggagctggccctgcccccagagctggccttccagctgaatgagctgtttggacctgtgggcattgattctggcagcctgactgtggaggactgtgtggtgcacatcgacctgaacctggccaaggtgatccacgagaagtggaaggagagcgtgatggagcggcagaggcaggaggaggtgtcctgtgggaagttcatgcaggaccccagcctggtgggccacacaggcctggacaaccctgagcagaagagcagccagaggacaggcaagaagctgctgaagaccctgacagccagcgagatgctgcccctgctggaccactggaacacccagaccaagaaggtgtccctgcgggagatcatgtctgaggagatcgccctgcaggagaagcacaacctgaagcgggagaccctgatgtttgagaaggactgtgccaccaagctgaaggagaagcagctgttcaagatcttccctgccatcaaccagaacttcctggtggacatcttcaaggaccacaactacagcctggagcacacagtgcagttcctgaactgtgtgctggagggggaccctgtgaagacagtggtggcccaggagtttgtgcaccagaatgaaaatgtgaccagccacacaggccagaagagcaaggagaagaagcccaagaagctgaaggagacagaggagaccccatctgagctgtccttccaggactttgagtacccagactatgatgactacagagctgaggccttcctgcaccagcagaagaggatggagtgctacagcaaggccaaggaggcctaccgcatcggcaagaagaatgtggccaccttctacgcccagcagggcaccctgcacgagcagaagatgaaggaggccaaccacctggccgccatcgagatctttgagaaggtgaatgccagcctgctgccccagaatgtgctggacctgcacggcctgcacgtggatgaggccctggagcacctgatgagggtgctggagaagaagacagaggagttcaagcagaatggaggcaagccctacctgagcgtcatcaccggccggggcaaccacagccagggcggcgtggcccgcatcaagccagctgtgatcaagtacctgatcagccacagcttccgcttcagcgagatcaagccaggctgcctgaaggtgatgctgaagtag

SEQ ID NO: 20208 - DNA, 477 bp, Artificial Sequence
  Description of Artificial Sequence: Synthetic coding sequence
atgggcagcggcagcagccgcagcagcaggaccctgcggaggagaagaagccctgagagcctgcctgctggccctggagctgctgccctggagggcggcacccggcggcgggtgcctgtggccgctgctgaggtgcctggagctgctgctgaggaggcccctggccgggaccccagccctgtggcccccccagatggaagagatgagaccctgcggctgctggatgagctgctggccgagagcgctgcctggggccccccagagcccgccccccggcggcctgcccggctgcggcccacagctgtggccggcagcgctgtgtgtgccgagcagagcacagagggccaccctggcagcggaaatgtgtctgaggcccctggcagcggcaggaagaagccagagaggcctgctgccatctcctatgaccacagcgaggagggcctgatggccagcattgaaagagagtactgcaggtag

SEQ ID NO: 20209 - DNA, 738 bp, Artificial Sequence; identical to SEQ ID NO: 18315
  Description of Artificial Sequence: Synthetic coding sequence

SEQ ID NO: 20210 - DNA, 1014 bp, Artificial Sequence
  Description of Artificial Sequence: Synthetic coding sequence
atggagcagccctggcccccacctggcccctggagcctgcccagggctgagggggaggccgaggaggagagtgactttgatgtgttccccagcagcccccgctgcccccagctgcccggcggcggggcccagatgtacagccacggcatcgagctggcctgccagaagcagaaggagtttgtgaagagctctgtggcctgcaagtggaacctggccgaggcccagcagaagctgggcagcctggccctgcacaacagcgagagcctggaccaggagcacgccaaggcccagacagctgtgtctgagctgcggcagcgggaggaggagtggaggcagaaggaggaggccctggtgcagcgggagaagatgtgcctgtggagcacagatgccatcagcaaggatgtgttcaacaagagcttcatcaaccaggacaagaggaaggacacagaagatgaggacaagtctgagagcttcatgcagaagtatgagcagaagatccgccacttcggcatgctgagccgctgggatgacagccagcgcttcctgagtgaccacccctacctggtgtgtgaggagacagccaagtacctgatcctgtggtgcttccacctggaggccgagaagaagggggccctgatggagcagatcgcccaccaggccgtggtgatgcagttcatcatggagatggccaagaactgcaatgtggacccccggggctgcttccgcctcttcttccagaaggccaaggccgaggaggagggctactttgaggccttcaagaatgagctggaggccttcaagagccgggtgcggctgtacagccagagccagagcttccagcccatgacagtgcagaaccacgtgccccacagcggcgtgggcagcatcggcctgctggagagcctgccccagaacccagactacctgcagtacagcatcagcacagccctgtgcagcctgaacagcgtggtgcacaaggaggatgatgagcccaagatgatggacacagtgtag

SEQ ID NO: 20211 - DNA, 927 bp, Artificial Sequence
  Description of Artificial Sequence: Synthetic coding sequence
atggagcagccctggcccccacctggcccctggagcctgcccagggctgagggggaggccgaggaggagagtgactttgatgtgttccccagcagcccccgctgcccccagctgcccggcggcggggcccagatgtacagccacggcatcgagctggcctgccagaagcagaaggagtttgtgaagagctctgtggcctgcaagtggaacctggccgaggcccagcagaagctgggcagcctggccctgcacaacagcgagagcctggaccaggagcacgccaaggcccagacagctgtgtctgagctgcggcagcgggaggaggagtggaggcagaaggaggaggccctggtgcagcgggagaagatgtgcctgtggagcacagatgccatcagcaaggatgtgttcaacaagagcttcatcaaccaggacaagaggaaggacacagaagatgaggacaagtctgagagcttcatgcagaagtatgagcagaagatccgccacttcggcatgctgagccgctgggatgacagccagcgcttcctgagtgaccacccctacctggtgtgtgaggagacagccaagtacctgatcctgtggtgcttccacctggaggccgagaagaagggggccctgatggagcagatcgcccaccaggccgtggtgatgcagttcatcatggagatggccaagaactgcaatgtggacccccggggctgcttccgcctcttcttccagaaggccaaggccgaggaggagggctactttgaggccttcaagaatgagctggaggccttcaagagccgggtgcggctgtacagccagagccagagcttccagcccatgacagtgcagaaccacgtgccccacagcggcgtgggcagcatcggcctgctggagagcctgccccaggccccccgcttctag

SEQ ID NO: 20212 - DNA, 4227 bp, Artificial Sequence; identical to SEQ ID NO: 19164
  Description of Artificial Sequence: Synthetic coding sequence

SEQ ID NO: 20213 - DNA, 528 bp, Artificial Sequence
  Description of Artificial Sequence: Synthetic coding sequence
atgatcctgaatgtgctggagtatggcagccagcaggtggccgacctgaccctgaacctggatgactacattgatgctgagcacctgggggacttccacaggacctacaagaacagcgaggagctgcggagccgcatcgtgtctggcatcatcacccccatccacgagcagtgggagaaggccaacgtgagcagcccccaccgggagttccccccagccacagcccgggaggtggaccccctgcgcatccccccccaccacccccacaccagccggcagcccccctggtgtgaccccctgggcccctttgtggtgggcggggaggacctggaccccttcggcccccggcggggcggcatgattgtggaccccctgcggagcggcttcccccgggccctgattgaccccagcagcggcctgcccaaccggctgcccccaggagctgtgcccccaggggccaggtttgaccccttcggccccatcggcaccagccccccaggccccaggccagaccggcggggccagtag

SEQ ID NO: 20214 - DNA, 552 bp, Artificial Sequence
  Description of Artificial Sequence: Synthetic coding sequence
atggccggcctggaggtgctgtttgccagcgctgccccagccatcacctgccggcaggatgccctggtgtgcttcctgcactgggaggtggtgacccacggctacttcggcctgggcgtgggggaccagcccggccccaatgacaagaagtctgagctgctgcctgctggctggaacaacaacaaggacctgtatgtgctgcgctatgagtacaaggatggcagcaggaagctgctggtgaaggccatcaccgtggagagctccatgatcctgaatgtgctggagtatggcagccagcaggtggccgacctgaccctgaacctggatgactacattgatgctgagcacctgggggacttccacaggacctacaagaacagcgaggagctgcggagccgcatcgtgtctggcatcatcacccccatccacgagcagtgggagaaggccaacgtgagcagcccccaccgggagttccccccagccacagcccgggaggtggaccccctgcgcatccccccccaccacccccacaccagccggcagcccccatag

SEQ ID NO: 20215 - DNA, 888 bp, Artificial Sequence; identical to SEQ ID NO: 18344
  Description of Artificial Sequence: Synthetic coding sequence

SEQ ID NO: 20216 - DNA, 888 bp, Artificial Sequence; identical to SEQ ID NO: 18344
  Description of Artificial Sequence: Synthetic coding sequence

SEQ ID NO: 20217 - DNA, 414 bp, Artificial Sequence
  Description of Artificial Sequence: Synthetic coding sequence
atgggcctgcgggccggcggcaccctgggccgggccggggccggccgcggggcccctgagggccctggccccagcggcggggcccagggcggcagcatccacagcggcagaattgctgctgtgcacaacgtgcccctgtctgtgctgatccggcccctgcccagcgtgctggaccctgccaaggtgcagagcctggtggacaccatcagagaagatcctgattctgtgccccccattgatgtgctgtggatcaagggggcccagggcggggactacttctacagctttggaggctgccacagatatgctgcctaccagcagctgcagcgggagaccatcccagccaagctggtgcagagcaccctgagtgacctgcgggtgtacctgggcgccagcaccccagacctgcagtag

SEQ ID NO: 20218 - DNA, 1731 bp, Artificial Sequence
  Description of Artificial Sequence: Synthetic coding sequence
atgaagtgccactatgaggccctgggcgtgagaagagatgccagcgaggaggagctgaagaaggcctacaggaagctggccctgaagtggcacccagacaagaacctggacaatgctgctgaggccgctgagcagttcaagctgatccaggccgcctatgatgtgctgagtgacccccaggagcgggcctggtatgacaaccaccgggaggccctgctgaagggcggctttgatggagagtaccaggatgacagcctggacctgctgcgctacttcaccgtgacctgctacagcggctatggagatgatgagaagggcttctacacagtgtacagaaatgtgtttgagatgattgccaaggaggagctggagagcgtgctggaggaggaggtggatgacttccccacctttggagacagccagagcgactatgacacagtggtgcaccccttctacgcctactggcagagcttctgcacccagaagaactttgcctggaaggaggagtatgacacccggcaggccagcaaccgctgggagaagagggccatggagaaggagaacaagaagatccgggacaaggccaggaaggagaagaatgagctggtgcggcagctggtggccttcatcaggaagagggacaagagggtgcaggcccacaggaagctggtggaggagcagaatgctgagaaggccaggaaggccgaggagatgaggcggcagcagaagctgaagcaggccaagctggtggagcagtaccgggagcagagctggatgaccatggccaacctggagaaggagctgcaggagatggaggcccgctatgagaaggagtttggagatggcagtgatgaaaatgagatggaggagcacgagctgaaggatgaagaagatggcaaggacagtgatgaagcagaagatgctgagctgtatgatgacctgtactgcccagcctgtgacaagagcttcaagacagagaaggccatgaagaaccacgagaagagcaagaagcaccgggagatggtggccctgctgaagcagcagctggaggaggaggaggagaacttcagccggccccagattgatgagaaccccctggatgacaacagcgaggaggagatggaggatgcccccaagcagaagctgagcaagaagcagaagaagaagaagcagaagccagcccaggatgtgcctgggaaggacagctacctgcctgctgcccacttccagatggcctggggcaagaagtgtgtgctgggggagaggagagatggagagagcgagcacaagtgtgccaagatgctgctggagaaccggcagaactatgatgacaacttcaacgtgaatggacctggagagggcgtgaaggtggaccctgaggacaccaacctgaaccaggacagcgccaaggagctggaggacagcccccaggagaatgtgtctgtgacagagatcatcaagccctgtgatgaccccaagtctgaggccaagtctgtgcccaagcccaagggcaagaagaccaaggacatgaagaagcctgtgcgggtgcctgctgagccccagaccatgtctgtgctgatcagctgcaccacctgccacagcgagttccccagcaggaacaagctgtttgaccacctgaaggccactggacatgcccgggcccccagcagcagcagcctgaacagcgccaccagcagccagagcaagaaggagaagaggaagaacagatag

SEQ ID NO: 20219 - DNA, 798 bp, Artificial Sequence
  Description of Artificial Sequence: Synthetic coding sequence
atgctggccctgactgtgctggagacctgtgtgaagaactgtggccaccgcttccacgtgctggtggccagccaggactttgtggagagcgtgctggtgaggaccatcctgcccaagaacaacccccccaccatcgtgcatgacaaggtgctgaacctgatccagagctgggcagatgccttccgcagcagcccagacctgactggagtggtgaccatctatgaggacctgcggaggaagggcctggagttccccatgacagacctggacatgctgagccccatccacaccccccagaggacagtgttcaacagcgagacccagagcggccaggacagcgtgggcacagacagcagccagcaggaggacagcggccagcacgccgcccccctgcctgccccacccatcctgagcggggacacccccatcgcccccaccccagagcagatcggcaagctgcggtctgagctggagatggtgtctggaaatgtgcgggtgatgtctgagatgctgacagagctggtgcccacccaggccgagcctgctgacctggagctgctgcaggagctgaacagaacctgccgggccatgcagcagagggtgctggagctgatcccccagatcgccaatgagcagctgacagaggagctgctgattgtgaatgacaacctgaacaacgtgttcctgcggcatgagcgggaccggggcctgactgtgctgccccggctggtgagcaacagctggccccaggccgtgctgcccccctggccacccaaggccctggtgctgcaggcctag

SEQ ID NO: 20220 - DNA, 6273 bp, Artificial Sequence
  Description of Artificial Sequence: Synthetic coding sequence
atggatgaggtggagcaggaccagcacgaggcccggctgaaggagctgtttgacagctttgacaccactggaacaggcagcctgggccaggaggagctgacagacctgtgccacatgctgagcctggaggaggtggcccctgtgctgcagcagaccctgctgcaggacaacctgctgggccgggtgcactttgaccagttcaaggaggccctgatcctgatcctgagcaggaccctgagcaatgaggagcacttccaggagccagactgcagcctggaggcccagcccaagtatgtgcggggcggcaagagatatggaagaagaagcctgcctgagttccaggagagcgtggaggagttccctgaggtgaccgtcatcgagcccctggatgaggaggcccggcccagccacatcccagctggggactgcagcgagcactggaagacccagaggtctgaggagtatgaagctgagggccagctgcgcttctggaacccagatgacctgaatgccagccagagcggcagcagccccccccaggactggattgaggagaagctgcaggaggtgtgtgaggacctgggcatcaccagagatggccacctgaacaggaagaagctggtgtccatctgtgagcagtatggcctgcagaatgtggatggagagatgctggaggaggtgttccacaacctggaccctgatggcaccatgtctgtggaggacttcttctacggcctcttcaagaatggcaagagcctgacccccagcgccagcaccccctaccggcagctgaagaggcacctgtccatgcagagctttgatgagagcggccgccgcaccaccaccagcagcgccatgaccagcaccatcggcttccgggtcttcagctgcctggatgatggcatgggccacgcctctgtggagcgcatcctggacacctggcaggaggagggcatcgagaacagccaggagatcctgaaggccctggacttcagcctggatggcaacatcaacctgacagagctgaccctggccctggagaatgagctgctggtgaccaagaacagcatccaccaggccgccctggccagcttcaaggccgagatccgccacctgctggagcgggtggaccaggtggtgcgggagaaggagaagctgcggagtgacctggacaaggccgagaagctgaagagcctgatggccagcgaggtggatgaccaccacgccgccattgaaagaagaaatgagtacaacctgaggaagctggatgaggagtacaaggagagaattgctgccctgaagaatgagctgaggaaggagcgggagcagatcctgcagcaggccggcaagcagaggctggagctggagcaggagattgagaaggccaagacagaggagaactacatccgggaccggctggccctgagcctgaaggagaacagccggctggagaatgagctgctggagaatgctgagaagctggccgagtatgagaacctgaccaacaagctgcagaggaacctggagaatgtgctggccgagaagtttggagacctggaccccagcagcgctgagttcttcctgcaggaggagcggctgacccagatgagaaatgaatatgaaaggcagtgccgggtgctgcaggaccaggtggatgagctgcagagcgagctggaggagtaccgggcccagggccgggtgctgcggctgcccctgaagaacagccccagcgaggaggtggaggccaacagcggcggcatcgagcctgagcacggcctgggcagcgaggagtgcaaccccctgaacatgagcattgaagctgagctggtgattgagcagatgaaggagcagcaccaccgggacatctgctgcctgcggctggagctggaggacaaggtgcgccactatgagaagcagctggatgaaacagtggtgtcctgcaagaaggcccaggagaacatgaagcagagacatgaaaatgagacccacaccctggagaagcagatcagtgacctgaagaatgaaattgctgagctgcagggccaggccgctgtgctgaaggaggcccaccacgaggccacctgcagacatgaggaggagaagaagcagctgcaggtgaagctggaggaggagaagacccacctgcaggagaagctgcggctgcagcacgagatggagctgaaggcccggctgacccaggcccaggccagctttgagcgggagcgggagggcctgcagagcagcgcctggacagaggagaaggtgcggggcctgacccaggagctggagcagttccaccaggagcagctgaccagcctggtggagaagcacaccctggagaaggaggagctgaggaaggagctgctggagaagcaccagcgggagctgcaggagggccgggagaagatggagacagagtgcaacagaaggaccagccagatcgaggcccagttccagagcgactgccagaaggtgacagagcgctgtgagagcgccctgcagagcctggagggccgctaccggcaggagctgaaggacctgcaggagcagcagcgggaggagaagagccagtgggagtttgagaaggatgagctgacccaggagtgtgccgaggcccaggagctgctgaaggagaccctgaagcgggagaagaccaccagcctggtgctgacccaggagcgggagatgctggagaagacctacaaggagcacctgaacagcatggtggtggagcggcagcagctgctgcaggacctggaggacctgagaaatgtgtctgagacccagcagagcctgctgagtgaccagatcctggagctgaagagcagccacaagcgggagctgcgggagcgggaggaggtgctgtgccaggccggggccagcgagcagctggccagccagaggctggagcggctggagatggagcatgaccaggagcggcaggagatgatgagcaagctgctggccatggagaacatccacaaggccacctgtgaaacagctgaccgggagcgggcagagatgagcacagagatcagccggctgcagagcaagatcaaggagatgcagcaggccaccagccccctgtccatgctgcagagcggctgccaggtgattggagaggaggaggtggagggagatggagccctgagcctgctgcagcagggcgagcagctgctggaggagaatggagatgtgctgctgagcctgcagagggcccacgagcaggccgtgaaggaaaatgtgaagatggccacagagatcagccggctgcagcagaggctgcagaagctggagcccggcctggtgatgagcagctgcctggatgagcccgccacagagttcttcggcaacacagctgagcagacagagcagttcctgcagcagaacagaaccaagcaggtggagggcgtgacccggcggcacgtgctgagtgacctggaggatgatgaggtgcgggacctgggcagcacaggcaccagctctgtgcagaggcaggaggtgaagattgaggagagcgaggcctctgtggagggcttcagcgagctggagaacagcgaggagaccaggacagagagctgggagctgaagaaccagatcagccagctgcaggagcagctgatgatgctgtgtgccgactgtgaccgggccagcgagaagaagcaggacctgctgtttgatgtgtctgtgctgaagaagaagctgaagatgctggagcgcatccctgaggccagccccaagtacaagctgctgtatgaagatgtgtcccgggagaatgactgcctgcaggaggagctgaggatgatggagaccaggtatgatgaggccctggagaacaacaaggagctgacagctgaggtgttccggctgcaggatgagctgaagaagatggaggaggtgacagagaccttcctgagcctggagaagagctatgatgaggtgaagattgaaaatgaaggcctgaatgtgctggtgctgcggctgcagggcaagattgagaagctgcaggagagcgtggtgcagagatgtgactgctgcctgtgggaggccagcctggagaacctggagattgaaccagatggcaacatcctgcagctgaaccagaccctggaggagtgtgtgccccgggtgcgctctgtgcaccacgtgattgaggagtgcaagcaggagaaccagtacctggagggcaacacccagctgctggagaaggtgaaggcccatgaaattgcctggctgcacggcaccatccagacccaccaggagcggccccgggtgcagaaccaggtgatcctggaggagaacaccaccctgctgggcttccaggacaagcacttccagcaccaggccaccatcgccgagctggagctggagaagaccaagctgcaggagctgaccaggaagctgaaggagcgggtgaccatcctggtgaagcagaaggatgtgctgagccacggggagaaggaggaggagctgaaggccatgatgcatgacctgcagatcacctgcagcgagatgcagcagaaggtggagctgctgcgctatgagagcgagaagctgcagcaggagaacagcatcctgagaaatgagatcaccaccctgaatgaggaggacagcatcagcaacctgaagctgggcaccctgaatggcagccaggaggagatgtggcagaagacagagaccgtgaagcaggagaatgctgctgtgcagaagatggtggagaacctgaagaagcagatcagcgagctgaagatcaagaaccagcagctggacctggagaacacagagctgagccagaagaacagccagaaccaggagaagctgcaggagctgaaccagaggctgacagagatgctgtgccagaaggagaaggagcccggcaacagcgccctggaggagcgggagcaggagaagttcaacctgaaggaggagctggagcgctgcaaggtgcagagcagcaccctggtgagcagcctggaggccgagctgtctgaggtgaagatccagacccacatcgtgcagcaggagaaccacctgctgaaggatgagctggagaagatgaagcagctgcaccgctgcccagacctgagtgacttccagcagaagatcagctctgtgctgagctacaatgagaagctgctgaaggagaaggaggccctgtctgaggagctgaacagctgtgtggacaagctggccaagagcagcctgctggagcaccgcatcgccaccatgaagcaggagcagaagtcctgggagcaccagagcgccagcctgaagagccagctggtggccagccaggagaaggtgcagaacctggaggacacagtgcagaatgtgaacctgcagatgagcaggatgaagagtgacctgcgggtgacccagcaggagaaggaggccctgaagcaggaggtgatgagcctgcacaagcagctgcagaatgccggcggcaagtcctgggcccctgagatcgccacccaccccagcggcctgcacaaccagcagaagaggctgtcctgggacaagctggaccacctgatgaatgaggagcagcagctgctgtggcaggagaatgaaaggctgcagaccatggtgcagaacaccaaggccgagctgacccacagccgggagaaggtgcggcagctggagagcaacctgctgcccaagcaccagaagcacctgaaccccagcggcaccatgaaccccacagagcaggagaagctgagcctgaagagagaatgtgaccagttccagaaggagcagagccctgccaacaggaaggtgtcccagatgaacagcctggagcaggagctggagaccatccacctggagaatgaaggcctgaagaagaagcaggtgaagctggatgagcagctgatggagatgcagcacctgcggagcacagccacccccagccccagcccccacgcctgggacctgcagctgctgcagcagcaggcctgccccatggtgccccgggagcagttcctgcagctgcagaggcagctgctgcaggccgagcgcatcaaccagcacctgcaggaggagctggagaacagaaccagcgagaccaacaccccccagggcaaccaggagcagctggtgacagtgatggaggagaggatgattgaggtggagcagaagctgaagctggtgaagaggctgctgcaggagaaggtgaaccagctgaaggagcaggtgtccctgcccggccacctgtgcagccccaccagccacagcagcttcaacagcagcttcaccagcctgtactgccactag

SEQ ID NO: 20221 - DNA, 4134 bp, Artificial Sequence
  Description of Artificial Sequence: Synthetic coding sequence
atggatgaggtggagcaggaccagcacgaggcccggctgaaggagctgtttgacagctttgacaccactggaacaggcagcctgggccaggaggagctgacagacctgtgccacatgctgagcctggaggaggtggcccctgtgctgcagcagaccctgctgcaggacaacctgctgggccgggtgcactttgaccagttcaaggaggccctgatcctgatcctgagcaggaccctgagcaatgaggagcacttccaggagccagactgcagcctggaggcccagcccaagtatgtgcggggcggcaagagatatggaagaagaagcctgcctgagttccaggagagcgtggaggagttccctgaggtgaccgtcatcgagcccctggatgaggaggcccggcccagccacatcccagctggggactgcagcgagcactggaagacccagaggtctgaggagtatgaagctgagggccagctgcgcttctggaacccagatgacctgaatgccagccagagcggcagcagccccccccaggactggattgaggagaagctgcaggaggtgtgtgaggacctgggcatcaccagagatggccacctgaacaggaagaagctggtgtccatctgtgagcagtatggcctgcagaatgtggatggagagatgctggaggaggtgttccacaacctggaccctgatggcaccatgtctgtggaggacttcttctacggcctcttcaagaatggcaagagcctgacccccagcgccagcaccccctaccggcagctgaagaggcacctgtccatgcagagctttgatgagagcggccgccgcaccaccaccagcagcgccatgaccagcaccatcggcttccgggtcttcagctgcctggatgatggcatgggccacgcctctgtggagcgcatcctggacacctggcaggaggagggcatcgagaacagccaggagatcctgaaggccctggacttcagcctggatggcaacatcaacctgacagagctgaccctggccctggagaatgagctgctggtgaccaagaacagcatccaccaggccgccctggccagcttcaaggccgagatccgccacctgctggagcgggtggaccaggtggtgcgggagaaggagaagctgcggagtgacctggacaaggccgagaagctgaagagcctgatggccagcgaggtggatgaccaccacgccgccattgaaagaagaaatgagtacaacctgaggaagctggatgaggagtacaaggagagaattgctgccctgaagaatgagctgaggaaggagcgggagcagatcctgcagcaggccggcaagcagaggctggagctggagcaggagattgagaaggccaagacagaggagaactacatccgggaccggctggccctgagcctgaaggagaacagccggctggagaatgagctgctggagaatgctgagaagctggccgagtatgagaacctgaccaacaagctgcagaggaacctggagaatgtgctggccgagaagtttggagacctggaccccagcagcgctgagttcttcctgcaggaggagcggctgacccagatgagaaatgaatatgaaaggcagtgccgggtgctgcaggaccaggtggatgagctgcagagcgagctggaggagtaccgggcccagggccgggtgctgcggctgcccctgaagaacagccccagcgaggaggtggaggccaacagcggcggcatcgagcctgagcacggcctgggcagcgaggagtgcaaccccctgaacatgagcattgaagctgagctggtgattgagcagatgaaggagcagcaccaccgggacatctgctgcctgcggctggagctggaggacaaggtgcgccactatgagaagcagctggatgaaacagtggtgtcctgcaagaaggcccaggagaacatgaagcagagacatgaaaatgagacccacaccctggagaagcagatcagtgacctgaagaatgaaattgctgagctgcagggccaggccgctgtgctgaaggaggcccaccacgaggccacctgcagacatgaggaggagaagaagcagctgcaggtgaagctggaggaggagaagacccacctgcaggagaagctgcggctgcagcacgagatggagctgaaggcccggctgacccaggcccaggccagctttgagcgggagcgggagggcctgcagagcagcgcctggacagaggagaaggtgcggggcctgacccaggagctggagcagttccaccaggagcagctgaccagcctggtggagaagcacaccctggagaaggaggagctgaggaaggagctgctggagaagcaccagcgggagctgcaggagggccgctatgaaagtgagaagctgcagcaggagaacagcatcctgagaaatgagatcaccaccctgaatgaagaagattccatcagcaacctgaagctgggcaccctgaatggcagccaggaggagatgtggcagaagacagaaacagtgaagcaggagaatgctgctgtgcagaagatggtggagaacctgaagaagcagatcagcgagctgaagatcaagaaccagcagctggacctggagaacacagagctgagccagaagaacagccagaaccaggagaagctgcaggagctgaaccagaggctgacagagatgctgtgccagaaggagaaggagcccggcaacagcgccctggaggagcgggagcaggagaagttcaacctgaaggaggagctggagcgctgcaaggtgcagagcagcaccctggtgagcagcctggaggccgagctgtctgaggtgaagatccagacccacatcgtgcagcaggagaaccacctgctgaaggatgagctggagaagatgaagcagctgcaccgctgcccagacctgagtgacttccagcagaagatcagctctgtgctgagctacaatgagaagctgctgaaggagaaggaggccctgtctgaggagctgaacagctgtgtggacaagctggccaagagcagcctgctggagcacagaattgccaccatgaagcaggagcagaagtcctgggagcaccagagcgccagcctgaagagccagctggtggccagccaggagaaggtgcagaacctggaggacacagtgcagaatgtgaacctgcagatgagcaggatgaagagtgacctgcgggtgacccagcaggagaaggaggccctgaagcaggaggtgatgagcctgcacaagcagctgcagaatgctgggggcaagtcctgggcccctgagatcgccacccaccccagcggcctgcacaaccagcagaagaggctgtcctgggacaagctggaccacctgatgaatgaggagcagcagctgctgtggcaggagaatgaaaggctgcagaccatggtgcagaacaccaaggccgagctgacccacagccgggagaaggtgcggcagctggagagcaacctgctgcccaagcaccagaagcacctgaaccccagcggcaccatgaaccccacagagcaggagaagctgagcctgaagcgggagtgtgaccagttccagaaggagcagagccctgccaacaggaaggtgtcccagatgaacagcctggagcaggagctggagaccatccacctggagaatgaaggcctgaagaagaagcaggtgaagctggatgagcagctgatggagatgcagcacctgcggagcacagccacccccagccccagcccccacgcctgggacctgcagctgctgcagcagcaggcctgccccatggtgccccgggagcagttcctgcagctgcagaggcagctgctgcaggccgagcgcatcaaccagcacctgcaggaggagctggagaacagaacatctgagaccaacaccccccagggcaaccaggagcagctggtgacagtgatggaggagaggatgattgaggtggagcagaagctgaagctggtgaagaggctgctgcaggagaaggtgaaccagctgaaggagcaggtgtccctgcccggccacctgtgcagccccaccagccacagcagcttcaacagcagcttcaccagcctgtactgccactag

SEQ ID NO: 20222 - DNA, 3171 bp, Artificial Sequence
  Description of Artificial Sequence: Synthetic coding sequence
atggccactggaaactacttcggcttcacccacagcggggctgctgctgctgctgctgctgcccagtacagccagcagcctgccagcggcgtggcctacagccaccccaccaccgtggccagctacacagtgcaccaggcccctgtggccgcccacacagtgacagctgcctatgccccagctgctgccaccgtggccgtggcccggcctgcccctgtggccgtggccgccgccgccacagctgctgcctacggcggctaccccacagcccacacagccacagattatggctacacccagaggcagcaggaggcccctcctcctcctcctccagccaccacccagaactaccaggacagctacagctatgtgcgcagcacagccccagctgtggcctatgacagcaagcagtactaccagcagcccacagccacagctgctgctgtggccgccgccgcccagccccagcccagcgtggccgagacctactaccagacagcccccaaggccggctacagccagggcgccacccagtacacccaggcccagcagacccggcaggtgacagccatcaagccagccacccccagccctgccaccaccaccttcagcatctaccctgtgagcagcacagtgcagcctgtggccgccgccgccaccgtggtgcccagctacacccagagcgccacctacagcaccacagctgtgacctacagcggcaccagctacagcggctatgaggccgctgtgtacagcgctgccagcagctactaccagcagcagcagcagcagcagaagcaggccgctgctgctgctgctgctgctgctgccacagctgcctggacaggcaccaccttcaccaagaaggcccccttccagaacaagcagctgaagcccaagcagccccccaagccaccccagatccactactgtgatgtgtgcaagatcagctgtgccggcccccagacctacaaggagcacctggagggccagaagcacaagaagaaggaggccgccctgaaggccagccagaacaccagcagcagcaacagcagcacccggggcacccagaaccagctgcgctgtgagctgtgtgatgtgtcctgcaccggggctgatgcctatgctgcccacatccggggggccaagcaccagaaggtggtgaagctgcacaccaagctgggcaagcccatccccagcacagagcccaacgtggtgtcccaggccaccagcagcacagctgtgtctgccagcaagcccacagccagccccagcagcattgctgccaacaactgcaccgtgaacaccagctctgtggccaccagctccatgaagggcctgaccaccaccggcaacagcagcctgaacagcaccagcaacaccaaggtgtctgctgtgcccaccaacatggccgccaagaagaccagcacccccaagatcaactttgtgggcggcaacaagctgcagagcactggaaacaaggccgaggacatcaagggcacagaatgtgtgaagagcacccctgtgaccagcgctgtgcagatccctgaggtgaagcaggacacagtgtctgagcctgtgaccccagccagcctggccgccctgcagagtgatgtgcagcctgtgggccatgactatgtggaggaggtgagaaatgatgagggcaaggtgatccgcttccactgcaagctgtgtgagtgcagcttcaatgaccccaatgccaaggagatgcacctgaagggccgccgccaccggctgcagtacaagaagaaggtgaacccagacctgcaggtggaggtgaagcccagcatccgggccaggaagatccaggaggagaagatgaggaagcagatgcagaaggaggagtactggaggcggcgggaggaggaggagcgctggaggatggagatgagaagatatgaggaggacatgtactggaggaggatggaggaggagcagcaccactgggatgacagaagaaggatgccagatggcggctacccccacggccccccaggccccctgggcctgctgggcgtgcggcccggcatgccaccccagccccagggccctgcccccctgcggcggccagacagcagtgatgaccgctacgtgatgaccaagcacgccaccatctaccccacagaggaggagctgcaggccgtgcagaagatcgtgtccatcacagagcgggccctgaagctggtgtctgacagcctgtctgaacatgagaagaacaagaacaaggagggagatgacaagaaggagggcggcaaggaccgggccctgaagggcgtgctgcgggtgggcgtgctggccaagggcctgctgctgcggggggacagaaatgtgaacctggtgctgctgtgcagcgagaagcccagcaagaccctgctgagcagaattgctgagaacctgcccaagcagctggccgtcatcagccctgagaagtatgacatcaagtgtgctgtgtctgaggccgccatcatcctgaacagctgtgtggagcccaagatgcaggtgaccatcaccctgaccagccccatcatccgggaggagaacatgagagaaggagatgtgaccagcggcatggtgaaggaccccccagatgtgctggaccggcagaagtgcctggatgccctggccgccctgcggcatgccaagtggttccagcaggcccgggccaacggcctgcagagctgtgtgatcatcatccgcatcctgcgggacctgtgccagagggtgcccacctggagcgacttccccagctgggccatggagctgctggtggagaaggccatcagcagcgccagcagcccccagagccctggagatgccctgcggcgggtgtttgagtgcatcagcagcggcatcatcctgaagggcagccctggcctgctggacccctgtgagaaggacccctttgacaccctggccaccatgacagaccagcagcgggaggacatcaccagcagcgcccagtttgccctgcggctgctggccttccggcagatccacaaggtgctgggcatggaccccctgccccagatgagccagcgcttcaacatccacaacaacaggaagagaagaagagacagtgatggcatggacctgaagctgcggggcaagaagaccaagaagatcatgatcaccttcaagaagtgcctgtag

SEQ ID NO: 20223 - DNA, 390 bp, Artificial Sequence
  Description of Artificial Sequence: Synthetic coding sequence
atgggctgctgcggctgcagcggcggctgcggcagcggctgcggcggctgcggcagcggctgcggcggctgcggcagcagctgctgcgtgcccatctgctgctgcaagcctgtgtgctgctgcgtgcctgcctgcagctgcaccagctgtggcagctgtggcggcagcaagggctgctgcggcagctgtggcggcagcaaaggaggctgcggcagctgtggcggcagcaaaggaggctgcggcagctgtggctgcagccagtgcagctgctgcaagccctgctactgcagcagcggctgcggcagcagctgctgccagagcagctgctgcaagccctgctgcagccaggccagctgctgcgtgcccatctgctgccagtgcaagatctag

SEQ ID NO: 20224 - DNA, 1344 bp, Artificial Sequence
  Description of Artificial Sequence: Synthetic coding sequence
atgcccatgcccacagagggcaccccaccacccctgagcggcacccccatccctgtgcctgcctacttcagacatgctgagcccggcttcagcctgaagaggccccggggcctgagccgcagcctgcccccacctcctccagccaagggcagcatccccatcagccgcctcttcccccccaggaccccaggctggcaccagctgcagcccaggagagtgtccttccggggggaggccagcgagaccctgcagagccctggctatgaccccagcaggcctgagagcttcttccagcagagcttccagaggctgagccggctgggccacggcagctatggagaggtgttcaaggtgcgcagcaaggaggatggccgcctgtatgctgtgaagaggtccatgagccccttccggggccccaaggaccgggccaggaagctggccgaggtgggcagccatgagaaggtgggccagcacccctgctgcgtgcggctggagcaggcctgggaggagggcggcatcctgtacctgcagacagagctgtgtggccccagcctgcagcagcactgtgaggcctggggcgccagcctgcctgaggcccaggtgtggggctacctgcgggacaccctgctggccctggcccacctgcacagccagggcctggtgcacctggatgtgaagccagccaacatcttcctgggcccccggggccgctgcaagctgggggactttggcctgctggtggagctgggcacagctggggccggggaggtgcaggagggggacccccgctacatggcccctgagctgctgcagggcagctatggaacagctgctgatgtgttcagcctgggcctgaccatcctggaggtggcctgcaacatggagctgccccacggcggggagggctggcagcagctgcggcagggctacctgcccccagagttcaccgctggcctgagcagcgagctgcggtctgtgctggtgatgatgctggagccagaccccaagctgcgggccacagctgaggccctgctggccctgcctgtgctgcggcagccccgggcctggggcgtgctgtggtgcatggctgctgaggccctgagccggggctgggccctgtggcaggccctgctggccctgctgtgctggctgtggcacggcctggcccacccagcctcctggctgcagcccctgggccccccagccaccccacctggcagccccccctgcagcctgctgctggacagcagcctgagcagcaactgggatgatgacagcctgggcccctgtgtgctgaagaggacagaaggagccctggagtgcagccagatggagggcctgtag

SEQ ID NO: 20225 - DNA, 1005 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccagcccttccctgcctaccccagcagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccagtag

SEQ ID NO: 20226 - DNA, 1173 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccagcccttccctgcctaccccagcagccccttccaggtgacagctggctaccagctgcctgtgtacaactaccaggccttccctgcctaccccaacagccctgtgcaggtgaccaccggctaccagctgcctgtgtacaactaccaggccttccctgcctaccccagcagccccttccaggtgaccaccggctaccagctgcctgtgtacaactaccaggccttccctgcctaccccaacagcgctgtgcaggtgaccaccggctaccagttccacgtgtacaactaccagatgccaccccagtgccctgtgggggagcagaggaggaacctgtggacagaggcctacaagtggtggtacctggtgtgcctgatccagaggcgggactag

SEQ ID NO: 20227 - DNA, 1173 bp, Artificial Sequence; identical to SEQ ID NO: 20226
  Description of Artificial Sequence: Synthetic coding sequence

SEQ ID NO: 20228 - DNA, 1101 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccagcccttccctgcctaccccagcagccccttccaggtgacagctggctaccagctgcctgtgtacaactaccaggccttccctgcctaccccaacagccctgtgcaggtgaccaccggctaccagctgcctgtgtacaactaccaggccttccctgcctaccccaacagcgctgtgcaggtgaccaccggctaccagttccacgtgtacaactaccagatgccaccccagtgccctgtgggggagcagaggaggaacctgtggacagaggcctacaagtggtggtacctggtgtgcctgatccagaggcgggactag

SEQ ID NO: 20229 - DNA, 1149 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccagcccttccctgcctaccccagcagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccagtag

SEQ ID NO: 20230 - DNA, 1842 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcagagcgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagaaattggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcagagcgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtgtgagatctgcaagatcctggtgctgaagaatgctgctgccttcctgtgccacagcaaggtgaacagaagcatctag

SEQ ID NO: 20231 - DNA, 384 bp, Artificial Sequence; identical to SEQ ID NO: 18976
  Description of Artificial Sequence: Synthetic coding sequence

SEQ ID NO: 20232 - DNA, 537 bp, Artificial Sequence
  Description of Artificial Sequence: Synthetic coding sequence
atgatgagggccatgaagcccccaggaggagagagcagcaacctgtttggcagccctgaggaggccacccccagcagccggcccaacaggatggccagcaacatcttcggccccacagaggagccccagaacatccccaagaggaccaaccccccaggcggcaaaggaagtggcatctttgatgagagcacccctgtgcagacccggcagcacctgaaccccccaggcggcaagaccagtgacatcttcggcagccctgtgacagccaccagccggctggcccaccccaacaagcccaaggaccacgtgttcctgtgtgagggggaggagcccaagagtgacctgaaggccgcccggagcatcccagctggagctgagcctggagagaagggcagcgccaggaaggccggccctgccaaggagcaggagcccatgcccaccgtggacagccatgagccccggctgggcccccggcccaggagccacaacaaggtgctgaaccccccaggcggcaagagcagcatctccttctactag

SEQ ID NO: 20233 - DNA, 657 bp, Artificial Sequence
  Description of Artificial Sequence: Synthetic coding sequence
atgttccaggtgcctgattctgagggcggccgggccggcagcaggaagtggcagctgctgaccggcagcctggccagcaccagccccagcctgctgagcggccagggcccctgggcccccctgcagagggccatgaagcccccaggaggagagagcagcaacctgtttggcagccctgaggaggccacccccagcagccggcccaacaggatggccagcaacatcttcggccccacagaggagccccagaacatccccaagaggaccaaccccccaggcggcaaaggaagtggcatctttgatgagagcacccctgtgcagacccggcagcacctgaaccccccaggcggcaagaccagtgacatcttcggcagccctgtgacagccaccagccggctggcccaccccaacaagcccaaggaccacgtgttcctgtgtgagggggaggagcccaagagtgacctgaaggccgcccggagcatcccagctggagctgagcctggagagaagggcagcgccaggaaggccggccctgccaaggagcaggagcccatgcccaccgtggacagccatgagccccggctgggcccccggcccaggagccacaacaaggtgctgaaccccccaggcggcaagagcagcatctccttctactag

SEQ ID NO: 20234 - DNA, 4866 bp, Artificial Sequence
  Description of Artificial Sequence: Synthetic coding sequence
atggccggcggccgcggggcccctggccggggcagagatgagcccccagagagctacccccagaggcaggaccacgagctgcaggccctggaggccatctacggggctgacttccaggacctgcggccagatgcctgtggccctgtgaaggagcccccagagatcaacctggtgctgtacccccagggcctgactggagaggaggtgtatgtgaaggtggacctgcgggtgaagtgcccccccacctacccagatgtggtgcctgagattgagctgaagaatgccaagggcctgagcaatgaatctgtgaacctgctgaagagccggctggaggagctggccaagaagcactgtggggaggtgatgatctttgagctggcctaccacgtgcagagcttcctgtctgagcacaacaagcccccacccaagagcttccacgaggagatgctggagcggcgggcccaggaggagcagcagaggctgctggaggccaagaggaaggaggagcaggagcagcgggagatcctgcacgagatccagaggaggaaggaggagatcaaggaggagaagaagaggaaggagatggccaagcaggagcggctggagatcgccagcctgagcaaccaggaccacaccagcaagaaggaccccggcggccacaggacagctgccatcctgcatggaggcagcccagactttgtgggcaatggcaagcaccgggccaacagcagcggccgcagccggcgggagcggcagtacagcgtgtgcaacagcgaggacagccctggcagctgtgagatcctgtacttcaacatgggcagcccagaccagctgatggtgcacaagggcaagtgcatcggcagtgatgagcagctgggcaagctggtgtacaatgccctggagacagccaccggcggctttgtgctgctgtatgagtgggtgctgcagtggcagaagaagatgggccccttcctgaccagccaggagaaggagaagattgacaagtgcaagaagcagatccagggcacagaaacagagttcaacagcctggtgaagctgagccaccccaacgtggtgcgctacctggccatgaacctgaaggagcaggatgacagcatcgtggtggacatcctggtggagcacatctctggagtgtccctggccgcccacctgagccacagcggccccatccctgtgcaccagctgcggcgctacacagcccagctgctgagcggcctggactacctgcacagcaacagcgtggtgcacaaggtgctgagcgccagcaatgtgctggtggatgctgagggcaccgtgaagatcacagactacagcatcagcaagaggctggccgacatctgcaaggaggatgtgtttgagcagaccagggtgcgcttcagtgacaatgccctgccctacaagacaggcaagaagggagatgtgtggaggctgggcctgctgctgctgagcctgagccagggccaggagtgtggggagtaccctgtgaccatccccagcgacctgcctgctgacttccaggacttcctgaagaagtgtgtgtgcctggatgacaaggagcgctggagcccccagcagctgctgaagcacagcttcatcaacccccagcccaagatgcccctggtggagcagagcccagaagattctgagggccaggactatgtggagaccgtcatccccagcaaccggctgcccagcgctgccttcttcagcgagacccagaggcagttcagccgctacttcatcgagtttgaggagctgcagctgctgggcaagggggcctttggagctgtgatcaaggtgcagaacaagctggatggctgctgctatgctgtgaagaggatccccatcaacccagccagccggcagttccgccgcatcaagggggaggtgaccctgctgagccggctgcaccacgagaacatcgtgcgctactacaatgcctggattgaaagacatgagaggcctgctggccctggcaccccacctccagacagcggccccctggccaaggatgacagagctgcccggggccagcctgccagtgacacagatggcctggacagcgtggaggccgccgcccccccacccatcctgagcagctctgtggagtggagcaccagcggggagaggtctgccagcgcccgcttccctgccaccggccctggcagcagtgatgatgaagatgatgatgaagatgaacatggaggagtcttcagccagagcttcctgcctgccagtgacagcgagagtgacatcatctttgacaatgaagatgagaacagcaagagccagaaccagatggagtactgtgagaagagcaccctgcgggacaccatcgaccagggcctgtacagagacacagtgcggctgtggaggctcttccgggagatcctggatggcctggcctacatccacgagaagggcatgatccaccgggacctgaagcctgtgaacatcttcctggacagtgatgaccacgtgaagatcggggactttggcctggccacagaccacctggccttctctgctgacagcaagcaggatgaccagacaggagacctgatcaagagtgaccccagcggccacctgaccggcatggtgggcacagccctgtatgtgtccccagaggtgcagggcagcaccaagagcgcctacaaccagaaggtggacctcttcagcctgggcatcatcttctttgagatgagctaccaccccatggtgacagccagcgagcgcatctttgtgctgaaccagctgcgggaccccaccagccccaagtttcctgaggactttgatgatggagaacatgccaagcagaagagcgtcatctcctggctgctgaaccacgaccctgccaagaggcccacagccacagagctgctgaagtctgagctgctgcccccaccccagatggaggagagcgagctgcacgaggtgctgcaccacaccctgaccaacgtggatggcaaggcctaccgcaccatgatggcccagatcttcagccagaggatcagccctgccatcgactacacctatgacagcgacatcctgaagggcaacttcagcatcagaacagccaagatgcagcagcacgtgtgtgagaccatcatccgcatcttcaagagacatggagctgtgcagctgtgcacccccctgctgctgcccaggaaccggcagatctatgagcacaatgaagctgccctcttcatggaccacagcggcatgctggtgatgctgccctttgacctgcgcatcccctttgcccgctacgtggccaggaacaacatcctgaacctgaagcgctactgcatcgagagggtcttccggcccaggaagctggaccgcttccaccccaaggagctgctggagtgtgcctttgatattgtgaccagcaccaccaacagcttcctgcccacagctgagatcatctacaccatctatgagatcatccaggagttccctgccctgcaggagaggaactacagcatctacctgaaccacaccatgctgctgaaggccatcctgctgcactgcggcatccctgaggacaagctgagccaggtgtacatcatcctgtatgatgctgtgacagagaagctgacccggcgggaggtggaggccaagttctgcaacctgagcctgagcagcaacagcctgtgccgcctgtacaagttcatcgagcagaagggggacctgcaggacctgatgcccaccatcaacagcctcatcaagcagaagacaggcatcgcccagctggtgaagtatggcctgaaggacctggaggaggtggtgggcctgctgaagaagctgggcatcaagctgcaggtgctgatcaacctgggcctggtgtacaaggtgcagcagcacaacggcatcatcttccagtttgtggccttcatcaagaggcggcagagagctgtgcctgagatcctggccgccggcggccgctatgacctgctgatcccccagttccggggcccccaggccctgggccctgtgcccacagccatcggcgtgtccatcgccatcgacaagatctctgctgctgtgctgaacatggaggagagcgtgaccatcagcagctgtgacctgctggtggtgtctgtgggccagatgtccatgagccgggccatcaacctgacccagaagctgtggacagctggcatcacagctgagatcatgtatgactggagccagagccaggaggagctgcaggagtactgccgccaccacgagatcacctacgtggccctggtgtctgacaaggagggcagccacgtgaaggtgaagagctttgagaaggagcggcagacagagaagagggtgctggagacagagctggtggaccacgtgctgcagaagctgcggaccaaggtgacagatgaaagaaatggccgggaggccagtgacaacctggccgtgcagaacctgaagggcagcttcagcaatgccagcggcctgtttgagatccacggggccaccgtggtgcccatcgtgtctgtgctggcccctgagaagctgagcgccagcacccggcggcgctatgagacccaggtgcagacccggctgcagaccagcctggccaacctgcaccagaagagcagcgagattgagatcctggccgtggacctgcccaaggagaccatcctgcagttcctgagcctggagtgggatgctgatgagcaggccttcaacaccaccgtgaagcagctgctgagccggctgcccaagcagcgctacctgaagctggtgtgtgatgagatctacaacatcaaggtggagaagaaggtgtctgtgctcttcctgtacagctacagagatgactactaccgcatcctcttctag

SEQ ID NO: 20235 - DNA, 2388 bp, Artificial Sequence
  Description of Artificial Sequence: Synthetic coding sequence
atgaagttcaccaacaccaaggtgcagatgatgcagaatgtgcacctggcccctgagacagatgaagatgacctgtacagcggctacaatgactacaaccccatctatgacatcgaggagctggagaatgatgctgccttccagcaggccgtgaggaccagccatggaagaagaccacccatcacagccaagatcagcagcacagctgtgacccggcccatcgccaccggctacggcagcaagaccagcctggccagcagcatcggccggcccatgactggagccatccaggatggagtgacccggcccatgacagctgtgcgggccgccggcttcaccaaggccgccctgcggggcagcgcctttgaccccctgagccagagccggggccctgccagccccctggaggccaagaagaaggacagccctgaggagaagatcaagcagctggagaaggaggtgaatgagctggtggaggagagctgcatcgccaacagctgtggggacctgaagctggccctggagaaggccaaggatgctggcaggaaggagcgggtgctggtgcggcagcgggagcaggtgaccaccccagagaacatcaacctggacctgacctacagcgtgctcttcaacctggccagccagtacagcgtgaatgagatgtatgcagaggccctgaacacctaccaggtgattgtgaagaacaagatgttcagcaatgccggcatcctgaagatgaacatgggcaacatctacctgaagcagaggaactacagcaaggccatcaagttctacaggatggccctggaccaggtgcccagcgtgaacaagcagatgaggatcaagatcatgcagaacattggagtgaccttcatccaggccggccagtacagtgatgccatcaacagctatgagcacatcatgtccatggcccccaacctgaaggccggctacaacctgaccatctgctactttgccatcggggaccgggagaagatgaagaaggccttccagaagctgatcaccgtgcccctggagattgatgaggacaagtacatcagccccagtgatgacccccacaccaacctggtgacagaggccatcaagaatgaccacctgcggcagatggagcgggagaggaaggccatggccgagaagtacatcatgaccagcgccaagctgattgcccctgtgattgagaccagctttgctgctggctatgactggtgtgtggaggtggtgaaggccagccagtatgtggagctggccaatgacctggagatcaacaaggctgtgacctacctgcggcagaaggactacaaccaggccgtggagatcctgaaggtgctggagaagaaggacagccgggtgaagtctgctgctgccaccaacctgagcgccctgtactacatgggcaaggactttgcccaggccagcagctatgctgacattgctgtgaacagcgaccgctacaacccagctgccctgaccaacaagggcaacacagtgtttgccaacggggactatgagaaggctgctgagttctacaaggaggccctgagaaatgacagcagctgcacagaggccctgtacaacatcggcctgacctatgagaagctgaaccggctggatgaggccctggactgcttcctgaagctgcacgccatcctgaggaacagcgctgaggtgctgtaccagatcgccaacatctatgagctgatggagaaccccagccaggccatcgagtggctgatgcaggtggtgtctgtcatccccacagacccccaggtgctgagcaagctgggggagctgtatgaccgggagggggacaagagccaggccttccagtactactatgagagctaccgctacttcccctgcaacattgaagtcatcgagtggctgggcgcctactacatcgacacccagttctgggagaaggccatccagtactttgagcgggccagcctcatccagcccacccaggtgaagtggcagctgatggtggccagctgcttccgccgcagcggcaactaccagaaggccctggacacctacaaggacacccacaggaagttcccagaaaatgtggagtgcagcggctctgtgaggacaggccacatggagcgggaccccctgaacctgctgcccaggaagtctgtgctgcccggccctgagatcgccaagtgcaactacttcagcggggagaagtactacctgagcgccttcctgagcagcagcctgcaccgctcctggatcaagcgctgcagccgcatctgccagaagacagaggaggtgggcaagaatgaaagaaataaaggaacagcccacaaggtgcggcagcgctggcagtggggcctgccctggcagaagaggaggaagtgctag

SEQ ID NO: 20236 - DNA, 192 bp, Artificial Sequence
  Description of Artificial Sequence: Synthetic coding sequence
atgagctactaccgcagctactacggcggcctgggctacggctatggaggctttggaggctggggctacggctacggctgcggctacggcagcttccggcggctgggctacggctgcggctatggaggctacggcttcagctgctgccggcccctgtactacggcggctacggcttcagcgccttctactag

SEQ ID NO: 20237 - DNA, 135 bp, Artificial Sequence
  Description of Artificial Sequence: Synthetic coding sequence
atgagctactacggcaactactacggcggcctgggctacggctatgactgcaagtacagctacaccagcggctttggagccttccgcatcctggactgtggctaccgctgtggctgcggcggcgtgtggatctag

SEQ ID NO: 20238 - DNA, 135 bp, Artificial Sequence
  Description of Artificial Sequence: Synthetic coding sequence
atgagctactacagccacctgagcggcggcctgggctgcggcctggccgtggccgtgaccatgggccgcacagtggccgtggccgagtatggccgctgcagacatggctgccacagcagctacagcgccaggtag

SEQ ID NO: 20239 - DNA, 138 bp, Artificial Sequence
  Description of Artificial Sequence: Synthetic coding sequence
atgtgctactaccacaactactacggcagcctggactatggctgcagctatggctctgaatatggcaacagcggctacgcctgcaacttcccctgcagctatggccgcttcctgctggcccccaggaagaagttctag

SEQ ID NO: 20240 - DNA, 624 bp, Artificial Sequence
  Description of Artificial Sequence: Synthetic coding sequence
atgccccacagccactgccacagcctgcgctccttccacaatgccccacccctgagcgccatcacccacggcaccaaccccatcacctttgaagatcggctgtgcctgcccagcagcttccacagcaggacctgcttcctggacaacttccaggagacctgcaatgagaccaccagctgccagatgaccaactgtgagcaggacctcttcacagatgacagctgtgtgcagagcaactgcttccctggggtggtgcagaccacctacagcaacagccggccctgtgagaggacagcctgccagagcgagagcagcagcgctggcctggcctgtgtgtcccagccctgccagagcgagagcacccagcagatgggctttgtggcccagagctgccagcctgccagcctgaagggcaacagctgcccccccaagaccagcaagagcaagaactttgagaccctggagcgggccagcagccagtgccagtgccagagccagaaccctgagagcagcagctgccggcccctggtgaatgtggcccctgagccccagctgctggagagcagccctggggtggagcccacctgctgcgtgactggaggcagccagctgcccagcaagtag

SEQ ID NO: 20241 - DNA, 645 bp, Artificial Sequence
  Description of Artificial Sequence: Synthetic coding sequence
atggcccacgtgagcagcgagacccaggatgtgagccccaaggatgagctgacagccagcgaggccagcaccaggagccccctgtgtgagcacaccttccctggggacagcgacctgcgctccatgattgaggagcacgccttccaggtgctgagccagggcagcctgctggagagccccagctacacagtgtgtgtgtctgagccagacaaggatgatgacttcctgagcctgaacttccccaggaagctgtggaagatcgtggagagtgaccagttcaagagcatctcctgggatgaaaatggcacctgcatcgtcatcaatgaggagctgttcaagaaggagatcctggagaccaaggccccctaccgcatcttccagacagatgccatcaagagctttgtgcggcagctgaacctgtatggcttcagcaagatccagcagaacttccagaggtctgccttcctggccaccttcctgtctgaggagaaggagagctctgtgctgagcaagctgcacgtgtttgtgttccaccacagcctgtttggagccaccttcggggagcaccacttccagccctgccccctgcccagcggcaacaaggcccccatcagcacctggagcggggacagctggctgctgtag

SEQ ID NO: 20242 - DNA, 645 bp, Artificial Sequence; identical to SEQ ID NO: 20241
  Description of Artificial Sequence: Synthetic coding sequence

SEQ ID NO: 20243 - DNA, 1437 bp, Artificial Sequence
  Description of Artificial Sequence: Synthetic coding sequence
atggctgctgccctgaagtgcctgctgaccctgggccgctggtgccccggcctgggcgtggccccccaggcccgggccctggccgccctggtgcctggggtgacccaggtggacaacaagagcggcttcctgcagaagaggccccaccggcagcaccctggcatcctgaagctgccccacgtgcggctgccccaggccctggccaatggagcccagctgctgctgctgggcagcgctggccccaccatggagaaccaggtgcagaccctgaccagctacctgtggagccgccacctgcctgtggagcctgaggagctgcagaggcgggcccggcacctggagaagaagttcctggagaacccagacctgagccagacagaggagaagctgcggggagctgtgctgcacgccctgaggaagaccacctaccactggcaggagctgagctacacagagggcctgagcctggtgtacatggccgcccggctggatggcggctttgctgctgtgtcccgggccttccacgagatccgggccaggaacccagccttccagccccagaccctgatggactttggcagcggcaccggctctgtgacctgggccgcccacagcatctggggccagagcctgcgggagtacatgtgtgtggacagatctgctgccatgctggtgctggccgagaagctgctgaagggcggcagcgagagcggggagccctacatccctggggtcttcttccggcagttcctgcctgtgagccccaaggtgcagtttgatgtggtggtgtctgccttcagcctgtctgagctgcccagcaaggctgacagaacagaggtggtgcagaccctgtggaggaagacaggccacttcctggtgctggtggagaatggcaccaaggccggccacagcctgctgatggatgcccgggacctggtgctgaagggcaaggagaagagccccctggacccccggcccggctttgtgtttgccccctgcccccatgagctgccctgcccccagctgaccaacctggcctgcagcttcagccaggcctaccaccccatccccttctcctggaacaagaagcccaaggaggagaagttctccatggtgatcctggcccggggcagccctgaggaggcccaccgctggccccgcatcacccagcctgtgctgaagaggcccaggcatgtgcactgccacctgtgctgcccagatggccacatgcagcacgctgtgctgacagcccggcggcacggccgctatggaggctgtgaccagaaccagtgggatgtggccggcagctgcagcccccggcagcacctgttcccccagggctttgtgtccctgtgcccctgccagctgctgggccgctccttcacctgtgcctacagcgtgtgtgtgagcagcatctacggcagcggcagcctgtag

SEQ ID NO: 20244 - DNA, 774 bp, Artificial Sequence
  Description of Artificial Sequence: Synthetic coding sequence
atggaggaggaggccagcagccctggcctgggctgcagcaagccccacctggagaagctgaccctgggcatcacccgcatcctggagagcagccctggggtgacagaggtgaccatcatcgagaagcccccagctgagcggcacatgatcagctcctgggagcagaagaacaactgtgtgatgccagaagatgtgaagaacttctacctgatgaccaacggcttccacatgacctggagcgtgaagctggatgccagtgatgaccagcctgagaagccccactttgacagccgcagcgtcatctttgagctggacagctgcaatggcagcggcaaggtgtgcctggtgtacaagagcggcaagccagccctggccgaggacacagagatctggttcctggaccgggccctgtactggcacttcctgacagacaccttcaccgcctactaccgcctgctgatcacccacctgggcctgccccagtggcagtatgccttcaccagctatggcatcagcccccaggccaagcagtggttctccatgtacaagcccatcacctacaacaccaacctgctgacagaggagacagacagctttgtgaacaagctggaccccagcaaggtgttcaagagcaagaacaagatcgtcatccccaagaagaagggccctgtgcagcctgctgggggccagaagggccccagcggccccagcggccccagcaccagcagcaccagcaagagcagcagcggcagcggcaaccccaccaggaagtag

SEQ ID NO: 20245 - DNA, 792 bp, Artificial Sequence; identical to SEQ ID NO: 18943
  Description of Artificial Sequence: Synthetic coding sequence

SEQ ID NO: 20246 - DNA, 390 bp, Artificial Sequence; identical to SEQ ID NO: 19988
  Description of Artificial Sequence: Synthetic coding sequence

SEQ ID NO: 20247 - DNA, 1626 bp, Artificial Sequence
  Description of Artificial Sequence: Synthetic coding sequence
atggaggccctgctggagggcatccagaacagaggacatggaggcggcttcctgaccagctgtgaggccgagctgcaggagctgatgaagcagattgacatcatggtggcccacaagaagtctgagtgggagggccgcacccacgccctggagacctgcctgaagatccgggagcaggagctgaagagcctgcggagccagctggatgtgacccacaaggaggtgggcatgctgcaccagcaggtggaggagcacgagaagatcaagcaggagatgaccatggagtacaagcaggagctgaagaagctgcacgaggagctgtgcatcctgaagaggagctatgagaagctgcagaagaagcagatgagggagttccggggcaacaccaagaaccaccgggaggacagaagtgaaattgagcggctgacagccaagattgaggagttccggcagaagagcctggactgggagaagcagaggctcatctaccagcagcaggtgagcagcctggaggcccagaggaaggccctggccgagcagagcgagatcatccaggcccagctggtgaacaggaagcagaagctggagagcgtggagctgagcagccagagcgagatccagcacctgagcagcaagctggagcgggccaatgacaccatctgtgccaatgagctggagattgagcggctgaccatgagggtgaatgacctggtgggcacctccatgacagtgctgcaggagcagcagcagaaggaggagaagctgcgggagagcgagaagctgctggaggccctgcaggaggagaagcgggagctgaaggccgccctgcagagccaggagaacctgatccacgaggcccgcatccagaaggagaagctgcaggagaaggtgaaggccaccaacacccagcacgctgtggaggccatccggccccgggaggagagcctggccgagaagaagtacaccagccagggccagggcgacctggacagcgtgctgagccagctgaacttcacccacaccagcgaggacctgctgcaggccgaggtgacctgcctggagggcagcctggagagcgtgtctgccacctgcaagcagctgagccaggagctgatggagaagtatgaggagctgaagaggatggaggcccacaacaatgagtacaaggccgagatcaagaagctgaaggagcagatcctgcagggcgagcagagctacagcagcgccctggagggcatgaagatggagatcagccacctgacccaggagctgcaccagagggacatcaccatcgccagcaccaagggcagcagcagtgacatggagaagaggctgcgggcagagatgcagaaggccgaggacaaggctgtggagcacaaggagatcctggaccagctggagagcctgaagctggagaacagacacctgtctgagatggtgatgaagctggagctgggcctgcatgaatgttccctgcctgtgagccccctgggcagcatcgccacccgcttcctggaggaggaggagctgcggagccaccacatcctggagcggctggatgcccacatcgaggagctgaagcgggagagcgagaagacagtgcggcagttcaccgccctgaagtag

SEQ ID NO: 20248 - DNA, 483 bp, Artificial Sequence; identical to SEQ ID NO: 20009
  Description of Artificial Sequence: Synthetic coding sequence

SEQ ID NO: 20249 - DNA, 483 bp, Artificial Sequence; identical to SEQ ID NO: 20009
  Description of Artificial Sequence: Synthetic coding sequence

SEQ ID NO: 20250 - DNA, 3192 bp, Artificial Sequence
  Description of Artificial Sequence: Synthetic coding sequence
atgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctggtgggtgcgggagggcttcttcaagccagagtaccaggcccggctgccccaggccactggagagaccttctccatgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggagagccagatgctgaggtggtggtgggcaccaccaggcctgagaccctgcctggagatgtggccgtggccgtgcacccagatgacagccgctacacccacctgcacggccggcagctgcggcaccccctgatgggccagcccctgcccctcatcacagattatgctgtgcagccccacgtgggcaccggggctgtgaaggtgaccccagcccacagccctgcagatgctgagatgggcgcccggcacggcctgagccccctgaatgtgattgctgaagatggcaccatgaccagcctgtgtggggactggctgcagggcctgcacagatttgtggcccgggagaagatcatgtctgtgctgtctgagcggggcctcttccggggcctgcagaaccaccccatggtgctgcccatctgcagccgctctggagatgtgattgagtacctgctgaagaaccagtggtttgtgcgctgccaggagatgggcgcccgggccgccaaggctgtggagagcggggccctggagctgagccccagcttccaccagaagaactggcagcactggttcagccacatcggggactggtgtgtgtcccggcagctgtggtggggccaccagatcccagcctacctggtggtggaggaccacgcccagggcgaggaggactgctgggtggtgggccgctctgaggccgaggcccgggaggtggccgctgagctgaccggccggcctggagctgagctgaccctggagcgggaccctgatgtgctggacacctggttcagcagcgccctcttccccttcagcgccctgggctggccccaggagaccccagacctggcccgcttctaccccctgagcctgctggagactggaagtgacctgctgctcttctgggtgggccgcatggtgatgctgggcacccagctgaccggccagctgcccttcagcaaggtgctgctgcaccccatggtgcgggaccggcagggcaggaagatgagcaagagcctgggcaatgtgctggacccccgggacatcatcagcggcgtggagatgcagctgctgcaggagaagctgcggagcggcaacctggaccctgctgagctggccatcgtggccgccgcccagaagaaggacttcccccacggcatcccagaatgtggcacagatgccctgcgcttcaccctgtgcagccatggagtgcaggccggggacctgcacctgtctgtgtctgaggtgcagagctgccgccacttctgcaacaagatctggaatgccctgcgcttcatcctgaatgccctgggggagaagtttgtgccccagcctgctgaggagctgagccccagcagccccatggatgcctggatcctgagccggctggccctggccgcccaggagtgtgagcggggcttcctgacccgggagctgagcctggtgacccacgccctgcaccacttctggctgcacaacctgtgtgatgtgtacctggaggccgtgaagcctgtgctgtggcacagcccccggcccctgggccccccccaggtgctcttcagctgtgccgacctgggcctgcggctgctggcccccctgatgcccttcctggccgaggagctgtggcagaggctgcccccccggcccggctgccccccagcccccagcatctctgtggccccctaccccagcgcctgcagcctggagcactggaggcagcctgagctggagcggcgcttcagccgggtgcaggaggtggtgcaggtgctgcgggccctgcgggccacctaccagctgaccaaggcccggccccgggtgctgctgcagagcagcgagcccggggaccagggcctgtttgaggccttcctggagcccctgggcaccctgggctactgtggggctgtgggcctgctgcccccaggcacagctgcccccagcggctgggcccaggcccccctgagtgacacagcccaggtgtacatggagctgcagggcctggtggacccccagatccagctgcccctgctggccgcccggcgctacaagctgcagaagcagctggacagcctgacagcccggaccccatctgagggggaggccggcacccagaggcagcagaagctgagcagcctgcagctggagctgagcaagctggacaaggccgccagccacctgcggcagctgatggatgagcccccagcccctggcagccctgagctgtag

SEQ ID NO: 20251 - DNA, 1620 bp, Artificial Sequence; identical to SEQ ID NO: 19050
  Description of Artificial Sequence: Synthetic coding sequence

SEQ ID NO: 20252 - DNA, 678 bp, Artificial Sequence
  Description of Artificial Sequence: Synthetic coding sequence
atggctgctggcagcgaggccaccacccctgtgattgtggccgccggggccggcggggaggagggggagcacgtgaagcccttcaagccagagaaggccaaggagatcatcatgagcctgcagcagcctgccatcttctgcaacatggtgtttgactggccagcccggcactggaatgccaagtacctgagccaggtgctgcacggcaagcagatccgcttcaggatgggcatgaagtccatgagcacagtgccccagtttgagaccacctgcaactacgtggaggccaccctggaggagttcctgacctggaactgtgaccagagcagcatcagcggccccttccgggactatgaccacagcaagttctgggcctatgctgactacaagtactttgtgtccctgtttgaggacaagacagacctcttccaggatgtgaagtggagcgactttggcttccctggaagaaatggccaggagagcaccctgtggattggcagcctgggcgcccacaccccctgccacctggacagctatggctgcaacctggtgttccaggtgcagggccgcctggagtgcaatggcatgatcatcgcccctggcccccaggccatcctgctgccccagcccctgaagtacctgggcctgcaggagaccatggccagcctgagcagctag

SEQ ID NO: 20253 - DNA, 2571 bp, Artificial Sequence; identical to SEQ ID NO: 18624
  Description of Artificial Sequence: Synthetic coding sequence

SEQ ID NO: 20254 - DNA, 2607 bp, Artificial Sequence
  Description of Artificial Sequence: Synthetic coding sequence
atggccagcttccctgagacagacttccagatctgcctgctgtgcaaggagatgtgtggcagccctgcccccctgagcagcaacagcagcgccagcagcagcagcagccagaccagcaccagcagcggcggcggcggcggcggccctggagctgctgcccggcggctgcacgtgctgccctgcctgcacgccttctgccggccctgcctggaggcccaccggctgcctgctgctgggggcggcgctgctggggagcccctgaagctgcgctgccctgtgtgtgaccagaaggtggtgctggccgaggccgccggcatggatgccctgcccagcagcgccttcctgctgagcaacctgctggatgctgtggtggccacagcagatgagcccccacccaagaatggccgggccggggccccagctggagctgggggccacagcaaccaccgccaccacgcccaccacgcccacccccgggccagcgccagcgccccacccctgccccaggccccccagcccccagcccccagccgcagcgcccctgggggccctgctgccagccccagcgccctgctgctgcggcggccccacggctgcagcagctgtgatgagggcaatgctgccagcagccgctgcctggactgccaggagcacctgtgtgacaactgtgtgcgggcccaccagagggtgcggctgaccaaggaccactacatcgagcggggccccccaggccctggagctgctgctgctgcccagcagctgggcctgggcccccccttccctggcccccccttcagcatcctgtctgtgtttcctgagcggctgggcttctgccagcaccatgatgatgaggtgctgcacctgtactgtgacacctgcagcgtgcccatctgccgggagtgcaccatgggccgccacggcggccacagcttcatctacctgcaggaggccctgcaggacagccgggccctgaccatccagctgctggctgatgcccagcagggccggcaggccatccagctgagcattgagcaggcccagacagtggccgagcaggtggagatgaaggccaaggtggtgcagagcgaggtgaaggctgtgacagcccggcacaagaaggccctggaggagagagaatgtgagctgctgtggaaggtggagaagatccggcaggtgaaggccaagagcctgtacctgcaggtggagaagctgcggcagaacctgaacaagctggagagcaccatctctgctgtgcagcaggtgctggaggagggccgggccctggacatcctgctggcccgggacaggatgctggcccaggtgcaggagctgaagacagtgcgcagcctgctgcagccccaggaggatgacagagtgatgttcaccccaccagaccaggccctgtacctggccatcaagagctttggatttgtgagcagcggggcctttgcccccctgaccaaggccactggagatggcctgaagagggccctgcagggcaaggtggccagcttcaccgtcatcggctatgaccatgatggagagccccggctgtctggaggagacctgatgtctgctgtggtgctgggcccagatggcaacctgtttggagctgaggtgtctgaccagcagaatggcacctacgtggtgtcctaccggccccagctggagggggagcacctggtgtctgtgaccctgtgcaaccagcacatcgagaacagccccttcaaggtggtggtgaagagcggccgctcctatgtgggcatcggcctgcccggcctgagctttggcagcgagggggacagtgatggcaagctgtgccggccctggggcgtgtctgtggacaaggagggctacatcatcgtggccgacaggagcaacaaccgcatccaggtgttcaagccctgtggggccttccaccacaagtttggcaccctgggcagccggcccggccagtttgacaggcctgctggggtggcctgtgatgccagcagaagaattgtggtggccgacaaggacaaccaccgcatccagatcttcacctttgagggccagttcctgctgaagtttggagagaagggcaccaagaatggccagttcaactacccctgggatgtggccgtgaacagcgagggcaagatcctggtgtctgacaccaggaaccaccgcatccagctgtttggaccagatggagtcttcctgaacaagtatggctttgaaggagccctgtggaagcactttgacagcccccggggcgtggccttcaaccacgagggccacctggtggtgacagacttcaacaaccaccggctgctggtgatccacccagactgccagagcgcccgcttcctgggcagcgagggcactggaaatggccagttcctgcggccccagggcgtggccgtggaccaggagggccgcatcatcgtggccgacagcaggaaccaccgggtgcagatgtttgagagcaatggcagcttcctgtgcaagtttggagcccagggcagcggcttcggccagatggaccggcccagcggcatcgccatcaccccagatggcatgattgtggtggtggactttggaaacaaccgcatcctggtgttctag

SEQ ID NO: 20255 - DNA, 1107 bp, Artificial Sequence
  Description of Artificial Sequence: Synthetic coding sequence
atgagggagcctgtgctgacctggtgtgtgcccctggagctgctgtgcagccaccccctgcccctgagcgccttcctgaagagccaggtgaagctgtacacctaccgggcctgtgccggcaaggatgagatgggcaagatggtgtctgtcatcaacacagtggacaccagccatgaggacatgattcatgatgcccagatggactactacggcacccggctggccacctgcagcagtgacagatctgtgaagatctttgatgtgagaaatggaggccagatcctgattgctgacctgcggggccacgagggccctgtgtggcaggtggcctgggcccaccccatgtatggcaacatcctggccagctgcagctatgacaggaaggtgatcatctggagagaagaaaatggcacctgggagaagagccatgaacatgctggccatgacagctctgtgaacagcgtgtgctgggcccctcatgactatggcctcatcctggcctgtggcagcagtgatggagccatcagcctgctgacctacacaggagagggccagtgggaggtgaagaagatcaacaatgcccacaccatcggctgcaatgctgtgtcctgggccccagctgtggtgcccggcagcctgattgaccaccccagcggccagaagcccaactacatcaagagatttgccagcggcggctgtgacaacctgatcaagctgtggaaggaggaggaggatggccagtggaaggaggagcagaagctggaggcccacagcgactgggtgagagatgtggcctgggcccccagcatcggcctgcccaccagcaccatcgccagctgcagccaggacggccgggtcttcatctggacctgtgatgatgccagcagcaacacctggagccccaagctgctgcacaagttcaatgatgtggtgtggcacgtgtcctggagcatcacagccaacatcctggccgtgtctggaggagacaacaaggtgaccctgtggaaggagagcgtggatggccagtgggtgtgcatcagtgatgtgaacaagggccagggctctgtgtctgcctctgtgacagagggccagcagaatgagcagtag

SEQ ID NO: 20256 - DNA, 1059 bp, Artificial Sequence
  Description of Artificial Sequence: Synthetic coding sequence
atggacatcgacaaggacctggaggcccccctgtacctgaccccagagggctggagcctcttcctgcagcgctactaccaggtggtgcatgagggcgctgagctgcggcacctggacacccaggtgcagagatgtgaggacatcctgcagcagctgcaggccgtggtgccccagattgacatggagggggacaggaacatctggatcgtgaagccaggggccaagagccggggccggggcatcatgtgcatggaccacctggaggagatgctgaagctggtgaatggaaatcctgtggtgatgaaggatggcaagtgggtggtgcagaagtacatcgagcggcccctgctgatcttcggcaccaagtttgacctgcggcagtggttcctggtgacagactggaaccccctgactgtgtggttctacagagacagctacatccgcttcagcacccagcccttcagcctgaagaacctggacaacagcgtgcacctgtgcaacaacagcatccagaagcacctggagaacagctgccaccgccaccccctgctgcccccagacaacatgtggagcagccagcgcttccaggcccacctgcaggagatgggcgccccaaatgcctggagcaccatcatcgtgcccggcatgaaggatgctgtgatccacgccctgcagaccagccaggacacagtgcagtgcaggaaggccagctttgagctgtatggagctgactttgtgtttggagaggacttccagccctggctgattgagatcaatgccagccccaccatggcccccagcacagctgtgacagcccggctgtgtgccggcgtgcaggccgacaccctgcgggtggtgattgacaggatgctggacaggaactgtgacacaggagcctttgagctgatctacaagcagcctgtgaccaccagccctgccagcaccccccggcccagctgcctgctgcccatgtacagcgacacccgggcccggagcagtgatgacagcacagcctcctggtgggccctgcggccctgccggccccaggcccggccctag

SEQ ID NO: 20257 - DNA, 579 bp, Artificial Sequence
  Description of Artificial Sequence: Synthetic coding sequence
atgggcaagggctgcaaggtggtggtgtgtggcctgctgtctgtgggcaagacagccatcctggagcagctgctgtatggcaaccacaccatcggcatggaggactgtgagaccatggaggatgtgtacatggcctctgtggagacagaccggggcgtgaaggagcagctgcacctgtatgacacccggggcctgcaggagggcgtggagctgcccaagcactacttctcctttgctgatggctttgtgctggtgtacagcgtgaacaacctggagagcttccagagggtggagctgctgaagaaggagattgacaagttcaaggacaagaaggaggtggccatcgtggtgctgggcaacaagattgacctgtctgagcagaggcaggtggatgctgaggtggcccagcagtgggccaagtctgagaaggtgcggctgtgggaggtgacagtgacagacaggaagaccctcatcgagcccttcaccctgctggccagcaagctgagccagccccagagcaagagcagcttccccctgcccggcaggaagaacaagggcaacagcaacagtgaaaattag

SEQ ID NO: 20258 - DNA, 1419 bp, Artificial Sequence
  Description of Artificial Sequence: Synthetic coding sequence
atgagcagaagagtggtgcggcagagcaagttcagacatgtgtttggccaggccgccaaggctgaccaggcctatgaggacatccgggtgtccaaggtgacctgggacagcagcttctgtgctgtgaaccccaagttcctggccatcatcgtggaggccggcggcggcggggccttcatcgtgctgcccctggccaagacaggccgggtggacaagaactaccccctggtgacaggccacacagcccctgtgctggacatcgactggtgcccccacaatgacaacgtgattgccagcgccagtgatgacaccaccatcatggtgtggcagatcccagactacacccccatgaggaacatcacagagcccatcatcaccctggagggccacagcaagagggtgggcatcctgtcctggcaccccacagccagaaatgtgctgctgtctgctggaggagacaacgtcatcatcatctggaatgtgggcactggagaggtgctgctgagcctggatgacatgcacccagatgtgatccacagcgtgtgctggaacagcaatggcagcctgctggccaccacctgcaaggacaagaccctgcgcatcatcgaccccaggaagggccaggtggtggccgagagatttgctgcccacgagggcatgaggcccatgagagctgtgttcacccggcagggccacatcttcaccaccggcttcaccaggatgagccagcgggagctgggcctgtgggaccccaacaactttgaggagcctgtggccctgcaggagatggacaccagcaatggagtgctgctgcccttctatgaccctgacagcagcatcgtgtacctgtgtgggaagggggacagcagcatccgctactttgagatcacagatgagcccccatttgtgcactacctgaacaccttcagcagcaaggagccccagaggggcatgggcttcatgcccaagaggggcctggatgtgtccaaatgtgaaattgcccgcttctacaagctgcacgagaggaaatgtgagcccatcatcatgacagtgcccaggaagagtgacctcttccaggatgacctgtacccagacaccccaggccctgagcccgccctggaggctgatgagtggctgagcggccaggatgctgagcctgtgctgatcagcctgagagatggctacgtgccccccaagcaccgggagctgcgggtgaccaagaggaacatcctggatgtgcggcccccatctggcccccggcgcagccagagcgccagtgatgcccccctgagccagcagcacaccctggagaccctgctggaggagatcaaggccctgcgggagcgggtgcaggcccaggagcagaggatcacagccctggagaacatgctgtgtgagctggtggatggaacagactag

SEQ ID NO: 20259 - DNA, 2628 bp, Artificial Sequence
  Description of Artificial Sequence: Synthetic coding sequence
atgggagacagtgatgatgaatatgacagaagaagaagagacaagttcagaagagagaggagtgactatgacaggagccgggagagagatgagaggagaagaggagatgactggaatgaccgggagtgggaccggggccgggagaggaggagcagaggagagtacagagattatgacaggaacagaagagagcgcttcagcccccccaggcatgagctgagccccccccagaagaggatgagaagagactgggatgagcacagcagtgacccctaccacagcggctatgagatgccctatgccggcggcggcggcggccccacctacggccccccccagccctggggccacccagatgtgcacatcatgcagcaccacgtgctgcccatccaggcccggctgggcagcattgctgagattgacctgggcgtgcccccacctgtgatgaagaccttcaaggagttcctgctgagcctggatgacagcgtggatgaaacagaggccgtgaagcgctacaatgactacaagctggacttccggcggcagcagatgcaggacttcttcctggcccacaaggatgaggagtggttccgcagcaagtaccacccagatgaggtgggcaagaggcggcaggaggcccggggggccctgcagaaccggctgcgggtcttcctgagcctgatggagaccggctggtttgacaacctgctgctggacatcgacaaggcagatgccatcgtgaagatgctggatgctgctgtgatcaagatggagggcggcacagaaaatgacctgcgcatcctggagcaggaggaggaggaggagcaggccggcaagccaggagagcccagcaagaaggaggagggccgggccggggccggcctgggagatggagagaggaagaccaatgacaaggatgagaagaaggaggatggcaagcaggccgagaatgacagcagcaatgatgacaagaccaagaagtcagaaggagatggagacaaggaggagaagaaggaggacagcgagaaggaggccaagaagagcagcaagaagaggaacaggaagcacagcggagatgacagctttgatgagggctctgtgtctgagagcgagagcgagagcgagagcggccaggccgaggaggagaaggaggaggccgaggccctgaaggagaaggagaagcccaaggaggaggagtgggagaagcccaaggatgctgctggcctggagtgcaagccccggcccctgcacaagacctgcagcctcttcatgagaaatattgcccccaacatcagcagagctgagatcatcagcctgtgcaagcgctacccaggcttcatgagggtggccctgtctgagccccagcctgagcggcgcttcttccggcggggctgggtgacctttgacagatctgtgaacatcaaggagatctgctggaacctgcagaacatccggctgcgggagtgtgagctgagccctggggtgaacagagacctgaccaggagagtgaggaacatcaatggcatcacccagcacaagcagatcgtgagaaatgacatcaagctggccgccaagctgatccacaccctggatgacaggacccagctgtgggccagcgagcccggcaccccacccctgcccaccagcctgcccagccagaaccccatcctgaagaacatcacagactacctgattgaggaggtgtctgctgaggaggaggagctgctgggcagcagtggaggagcccctcctgaggagccccccaaggagggcaacccagctgagatcaacgtggagagagatgagaagctgatcaaggtgctggacaagctgctgctgtacctgagaattgtgcacagcctggactactacaacacctgtgagtacccaaatgaagatgagatgcccaacagatgtggcatcatccacgtgcggggccccatgccacccaaccgcatcagccatggagaggtgctggagtggcagaagacctttgaggagaagctgacccccctgctgtctgtgcgggagagcctgtctgaggaggaggcccagaagatgggcaggaaggaccctgagcaggaggtggagaagtttgtgaccagcaacacccaggagctgggcaaggacaagtggctgtgccccctgagcggcaagaagttcaagggccctgagtttgtgaggaagcacatcttcaacaagcacgccgagaagattgaggaggtgaagaaggaggtggccttcttcaacaacttcctgacagatgccaagaggcctgccctgcctgagatcaagccagcccagcccccaggccctgcccagatcctgcccccaggcctgaccccaggcctgccctacccccaccagaccccccagggcctgatgccctacggccagccccggccccccatcctgggctatggagctggagctgtgcggcctgctgtgcccaccggcggccccccctacccccacgccccctacggggccggccggggcaactatgatgccttccggggccagggcggctacccaggcaagcccaggaacaggatggtgcggggggacccccgggccatcgtggagtacagagacctggatgccccagatgatgtggacttcttctag

SEQ ID NO: 20260 - DNA, 816 bp, Artificial Sequence
  Description of Artificial Sequence: Synthetic coding sequence
atggctgctgtggagaagaggcggcaggccgtgcccccacctgctggcttcacagacagcggccggcagagcgtgtccagagctgctggagctgctgagagcgaggaggacttcctgcggcaggtgggcgtgacagagatgctgcgggccgccctgctgaaggtgctggaggcccggcctgaggagcccatcgccttcctggcccactactttgagaacatgggcctgcggagccctgtgaatggaggagctggggagcccccaggccagctgctgctgcagcagcagaggctgggccgggccctgtggcacctgcggctggcccaccacagccagagagctgccttcaacaacaacgtgtctgtggcctatgaatgtctgtctgctgggggccgcaggaagaggcctggcctggatggccgcacctacagcgagctgctgcggcgcatctgcagagatggccaggcccctgaggaggtggtggcccccctgctgaggaaggtgcagtgccgggaccatgaagctgtgcccctgtctgtgttccgggccggcaccctgacctgctttgtgctgctggagtttgtggcccgggccggggccctcttccagctgctggaggacagcgctgctgctgtggccgacagaagagtgggccaggccgtgctggacaccctggagggcgccctgcaggccagtgatgctgctgccccagcccgcttcctggaggccggcagccggctggcccccatgacccgggaggagttcctggagagagctgctgccctcttcatcgccaaggtgaagcctgtgggctag

SEQ ID NO: 20261 - DNA, 1977 bp, Artificial Sequence
  Description of Artificial Sequence: Synthetic coding sequence
atgggcggccacctgagcccctggcccacctacaccagcggccagaccatcctgcagaacaggaagccctgcagtgatgactacaggaagagggtgggcagctgccagcagcaccccttcagaacagccaagccccagtacctggaggagctggagaactacctgaggaaggagctgctgctgctggacctgggcacagacagcacccaggagctgcggctgcagccctaccgggagatctttgagttcttcatcgaggacttcaagacctacaagcccctgctgagcagcatcaagaatgcctatgagggcatgctggcccaccagcgggagaagatccgggccctggagcccctgaaggccaagctggtgacagtgaatgaagactgcaatgaaagaatcctggccatgagagctgaggagaagtatgagatcagcctgctgaagaaggagaagatgaacctgctgaagctgattgacaagaagaatgaggagaagatcagcctgcagagcgaggtgaccaagctgaggaagaacctggccgaggagtacctgcactacctgtctgaaagagatgcctgcaagatcctgattgctgacctgaatgagctgcgctaccagcgggaggacatgagcctggcccagagccctggcatctggggcgaggaccctgtgaagctgaccctggccctgaagatgacccggcaggacctgaccaggacccagatggagctgaacaacatgaaggccaactttggagatgtggtgccccggcgggactttgagatgcaggagaagaccaacaaggacctgcaggagcagctggacaccctgcgggccagctatgaggaggtgaggaaggagcacgagatcctgatgcagctgcacatgagcaccctgaaggagcgggaccagttcttcagcgagctgcaggagatccagaggaccagcacccccaggccagactggaccaagtgcaaggatgtggtggccggcggccctgagcgctggcagatgctggccgagggcaagaacagcgaccagctggtggatgtgctgctggaggagatcggcagcggcctgctgcgggagaaggacttcttccctggcctgggctatggagaggccatcccagccttcctgcgctttgatggcctggtggagaacaagaagcccagcaagaaggatgtggtgaacctgctgaaggatgcctggaaggagcggctggccgaggagcagaaggagaccttcccagacttcttcttcaacttcctggagcacagatttggccccagtgatgccatggcctgggcctacaccatctttgagaacatcaagatcttccacagcaatgaggtgatgagccagttctatgctgtgctgatgggcaagagaagtgaaaatgtgtatgtgacccagaaggagaccgtggcccagctgctgaaggagatgaccaatgctgacagccagaatgaaggcctgctgaccatggagcagttcaacacagtgctgaagagcaccttccccctgaagacagaggagcagatccaggagctgatggaggccggcggctggcaccccagcagcagcaatgctgacctgctgaactaccgcagcctcttcatggaggatgaggagggccagagcgagccctttgtgcagaagctgtgggagcagtacatggatgagaaggatgagtacctgcagcagctgaagcaggagctgggcatcgagctgcacgaggaggtgaccctgcccaagctgcggggcggcctgatgaccatcgaccccagcctggacaagcagacagtgaacacctacatgagccaggccttccagctgcctgagagcgagatgcctgaggagggagatgagaaggaggaggccgtggtggagatcctgcagacagccctggagcggctgcaggtgattgacatcagaagagtgggcccccgggagcctgagcccgccagctag

SEQ ID NO: 20262 - DNA, 1287 bp, Artificial Sequence
  Description of Artificial Sequence: Synthetic coding sequence
atggagcccctgaaggtggagaagtttgccacagccaagagaggaaatggcctgcgggctgtgacccccctgcggcctggagagctgctcttcagaagtgaccccctggcctacacagtgtgcaagggcagccggggcgtggtgtgtgaccgctgcctgctgggcaaggagaagctgatgcgctgcagccagtgccgggtggccaagtactgcagcgccaagtgccagaagaaggcctggccagaccacaagcgggagtgcaagtgcctgaagagctgcaagccccgctaccccccagattctgtgcggctgctgggccgggtggtgttcaagctgatggatggagcccccagcgagagcgagaagctgtacagcttctatgacctggagagcaacatcaacaagctgacagaggacaagaaggagggcctgcggcagctggtgatgaccttccagcacttcatgagggaggagatccaggatgccagccagctgcccccagcctttgacctgtttgaggcctttgccaaggtgatctgcaacagcttcaccatctgcaatgctgagatgcaggaggtgggcgtgggcctgtaccccagcatcagcctgctgaaccacagctgtgaccccaactgcagcatcgtgttcaacggcccccacctgctgctgcgggctgtgcgggacatcgaggtgggggaggagctgaccatctgctacctggacatgctgatgaccagcgaggagaggaggaagcagctgcgggaccagtactgctttgaatgtgactgcttccgctgccagacccaggacaaggatgctgacatgctgactggagatgagcaggtgtggaaggaggtgcaggagagcctgaagaagattgaggagctgaaggcccactggaagtgggagcaggtgctggccatgtgccaggccatcatcagcagcaacagcgagcggctgcctgacatcaacatctaccagctgaaggtgctggactgtgccatggatgcctgcatcaacctgggcctgctggaggaggccctcttctacggcaccaggaccatggagccctaccgcatcttcttccctggcagccaccctgtgcggggcgtgcaggtgatgaaggtgggcaagctgcagctgcaccagggcatgttcccccaggccatgaagaacctgcggctggcctttgacatcatgagggtgacccacggccgggagcacagcctgattgaggacctgatcctgctgctggaggagtgtgatgccaacatccgggccagctag

SEQ ID NO: 20263 - DNA, 1122 bp, Artificial Sequence
  Description of Artificial Sequence: Synthetic coding sequence
atgagcagcggcaactaccagcagagcgaggccctgagcaagcccaccttcagcgaggagcaggccagcgccctggtggagagcgtgtttggcctgaaggtgtccaaggtgcggcccctgcccagctatgatgaccagaacttccacgtgtatgtgtccaagaccaaggatggccccacagaatatgtgctgaagatcagcaacaccaaggccagcaagaacccagacctgattgaggtgcagaaccacatcatcatgttcctgaaggctgctggcttccccacagcctctgtgtgccacaccaagggggacaacacagccagcctggtgtctgtggacagcggcagcgagatcaagagctacctggtgcggctgctgacctacctgcccggccggcccatcgccgagctgcctgtgagcccccagctgctgtatgaaattggcaagctggccgccaagctggacaagaccctgcagcgcttccaccaccccaagctgagcagcctgcaccgggagaacttcatctggaacctgaagaatgtgcccctgctggagaagtacctgtatgccctgggccagaacagaaaccgggagatcgtggagcacgtgatccacctgttcaaggaggaggtgatgaccaagctgagccacttccgggagtgcatcaaccacggggacctgaatgaccacaacatcctgattgagagcagcaagagcgccagcggaaatgctgagtaccaggtgtctggcatcctggactttggagacatgtcctatggctactacgtgtttgaggtggccatcaccatcatgtacatgatgattgagagcaagagccccatccaggtgggcggccacgtgctggccggctttgagagcatcacccccctgacagctgtggagaagggggccctcttcctgctggtgtgcagccgcttctgccagagcctggtgatggccgcctacagctgccagctgtacccagagaacaaggactacctgatggtgacagccaagacaggctggaagcacctgcagcagatgtttgacatgggccagaaggctgtggaggagatctggtttgaaacagccaagagctatgaaagtggcatctccatgtag

SEQ ID NO: 20264 - DNA, 2766 bp, Artificial Sequence
  Description of Artificial Sequence: Synthetic coding sequence
atggccctgctgtgtggcctgggccaggtgaccctgcgcatctgggtgtccctgcccagccagagtgaaaatggcatcggcagcggcggcatggaggccctgaccacccagctgggccctggccgggagggcagcagcagccccaacagcaagcaggagctgcagccctacagcggcagcagcgccctgaagcccaaccaggtgggggagaccagcctgtatggagtgcccatcgtgtccctggtgattgatggccaggagcggctgtgcctggcccagatcagcaacaccctgctgaagaactacagctacaatgagatccacaacagaagagtggccctgggcatcacctgtgtgcagtgcacccctgtgcagctggagatcctgcggcgggccggggccatgcccatcagcagccgccgctgtggcatgatcaccaagcgggaggccgagcggctgtgcaagagcttcctgggggagcacaagccacccaagctgcctgagaactttgcctttgatgtggtgcatgaatgtgcctggggcagccggggcagcttcatcccagcccgctacaacagcagccgggccaagtgcatcaagtgtggctactgcagcatgtacttcagccccaacaagttcatcttccacagccacaggaccccagatgccaagtacacccagccagatgctgccaacttcaacagctggaggaggcacctgaagctgagtgacaagagcgccacagatgagctgagccacgcctgggaggatgtgaaggccatgtttaatggaggcacccgctgtggggctgagatggcccctggccccccaccccacaagagcctgcgctgtggggaggatgaagctgctggccccccaggccccccaccaccccacccccagaggggcctgggcctggccaccggggccagcggccctgctggccctgggggccctgggggcggggccggcgtgcgcagctaccctgtgattcctgtgcccagcaagggcttcggcctgctgcagaagctgcccccacccctcttcccccacccctacggcttccccacagccttcggcctgtgccccaagaaggatgatcctgtgctgggcgctggggagcccaagggcggccctggcactggaagtggcggcggcggggccggcaccggcggcggggccggcggccctggggccagccacctgcccccaggggccggggccggccctgggggcggggccatgttctggggccaccagcccagcggggccgccaaggatgctgctgctgtggccgctgctgctgctgctgccaccgtgtaccccaccttccccatgttctggccagctgctggcagcctgcctgtgcccagctacccagctgcccagagccaggccaaggctgtggccgctgctgtggccgctgctgctgctgctgctgctgctgctgctggcagcggggcccctgagcccctggatggagctgagcccgccaaggagagcggcctgggcgctgaggagcgctgccccagcgccctgagccggggccccctggatgaagatggaacagatgaggccctgcccccacccctggcccccctgcccccacctcctcctcctccagccaggaagggcagctatgtgtctgccttccggcctgtggtgaaggacacagagagcatcgccaagctgtatggcagcgcccgggaggcctacggggccggccctgcccggggccctggccctggggccggcagcggcggctacgtgtccccagacttcctgtctgagggcagcagcagctacaacagcgccagcccagatgtggacacagcagatgagcctgaggtggatgtggagagcaaccgcttcccagatgatgaagatgcccaggaggagacagagcccagcgcccccagcgctgggggcggcccagatggagagcagcccactggacctccttctgccaccagcagtggagcagatggccctgccaacagcccagatggcggcagcccccggccccggcggcggctgggccccccacctgctggccgcccagcctttggagacctggccgctgaggacctggtgagaagacctgagaggagccccccatctgggggcggcggctatgagctgcgggagccctgtggccccctgggcggccctgccccagccaaggtgtttgcccctgagagagatgaacatgtgaagtctgctgctgtggccctgggccctgctgccagctatgtgtgcaccccagaggcccacgagccagacaaggaggacaaccacagccctgcagatgacctggagaccaggaagagctacccagaccagaggagcatcagccagcccagccctgccaacacagacagaggagaagatggcctgaccctggatgtgacaggcacccacctggtggagaaggacatcgagaacctggcccgggaggagctgcagaagctgctgctggagcagatggagctgaggaagaagctggagcgggagttccagagcctgaaggacaacttccaggaccagatgaagcgggagctggcctaccgggaggagatggtgcagcagctgcagatcgtgcgggacaccctgtgcaatgagctggaccaggagaggaaggcccgctatgccatccagcagaagctgaaggaggcccatgatgccctgcaccacttcagctgcaagatgctgacccccaggcactgcaccggcaactgcagcttcaagccacccctgctgccctag

SEQ ID NO: 20265 - DNA, 1395 bp, Artificial Sequence
  Description of Artificial Sequence: Synthetic coding sequence
atggccatgacagctggcaccaccaccaccttccccatgagcaaccacacccgggagcgggtgacagtggccaagctgaccctggagaacttctacagcaacctgatcctgcagcacgaggagcgggagacccggcagaagaagctggaggtggccatggaggaggagggcctggctgatgaggagaagaagctgcggcgcagccagcacgccaggaaggagacagagttcctgcggctgaagaggacccggctgggcctggatgactttgagagcctgaaggtgattggccgcggggcctttggagaggtgcggctggtgcagaagaaggacaccggccacatctatgccatgaagatcctgaggaagagtgacatgctggagaaggagcaggtggcccacatccgggcagagcgggacatcctggtggaggctgatggagcctgggtggtgaagatgttctacagcttccaggacaagaggaacctgtacctgatcatggagttcctgcctggaggagacatgatgaccctgctgatgaagaaggacaccctgacagaggaggagacccagttctacatcagcgagaccgtgctggccattgatgccatccaccagctgggcttcatccaccgggacatcaagccagacaacctgctgctggatgccaagggccacgtgaagctgagtgactttggcctgtgcaccggcctgaagaaggcccacaggacagagttctacagaaacctgacccacaacccccccagcgacttctccttccagaacatgaacagcaagaggaaggccgagacctggaagaagaacagacggcagctggcctacagcacagtgggcaccccagactacatcgcccctgaggtgttcatgcagacaggctacaacaagctgtgtgactggtggagcctgggcgtcatcatgtatgagatgctgattggctacccacccttctgcagcgagaccccccaggagacctacaggaaggtgatgaactggaaggagaccctggtgtttcctcctgaggtgcccatcagcgagaaggccaaggacctgatcctgcgcttctgcattgattctgagaacagaattggcaacagcggcgtggaggagatcaagggccaccccttctttgaaggagtggactgggagcacatccgggagaggcctgctgccatccccatcgagatcaagagcattgatgacaccagcaactttgatgacttccctgagagtgacatcctgcagcctgtgcccaacaccacagagccagactacaagagcaaggactgggtgttcctgaactacacctacaagagatttgagggcctgacccagaggggcagcatccccacctacatgaaggccggcaagctgtag

SEQ ID NO: 20266 - DNA, 3951 bp, Artificial Sequence
  Description of Artificial Sequence: Synthetic coding sequence
atggccagcaagggggccggcatgtccttcagcaggaagagctaccgcctgaccagtgatgctgagaagagccgggtgactggaattgtgcaggagaagctgctgaatgactacctgaaccgcatcttcagcagcagcgagcacgcccccccagctgccaccagcaggaagcccctgaacttccagaacctgcctgagcacctggaccagctgctgcaggtggacaatgaggaggaggagagccagggccaggtggagggccgcctgggccccagcacagtggtgctggaccacactggaggctttgagggcctgctgctggtggatgatgacctgctgggcgtcatcggccacagcaactttggcaccatccgcagcaccacctgtgtgtacaagggcaagtggctgtatgaggtgctgatcagcagccagggcctgatgcagatcggctggtgcaccatcagctgccgcttcaaccaggaggagggcgtgggggacacccacaacagctatgcctatgatggcaacagagtgaggaagtggaatgtgaccaccaccaactacggcaaggcctgggccgccggggacatcgtgtcctgcctgattgacctggatgatggcaccctgtccttctgcctgaatggagtgtccctgggcacagcctttgagaacctgagccggggcctgggcatggcctacttccctgccatcagcctgtccttcaaggagagcgtggccttcaactttggcagccggcccctgcgctaccctgtggccggctaccggcccctgcaggaccccccatctgctgacctggtgcgggcccagaggctgctgggctgcttccgggctgtgctgtctgtggagctggaccctgtggagggccgcctgctggacaaggagagcagcaagtggaggctgcggggccagcccaccgtgctgctgaccctggcccacatcttccaccactttgcccccctgctgaggaaggtgtacctggtggaggccgtgctgatgtccttcctgctgggcatcgtggagaagggcacccccacccaggcccagagcgtggtgcaccaggtgctggacctgctgtggctgttcatggaggactatgaggtgcaggactgcctgaagcagctgatgatgagcctgctgcggctgtaccgcttcagccccatcgtgcctgacctgggcctgcagatccactacctgcggctgaccatcgccatcctgcggcatgagaagagcaggaagttcctgctgagcaatgtgctgtttgatgtgctgcggtctgtggtgttcttctacatcaagagccccctgcgggtggaggaggccggcctgcaggagctgatccccaccacctggtggccccactgcagcagccgggagggcaaggagagcacagagatgaaggaggagacagctgaggagcggctgcggcggcgggcctatgaaagaggctgccagaggctgaggaagagaattgaggtggtggaggagctgcaggtgcagatcctgaagctgctgctggacaacaaggatgacaatggaggagaggccagccgctacatcttcctgaccaagttcaggaagttcctgcaggagaatgccagcggccggggcaacatgcccatgctgtgccccccagagtacatggtgtgcttcctgcacaggctcatcagcgccctgcgctactactgggatgagtacaaggccagcaacccccacgccagcttcagcgaggaggcctacatccccccccaggtgttctacaacgggaaggtggactactttgacctgcagaggctgggcggcctgctgagccacctgaggaagaccctgaaggatgacctggccagcaaggccaacatcgtcatcgaccccctggagctgcagagcacagccatggatgacctggatgaagatgaggagcccgccccagccatggcccagaggcccatgcaggccctggccgtgggcggccccctgcccctgccccggcccggctggctgagcagccccaccctgggccgggccaaccgcttcctgagcacagctgctgtgtccctgatgaccccccggcggcccctgagcaccagcgagaaggtgaaggtgaggaccctgtctgtggagcagaggacccgggaggacatcgagggcagccactggaatgaaggcctgctgctgggccggcccccagaggagcctgagcagcccctgacagagaacagcctgctggaggtgctggatggagctgtgatgatgtacaacctgtctgtgcaccagcagctgggcaagatggtgggcgtgtctgatgatgtgaatgaatatgccatggccctgcgggacacagaggacaagctgcggcgctgccccaagaggaggaaggacatcctggccgagctgaccaagagccagaaggtgttcagcgagaagctggaccacctgagccggcggctggcctgggtgcacgccaccgtgtacagccaggagaagatgctggacatctactggctgctgcgggtgtgcctgcggaccattgaacatggagacagaacaggcagcctgtttgccttcatgcctgagttctacctgtctgtggccatcaacagctacagcgccctgaagaactactttggacctgtgcacagcatggaggagctgcccggctatgaggagaccctgacccggctggccgccatcctggccaagcactttgctgatgccagaattgtgggcacagacatccgggacagcctgatgcaggccctggccagctatgtgtgctacccccacagcctgcgggctgtggagcgcatccctgaggagcagagaattgccatggtgaggaacctgctggccccctatgagcagaggccctgggcccagaccaactggatcctggtgcggctgtggaggggctgcggcttcggctaccgctacacccggctgccccacctgctgaagaccaagctggaggatgccaacctgcccagcctgcagaagccctgccccagcaccctgctgcagcagcacatggctgacctgctgcagcagggcccagatgtggcccccagcttcctgaacagcgtgctgaaccagctgaactgggccttcagcgagttcatcggcatgatccaggagatccagcaggccgctgagcggctggagaggaactttgtggacagccggcagctgaaggtgtgtgccacctgctttgacctgtctgtgtccctgctgcgggtgctggagatgaccatcaccctggtgcctgagatcttcctggactggacccggcccaccagcgagatgctgctgcggcggctggcccagctgctgaaccaggtgctgaacagagtgacagctgagaggaacctgtttgacagagtggtgaccctgcggctgcccggcctggagagcgtggaccactaccccatcctggtggccgtgacaggcatcctggtgcagctgctggtgcggggccctgccagcgagcgggagcaggccacctctgtgctgctggccgacccctgcttccagctgcggagcatctgctacctgctgggccagcctgagcccccagcccctggaacagccctgcctgccccagacaggaagcgcttcagcctgcagagctatgctgactacatctctgcagatgagctggcccaggtggagcagatgctggcccacctgaccagcgccagcgcccaggccgctgctgccagcctgcccaccagcgaggaggacctgtgccccatctgctacgcccaccccatctctgctgtgttccagccctgtggccacaagagctgcaaggcctgcatcaaccagcacctgatgaacaacaaggactgcttcttctgcaagaccaccaccagcaacctgctggcctgcctgtacccccactggtgggagcccagccacggccccaactgtgcctag

SEQ ID NO: 20267 - DNA, 2043 bp, Artificial Sequence
  Description of Artificial Sequence: Synthetic coding sequence
atgcccagcgtgtccaaggctgctgctgctgccctgagcggcagccccccccagacagagaagcccacccactaccgctacctgaaggagttcagaacagagcagtgccccctcttcagccagcacaagtgtgcccagcaccggcccttcacctgcttccactggcacttcctgaaccagaggagaagaagacccctgcggaggagagatggcaccttcaactacagcccagatgtgtactgcagcaagtacaatgaggccaccggggtgtgcccagatggagatgagtgcccctacctgcacaggaccaccggggacacagagaggaagtaccacctgcgctactacaagacaggcacctgcatccatgaaacagatgcccggggccactgtgtgaagaatggcctgcactgtgcctttgcccacggccccctggacctgcggccccctgtgtgtgatgtgcgggagctgcaggcccaggaggccctgcagaatggccagctgggcggcggggagggcgtgcctgacctgcagcccggggtgctggccagccaggccatgattgagaagatcctgtctgaggacccccgctggcaggatgccaactttgtgctgggcagctacaagacagagcagtgccccaagccaccccggctgtgccggcagggctacgcctgcccccactaccacaacagccgggacagaagaagaaacccccggcgcttccagtaccgcagcaccccctgccccagcgtgaagcatggagatgagtggggcgagcccagccgctgtgatggaggagatggctgccagtactgccacagcaggacagagcagcagttccaccctgagagcaccaagtgcaatgacatgaggcagacaggctactgcccccggggccccttctgtgcctttgcccacgtggagaagagcctgggcatggtgaatgagtggggctgccacgacctgcacctgaccagccccagcagcactggaagtggccagcctggaaatgccaagagaagagacagccctgctgagggcggcccccggggcagcgagcaggacagcaagcagaaccacctggccgtgtttgctgctgtgcaccccccagcccccagcgtgagcagctctgtggccagcagcctggccagcagcgctggcagcggcagcagcagccccacagccctgcctgcccccccagcccgggccctgcccctgggccctgccagcagcacagtggaggccgtgctgggcagcgccctggacctgcacctgagcaatgtgaacatcgccagcctggagaaggacctggaggagcaggacggccatgacctgggcgctgctggccccaggagcctggccggcagcgcccctgtggccatccctggcagcctgccccgggcccccagcctgcacagccccagcagcgccagcaccagccccctgggcagcctgagccagcccctgcccggccctgtgggcagcagcgccatgaccccaccccagcagcccccacccctgcggtctgagcccggcaccctgggcagcgctgccagcagctacagccccctgggcctgaatggagtgcccggcagcatctgggactttgtgtctggcagcttcagccccagccccagccccatcctgtctgctggcccccccagcagcagcagcgccagccccaatggagctgagctggcccgggtgcggcggcagctggatgaggccaagaggaagatccggcagtgggaggagagctggcagcaggtgaagcaggtgtgtgatgcctggcagcgggaggcccaggaggccaaggagcgggcccgggtggccgacagcgaccggcagctggccctgcagaagaaggaggaggtggaggcccaggtgatcttccagctgcgggccaagcagtgtgtggcctgccgggagcgggcccatggagctgtgctgcggccctgccagcaccacatcctgtgtgagccctgtgccgccacagccccagaatgtccctactgcaagggccagcccctgcagtggtag

SEQ ID NO: 20268 - DNA, 462 bp, Artificial Sequence
  Description of Artificial Sequence: Synthetic coding sequence
atgagcagccccctggccagcctgagcaagaccaggaaggtgcccctgcccagcgagcccatgaaccctggaagaagaggcatccgcatctatggagatgtgcctgccagccatgacagcgagctgatggccttcatgaccaggaagctgtgggacctggagcagcaggtgaaggcccagacagatgagatcctgagcaaggaccagaagattgctgccctggaggacctggtgcagaccctgcggccccaccctgctgaggccaccctgcagaggcaggaggagctggagaccatgtgtgtgcagctgcagaggcaggtgcgggagatggagcgcttcctgagtgactatggcctgcagtgggtgggggagcccatggaccaggaggacagcgagagcaagacagtgtctgaacatggagagcgggactggatgacagccaagaagttctggaagccctag

SEQ ID NO: 20269 - DNA, 2382 bp, Artificial Sequence
  Description of Artificial Sequence: Synthetic coding sequence
atgggccagtgctacaacctggaggatgatgacctggagacagatgtgaacaagctgagcagcaagccaggcctggacaggcctgaggaggagctgatgcagtatgaggtgatgtgcctggagctgagctacagctttgaggagctgcagagcaagctgggagatgacctgaacagcgagaagacccagtatgccaaccaccaccacatcccagctgctgccagcagcaagcagcactgctacagcaaggaccagagcagctgtggccaggagcgggagtatgctgtgcagaccagcctgctgtgccgggtgaagacaggccgcagcacagtgcacctgggcagcaagaagaaccctggggtgaacctgtaccagaatgtgcagagcaacagcctgcggcgggacagcagcgagagcgagatcccagacatccaggccagccccaaggcagatgcctgggatgtggatgccatcttctgccccaggatgtctgccagcttcagcaacagcaccaggacccgggaggtggtgaaggtgattgacaagctgctgcagacccacctgaagagggtgcccttccatgacccctacctgtacatggccaaggcccggaggaccagctctgtggtggacttcaagatgatggccttcccagatgtgtggggccactgccccccacccaccacccagcccatgctggagaggaaatgtggggtgcagaggatccgcatctttgaggacatcagaagactcatccagcccagtgatgtgatcaacaaggtggtgttcagcctggatgagccctggcccctgcaggacaatgccagcaactgcctgcgcttcttcagcaagtttgaaagtggcaacctgaggaaggccatccaggtgcgggagtttgaatatgacctgctggtgaatgctgatgtgaacagcacccagcaccagcagtggttctacttcaaggtgtctggcatgcaggccgccatcccctaccacttcaacatcatcaactgtgagaagcccaacagccagttcaactacggcatgcagcccaccctgtacagcgtgaaggaggccctgctgggcaagcccacctggatcagaactggacatgagatctgctactacaagaaccactaccggcagagcacagctgtggccggcggggccagcggcaagtgctactacaccctgacctttgctgtgaccttcccccacagtgaagatgtgtgctacctggcctaccactacccctacacctacacagccctgatgacccacctggacatcctggagaagtctgtgaacctgaaggaggtgtacttccggcaggatgtgctgtgccagaccctgggcggcaacccctgccccctggtgaccatcacagccatgcctgagagcaacagtgatgagcacctggagcagttccgccaccggccctaccaggtgatcacagcccgggtgcaccctggagagagcaatgcctcctgggtgatgaagggcaccctggagttcctggtgtccagtgaccctgtggcccggctgctgcgggagaacttcatcttcaagatcatccccatgctgaacccagatggagtcatcaatggaaaccaccgctgcagcctgtctggagaggacctgaaccggcagtggctgagccccagcgcccacctgcagcccaccatctaccacgccaagggcctgctgtaccacctgagcagcatcggccgcagccctgtggtgttctgtgacttccacggccacagccagaagaagaatgtgttcctgtatggctgcagcatcaaggagaccctgtggcaggccgcctgcaccgtgggcaccagcaccatcctggaggaggtgaactaccgcaccctgcccaagatcctggacaagctggccccagccttcaccatgagcagctgcagcttcctggtggagaagagccgggccagcacagcccgggtggtggtgtggagggagatgggcgtgagccgcagctacaccatggagagcagctactgcggctgcaaccagggcccctaccagtgcacccagaggctgctggagaggaccaagaatgaaagagcccaccctgtggatggcctgcagggcctgcagtttggcacccgggagctggaggagatgggcgccatgttctgcctgggcctgctgatcctggagctgaagagcgccagctgcagccaccagctgctggcccaggccgccaccctgctgtctgctgaggaggatgccctggaccagcacctgcagaggctgaagagcagcaacttcctgcccaagcacatctggtttgcctaccacttctttgccatcaccaacttcttcaagatgaacctgctgctgcacgtgagcccctag

SEQ ID NO: 20270 - DNA, 153 bp, Artificial Sequence
  Description of Artificial Sequence: Synthetic coding sequence
atgatgcagaatgtgcacctggcccctgagacagatgaagatgacctgtacagcggctacaatgactacaaccccatctatgacatcgaggagctggagaatgatgctgccttccagcaggccgtgaggaccagccacggccggcggccctag

SEQ ID NO: 20271 - DNA, 1299 bp, Artificial Sequence
  Description of Artificial Sequence: Synthetic coding sequence
atgacagctgtgcgggctgctggcttcaccaaggccgccctgcggggcagcgcctttgaccccctgagccagagccggggccctgccagccccctggaggccaagaagaaggacagccctgaggagaagatcaagcagctggagaaggaggtgaatgagctggtggaggagagctgcatcgccaacagctgtggggacctgaagctggccctggagaaggccaaggatgctggcaggaaggagcgggtgctggtgcggcagcgggagcaggtgaccaccccagagaacatcaacctggacctgacctacagcgtgctcttcaacctggccagccagtacagcgtgaatgagatgtatgcagaggccctgaacacctaccaggtgattgtgaagaacaagatgttcagcaatgccggcatcctgaagatgaacatgggcaacatctacctgaagcagaggaactacagcaaggccatcaagttctacaggatggccctggaccaggtgcccagcgtgaacaagcagatgaggatcaagatcatgcagaacatcggcgtgaccttcatccaggccgaccgggagaagatgaagaaggccttccagaagctgatcaccgtgcccctggagattgatgaggacaagtacatcagccccagtgatgacccccacaccaacctggtgacagaggccatcaagaatgaccacctgcggcagatggagcgggagaggaaggccatggccgagaagtacatcatgaccagcgccaagctgattgcccctgtgattgagaccagctttgctgctggctatgactggtgtgtggaggtggtgaaggccagccagtatgtggagctggccaatgacctggagatcaacaaggctgtgacctacctgcggcagaaggactacaaccaggccgtggagatcctgaaggtgctggagaagaaggacagccgggtgaagtctgctgctgccaccaacctgagcgccctgtactacatgggcaaggactttgcccaggccagcagctatgctgacattgctgtgaacagcgaccgctacaacccagctgccctgaccaacaagggcaacacagtgtttgccaatggagactatgagaaggctgctgagttctacaaggaggccctgagaaatgacagcagctgcacagaggccctgtacaacatcggcctgacctatgagaagctgaaccggctggatgaggccctggactgcttcctgaagctgcacgccatcctgagaaattctgctgaggtgctgtaccagatcgccaactag

SEQ ID NO: 20272 - DNA, 387 bp, Artificial Sequence
  Description of Artificial Sequence: Synthetic coding sequence
atggctgctgctgctgctgagcagcagcagttctacctgctgctgggcaacctgctgagcccagacaacgtggtgaggaagcaggccgaggcccggcagatggctgctgtgctgctgcggcggctgctgagcagcgcctttgatgaggtgtacccagccctgcccagtgatgtgcagacagccatcaagtctgagctgctgatgatcatccagatggagacccagagctccatgaggaagaaggtgtgtgacattgctgctgagctggccaggaacctgattgatgaagatggcaacaaccagtggccagagggcctgaagttcctgtttgacagcgtgagcagccagaatgtgggcctgcgggaggccgccctgcacatcttctag

SEQ ID NO: 20273 - DNA, 2766 bp, Artificial Sequence
  Description of Artificial Sequence: Synthetic coding sequence
atgaggcctgagggcgccggcatggagctgggcggcggggaggagcggctgcctgaggagagccggcgggagcactggcagctgctgggcaacctgaagaccaccgtggagggcctggtgtccaccaacagccccaacgtgtggagcaaatatggaggcctggagcggctgtgccgggacatgcagagcatcctgtaccacggcctcatccgggaccaggcctgccggcggcagacagactactggcagtttgtgaaggacatccgctggctgagcccccacagcgccctgcacgtggagaagttcatctctgtgcatgaaaatgaccagagcagcgcagatggagccagcgagagagctgtggccgagctgtggctgcagcacagcctgcagtaccactgcctgagcgcccagctgcggcccctgctgggggaccggcagtacatcaggaagttctacacagatgctgccttcctgctgagtgatgcccacgtgacagccatgctgcagtgcctggaggccgtggagcagaacaacccccggctgctggcccagattgatgcctccatgtttgccaggaagcatgagagccccctgctggtgaccaagagccagagcctgacagccctgcccagcagcacctacaccccacccaacagctatgcccagcacagctacttcggcagcttcagcagcctgcaccagagcgtgcccaacaacggcagcgagcggcgcagcaccagcttccccctgagcggcccccccaggaagccccaggagagccggggccacgtgtccccagctgaggaccagaccatccaggcccctcctgtgtctgtgtctgccctggcccgggacagccccctgaccccaaatgagatgagcagcagcaccctgaccagccccatcgaggcctcctgggtgagcagccagaatgacagccctggagatgccagcgagggccctgagtacctggccatcggcaacctggacccccggggccgcacagccagctgccagagccacagcagcaatgctgagagcagcagcagcaacctcttcagcagcagcagcagccagaagccagacagcgctgccagcagcctgggggaccaggagggcggcggggagagccagctgagctctgtgctgcggcgcagcagcttcagcgagggccagaccctgactgtgaccagcggggccaagaagagccacatccgcagccacagcgacaccagcatcgccagcagaggagcccctgagagctgcaatgacaaggccaagctgcggggccccctgccctacagcggccagagcagcgaggtgtccacccccagcagcctgtacatggagtatgagggcggccgctacctgtgcagcggggagggcatgttccggcggcccagcgagggccagagcctcatctcctacctgtctgagcaggactttggcagctgtgccgacctggagaaggaaaatgcccacttcagcatcagcgagagcctgattgctgccatcgagctgatgaagtgcaacatgatgagccagtgcctggaggaggaggaggtggaggaggaggacagcgaccgggagatccaggagctgaagcagaagatccggctgcggcggcagcagatccgcaccaagaacctgctgcccatgtaccaggaggccgagcacggcagcttccgggtgaccagcagcagcagccagttcagcagccgggacagcgcccagctgagtgacagcggcagcgcagatgaggtggatgaatttgagatccaggacggcagcgagggcagcaacctgacccacatcagcaagaatggcctgtctgtgtccctggcctccatgttcagtgatgctgacatcagaagaaacacagccagcagcagcaagagctttgtgagcagccagagcttcagccactgcttcctgcacagcaccagcgctgaggccgtggccatgggcctgctgaagcagtttgagggcatgcagctgcctgctgccagcgagctggagtggctggtgcctgagcatgatgccccccagaagctgctgcccatcccagacagcctgcccatcagcccagatgatggccagcacgccgacatctacaagctgcgcatccgggtgcggggcaacctggagtgggccccaccccggccccagatcatcttcaacgtgcacccagcccccaccaggaagattgctgtggccaagcagaactaccgctgtgccggctgcggcatcagaacagatcctgactacatcaagaggctgcgctactgtgagtacctgggcaagtacttctgccagtgctgccatgaaaatgcccagatggccatccccagccgggtgctgaggaagtgggacttcagcaagtactacgtgagcaacttcagcaaggacctgctgatcaagatctggaatgaccccctcttcaacgtgcaggacatcaacagcgccctgtacaggaaggtgaagctgctgaaccaggtgcggctgctgcgggtgcagctgtgccacatgaagaacatgttcaagacctgccgcctggccaaggagctgctggacagctttgacacagtgcccggccacctgacagaggacctgcacctgtacagcctgaatgacctgacagccaccaggaaaggagagctgggcccccggctggccgagctgacccgggccggggccacccacgtggagcgctgcatggtgaggaagagccactgcagcatgcagctgagcccctgcttctag

SEQ ID NO: 20274 - DNA, 1644 bp, Artificial Sequence
  Description of Artificial Sequence: Synthetic coding sequence
atgagggccctgactgtgcagagggtgaagtttgccatggacctgcccctgctgaagagagctggccaggacctggccgagaagaccaagaactttgtgagccgcagcctggtgattggagaggtgctgtccatggctgacatggccaccggggtgaagtgtggcatcatctactggctgtttggaggagccatccggaacctgggcagccctgagcacgtgaccaagtggttccagcccctgcaggagcagaagtacacaggcatgtttgccatgacagagcggggccacggcagcaatgcccggggcatccagacagaggccacctttgacctgagcgcccaggagtttgtgattgacaccccctgtgaaaatgctgagaagatgtacatcggaaatgccatgtatggcaactatgctgctgtgtttgcccagctgatcattgatggccgcagccagggcccccactgcttcatcgtgcctgtgagagatgaaaatggcagcctgtacccaggagtgacagccatcgacatgatgtacaaggagggcctgcatggagtggacaatggcatcctgatctttgacaaggtgcgcatcccccgggagaacctgctggacaagtttggatctgtggccccagatggccagtaccacagccccatccggaacaagagcgcccgcttcaatgccatgctggccgccctgacccccagccggctggccgtggccttccaggccatgggcgccatgaagctgggcctgaccatcgccatccgctacagccacagccggcggcagtttggccccaagaccaaggaggaggtgaagatcatcgagcaccagacccagaccctgcggctgatgccccacctggccacagccctggccctgacctttgtgagccgctatgctggggccctgctggatgaagatgtgttccagggcaaggagctggtgaacagccgcagcctgcaggccctggtggccggcctgaaggcctacagcacctgggagaacatccgctgcctgcaggactgccgggagtgcaccggcggcatgggctacatgatggagaaccgcatcagcggcctgaagtgtgacacagatgtgtttgccacctttgaaggagatgatgtggtgatgctgcaggtggtgggccgggagctgctggcccagtacaccaagcagtatgaggagaagcccctgtttggcctgctgcagaactgggccgagagcgtgggggacaagctgcggaccagcttcctggccttcaacatggacacagtggatgacctggccttcctgctgaaggctgtgaagttccgggagcgggtgctgcagaggggcctggtggcccgcatctactacaaggtgaagaccaagaaggaggacttcttccacgcctggaacagctgcctgcaccacgtggccagcctgagcctggcccacacccaccgggtgaccctggagcagttcagcctggccgtgaagagctgcccagaccaggaggaccagaccctgctgatgaagttctgcctgctgtatggcaccaagctggtgttccaggagcgggcctggtacctggagcacaagtacctgacccccatggccagcacccgcatccggaaccaggagcgctgctag

SEQ ID NO: 20275 - DNA, 6087 bp, Artificial Sequence
  Description of Artificial Sequence: Synthetic coding sequence
atggatgtgacagtgtctgagctgctggagctgttcctgcagagccccctggtgacctgggtgaagaccttcggcccctttggaagtggcagccaggacaacctgaccatgtacatggacctggtggatggcatcttcctgaaccagatcatgctgcagattgacccccggcccaccaaccagaggatcaacaagcacgtgaacaatgatgtgaacctgcgcatccagaacctgaccatcctggtgaggaacatcaagacctactaccaggaggtgctgcagcagctgattgtgatgaacctgcccaacgtgctgatgattggccgggaccccctgagcggcaagtccatggaggagatcaagaaggtgctgctgctggtgctgggctgtgctgtgcagtgtgagaggaaggaggagttcatcgagcgcatcaagcagctggacatcgagacccaggccggcatcgtggcccacatccaggaggtgacccacaaccaggagaatgtgtttgacctgcagtggctggagctgcctgatgtggcccctgaggagctggaggccctgagccgctccatggtgctgcacctgcggcggctgattgaccagagagatgaatgtacagagctgattgtggacctgacccaggagcgggactacctgcaggcccagcacccccccagccccatcaagagcagcagcgctgacagcacccccagccccaccagcagcctgagcagcgaggacaagcagcacctggccgtggagctggccgacaccaaggcccggctgcggcgggtgcggcaggagctggaggacaagacagagcagctggtggacaccaggcatgaggtggaccagctggtgctggagctgcagaaggtgaagcaggagaacatccagctggccgcagatgcccggagcgcccgggcctacagagatgagctggacagcctgcgggagaaggccaacagagtggagcggctggagctggagctgacccgctgcaaggagaagctgcatgatgtggacttctacaaggccaggatggaggagctgcgggaggacaacatcatcctgattgagaccaaggccatgctggaggagcagctgacagctgcccgggcccggggggacaaggtgcatgagctggagaaggagaacctgcagctgaagagcaagctgcatgacctggagctggaccgggacacagacaagaagagaattgaggagctgctggaggagaacatggtgctggagatcgcccagaagcagagcatgaatgaaagtgcccacctgggctgggagctggagcagctgagcaagaatgctgacctgagtgatgccagcaggaagagctttgtgtttgagctgaatgaatgtgccagcagccgcatcctgaagctggagaaggagaaccagagcctgcagagcaccatccagggcctgagagatgccagcctggtgctggaggagagcggcctgaagtgtggggagctggagaaggagaaccaccagctgagcaagaagattgagaagctgcagacccagctggagcgggagaagcagagcaaccaggacctggagaccctgtctgaggagctgatccgggagaaggagcagctgcagagcgacatggagaccctgaaggctgacaaggcccggcagatcaaggacctggagcaggagaaggaccacctgaacagagccatgtggagcctgcgggagaggagccaggtgtcctctgaggccaggatgaaggatgtggagaaggagaacaaggccctgcaccagacagtgacagaggccaacgggaagctgagccagctggagtttgagaagaggcagctgcaccgggacctggagcaggccaaggagaagggggagcgggcagagaagctggagcgggagctgcagaggctgcaggaggagaatggccgcctggccaggaaggtgaccagcctggagacagccacagagaaggtggaggccctggagcacgagagccagggcctgcagctggagaacagaaccctgaggaagagcctggacaccctgcagaatgtgtccctgcagctggagggcctggagcgggacaacaagcagctggatgctgagaacctggagctgcggcggctggtggagaccatgaggttcaccagcaccaagctggcccagatggagcgggagaaccagcagctggagcgggagaaggaggagctgaggaagaatgtggacctgctgaaggccctgggcaagaagtctgagcggctggagctgagctaccagagcgtgtctgctgagaacctgcggctgcagcagagcctggagagcagcagccacaagacccagaccctggagagcgagctgggggagctggaggccgagcggcaggccctgcggcgggacctggaggccctgcggctggccaatgcccagctggagggcgctgagaaggacaggaaggccctggagcaggaggtggcccagctggagaaggacaagaagctgctggagaaggaggccaagaggctgtggcagcaggtggagctgaaggatgctgtgctggatgacagcacagccaagctgtctgctgtggagaaggagagccgggccctggacaaggagctggcccgctgcagagatgctgctgggaagctgaaggagctggagaaggacaacagagacctgaccaagcaggtgacagtgcacgcccggaccctgaccaccctgcgggaggacctggtgctggagaagctgaagagccagcagctgagcagcgagctggacaagctgagccaggagctggagaaggtgggcctgaaccgggagctgctgctgcaggaggatgattctggcagtgacaccaagtacaagatcctggagggcagaaatgaaagtgccctgaagaccaccctggccatgaaggaggagaagatcgtgctgctggaggcccagatggaggagaaggccagcctgaaccggcagctggagagcgagctgcagatgctgaagaaggaatgtgagaccctgcggcagaaccagggcgagggccagcacctgcagaacagcttcaagcaccctgctgggaagacagctgccagccaccagggcaaggaggcctggggccctggccacaaggaggccaccatggagctgctgcgggtgaaggaccgggccatcgagctggagaggaacaatgctgccctgcaggccgagaagcagctgctgaaggagcagctgcagcacctggagacccagaatgtgaccttcagcagccagatcctgaccctgcagaagcagagcgccttcctgcaggagcacaacaccaccctgcagacccagacagccaagctgcaggtggagaacagcaccctgagcagccagagcgctgccctgacagcccagtacaccctgctgcagaaccaccacacagccaaggagacagaaaatgaaagcctgcagaggcagcaggagcagctgacagctgcctatgaggccctgctgcaggaccacgagcacctgggcaccctgcacgagcggcagagcgcagaatatgaggccctgatccggcagcacagctgcctgaagaccctgcacaggaacctggagctggagcacaaggagctgggggagagacatggagacatgctgaagaggaaggccgagctggaggagcgggagaaggtgctgaccacagagcgggaggccctgcagcaggagcagaggaccaatgccctggccatgggagagaaccagaggctgcggggggagctggacagagtgaacttcctgcaccaccagctgaagggggagtatgaggagctgcacgcccacaccaaggagctgaagaccagcctgaacaatgcccagctggagctgaaccgctggcaggccaggtttgatgagctgaaggagcagcaccagaccatggacatcagcctgaccaagctggacaaccactgtgagctgctgagccggctgaagggcaacctggaggaggagaaccaccacctgctgagccagatccagctgctgagccagcagaaccagatgctgctggagcagaacatggagaacaaggagcagtaccacgaggagcagaagcagtacatcgacaagctgaatgccctgcggcggcacaaggagaagctggaggagaagatcatggaccagtacaagttctatgaccccccacccaagaagaagaaccactggattggagccaaggccctggtgaagctgatcaagcccaagaaggagggcagccgggagcggctgaagagcacagtggacagccccccctggcagctggagagcagtgaccctgccagccctgctgccagccagcccctgcggagccaggccgagaacccagacaccccagccctgggcagcaactgtgccgaggagagagatgcccacaatggatctgtgggcaagggccctggggacctgaagcccaagaggggcagcccccaccggggcagcctggacagaacagatgccagcacagacctggccatgaggtcctggcccagcgagctgggcagcaggacctgcagcaccagcgccaccaccacagcccccagcaacagcacccccatcgcccggcaccctggccgcaccaagggctacaacagtgatgacaacctgtgtgagcccagcctggagtttgaggtgcccaaccaccggcagtatgtgtcccggcccagcagcctggagagcagcaggaacaccagcagcaacagcagccccctgaacctgaagggcagcagcgagcagctgcacggccgctctgagagcttcagcagtgaagatctcatccccagccgggacctggccaccctgccccgggaggccagcaccccaggaagaaatgccctgggcagacatgagtaccccctgcccagaaatggccccctgccccaggagggcgcccagaagaggggcacagccccaccctacgtgggcgtgcggccctgcagcgccagccccagcagcgagatggtgaccctggaggagttcctggaggagagcaacagaagcagccccacccatgacacccccagctgcagagatgacctgctgagtgactacttcaggaaggccagtgaccccccagccatcggcggccagcccggccccccagccaagaaggagggcgccaagatgcccaccaactttgtggcccccaccgtgaagatggccgcccccaccagcgagggccggcccctgaagccaggccagtatgtgaagcccaacttccggctgacagaggccgaggcccctccttctgtggccccccggcaggcccagcccccccagagcctgagcctgggccggccccggcaggcccctgtgcccccagccagccacgccccagccagccgcagcgccagcctgagccgggccttcagcctggccagcgctgacctgctgcgggccagcggccctgaggcctgcaagcaggagagcccccagaagctgggcgcccctgaggccctgggcggccgggagaccggcagccacaccctgcagagccctgccccacccagcagccacagcctggcccgggagaggacccccctggtgggcaaggccggcagcagctgccagggccctggccccaggagccggcccctggacacccggcgcttcagcctggccccacccaaggaggagcggctggcccccctgcaccagagcgccacagccccagccatcgccacagctggagctggagctgctgctgctggcagcggcagcaacagccagctgctgcacttctccccagctgctgccccagctgcccggaccaagcccaaggccccacccaggtctggagaggtggccaccatcacccctgtgcgggccggcctgagcctgtctgaaggagatggagtgcccggccagggctgcagcgagggcctgcctgccaagagccctggccgcagcccagacctggccccccacctgggccgggccctggaggactgcagccggggctctgtgtccaagagcagccctgccagccctgagcccggcggggacccccagacagtgtggtatgaatatggctgtgtgtag

SEQ ID NO: 20276 - DNA, 3831 bp, Artificial Sequence
  Description of Artificial Sequence: Synthetic coding sequence
atggatgaggtggagcaggaccagcacgaggcccggctgaaggagctgtttgacagctttgacaccactggaacaggcagcctgggccaggaggagctgacagacctgtgccacatgctgagcctggaggaggtggcccctgtgctgcagcagaccctgctgcaggacaacctgctgggccgggtgcactttgaccagttcaaggaggccctgatcctgatcctgagcaggaccctgagcaatgaggagcacttccaggagccagactgcagcctggaggcccagcccaagtatgtgcggggcggcaagagatatggaagaagaagcctgcctgagttccaggagagcgtggaggagttccctgaggtgaccgtcatcgagcccctggatgaggaggcccggcccagccacatcccagctggggactgcagcgagcactggaagacccagaggtctgaggagtatgaagctgagggccagctgcgcttctggaacccagatgacctgaatgccagccagagcggcagcagccccccccaggactggattgaggagaagctgcaggaggtgtgtgaggacctgggcatcaccagagatggccacctgaacaggaagaagctggtgtccatctgtgagcagtatggcctgcagaatgtggatggagagatgctggaggaggtgttccacaacctggaccctgatggcaccatgtctgtggaggacttcttctacggcctcttcaagaatggcaagagcctgacccccagcgccagcaccccctaccggcagctgaagaggcacctgtccatgcagagctttgatgagagcggccgccgcaccaccaccagcagcgccatgaccagcaccatcggcttccgggtcttcagctgcctggatgatggcatgggccacgcctctgtggagcgcatcctggacacctggcaggaggagggcatcgagaacagccaggagatcctgaaggccctggacttcagcctggatggcaacatcaacctgacagagctgaccctggccctggagaatgagctgctggtgaccaagaacagcatccaccaggccgccctggccagcttcaaggccgagatccgccacctgctggagcgggtggaccaggtggtgcgggagaaggagaagctgcggagtgacctggacaaggccgagaagctgaagagcctgatggccagcgaggtggatgaccaccacgccgccattgaaagaagaaatgagtacaacctgaggaagctggatgaggagtacaaggagagaattgctgccctgaagaatgagctgaggaaggagcgggagcagatcctgcagcaggccggcaagcagaggctggagctggagcaggagattgagaaggccaagacagaggagaactacatccgggaccggctggccctgagcctgaaggagaacagccggctggagaatgagctgctggagaatgctgagaagctggccgagtatgagaacctgaccaacaagctgcagaggaacctggagaatgtgctggccgagaagtttggagacctggaccccagcagcgctgagttcttcctgcaggaggagcggctgacccagatgagaaatgaatatgaaaggcagtgccgggtgctgcaggaccaggtggatgagctgcagagcgagctggaggagtaccgggcccagggccgggtgctgcggctgcccctgaagaacagccccagcgaggaggtggaggccaacagcggcggcatcgagcctgagcacggcctgggcagcgaggagtgcaaccccctgaacatgagcattgaagctgagctggtgattgagcagatgaaggagcagcaccaccgggacatctgctgcctgcggctggagctggaggacaaggtgcgccactatgagaagcagctggatgaaacagtggtgtcctgcaagaaggcccaggagaacatgaagcagagacatgaaaatgagacccacaccctggagaagcagatcagtgacctgaagaatgaaattgctgagctgcagggccaggccgctgtgctgaaggaggcccaccacgaggccacctgcagacatgaggaggagaagaagcagctgcaggtgaagctggaggaggagaagacccacctgcaggagaagctgcggctgcagcacgagatggagctgaaggcccggctgacccaggcccaggccagctttgagcgggagcgggagggcctgcagagcagcgcctggacagaggagaaggtgcggggcctgacccaggagctggagcagttccaccaggagcagctgaccagcctggtggagaagcacaccctggagaaggaggagctgaggaaggagctgctggagaagcaccagcgggagctgcaggagggccgctatgaaagtgagaagctgcagcaggagaacagcatcctgagaaatgagatcaccaccctgaatgaagaagattccatcagcaacctgaagctgggcaccctgaatggcagccaggaggagatgtggcagaagacagaaacagtgaagcaggagaatgctgctgtgcagaagatggtggagaacctgaagaagcagatcagcgagctgaagatcaagaaccagcagctggacctggagaacacagagctgagccagaagaacagccagaaccaggagaagctgcaggagctgaaccagaggctgacagagatgctgtgccagaaggagaaggagcccggcaacagcgccctggaggagcgggagcaggagaagttcaacctgaaggaggagctggagcgctgcaaggtgcagagcagcaccctggtgagcagcctggaggccgagctgtctgaggtgaagatccagacccacatcgtgcagcaggagaaccacctgctgaaggatgagctggagaagatgaagcagctgcaccgctgcccagacctgagtgacttccagcagaagatcagctctgtgctgagctacaatgagaagctgctgaaggagaaggaggccctgtctgaggagctgaacagctgtgtggacaagctggccaagagcagcctgctggagcacagaattgccaccatgaagcaggagcagaagtcctgggagcaccagagcgccagcctgaagagccagctggtggccagccaggagaaggtgcagaacctggaggacacagtgcagaatgtgaacctgcagatgagcaggatgaagagtgacctgcgggtgacccagcaggagaaggaggccctgaagcaggaggtgatgagcctgcacaagcagctgcagaatgctgggggcaagtcctgggcccctgagatcgccacccaccccagcggcctgcacaaccagcagaagaggctgtcctgggacaagctggaccacctgatgaatgaggagcagcagctgctgtggcaggagaatgaaaggctgcagaccatggtgcagaacaccaaggccgagctgacccacagccgggagaaggtgcggcagctggagagcaacctgctgcccaagcaccagaagcacctgaaccccagcggcaccatgaaccccacagagcaggagaagctgagcctgaagcgggagtgtgaccagttccagaaggagcagagccctgccaacaggaaggtgtcccagatgaacagcctggagcaggagctggagaccatccacctggagaatgaaggcctgaagaagaagcaggtgaagctggatgagcagctgatggagaacagcgtggtgggcagcagccgggagggctgcagcagcctgcctgagatcgtgtgtgaagatgctgcccctgaggtgcactgtgatgcctag

SEQ ID NO: 20277 - DNA, 2997 bp, Artificial Sequence
  Description of Artificial Sequence: Synthetic coding sequence
atgaaggacagcggggacagcaaggaccagcagctgatggtggccctgcgggtgcggcccatctctgtggccgagctggaggagggcgccaccctgattgcccacaaggtggatgagcagatggtggtgctgatggaccccatggaggaccctgatgacatcctgcgggcccacaggagccgggagaagagctacctgtttgatgtggcctttgacttcaccgccacccaggagatggtgtaccaggccaccaccaagagcctgattgaaggagtcatcagcggctacaatgccaccgtgtttgcctacggccccaccggctgtgggaagacctacaccatgctgggcacagaccaggagcccggcatctacgtgcagaccctgaatgacctcttccgggccatcgaggagaccagcaatgacatggagtatgaggtgtccatgagctacctggagatctacaatgagatgatccgggacctgctgaaccccagcctgggctacctggagctgcgggaggacagcaagggcgtcatccaggtggccggcatcacagaggtgtccaccatcaatgccaaggagatcatgcagctgctgatgaagggcaaccggcagaggacccaggagcccacagctgccaaccagaccagcagccgcagccatgctgtgctgcaggtgacagtgcggcagaggagccgggtgaagaacatcctgcaggaggtgcggcagggccgcctcttcatgattgacctggccggcagcgagcgggccagccagacccagaacagaggccagaggatgaaggagggcgcccacatcaacagaagcctgctggccctgggcaactgcatcaatgccctgagtgacaagggcagcaacaagtacatcaactacagagacagcaagctgacccggctgctgaaggacagcctgggcggcaacagcaggacagtgatgattgcccacatcagccctgccagcagcgcctttgaggagagcaggaacaccctgacctacgccggccgggccaagaacatcaagaccagggtgaagcagaacctgctgaatgtgtcctaccacatcgcccagtacaccagcatcatcgctgacctgcggggggagatccagaggctgaagaggaagattgatgagcagacaggccggggccaggcccggggccggcaggacagaggagacatccgccacatccaggccgaggtgcagctgcacagcggccagggcgagaaggccggcatgggccagctgcgggagcagctggccagcgccttccaggagcagatggatgtgagaagaaggctgctggagctggagaacagagccatggaggtgcagattgacaccagccgccacctgctgaccatcgccggctggaagcatgagaagagccggcgggccctgaagtggagggaggagcagaggaaggagtgctacgccaaggatgattctgagaaggacagcgacacaggagatgaccagcctgacatcctggagcccccagaggtggccgccgcccgggagagcattgctgccctggtggatgagcagaagcagctgaggaagcagaagctggccctggagcagcgctgccgggagctgcgggcccggggccggcggctggaggagaccctgccccggcgcatcggcagcgaggagcagcgggaggtgctgagcctgctgtgccgggtgcatgagctggaggtggagaacacagagatgcagagccacgccctgctgagagatggagccctgcggcacagacatgaggccgtgcggcggctggagcagcacaggagcctgtgtgatgagatcatccagggccagaggcagatcattgatgactacaacctggccgtgccccagaggctggaggagctgtatgaggtgtacctgcgggagctggaggagggcagcctggagcaggccaccatcatggaccaggtggccagccgggccctgcaggacagcagcctgcccaagatcaccccagctggcaccagcctgaccccagacagcgacctggagagcgtgaagaccctgagcagtgatgcccagcacctgcagaacagcgccctgccccccctgagcacagaaagtgagggccaccacgtgttcaaggccggcactggagcctggcaggccaagagcagctctgtgcccaccccaccacccatccagctgggcagcctggtgacccaggaggccccagcccaggacagcctgggctcctggatcaacagcagcccagacagcagcgagaacctgtctgagatccccctgagccacaaggagaggaaggagatcctgaccggcaccaagtgcatctgggtgaaggccgcccggcggcgcagccgggccctgggcacagagggccgccacctgctggccccagccacagagaggagcagcctgagcctgcacagcctgtctgaaggagatgatgcccggcccccaggccccctggcctgcaagaggcctcccagccccaccctgcagcacgccgccagcgaggacaacctgagcagcagcactggagaggcccccagcagagctgtgggccaccacggagatggcccccggccctggctgcggggccagaagaagagcctgggcaagaagcgggaggagagcctggaggccaagaggaggaagagaagaagccgcagctttgaggtgacaggccagggcctgagccaccccaagacccacctgctgggcccccaccaggccgagcgcatcagtgaccacaggatgcctgtgtgccgccacccagcccctggcatccgccacctgggcaaggtgaccctgcccctggccaaggtgaagctgccccccagccagaacacaggccctggggacagcagccccctggccgtgccccccaaccctgggggcggcagccggcgggccacccggggcccccggctgccccacggcaccagcacccacggcaaggatggctgcagccgccacaactag

SEQ ID NO: 20278 - DNA, 1194 bp, Artificial Sequence
  Description of Artificial Sequence: Synthetic coding sequence
atgacagctgaggagggcgtgcagctgagccagcagaatgccaaggacttcttccgggtgctgaacctgaacaagaagtgtgacaccagcaagcacaaggtgctggtggtgtctgtgtgcccccagagcctgccctactttgctgccaagttcaacctgtctgtgacagatgccagccggcggctgtgtggcttcctgaagagcctgggcgtgcactacgtgtttgacaccaccatcgctgctgacttcagcatcctggagagccagaaggagtttgtgcggcgctaccggcagcacagcgaggaggagaggaccctgcccatgctgaccagcgcctgccccggctgggtgcgctatgcagagcgggtgctgggccggcccatcacagcccacctgtgcacagccaagagcccccagcaggtgatgggcagcctggtgaaggactactttgcccggcagcagaacctgagccctgagaagatcttccacgtgattgtggccccctgctatgacaagaagctggaggccctgcaggagagcctgcccccagccctgcacggcagcagaggagctgactgtgtgctgaccagcggggagatcgcccagatcatggagcagggcgacctgtctgtgagagatgctgctgtggacaccctgtttggagacctgaaggaggacaaggtgaccaggcatgatggagccagcagtgatggccacctggcccacatcttcagacatgctgccaaggagctgttcaatgaagatgtggaggaggtgacctaccgggccctgaggaacaaggacttccaggaggtgaccctggagaagaatggagaggtggtgctgcgctttgctgctgcctacggcttcaggaacatccagaacatgatcctgaagctgaagaagggcaagttccccttccactttgtggaggtgctggcctgtgccggcggctgcctgaatggccggggccaggcccagaccccagatggccatgctgacaaggccctgctgcggcagatggagggcatctatgctgacatccctgtgagaagacctgagagcagcgcccacgtgcaggagctgtaccaggagtggctggagggcatcaacagccccaaggcccgggaggtgctgcacaccacctaccagagccaggagcggggcacccacagcctggacatcaagtggtag

SEQ ID NO: 20279 - DNA, 3603 bp, Artificial Sequence
  Description of Artificial Sequence: Synthetic coding sequence
atgaaggtggccggcggcctggagctgggcgccgccgccctgctgagcgccagcccccgggccctggtgaccctgagcacaggccccacctgcagcatcctgcccaagaaccccctcttcccccagaacctgagcagccagccctgcatcaagatggagggggacaagagcctgaccttcagcagctatggcctgcagtggtgcctgtatgagctggacaaggaggagttccagaccttcaaggagctgctgaagaagaagagcagcgagagcaccacctgcagcatcccccagtttgaaattgaaaatgccaacgtggagtgcctggccctgctgctgcacgagtactatggagccagcctggcctgggccaccagcatcagcatctttgagaacatgaacctgcggaccctgtctgagaaggccagagatgacatgaagaggcacagccctgaggaccctgaggccaccatgacagaccagggccccagcaaggagaaggtgcccggcatcagccaggccgtgcagcaggacagcgccacagctgctgagaccaaggagcaggagatcagccaggccatggagcaggagggcgccacagctgctgagacagaggagcaggagatcagccaggccatggagcaggagggcgccacagctgctgagacagaggagcagggccacggcggggacacctgggactacaagagccacgtgatgaccaagtttgctgaggaggaggatgtgcggcgcagctttgagaacacagctgctgactggccagagatgcagaccctggccggggcctttgacagcgaccgctggggcttccggcccaggacagtggtgctgcacggcaagagcggcatcggcaagagcgccctggccaggagaattgtgctgtgctgggcccagggcggcctgtaccagggcatgttctcctatgtgttcttcctgcctgtgcgggagatgcagaggaagaaggagagctctgtgacagagttcatcagccgggagtggccagacagccaggcccctgtgacagagatcatgagcaggcctgagcggctgctcttcatcattgatggctttgatgacctgggctctgtgctgaacaatgacaccaagctgtgcaaggactgggccgagaagcagccccccttcaccctcatccgcagcctgctgaggaaggtgctgctgcctgagagcttcctgattgtgacagtgagagatgtgggcacagagaagctgaagtctgaggtggtgagcccccgctacctgctggtgcggggcatctctggagagcagaggatccacctgctgctggagcggggcatcggggagcaccagaagacccagggcctgcgggccatcatgaacaaccgggagctgctggaccagtgccaggtgcctgctgtgggcagcctcatctgtgtggccctgcagctgcaggatgtggtgggggagagcgtggcccccttcaaccagaccctgaccggcctgcatgctgcctttgtgttccaccagctgaccccccggggcgtggtgcggcgctgcctgaacctggaggagcgggtggtgctgaagcgcttctgcaggatggctgtggagggcgtgtggaacaggaagtctgtgtttgatggagatgacctgatggtgcagggcctgggggagagcgagctgcgggccctcttccacatgaacatcctgctgcctgacagccactgtgaggagtactacaccttcttccacctgagcctgcaggacttctgtgccgccctgtactacgtgctggagggcctggagattgaaccagccctgtgccccctgtatgtggagaagaccaagaggtccatggagctgaagcaggccggcttccacatccacagcctgtggatgaagcgcttcctgtttggcctggtgtctgaagatgtgcggcggcccctggaggtgctgctgggctgccctgtgcccctgggcgtgaagcagaagctgctgcactgggtgtccctgctgggccagcagcccaatgccaccacccctggggacaccctggatgccttccactgcctgtttgagacccaggacaaggagtttgtgcggctggccctgaacagcttccaggaggtgtggctgcccatcaaccagaacctggacctgattgccagcagcttctgcctgcagcactgcccctacctgaggaagatccgggtggatgtgaagggcatcttccccagagatgaatctgctgaggcctgccctgtggtgcccctgtggatgagggacaagaccctcatcgaggagcagtgggaggacttctgcagcatgctgggcacccacccccacctgcggcagctggacctgggcagcagcatcctgacagagcgggccatgaagaccctgtgtgccaagctgcggcaccccacctgcaagatccagaccctgatgttcagaaatgcccagatcaccccaggagtgcagcacctgtggagaattgtgatggccaacagaaacctgcggagcctgaacctgggcggcacccacctgaaggaggaggatgtgaggatggcctgtgaggccctgaagcaccccaagtgcctgctggagagcctgcggctggactgctgcggcctgacccacgcctgctacctgaagatcagccagatcctgaccaccagccccagcctgaagagcctgagcctggccggcaacaaggtgacagaccagggcgtgatgcccctgagtgatgccctgcgggtgtcccagtgtgccctgcagaagctgatcctggaggactgtggcatcacagccaccggctgccagagcctggccagcgccctggtgagcaacagaagcctgacccacctgtgcctgagcaacaacagcctgggcaatgaaggagtgaacctgctgtgccgctccatgaggctgccccactgcagcctgcagaggctgatgctgaaccagtgccacctggacacagctggctgcggcttcctggccctggccctgatgggcaacagctggctgacccacctgagcctgtccatgaaccctgtggaggacaatggagtgaagctgctgtgtgaggtgatgagggagcccagctgccacctgcaggacctggagctggtgaagtgccacctgacagctgcctgctgtgagagcctgagctgtgtgatcagccgcagccgccacctgaagagcctggacctgacagacaatgccctgggagatggaggagtggccgccctgtgtgagggcctgaagcagaagaacagcgtgctggcccggctgggcctgaaggcctgtggcctgaccagtgactgctgtgaggccctgagcctggccctgagctgcaacagacacctgaccagcctgaacctggtgcagaacaacttcagccccaagggcatgatgaagctgtgcagcgcctttgcctgccccaccagcaacctgcagatcatcggcctgtggaagtggcagtaccctgtgcagatcaggaagctgctggaggaggtgcagctgctgaagccccgggtggtgattgatggctcctggcacagctttgatgaagatgaccgctactggtggaagaactag

SEQ ID NO: 20280 - DNA, 2787 bp, Artificial Sequence
  Description of Artificial Sequence: Synthetic coding sequence
atgaatgaggccatggccacagacagcccccggcggcccagccgctgcacaggaggagtggtggtgcggccccaggccgtgacagagcagagctacatggagagcgtggtgaccttcctgcaggatgtggtgccccaggcctacagcggcacccccctgacagaggagaaggagaagatcgtgtgggtgcgctttgaaaatgctgacctgaatgacaccagcaggaacctggagttccacgagatccacagcactggaaatgaaccacccctgctgatcatgattggctacagtgatggcatgcaggtgtggagcatccccatctctggagaggcccaggagctgttctctgtgcgccacggccccatccgggccgcccgcatcctgcctgccccccagtttggagcccagaagtgtgacaactttgctgagaagaggcccctgctgggcgtgtgcaagagcatcggcagcagcggcaccagccccccctactgctgcgtggacctgtacagcctgaggactggagagatggtgaagagcatccagttcaagacccccatctatgacctgcactgcaacaagaggatcctggtggtggtgctgcaggagaagattgctgcctttgacagctgcaccttcaccaagaagttctttgtgaccagctgctacccctgccccggccccaacatgaaccccatcgccctgggcagccgctggctggcctatgcagagaacaagctgatccgctgccaccagagcagaggaggagcctgtggggacaacatccagagctacacagccaccgtcatctctgctgccaagaccctgaagagcggcctgaccatggtgggcaaggtggtgacccagctgaccggcaccctgcccagcggcgtgacagaagatgatgtggccatccacagcaacagccgccgcagccccctggtgcccggcatcatcaccgtcatcgacacagagaccgtgggggagggccaggtgctggtgtctgaggacagcgacagtgatggcatcgtggcccacttccctgcccacgagaagcctgtgtgctgcatggccttcaacaccagcggcatgctgctggtgaccacagacaccctgggccatgacttccacgtgttccagatcctgacccacccctggagcagcagccagtgtgctgtgcaccacctgtacaccctgcacagaggagaaacagaggccaaggtgcaggacatctgcttcagccatgactgccgctgggtggtggtgtccaccctgcggggcaccagccacgtgttccccatcaacccctatggaggccagccctgtgtgaggacccacatgagcccccgggtggtgaacaggatgagccgcttccagaagtctgctggcctggaggagattgagcaggagctgaccagcaagcagggcggccgctgcagccctgtgcccggcctgagcagcagccccagcggcagccccctgcacggcaagctgaacagccaggacagctacaacaacttcaccaacaacaaccctggcaacccccggctgagccccctgcccagcctgatggtggtgatgcccctggcccagatcaagcagcccatgaccctgggcaccatcaccaagaggacaggcccctacctgtttggagctggctgcttcagcatcaaggccccctgcaaggtgaagcccccaccccagatcagccccagcaagtccatgggcggggagttctgtgtggccgccatcttcggcaccagccgctcctggtttgccaacaatgccggcctgaagcgggagaaggaccagagcaagcaggtggtggtggagagcctgtacatcatcagctgctacggcaccctggtggagcacatgatggagccccggcccctgagcacagcccccaagatcagtgatgacacccccctggagatgatgaccagcccccgggcctcctggaccctggtgaggaccccccagtggaatgagctgcagccccccttcaatgccaaccaccccctgctgctggccgcagatgctgtgcagtactaccagttcctgctggccggcctggtgcccccaggcagccctggccccatcaccaggcatggcagctatgacagcctggccagtgaccacagcggccaggaggatgaggagtggctgagccaggtggagatcgtgacccacacaggcccccaccggcggctgtggatgggcccccagttccagttcaagaccatccaccccagcggccagaccaccgtcatcagcagcagcagctctgtgctgcagagccacggccccagcgacaccccccagcccctgctggactttgacacagatgacctggacctgaacagcctgcgcatccagcctgtgcggagtgaccctgtgtccatgcctggcagcagcaggcctgtgtctgaccggcggggcgtgtccacagtgattgatgctgccagcggcacctttgacagatctgtgaccctgctggaggtgtgtggctcctggccagagggcttcggcctgcggcacatgagctccatggagcacacagaggagggcctgcgggagcggctggctgatgccatggccgagagccccagcagagatgtggtgggcagcggcacagagctgcagcgggagggcagcattgagaccctgagcaacagcagcggcagcaccagcggcagcatccccaggaactttgatggctaccgcagccccctgcccaccaatgaaagccagcccctgagcctcttccccaccggcttcccctag

SEQ ID NO: 20281 - DNA, 501 bp, Artificial Sequence
  Description of Artificial Sequence: Synthetic coding sequence
atggtgaacagctgctgcggctctgtgtgcagcgaccagggctgcggcctggagaactgctgccggcccagctactgccagaccacctgctgcaggaccacctgctgccggcccagctgctgcgtgagcagctgctgccggccccagtgctgccagaccacctgctgcaggaccacctgctgccaccccagctgctgcgtgagcagctgctgccggccccagtgctgccagagcgtgtgctgccagcccacctgctgccggccccagtgctgccagaccacctgctgcaggaccacctgctgccggcccagctgctgccggccccagtgctgccagagcgtgtgctgccagcccacctgctgctgccccagctactgtgtgagcagctgctgccggccccagtgctgccagaccacctgctgcaggaccacctgctgccggcccagctgctgcgtgagccgctgctaccggccccactgcggccagagcctgtgctgctag

SEQ ID NO: 20282 - DNA, 1104 bp, Artificial Sequence
  Description of Artificial Sequence: Synthetic coding sequence
atggatgatgctgctgtgctgaagagaagaggctacctgctgggcatcaacctgggggagggcagctatgccaaggtgaagagcgcctacagcgagcggctgaagttcaacgtggccatcaagatcatcgacaggaagaaggccccagctgacttcctggagaagttcctgccccgggagattgagatcctggccatgctgaaccactgcagcatcatcaagacctatgagatctttgagaccagccacggcaaggtgtacatcgtgatggagctggccgtgcagggcgacctgctggagctgatcaagaccaggggggccctgcatgaagatgaggccaggaagaagttccaccagctgagcctggccatcaagtactgccacgacctggatgtggtgcaccgggacctgaagtgtgacaacctgctgctggacaaggacttcaacatcaagctgagtgacttctccttcagcaagcgctgcctgagagatgacagcggccgcatggccctgagcaagaccttctgtggcagccctgcctatgctgcccctgaggtgctgcagggcatcccctaccagcccaaggtgtatgacatctggagcctgggcgtcatcctgtacatcatggtgtgtggctccatgccctatgatgacagcaacatcaagaagatgctgcgcatccagaaggagcaccgggtgaacttccccaggagcaagcacctgaccggggagtgcaaggacctgatctaccacatgctgcagccagatgtgaacagaaggctgcacattgatgagatcctgagccactgctggatgcagcccaaggcccggggcagccccagcgtggccatcaacaaggagggggagagcagccggggcacagagcccctgtggaccccagagcccggcagtgacaagaagagcgccaccaagctggagcctgagggggaggcccagccccaggcccagcctgagaccaagccagagggcacagccatgcagatgagccggcagagcgagatcctgggcttccccagcaagcccagcaccatggagacagaggagggccccccccagcagcccccagagacccgggcccagtag

SEQ ID NO: 20283 - DNA, 273 bp, Artificial Sequence
  Description of Artificial Sequence: Synthetic coding sequence
atgagccactacggcagctactacggcggcctgggctacagctgtggcggctttggaggcctgggctacggctacggctgcggctgcggcagcttctgccggcggggcagcggctgcggctatggaggctacggctacggcagcggcttcggcagctatggctacggcagcggctttggaggctacggctacggcagcggctttggaggctacggctacggctgctgccggcccagctacaatggaggctacggcttcagcggcttctactag

SEQ ID NO: 20284 - DNA, 519 bp, Artificial Sequence
  Description of Artificial Sequence: Synthetic coding sequence
atgagctacaactgctgcagcaggaacttcagcagctgcagccatggaggctacctgcactacccaggcagcagctgtggcagcagctaccccagcaacctggtgtacagcacagacctgtgcagccccagcacctgccagctgggcagcagcctgtaccggggctgccaggagacctgctggaggcccaacagctgccagaccctgtgtgtggagagcagcccctgccacaccagctgctactaccccaggacccacatgctgtgcaacagctgcctgaccatgcacgtgggcagccggggcttcggcagcaacagctgctgcagcctgagctgtggcagccgcagctgcagcagcctgggctgcggcagcaatggcttccgctacctgaactaccgcatccacaccagccccagccagagctaccgcagccgcttctgccaccccatctacttccccccccggcgctggttccacagcagctgctaccagcccttctgccgcagcggcttctactag

SEQ ID NO: 20285 - DNA, 1554 bp, Artificial Sequence
  Description of Artificial Sequence: Synthetic coding sequence
atgagcggcagctgcagcagcaggaagtgcttctctgtgcctgccaccagcctgtgcagcacagaggtgtcctgtggcggccccatctgcctgcccagcagctgccagagccagacctggcagctggtgacctgccaggacagctgtggcagcagcagctgtggcccccagtgccggcagcccagctgccctgtgagcagctgtgcccagcccctgtgctgtgaccccgtcatctgtgagcccagctgcagcgtgagcagcggctgccagcctgtgtgctgtgaggccaccacctgtgagcccagctgcagcgtgagcaactgctaccagcctgtgtgctttgaggccaccatctgtgagcccagctgcagcgtgagcaactgctgccagcctgtgtgctttgaggccaccgtgtgtgagcccagctgcagcgtgagcagctgtgcccagcctgtgtgctgtgagcccgccatctgtgagcccagctgcagcgtgagcagctgctgccagcctgtgggcagcgaggccaccagctgccagcctgtgctgtgtgtgcccaccagctgccagcctgtgctgtgcaagagcagctgctgccagcctgtggtgtgtgagcccagctgctgcagcgctgtgtgcaccctgcccagcagctgccagcctgtggtgtgtgagcccagctgctgccagcctgtgtgccccacccccacctgcagcgtgaccagcagctgccaggccgtgtgctgtgaccccagcccctgtgagcccagctgcagcgagagcagcatctgccagcctgccacctgtgtggccctggtgtgtgagcctgtgtgcctgcggcctgtgtgctgcgtgcagagcagctgtgagcccccatctgtgcccagcacctgccaggagcccagctgctgcgtgagcagcatctgccagcccatctgcagcgagcccagcccctgcagccctgctgtgtgtgtgagcagcccctgccagcccacctgctacgtggtgaagcgctgccccagcgtgtgcccagagcctgtgtcctgccccagcaccagctgccggcccctgagctgcagccctggcagcagcgccagcgccatctgccggcccacctgccccaggaccttctacatccccagcagcagcaagaggccctgcagcgccaccatctcctacagacctgtgtcccggcccatctgccggcccatctgcagcggcctgctgacctaccggcagccctacatgaccagcatctcctacagacctgcctgctaccggccctgctacagcatcctgcggcggcctgcctgtgtgaccagctacagctgcaggcctgtgtacttccggcccagctgcacagaaagtgacagctgcaagagggactgcaagaagagcaccagcagccagctggactgtgtggacaccaccccctgcaaggtggatgtgtctgaggaggccccctgccagcccacagaggccaagcccatcagccccaccacccgggaggccgccgccgcccagcctgctgccagcaagccagccaactgctag

SEQ ID NO: 20286 - DNA, 1026 bp, Artificial Sequence
  Description of Artificial Sequence: Synthetic coding sequence
atggctgatggctgctgccccggcaacaccacagccatcccagctgtgcccaccatcaccacctaccctgtgaagggcggcttcagacatgccctgtgcctgcccagcagctgccacagcaggatgtggcagctggtgacctgccaggagagctgccagcccagcatcggggcccccagcggctgtgaccctgccagctgccagcccacccggctgcctgccaccagctgtgtgggctttgtgtgccagcccatgtgcagccatgctgcctgctaccagagcggcaccggccagagcccctgcctggtgagcagctgccagcccagctgcagcgagagcacctgctgccaggagaagtgctgtgatgccagcccctgccagcagagcagctgccaggagagcgtgtgcatgagcggcagctgccaggccgcctgtggccagagcgtgtgctgtgatgctggcagctgccagcccagctgcagcgaggtgaccagctgcccagagaccagctgcctgcccaccatctgcacagccagcccctgccagcccacctggtgccagggcagcagctgccagcctgtgtctggagagggccagccctgcaagagcacctactaccagcccatctgctacatcttcaagccctgccagagcgccctgtacatgcctgtgccctgccagcccagcacctgtgtgttcagcagctgcaacaccacctgctgcgtgcccagccactgccagcccccccactgccagctggtgcccagcacctgcttcatctaccagcctgtggccaactgccaggccccctgcagcaccaagaactgctgcaagccagccagctgtgacaccgtcatcagcggccagcccacctgtgatggccccccatcctacaaccagagcggctgcaagagcgcctgctgcgtgacaggcctgggcaccagccccagcagcggcagcaactgcctgcccaccagctgccagcccagctgtgagagcagcttctgcaaggccaccctgtgctag

SEQ ID NO: 20287 - DNA, 588 bp, Artificial Sequence
  Description of Artificial Sequence: Synthetic coding sequence
atggtgagcagctgctgcggctctgtgtgcagcgaccagagctgtggccagggcctgggccaggagagctgctgccggcccagctgctgccagaccacctgctgcaggaccacctgctgccggcccagctgctgcatcagcagctgctgccggcccagctgctgcatcagcagctgctgcaagcccagctgctgcaggaccacctgctgccggcccagctgctgcatcagcagctgctgccggcccagctgctgcatcagcagctgctgcaagcccagctgctgcaggaccacctgctgccggcccagctgctgcatcagcagctgctgccggcccagctgctgcatcagcagctgctgcaagcccagctgctgccagaccacctgctgccggcccagctgctgcatcagcagctgctaccggccccagtgctgccagcccagctgctgcaggcctgcctgctgcatcagcagctgctgccaccccagctgctgcgtgagcagctgccgctgccccttcagctgccccaccacctgctgcaggaccacctgcttccaccccatctgctgcggcagcagctgctgctag

SEQ ID NO: 20288 - DNA, 588 bp, Artificial Sequence
  Description of Artificial Sequence: Synthetic coding sequence
atggtgaacagctgctgcggctctgtgtgcagccaccagggctgcggccgggacctgtgccaggagacctgctgccggcccagctgctgtgagaccacctgctgcaggaccacctactgccggcccagctgctgcgtgagcagctgctgccggccccagtgctgccagagcgtgtgctgccagcccacctgctgccggccccgctgctgcatcagcagctgctgccggcccagctgctgcgtgagcagctgctgcaagccccagtgctgccagagcatgtgctgccagcccacctgctgccggccccgctgctgcatcagcagctgctgccggcccagctgctgcgtgagcagctgctgccggccccagtgctgccagagcgtgtgctgccagcccacctgctgccaccccagctgcagcatcagcagctgctgccggcccagctgctgtgagagcagctgctgccggccctgctgctgcctgcggcctgtgtgtggccgggtgtcctgccacaccacctgctaccggcccacctgtgtgatcagcagctgcccccggcccctgtgctgtgccagcagctgctgctag

SEQ ID NO: 20289 - DNA, 633 bp, Artificial Sequence
  Description of Artificial Sequence: Synthetic coding sequence
atggtgagcagctgctgcggctctgtgtgcagcgaccagggctgcggccaggacctgtgccaggagacctgctgccggcccagctgctgtgagaccacctgctgcaggaccacctgctgccggcccagctgctgcgtgagcagctgctgccggccccagtgctgccagagcgtgtgctgccagcccacctgcagccggcccagctgctgccagaccacctgctgcaggaccacctgctaccggcccagctgctgcgtgagcagctgctgccggccccagtgctgccagcctgcctgctgccagcccacctgctgccggcccagctgctgtgagaccacctgctgccacccccgctgctgcatcagcagctgctgccggcccagctgctgcgtgagcagctgctgcaagccccagtgctgccagagcgtgtgctgccagcccaactgctgccggcccagctgcagcatcagcagctgctgccggcccagctgctgtgagagcagctgctgccggccctgctgctgcgtgcggcctgtgtgtggccgggtgtcctgccacaccacctgctaccggcccacctgtgtgatcagcagctgcccccggcccctgtgctgtgccagcagctgctgctag

SEQ ID NO: 20290 - DNA, 387 bp, Artificial Sequence
  Description of Artificial Sequence: Synthetic coding sequence
atgacaggcagctgctgcggcagcaccctgagcagcctgtcctatggaggcggctgctgccagccctgctgctgccgggacccctgctgctgcaggcctgtgacctgccagaccaccgtgtgcaggcctgtgacctgtgtgccccgctgcacccggcccatctgtgagccctgcagaagacctgtgtgctgtgacccctgcagcctgcaggagggctgctgccggcccatcacctgctgccccagcagctgcacagctgtggtgtgccggccctgctgctgggccaccacctgctgccagcctgtgtctgtgcagagcccctgctgcaggcctccctgtggccagcccaccccctgcagcaccacctgcaggaccagcagctgctag

SEQ ID NO: 20291 - DNA, 387 bp, Artificial Sequence
  Description of Artificial Sequence: Synthetic coding sequence
atgacaggcagctgctgcggcagcaccttcagcagcctgtcctatggaggcggctgctgccagccctgctgctgccgggacccctgctgctgcaggcctgtgacctgccagaccaccgtgtgcaggcctgtgacctgtgtgccccgctgcacccggcccatctgtgagccctgcagaagacctgtgtgctgtgacccctgcagcctgcaggagggctgctgccggcccatcacctgctgccccagcagctgcacagctgtggtgtgccggccctgctgctgggccaccacctgctgccagcctgtgtctgtgcagagcccctgctgcaggcctccctgtggccagcccaccccctgcagcaccacctgcaggaccagcagctgctag

SEQ ID NO: 20292 - DNA, 297 bp, Artificial Sequence
  Description of Artificial Sequence: Synthetic coding sequence
atggactgctgtgccagccggggctgcagcgtgcccactggacctgccaccaccatctgcagcagtgacaagagctgccgctgtggggtgtgcctgcccagcacctgcccccacacagtgtggctgctggagcccacctgctgtgacaactgccccccaccctgccacatcccccagccctgtgtgcccacctgcttcctgctgaacagctgccagcccaccccaggcctggagaccctgaacctgaccaccttcacccagccctgctgtgagccctgcctgccccggggctgctag

SEQ ID NO: 20293 - DNA, 297 bp, Artificial Sequence
  Description of Artificial Sequence: Synthetic coding sequence
atggactgctgtgccagccgcagctgcagcgtgcccactggacctgccaccaccatctgcagcagtgacaagagctgccgctgtggggtgtgcctgcccagcacctgcccccacacagtgtggctgctggagcccatctgctgtgacaactgccccccaccctgccacatcccccagccctgtgtgcccacctgcttcctgctgaacagctgccagcccaccccaggcctggagaccctgaacctgaccaccttcacccagccctgctgtgagccctgcctgccccggggctgctag

SEQ ID NO: 20294 - DNA, 297 bp, Artificial Sequence
  Description of Artificial Sequence: Synthetic coding sequence
atgtactgctgtgccctgcggagctgcagcgtgcccactggacctgccaccaccttctgcagctttgacaagagctgccgctgtggggtgtgcctgcccagcacctgcccccatgagatcagcctgctgcagcccatctgctgtgacacctgccccccaccctgctgcaagccagacacctacgtgcccacctgctggctgctgaacaactgccaccccaccccaggcctgagcggcatcaacctgaccacctacgtgcagcccggctgtgagagcccctgtgagccccgctgctag

SEQ ID NO: 20295 - DNA, 291 bp, Artificial Sequence
  Description of Artificial Sequence: Synthetic coding sequence
atgtgccacaccagctgcagcagcggctgccagcctgcctgctgtgcccccagcccctgccaggccagctgctacatccctgtgggctgccagagctctgtgtgtgtgcctgtgtccttcaagccagctgtgtgtgtgcctgtgcgctgccagagctctgtgtgtgtgcctgtgtcctgcaggcctgtggtgtatgctgcccccagctgccagagcagcggctgctgccagcccagctgcacctctgtgctgtgccggcccatcagctgcagcacccccagctgctgctag

SEQ ID NO: 20296 - DNA, 339 bp, Artificial Sequence
  Description of Artificial Sequence: Synthetic coding sequence
atgtgccacaccagccacagcagcggctgccccatggcctgccccggcagcccctgctgcgtgcccagcacctgctacccacctgagggctacggcaccagctgctgctgcagcgccccctgtgtggccctgctgtgccggcccctgtgtggggtgtccacctgctgccagcctgcctgctgcgtgcccagcccctgccaggtggcctgctgcgtgcctgtgtcctgcaagcctgtgctgtgtgtggccagcttctgccccaccagcggctgctgccagcccttctgccccaccctggtgtacagacctgtgacctggagcacccccaccggctgctag

SEQ ID NO: 20297 - DNA, 666 bp, Artificial Sequence
  Description of Artificial Sequence: Synthetic coding sequence
atggccaccagcaccatgtctgtgtgcagcagcgcctacagcgacagctggcaggtggatgcctgcccagagagctgctgtgagcccccctgctgtgccaccagctgctgtgccccagccccctgcctgaccctggtgtgcacccctgtgtcctgtgtgagcagcccctgctgccaggccgcctgtgagcccagcccctgccagagcggctgcaccagcagctgcacccccagctgctgccagcagagcagctgccagcctgcctgctgcaccagcagcccctgccagcaggcctgctgcgtgcctgtgtgctgcaagcctgtgtgctgcgtgcctgtgtgctgcaagcctgtgtgctgcaagcccatctgctgcgtgcctgtgtgcagcggggccagcagcagctgctgccagcagagcagccggcagcctgcctgctgcaccaccagctgctgccggcccagcagctctgtgtccctgctgtgcaggcctgtgtgccgcagcacctgctgcgtgcccatccccagctgctgtgccccagccagcacctgccagcccagctgctgcaggcctgccagctgtgtgtccctgctgtgccggcccacctgcagccggctgagcagcgcctgctgcggcctgagcagcggccagaagagcagctgctag

SEQ ID NO: 20298 - DNA, 768 bp, Artificial Sequence
  Description of Artificial Sequence: Synthetic coding sequence
atggccgccagcaccatgagcatctgcagcagcgcctgcaccaacagctggcaggtggatgactgcccagagagctgctgtgagctgccctgtggcacccccagctgctgtgccccagccccctgcctgaccctggtgtgcacccctgtgtcctgtgtgagcagcccctgctgccaggccgcctgtgagcccagcgcctgccagagcggctgcaccagcagctgcacccccagctgctgccagcagagcagctgccagcctgcctgctgcaccagcagcccctgccagcaggcctgctgcgtgcctgtgtgctgcaagcctgtgtgctgcgtgcctgtgtgctgcggggccagcagctgctgccagcagagcagctgccagcctgcctgctgtgccagcagcagctgccagcagagctgccgggtgcctgtgtgctgcaaggctgtgtgctgcgtgcccacctgcagcgagagcagcagcagctgctgccagcagagcagctgccagcctgcctgctgcaccagcagcccctgccagcagagctgctgcgtgtctgtgtgctgcaagcctgtgtgctgcaagagcatctgctgcgtgcctgtgtgcagcggggccagcagcccctgctgccagcagagcagctgccagcctgcctgctgcaccagcagctgctgccggcccagcagctctgtgtccctgctgtgcaggcctgtgtgcagcaggcctgccagctgcagcttcagcagcggccagaagagcagctgctag

SEQ ID NO: 20299 - DNA, 312 bp, Artificial Sequence
  Description of Artificial Sequence: Synthetic coding sequence
atgtgtggcagctactacagaaactacaacggcggccacggctacggctgctgcggctacggcggcctgggctgcggctatggaggctgcggctacggctgctgcggctatggaggcctgggcttcggctacggcggcctggactgtggctatggaggcctgggctgcggctacggcagcttctgtggctgcggctaccggggcctggactgtggctacggctgcggctacggctacgtgagccacagcttctgtggctgcggctaccgctgtggcagcggctacggcagcagctttggctactactactag

SEQ ID NO: 20300 - DNA, 3117 bp, Artificial Sequence
  Description of Artificial Sequence: Synthetic coding sequence
atggtgagcagcgcccagatgggcttcaacctgcaggccctgctggagcagctgagccaggatgagctgagcaagttcaagtacctgatcaccaccttcagcctggcccacgagctgcagaagatcccccacaaggaggtggacaaggcagatggcaagcagctggtggagatcctgaccacccactgtgacagctactgggtggagatggccagcctgcaggtgtttgagaagatgcacaggatggacctgtctgagcgggccaaggatgaggtgcgggaggccgccctgaagagcttcaacaagaggaagcccctgagcctggccttcacagagaccaagggaaatgtcatctgcctgggcaaggaggtgttcaagggcaagaagccagacaaggacaaccgctgccgctacatcctgaagaccaagttccgggagatgtggaagtcctggccaggggacagcaaggaggtgcaggtgatggccgagcgctacaagatgctgatccccttcagcaacccccgggtgctgcccggccccttctcctacacagtggtgctgtatggccctgctggcctgggcaagaccaccctggcccagaagctgatgctggactgggccgaggacaacctgatccacaagttcaagtatgccttctacctgagctgccgggagctgagccggctgggcccctgcagctttgctgagctggtgttccgggactggccagagctgcaggatgacatcccccacatcctggcccaggccaggaagatcctgtttgtgattgatggctttgatgagctgggcgccgcccctggggccctgattgaggacatctgtggggactgggagaagaagaagcctgtgcctgtgctgctgggcagcctgctgaacagagtgatgctgcccaaggccgccctgctggtgaccacccggccccgggccctgcgggacctgcgcatcctggccgaggagcccatctacatccgggtggagggcttcctggaggaggaccggcgggcctacttcctgcggcactttggagatgaggaccaggccatgagggcctttgagctgatgaggagcaatgctgccctcttccagctgggcagcgccccagctgtgtgctggatcgtgtgcaccaccctgaagctgcagatggagaagggggaggaccctgtgcccacctgcctgaccaggacaggcctcttcctgcgcttcctgtgcagccgcttcccccagggcgcccagctgcggggggccctgcggaccctgagcctgctggccgcccagggcctgtgggcccagacctctgtgctgcaccgggaggacctggagcggctgggcgtgcaggagagtgacctgcggctcttcctggatggagacatcctgcggcaggacagagtgtccaagggctgctacagcttcatccacctgtccttccagcagttcctgacagccctcttctacaccctggagaaggaggaggaggaggacagagatggccacacctgggacattggagatgtgcagaagctgctgagcggcgtggagcggctgaggaacccagacctgatccaggccggctactacagctttggcctggccaatgagaagagggccaaggagctggaggccaccttcggctgcaggatgagcccagacatcaagcaggagctgctgcgctgtgacatcagctgcaagggcggccacagcacagtgacagacctgcaggagctgctgggctgcctgtatgagagccaggaggaggagctggtgaaggaggtgatggcccagttcaaggagatcagcctgcacctgaatgctgtggatgtggtgcccagcagcttctgtgtgaagcactgcaggaacctgcagaagatgagcctgcaggtgatcaaggagaacctgcctgaaaatgtgacagccagcgagagtgatgctgaggtggagaggagccaggatgaccagcacatgctgcccttctggacagacctgtgcagcatcttcggcagcaacaaggacctgatgggcctggccatcaatgacagcttcctgagcgccagcctggtgcgcatcctgtgtgagcagatcgccagtgacacctgccacctgcagagggtggtgttcaagaacatcagccctgcagatgcccacaggaacctgtgcctggccctgcggggccacaagacagtgacctacctgaccctgcagggcaatgaccaggatgacatgtttcctgccctgtgtgaggtgctgcggcaccctgagtgcaacctgcgctacctgggcctggtgtcctgcagcgccaccacccagcagtgggccgacctgagcctggccctggaggtgaaccagagcctgacctgtgtgaacctgagtgacaatgagctgctggatgaaggagccaagctgctgtacaccaccctgcggcaccccaagtgcttcctgcagaggctgagcctggagaactgccacctgacagaggccaactgcaaggacctggccgctgtgctggtggtgtcccgggagctgacccacctgtgcctggccaagaaccccatcggcaacacaggagtgaagttcctgtgtgagggcctgcgctacccagagtgcaagctgcagaccctggtgctgtggaactgtgacatcaccagtgatggctgctgtgacctgaccaagctgctgcaggagaagagcagcctgctgtgcctggacctgggcctgaaccacatcggcgtgaagggcatgaagttcctgtgtgaggccctgaggaagcccctgtgcaacctgcgctgcctgtggctgtggggctgcagcatcccccccttcagctgtgaggacctgtgcagcgccctgagctgcaaccagagcctggtgaccctggacctgggccagaaccccctgggcagcagtggagtgaagatgctgtttgagaccctgacctgcagcagcggcaccctgcggaccctgcggctgaagattgatgacttcaatgatgagctgaacaagctgctggaggagattgaggagaagaacccccagctgatcatcgacacagagaagcaccacccctgggccgagcggcccagcagccatgacttcatgatctag

SEQ ID NO: 20301 - DNA, 762 bp, Artificial Sequence
  Description of Artificial Sequence: Synthetic coding sequence
atggagctggagcagcgggagggcaccatggctgctgtgggctttgaggagttcagcgcccctcctggcagcgagctggccctgccccccctgtttggaggccacatcctggagagcgagctggagacagaggtggagtttgtgtctgggggcctgggcggcagcggcctgcgggagagagatgaggaggaggaggccgcccggggcagaagaagacggcagcgggagctgaacagaaggaagtaccaggccctgggccgccgctgccgggagattgagcaggtgaatgaaagagtgctgaaccggctgcaccaggtgcagaggatcacccggcggctgcagcaggagcggcgcttcctgatgagggtgctggacagctatggagatgactaccgggccagccagttcaccatcgtgctggaggatgagggcagccagggcacagatgcccccaccccaggaaatgcagaaaatgagcccccagagaaggagaccctgagcccccccaggaggaccccagcccctcctgagcccggcagccctgcccctggagagggccccagcggcaggaagagaagaagagtgcccagagatggccggcgggctggaaatgccctgaccccagagctggcccctgtgcagatcaaggtggaggaggactttggatttgaagcagatgaggccctggacagctcctgggtgtcccggggccctgacaagctgctgccctaccccaccctggccagccctgccagtgactag

SEQ ID NO: 20302 - DNA, 2679 bp, Artificial Sequence
  Description of Artificial Sequence: Synthetic coding sequence
atgctgaggacagctggaagagatggcctgtgccgcctgagcacctacctggaggagctggaggccgtggagctgaagaagttcaagctgtacctgggcacagccacagagctgggggagggcaagatcccctggggctccatggagaaggccggccccctggagatggcccagctgctgatcacccacttcggccctgaggaggcctggaggctggccctgagcacctttgagcgcatcaacaggaaggacctgtgggagcggggccagcgggaggacctggtgcgggacaccccacctgggggccccagcagcctgggcaaccagagcacctgcctgctggaggtgtccctggtgacccccaggaaggacccccaggagacctacagagattatgtgcggaggaagttccggctgatggaggacagaaatgcccggctgggagaatgtgtgaacctgagccaccgctacacccggctgctgctggtgaaggagcacagcaaccccatgcaggtgcagcagcagctgctggacaccggccggggccacgccaggacagtgggccaccaggccagccccatcaagattgagaccctgtttgagccagatgaggagaggcctgagccccccaggacagtggtgatgcagggcgctgctggcatcggcaagtccatgctggcccacaaggtgatgctggactgggcagatggcaagctgttccagggccgctttgactacctgttctacatcaactgccgggagatgaaccagagcgccacagaatgttccatgcaggacctgatcttcagctgctggccagagcccagcgcccccctgcaggagctgatccgggtgcctgagcggctgctcttcatcattgatggctttgatgagctgaagcccagcttccatgacccccagggcccctggtgcctgtgctgggaggagaagaggcccacagagctgctgctgaacagcctcatcaggaagaagctgctgcctgagctgagcctgctgatcaccacccggcccacagccctggagaagctgcaccggctgctggagcaccccaggcatgtggagatcctgggcttcagcgaggccgagaggaaggagtacttctacaagtacttccacaatgctgagcaggccggccaggtgttcaactacgtgcgggacaatgagcccctcttcaccatgtgctttgtgcccctggtgtgctgggtggtgtgcacctgcctgcagcagcagctggagggcggcggcctgctgcggcagaccagcaggaccaccacagctgtgtacatgctgtacctgctgagcctgatgcagcccaagccaggggccccccggctgcagcccccacccaaccagaggggcctgtgcagcctggccgcagatggcctgtggaaccagaagatcctgtttgaggagcaggacctgaggaagcacggcctggatggagaagatgtgtctgccttcctgaacatgaacatcttccagaaggacatcaactgtgagcgctactacagcttcatccacctgtccttccaggagttctttgctgccatgtactacatcctggatgaaggagagggcggggccggccctgaccaggatgtgacccggctgctgacagaatatgccttcagcgagaggagcttcctggccctgaccagccgcttcctgtttggcctgctgaatgaggagaccaggagccacctggagaagagcctgtgctggaaggtgagcccccacatcaagatggacctgctgcagtggatccagagcaaggcccagagtgatggcagcaccctgcagcagggcagcctggagttcttcagctgcctgtatgagatccaggaggaggagttcatccagcaggccctgagccacttccaggtgattgtggtgagcaacatcgccagcaagatggagcacatggtgtcctccttctgcctgaagcgctgccgcagcgcccaggtgctgcacctgtatggagccacctacagcgcagatggagaagatcgggcccgctgcagcgctggggcccacaccctgctggtgcagctgcggcctgagaggacagtgctgctggatgcctacagcgagcacctggccgccgccctgtgcaccaaccccaacctgattgagctgagcctgtacagaaatgccctgggcagccggggcgtgaagctgctgtgccagggcctgcggcaccccaactgcaagctgcagaacctgcggctgaagcgctgccgcatcagcagcagcgcctgtgaggacctgtctgctgccctgattgccaacaagaacctgaccaggatggacctgtctggaaatggagtgggcttccctggcatgatgctgctgtgtgagggcctgcggcacccccagtgccgcctgcagatgatccagctgaggaagtgccagctggagagcggggcctgccaggagatggcctctgtgctgggcaccaacccccacctggtggagctggacctgactggaaatgccctggaggacctgggcctgcggctgctgtgccagggcctgcggcaccctgtgtgccgcctgcggaccctgtggtggctgtttggcatggacctgaacaagatgacccacagccggctggccgccctgcgggtgaccaagccctacctggacatcggctgctag

SEQ ID NO: 20303 - DNA, 3189 bp, Artificial Sequence
  Description of Artificial Sequence: Synthetic coding sequence
atgctgaggacagctggaagagatggcctgtgccgcctgagcacctacctggaggagctggaggccgtggagctgaagaagttcaagctgtacctgggcacagccacagagctgggggagggcaagatcccctggggctccatggagaaggccggccccctggagatggcccagctgctgatcacccacttcggccctgaggaggcctggaggctggccctgagcacctttgagcgcatcaacaggaaggacctgtgggagcggggccagcgggaggacctggtgcgggacaccccacctgggggccccagcagcctgggcaaccagagcacctgcctgctggaggtgtccctggtgacccccaggaaggacccccaggagacctacagagattatgtgcggaggaagttccggctgatggaggacagaaatgcccggctgggagaatgtgtgaacctgagccaccgctacacccggctgctgctggtgaaggagcacagcaaccccatgcaggtgcagcagcagctgctggacaccggccggggccacgccaggacagtgggccaccaggccagccccatcaagattgagaccctgtttgagccagatgaggagaggcctgagccccccaggacagtggtgatgcagggcgctgctggcatcggcaagtccatgctggcccacaaggtgatgctggactgggcagatggcaagctgttccagggccgctttgactacctgttctacatcaactgccgggagatgaaccagagcgccacagaatgttccatgcaggacctgatcttcagctgctggccagagcccagcgcccccctgcaggagctgatccgggtgcctgagcggctgctcttcatcattgatggctttgatgagctgaagcccagcttccatgacccccagggcccctggtgcctgtgctgggaggagaagaggcccacagagctgctgctgaacagcctcatcaggaagaagctgctgcctgagctgagcctgctgatcaccacccggcccacagccctggagaagctgcaccggctgctggagcaccccaggcatgtggagatcctgggcttcagcgaggccgagaggaaggagtacttctacaagtacttccacaatgctgagcaggccggccaggtgttcaactacgtgcgggacaatgagcccctcttcaccatgtgctttgtgcccctggtgtgctgggtggtgtgcacctgcctgcagcagcagctggagggcggcggcctgctgcggcagaccagcaggaccaccacagctgtgtacatgctgtacctgctgagcctgatgcagcccaagccaggggccccccggctgcagcccccacccaaccagaggggcctgtgcagcctggccgcagatggcctgtggaaccagaagatcctgtttgaggagcaggacctgaggaagcacggcctggatggagaagatgtgtctgccttcctgaacatgaacatcttccagaaggacatcaactgtgagcgctactacagcttcatccacctgtccttccaggagttctttgctgccatgtactacatcctggatgaaggagagggcggggccggccctgaccaggatgtgacccggctgctgacagaatatgccttcagcgagaggagcttcctggccctgaccagccgcttcctgtttggcctgctgaatgaggagaccaggagccacctggagaagagcctgtgctggaaggtgagcccccacatcaagatggacctgctgcagtggatccagagcaaggcccagagtgatggcagcaccctgcagcagggcagcctggagttcttcagctgcctgtatgagatccaggaggaggagttcatccagcaggccctgagccacttccaggtgattgtggtgagcaacatcgccagcaagatggagcacatggtgtcctccttctgcctgaagcgctgccgcagcgcccaggtgctgcacctgtatggagccacctacagcgcagatggagaagatcgggcccgctgcagcgctggggcccacaccctgctggtgcagctgcggcctgagaggacagtgctgctggatgcctacagcgagcacctggccgccgccctgtgcaccaaccccaacctgattgagctgagcctgtacagaaatgccctgggcagccggggcgtgaagctgctgtgccagggcctgcggcaccccaactgcaagctgcagaacctgcggctgaagcgctgccgcatcagcagcagcgcctgtgaggacctgtctgctgccctgattgccaacaagaacctgaccaggatggacctgtctggaaatggagtgggcttccctggcatgatgctgctgtgtgagggcctgcggcacccccagtgccgcctgcagatgatccagctgaggaagtgccagctggagagcggggcctgccaggagatggcctctgtgctgggcaccaacccccacctggtggagctggacctgactggaaatgccctggaggacctgggcctgcggctgctgtgccagggcctgcggcaccctgtgtgccgcctgcggaccctgtggctgaagatctgccgcctgacagctgctgcctgtgatgagctggccagcaccctgtctgtgaaccagagcctgcgggagctggacctgagcctgaatgagctgggggacctgggcgtgctgctgctgtgtgagggcctgcggcaccccacctgcaagctgcagaccctgcggctgggcatctgccgcctgggcagcgctgcctgtgagggcctgtctgtggtgctgcaggccaaccacaacctgcgggagctggacctgtccttcaatgacctgggggactggggcctgtggctgctggccgagggcctgcagcacccagcctgccgcctgcagaagctgtggctggacagctgtggcctgacagccaaggcctgtgaaaatctctacttcaccctgggcatcaaccagaccctgacagacctgtacctgaccaacaatgccctgggggacaccggggtgcggctgctgtgcaagaggctgagccaccctggctgcaagctgcgggtgctgtggctgtttggcatggacctgaacaagatgacccacagccggctggccgccctgcgggtgaccaagccctacctggacatcggctgctag

SEQ ID NO: 20304 - DNA, 3015 bp, Artificial Sequence
  Description of Artificial Sequence: Synthetic coding sequence
atgctgaggacagctggaagagatggcctgtgccgcctgagcacctacctggaggagctggaggccgtggagctgaagaagttcaagctgtacctgggcacagccacagagctgggggagggcaagatcccctggggctccatggagaaggccggccccctggagatggcccagctgctgatcacccacttcggccctgaggaggcctggaggctggccctgagcacctttgagcgcatcaacaggaaggacctgtgggagcggggccagcgggaggacctggtgcgggacaccccacctgggggccccagcagcctgggcaaccagagcacctgcctgctggaggtgtccctggtgacccccaggaaggacccccaggagacctacagagattatgtgcggaggaagttccggctgatggaggacagaaatgcccggctgggagaatgtgtgaacctgagccaccgctacacccggctgctgctggtgaaggagcacagcaaccccatgcaggtgcagcagcagctgctggacaccggccggggccacgccaggacagtgggccaccaggccagccccatcaagattgagaccctgtttgagccagatgaggagaggcctgagccccccaggacagtggtgatgcagggcgctgctggcatcggcaagtccatgctggcccacaaggtgatgctggactgggcagatggcaagctgttccagggccgctttgactacctgttctacatcaactgccgggagatgaaccagagcgccacagaatgttccatgcaggacctgatcttcagctgctggccagagcccagcgcccccctgcaggagctgatccgggtgcctgagcggctgctcttcatcattgatggctttgatgagctgaagcccagcttccatgacccccagggcccctggtgcctgtgctgggaggagaagaggcccacagagctgctgctgaacagcctcatcaggaagaagctgctgcctgagctgagcctgctgatcaccacccggcccacagccctggagaagctgcaccggctgctggagcaccccaggcatgtggagatcctgggcttcagcgaggccgagaggaaggagtacttctacaagtacttccacaatgctgagcaggccggccaggtgttcaactacgtgcgggacaatgagcccctcttcaccatgtgctttgtgcccctggtgtgctgggtggtgtgcacctgcctgcagcagcagctggagggcggcggcctgctgcggcagaccagcaggaccaccacagctgtgtacatgctgtacctgctgagcctgatgcagcccaagccaggggccccccggctgcagcccccacccaaccagaggggcctgtgcagcctggccgcagatggcctgtggaaccagaagatcctgtttgaggagcaggacctgaggaagcacggcctggatggagaagatgtgtctgccttcctgaacatgaacatcttccagaaggacatcaactgtgagcgctactacagcttcatccacctgtccttccaggagttctttgctgccatgtactacatcctggatgaaggagagggcggggccggccctgaccaggatgtgacccggctgctgacagaatatgccttcagcgagaggagcttcctggccctgaccagccgcttcctgtttggcctgctgaatgaggagaccaggagccacctggagaagagcctgtgctggaaggtgagcccccacatcaagatggacctgctgcagtggatccagagcaaggcccagagtgatggcagcaccctgcagcagggcagcctggagttcttcagctgcctgtatgagatccaggaggaggagttcatccagcaggccctgagccacttccaggtgattgtggtgagcaacatcgccagcaagatggagcacatggtgtcctccttctgcctgaagcgctgccgcagcgcccaggtgctgcacctgtatggagccacctacagcgcagatggagaagatcgggcccgctgcagcgctggggcccacaccctgctggtgcagctgcctgagaggacagtgctgctggatgcctacagcgagcacctggccgccgccctgtgcaccaaccccaacctgattgagctgagcctgtacagaaatgccctgggcagcagaggagtgaagctgctgtgccagggcctgcggcaccccaactgcaagctgcagaacctgcggctgaagcgctgccgcatcagcagcagcgcctgtgaggacctgtctgctgccctgattgccaacaagaacctgaccaggatggacctgtctggaaatggagtgggcttccctggcatgatgctgctgtgtgagggcctgcggcacccccagtgccgcctgcagatgatccagctgaggaagtgccagctggagagcggggcctgccaggagatggcctctgtgctgggcaccaacccccacctggtggagctggacctgactggaaatgccctggaggacctgggcctgcggctgctgtgccagggcctgcggcaccctgtgtgccgcctgcggaccctgtggctgaagatctgccgcctgacagctgctgcctgtgatgagctggccagcaccctgtctgtgaaccagagcctgcgggagctggacctgagcctgaatgagctgggggacctgggcgtgctgctgctgtgtgagggcctgcggcaccccacctgcaagctgcagaccctgcggctggacagctgtggcctgacagccaaggcctgtgaaaatctctacttcaccctgggcatcaaccagaccctgacagacctgtacctgaccaacaatgccctgggggacaccggggtgcggctgctgtgcaagaggctgagccaccctggctgcaagctgcgggtgctgtggctgtttggcatggacctgaacaagatgacccacagccggctggccgccctgcgggtgaccaagccctacctggacatcggctgctag

SEQ ID NO: 20305 - DNA, 327 bp, Artificial Sequence
  Description of Artificial Sequence: Synthetic coding sequence
atggccagcggccggcctgaggagctgtgggaggccgtggtgggcgctgctgagcgcttccgggccaggactggaacagagctggtgctgctgacagctgcccctcctcctccacccaggcctggcccctgtgcctatgctgcccacggccgcggggccctggccgaggccgcccggcgctgcctgcatgacatcgccctggcccacagagctgccacagctgcccggcccccagcccctcctccagccccccagccccccagccccacccccagccccccccggcccaccctggccagagaagataatgaagaagatgaagattag

SEQ ID NO: 20306 - DNA, 771 bp, Artificial Sequence; identical to SEQ ID NO: 19315
  Description of Artificial Sequence: Synthetic coding sequence

SEQ ID NO: 20307 - DNA, 771 bp, Artificial Sequence; identical to SEQ ID NO: 19315
  Description of Artificial Sequence: Synthetic coding sequence

SEQ ID NO: 20308 - DNA, 771 bp, Artificial Sequence; identical to SEQ ID NO: 19315
  Description of Artificial Sequence: Synthetic coding sequence

SEQ ID NO: 20309 - DNA, 771 bp, Artificial Sequence; identical to SEQ ID NO: 19315
  Description of Artificial Sequence: Synthetic coding sequence

SEQ ID NO: 20310 - DNA, 831 bp, Artificial Sequence
  Description of Artificial Sequence: Synthetic coding sequence
atgagctttgaaggaggagatggagctggccctgccatgctggccaccggcacagccaggatggccagcggccggcctgaggagctgtgggaggccgtggtgggcgctgctgagcgcttccgggccaggactggaacagagctggtgctgctgacagctgcccctcctcctccacccaggcctggcccctgtgcctatgctgcccacggccgcggggccctggccgaggccgcccggcgctgcctgcatgacatcgccctggcccacagagctgccacagctgcccggcccccagcccctcctccagccccccagccccccagccccacccccagccccccccggcccaccctggccagagaagataatgaagaagatgaagatgagcccacagaaacagagaccagcggggagcagctgggcatcagtgacaatggaggcctgtttgtgatggatgaagatgccaccctgcaggacctgccccccttctgtgagagtgaccctgagagcacagatgatggcagcctgtctgaggagaccccagctggcccccccacctgcagcgtgcccccagccagcgccctgcccacccagcagtatgccaagagcctgcctgtgtctgtgcctgtgtggggcttcaaggagaagaggacagaggcccggagcagtgatgaggagaatggaccacccagcagcccagacctggacagaattgctgcctccatgagggccctggtgctgcgggaggccgaggacacccaggtgtttggagacctgccccggccccggctgaacaccagtgacttccagaagctgaagaggaagtactag

SEQ ID NO: 20311 - DNA, 906 bp, Artificial Sequence; identical to SEQ ID NO: 19231
  Description of Artificial Sequence: Synthetic coding sequence

SEQ ID NO: 20312 - DNA, 612 bp, Artificial Sequence
  Description of Artificial Sequence: Synthetic coding sequence
atggccgaggtgcaggtgctggtgctggatggccggggccacctgctgggccgcctggccgccatcgtggccaagcaggtgctgctgggcaggaaggtggtggtggtgcgctgtgagggcatcaacatcagcggcaacttctacagaaacaagctgaagtacctggccttcctgaggaagaggatgaacaccaaccccagccggggcccctaccacttccgggcccccagccgcatcttctggaggacagtgcggggcatgctgccccacaagaccaagaggggccaggccgccctggaccggctgaaggtgtttgatggcatccccccaccctatgacaagaagaagaggatggtggtgcctgctgccctgaaggtggtgcggctgaagcccaccaggaagtttgcctacctgggccgcctggcccacgaggtgggctggaagtaccaggccgtgacagccaccctggaggagaagaggaaggagaaggccaagatccactacaggaagaagaagcagctgatgaggctgaggaagcaggccgagaagaatgtggagaagaagattgacaagtacacagaggtgctgaagacccacggcctgctggtgtag

SEQ ID NO: 20313 - DNA, 690 bp, Artificial Sequence; identical to SEQ ID NO: 18357
  Description of Artificial Sequence: Synthetic coding sequence

SEQ ID NO: 20314 - DNA, 2283 bp, Artificial Sequence
  Description of Artificial Sequence: Synthetic coding sequence
atgatggaggagagagctgctgctgctgtggccgctgctgccagcagctgccggcccctgggcagcggggccggccctggccccactggagctgcccctgtgtctgccccagcccctggccctggccctgctgggaagggcggcggcggcggcggcagccctggccccacagctggccctgagcccctgagcctgcccggcatcctgcacttcatccagcacgagtgggccaggtttgaagctgagaaggcccgctgggaggccgagagagctgagctgcaggcccaggtggccttcctgcagggcgagaggaagggccaggagaacctgaagacagacctggtgcggcgcatcaagatgctggagtatgccctgaagcaggagcgggccaagtaccacaagctgaagtttggaacagacctgaaccagggcgagaagaaggcagatgtgtctgagcaggtgtccaatggacctgtggagagcgtgaccctggagaacagccccctggtgtggaaggagggccggcagctgctgcggcagtacctggaggaggtgggctacacagacaccatcctggacatgaggagcaagagggtgcgcagcctgctgggccgcagcctggagctgaatggagctgtggagcccagcgagggcgccccccgggcccctcctggccctgctggcctgagcggcggggagagcctgctggtgaagcagatcgaggagcagatcaagagaaatgctgctgggaaggatggcaaggagcggctgggcggctctgtgctgggccagatccccttcctgcagaactgtgaagatgaggacagtgatgaagatgatgagctggacagcgtgcagcacaagaagcagagggtgaagctgcccagcaaggccctggtgcctgagatggaggatgaagatgaagaagatgacagtgaagatgccatcaatgaatttgacttcctgggcagcggggaggatggagagggcgccccagacccccggcgctgcaccgtggatggcagcccccatgagctggagagcagaagagtgaagctgcagggcatcctggccgacctgagagatgtggatggcctgccccccaaggtgactggacctcctcctggcaccccccagccccggccccatgagggcagctttggcttcagcagtgatgtgttcatcatggacaccatcggcggcggggaggtgtccctgggggacctggccgacctgactgtgaccaatgacaatgacctgagctgtgacctgagtgacagcaaggatgccttcaagaagacctggaaccccaagttcaccctgcggagccactatgatggcatccgcagcctggccttccaccacagccagagcgccctgctgacagcctctgaagatggcaccctgaagctgtggaacctgcagaaggctgtgacagccaagaagaatgctgccctggatgtggagcccatccacgccttccgggcccaccggggccctgtgctggccgtggccatgggcagcaacagcgagtactgctacagcggcggcgcagatgcctgcatccacagctggaagatcccagacctgtccatggacccctatgatggctatgaccccagcgtgctgagccacgtgctggagggccatggagatgctgtgtggggcctggccttcagccccaccagccagaggctggccagctgcagcgcagatggcaccgtgcgcatctgggaccccagcagcagcagccctgcctgcctgtgcaccttccccacagccagcgagcacggcgtgcccacctctgtggccttcaccagcacagagcccgcccacatcgtggccagcttccgcagcggggacacagtgctgtatgacatggaggtgggcagcgccctgctgaccctggagagccggggcagcagcggccccacccagatcaaccaggtggtgagccaccccaaccagcccctgaccatcacagcccatgatgaccggggcatccgcttcctggacaacagaacaggcaagcctgtgcacagcatggtggcccacctggatgctgtgacctgcctggccgtggaccccaatggagccttcctgatgagcggcagccatgactgcagcctgcggctgtggagcctggacaacaagacctgtgtgcaggagatcacagcccacaggaagaagcatgaggaggccatccatgctgtggcctgccaccccagcaaggccctgattgccagcgctggagcagatgccctggccaaggtgtttgtgtag

SEQ ID NO: 20315 - DNA, 327 bp, Artificial Sequence
  Description of Artificial Sequence: Synthetic coding sequence
atgaccccagaggagctgcagaagcgggaggaggaggagttcaacacaggccccctgtctgtgctgacccagagcgtgaagaacaacacccaggtgctgatcaactgcaggaacaacaagaagctgctgggccgggtgaaggcctttgacagacactgcaacatggtgctggagaatgtgaaggagatgtggacagaggtgcccaagagcggcaagggcaagaagaagagcaagcctgtgaacaaggaccgctacatcagcaagatgttcctgcggggggacagcgtgattgtggtgctgaggaaccccctgattgctgggaagtag

SEQ ID NO: 20316 - DNA, 1275 bp, Artificial Sequence
  Description of Artificial Sequence: Synthetic coding sequence
atggtgcagaccctgtactacagcgctgaccacaagctgctggatggcaacctgctggatggccaggccgaggtgtttggaagtgatgatgaccacatccagtttgtgcagaagaagcccccaagagaaaatggccacaagcagatcagcagcagcagcacaggctgcctgagcagccccaatgccaccgtgcagagccccaagcatgagtggaagatcgtggccagcgagaagaccagcaacaacacctacctgtgcctggccgtgctggatggcatcttctgtgtgatcttcctgcacggcaggaacagcccccagagcagccccaccagcacccccaagctgagcaagagcctgagctttgagatgcagcaggatgagctgattgagaagcccatgagccccatgcagtatgcccggagcggcctgggcacagctgagatgaatggcaagctgattgctgctgggggctacaaccgggaggagtgcctgaggacagtggagtgctacaacccccacacagaccactggagcttcctggcccccatgaggaccccccgggcccgcttccagatggctgtgctgatgggccagctgtatgtggtgggcggcagcaatggccacagtgatgacctgagctgtggggagatgtatgacagcaacattgatgactggatccctgtgcctgagctgcggaccaaccgctgcaatgctggggtgtgtgccctgaatggcaagctgtacatcgtgggcggcagtgacccctacggccagaagggcctgaagaactgtgatgtgtttgatcctgtgaccaagctgtggaccagctgtgcccccctgaacatcagaagacaccagagcgctgtgtgtgagctgggcggctacctgtacatcattggaggagctgagagctggaactgcctgaacacagtggagcgctacaaccctgagaacaacacctggaccctcatcgcccccatgaatgtggccaggagaggagctggggtggccgtgctgaatggcaagctgtttgtgtgtggcggctttgatggcagccacgccatcagctgtgtggagatgtatgaccccaccagaaatgagtggaagatgatgggcaacatgaccagccccaggagcaatgccggcatcgccaccgtgggcaacaccatctatgctgtgggcggctttgatggaaatgagttcctgaacacagtggaggtgtacaacctggagagcaatgagtggagcccctacaccaagatcttccagttctag

SEQ ID NO: 20317 - DNA, 483 bp, Artificial Sequence
  Description of Artificial Sequence: Synthetic coding sequence
atgaacaatgcccgctacctgtggaagaggatccccccagccatcaagagcgccaacagcgagctgggcggcatctggagcgtgggccagaggatctggcagagggacttccctggcatctacaccaccatcaatgcccaccagtggagcgagaccgtgcagcccatcatggaggccctgagagatgccacccggcggcgggcctttgccctggtgtcccaggcctacaccagcatcatcgcagatgactttgctgcctttgtgggcctgcctgtggaggaggccgtgaagggcatcctggagcagggctggcaggccgacagcaccaccaggatggtgctgcccaggaagcctgtggccggggccctggatgtgtccttcaacaagttcatccccctgtctgagcccgcccctgtgccccccatccccaatgagcagcagctggcccggctgacagattatgtggccttcctggagaactag

SEQ ID NO: 20318 - DNA, 927 bp, Artificial Sequence
  Description of Artificial Sequence: Synthetic coding sequence
atgatggaggagatcagcatcatggtggcctatgatgcccacgtgttcagccagctgcatgatgaggacttcctgaccagcctggtggccatcagcaagcccaggtccatggtgcccaccaagaagctgaagaagtatgagaaggagtaccagaccatgagggagagccagctgcagcaggaggaccccatggaccgctacaagcgggagaacagaaggctgcaggaggcctccatgaggctggagcaggagaatgatgacctggcccacgagctggtgaccagcaagatcgccctgagaaatgacctggaccaggccgaggacaaggcagatgtgctgaacaaggagctgctgctgaccaagcagaggctggtggagacagaggaggagaagaggaagcaggaggaggagacagcccagctgaaggaggtgttcaggaagcagctggagaaggccgagtatgagatcaagaagaccacagccatcatcgccgagtacaagcagatctgcagccagctgagcacccggctggagaagcagcaggccgccagcaaggaggagctggaggtggtgaagggcaagatgatggcctgcaagcactgcagcgacatcttcagcaaggagggcgccctgaagctggccgccaccggccgggaggaccagggcattgaaacagatgatgagaaggacagcctgaagaagcagctgcgggagatggagctggagctggcccagaccaagctgcagctggtggaggccaagtgcaagatccaggagctggagcaccagagaggagccctgatgaatgagatccaggccgccaagaacagctggttcagcaagaccctgaacagcatcaagacagccaccggcacccagcccctgcagcctgcccctgtgacccagccccccaaggagagcacctag

SEQ ID NO: 20319 - DNA, 3600 bp, Artificial Sequence; identical to SEQ ID NO: 18409
  Description of Artificial Sequence: Synthetic coding sequence

SEQ ID NO: 20320 - DNA, 2337 bp, Artificial Sequence
  Description of Artificial Sequence: Synthetic coding sequence
cgcatccaggagcagctggagagcagcttcaccggcctgacagatgagaaggtgaaggcctacctgagcctgcacccccaggtgctggatgaatttgtgtctgagagcgtgtctgctgagaccgtggagaagtggctgaagaggaagaacaacaagtcagaagatgaaagtgcccccaaggaggtgagccgctaccaggacaccaacatgcagggcgtggtgtatgagctgaacagctacatcgagcagaggctggacacaggaggagacaaccagctgctgctgtatgagctgagcagcatcatcaagatcgccaccaaggcagatggctttgccctgtacttcctgggggagtgcaacaacagcctgtgcatcttcaccccacctggcatcaaggagggcaagcccaggctcatcccagctggccccatcacccagggcaccaccgtgtctgcctacgtggccaagagcaggaagaccctgctggtggaggacatcctgggagatgagcgcttcccccggggcaccggcctggagagcggcacccgcatccagagcgtgctgtgcctgcccatcgtgacagccatcggggacctgattggcatcctggagctgtaccgccactggggcaaggaggccttctgcctgagccaccaggaggtggccacagccaacctggcctgggcctctgtggccatccaccaggtgcaggtgtgccggggcctggccaagcagacagagctgaatgacttcctgctggatgtgtccaagacctactttgacaacatcgtggccatcgacagcctgctggagcacatcatgatctatgccaagaacctggtgaatgctgacagatgtgccctcttccaggtggaccacaagaacaaggagctgtacagcgacctgtttgatattggagaggagaaggagggcaagcctgtgttcaagaagaccaaggagatccgcttcagcattgaaaaaggaattgctggccaggtggccaggactggagaggtgctgaacatcccagatgcctatgctgacccccgcttcaaccgggaggtggacctgtacacaggctacaccaccaggaacatcctgtgcatgcccatcgtgtcccggggcagcgtcatcggcgtggtgcagatggtgaacaagatcagcggcagcgccttcagcaagacagatgagaacaacttcaagatgtttgctgtgttctgtgccctggccctgcactgtgccaacatgtaccaccgcatccgccacagcgagtgcatctacagagtgaccatggagaagctgagctaccacagcatctgcaccagcgaggagtggcagggcctgatgcagttcaccctgcctgtgcggctgtgcaaggagattgagctgttccactttgacatcggcccctttgagaacatgtggccaggcatctttgtgtacatggtgcacaggagctgtggcaccagctgctttgagctggagaagctgtgccgcttcatcatgtctgtgaagaagaactacagaagagtgccctaccacaactggaagcatgctgtgacagtggcccactgcatgtatgccatcctgcagaacaaccacaccctcttcacagacctggagaggaagggcctgctgattgcctgcctgtgccacgacctggaccaccggggcttcagcaacagctacctgcagaagtttgaccaccccctggccgccctgtacagcaccagcaccatggagcagcaccacttcagccagacagtgtccatcctgcagctggagggccacaacatcttcagcaccctgagcagcagtgaatatgagcaggtgctggagatcatcaggaaggccatcatcgccacagacctggccctgtacttcggcaacaggaagcagctggaggagatgtaccagacaggcagcctgaacctgaacaaccagagccaccgggacagagtgattggcctgatgatgacagcctgtgacctgtgcagcgtgaccaagctgtggcctgtgaccaagctgacagccaatgacatctatgcagagttctgggccgagggagatgagatgaagaagctgggcatccagcccatccccatgatggaccgggacaagaaggatgaggtgccccagggccagctgggcttctacaatgctgtggccatcccctgctacaccaccctgacccagatcctgcccccaacagagcccctgctgaaggcctgccgggacaacctgagccagtgggagaaggtgatccggggggaggagacagccacctggatcagcagccccagcgtggcccagaaggccgccgcctctgaagattag

SEQ ID NO: 20321 - DNA, 1281 bp, Artificial Sequence; identical to SEQ ID NO: 19686
  Description of Artificial Sequence: Synthetic coding sequence

SEQ ID NO: 20322 - DNA, 1779 bp, Artificial Sequence
  Description of Artificial Sequence: Synthetic coding sequence
atggatgtgatgctggagaactactgccacctgatctctgtgggctgccacatgaccaagccagatgtgatcctgaagctggagcggggggaggagccctggaccagctttgctggccacacctgcctggaggagaactggaaggccgaggacttcctggtgaagttcaaggagcaccaggagaagtacagccgctctgtggtgtccatcaaccacaagaagctggtgaaggagaagagcaagatctatgagaagaccttcaccctgggcaagaaccctgtgaacagcaagaacctgcccccagaatatgacacccacggccgcatcctgaagaatgtgtctgagctgatcatcagcaacctgaacccagccaggaagaggctgtctgagtacaacggctacggcaagagcctgctgagcaccaagcaggagaccacccaccctgaggtgaagagccacaaccagagcgcccgggccttcagccacaatgaggtgctgatgcagtaccagaagacagagaccccagcccagagctttggctacaatgactgtgagaagagcttcctgcagaggggcggcctcatcacccacagccggccctacaagggggagaaccccagcgtgtacaacaagaagagaagagccaccaacatcgagaagaagcacacctgcaatgaatgtgggaagagcttctgcaggaagtctgtgctgatcctgcaccagggcatccacagcgaggagaagccctaccagtgccaccagtgtggaaatgccttccggaggaagagctacctgattgaccaccagaggacccacactggagagaagccctttgtgtgcaatgaatgtgggaagagcttccggctgaagacagccctgacagaccaccagaggacccacactggagagaagagctatgaatgtctgcagtgcagaaatgccttccggctgaagagccacctgatccgccaccagaggacccacactggagagaagccctatgaatgtaatgactgtgggaagagcttccggcagaagaccaccctgagcctgcaccagaggatccacactggagagaagccctacatctgcaaggaatgtgggaagagcttccaccagaaggccaacctgactgtgcaccagaggacccacactggagagaagccctacatctgcaatgaatgtgggaagagcttcagccagaagaccaccctggccctgcacgagaagacccacaatgaggagaagccctacatctgcagtgaatgtgggaagagcttccggcagaagaccaccctggtggcccaccagaggacccacactggagagaagagctatgaatgtccccactgcggcaaggccttcaggatgaagagctacctgattgaccaccacaggacccacactggagagaagccctatgaatgtaatgaatgtgggaagagcttcagccagaagaccaacctgaacctgcaccagaggatccacactggagagaagccctacgtgtgcaatgaatgtgggaagagcttccggcagaaggccaccctgactgtgcaccagaagatccacacaggccagaagagctatgaatgtccccagtgtgggaaggccttcagcaggaagagctacctgatccaccaccagaggacccacactggagagaagccctacaagtgcagtgaatgtgggaagtgcttccggcagaagaccaacctgattgtgcaccagaggacccacactggaggagaagatggcctgaccggctgcctgtcctag

SEQ ID NO: 20323 - DNA, 645 bp, Artificial Sequence
  Description of Artificial Sequence: Synthetic coding sequence
atggaggtgactggagtgtctgcccccaccgtgaccgtcttcatcagcagcagcctgaacaccttccgctctgagaagcgctacagccgcagcctgaccatcgccgagttcaagtgcaagctggagctgctggtgggcagccctgccagctgcatggagctggagctgtatggagtggatgacaagttctacagcaagctggaccaggaggatgccctgctgggcagctaccctgtggatgatggctgccgcatccacgtgattgaccacagcggggcccggctgggggagtatgaagatgtgtcccgggtggagaagtacaccatcagccaggaggcctatgaccagaggcaggacacagtgcgctccttcctgaagaggagcaagctgggccgctacaatgaggaggagcgggcccagcaggaggccgaggccgcccagaggctggccgaggagaaggcccaggccagcagcatccctgtgggcagccgctgtgaggtgcgggccgccggccagagcccccggcggggcaccgtgatgtatgtgggcgcctggctggccggccctgtgcccggcagccgggcccccaggcctggaggaaatgtgggcggcaccgtggagccccggcggcccaggtctgcctag

SEQ ID NO: 20324 - DNA, 189 bp, Artificial Sequence
  Description of Artificial Sequence: Synthetic coding sequence
atgagcatccagtggaagacccggcagctgcagagcaagctgcatgaagctgacatcgtggtgctgggcagccccaagccagaggagatccccctgacctggatccagcccggcaccaccgtgctgaactgcagccatgacttcctgtctgagagcctcatcatcatccggaggatggccatcttctag

SEQ ID NO: 20325 - DNA, 1269 bp, Artificial Sequence
  Description of Artificial Sequence: Synthetic coding sequence
atgtaccccaaccccctcatctactgcacctgctgggacccctggaacctgggccccaggaagctgatcaagaccccccagctgcccaggaagaacagcacaggcagcagcaagctgacccccctggtgcctgcccccaagaaccacaactacctgcagcccaccaagcctgtggtgagccccaagatgaagatccacagcgcccggcaggaggagaccaacaagagcttctatgaggtgatcaacgtgtccccaggctaccagctggtgaggaaccgggagcagatctctgtgaccctgggagatgagatgtttgacaggaagaagcgctgggagagcgagatcccagacaagggccgcttcagcaggaccaacatcatcagtgacctggaggagcagatcagcgagctgacagccatcatcgagcagatgaacagagaccaccagagcgcccagaagctgctgagcagcgagatggacctgcgctgtgccgagatgaagcagaactttgagaacaagaaccgggagctgaaggaggcccatgaagctgagctgtctgagctggagaacaactacaaggccgccctgaaggccgagaagctggccgcccaggagaagctggaggagatgggcaaggagtacaagtacctgaagaacatgttccgcacctaccaggacagcatctatgatgagatggaggagaagtggagcaagcagaaggccaagtggaagaaggatgagaagtttgagcgggagaacatcctgctgcagcagaagaagaagatgaccaagaagtttgagatggagagcggggaggaggacaagaagatcaatgaaagctgcagcgctgtgtttgagaacttcatccaggagaaggaggagctgctgaagcagcaccagagcgacaccctgcagctggaggagctgaggaagaccaaggaggtgatgcaggaggagctgcacgcccaggccctgatcctggagagcctgaacaccaacctgtactacacccagctggagctgcagaaggagaaggccatcgtgggcaacctggagaagatgctgcagaccaagtttgctgagacagaggagaagtacaagcacaccatccagatcctgacagaggagaacatccacctgaagcagaagatcatcagcaagaatgaggagatctgtgagggctgcagcggccgcctggccagcatcaccgtgtccaaggatgacagcgacacagtgcaggacggcagcaagaagggccaggagagctag

SEQ ID NO: 20326 - DNA, 1380 bp, Artificial Sequence
  Description of Artificial Sequence: Synthetic coding sequence
atggtgcccttcggcccctttgccttcatgcctgggaagctggtgcacaccaatgaggtgacagtgctgctgggggacaactggtttgccaagtgcagcgccaagcaggccgtgggcctggtggagcacaggaaggagcacgtgaggaagaccattgatgacctgaagaaggtgatgaagaactttgagagccgggtggagttcacagaggacctgcagaagatgtctgatgctgctggggacatcgtggacatccgggaggagatcaagtgtgactttgagttcaaggccaagcacagaattgcccacaagccccacagcaagcccaagaccagtgacatctttgaagctgacatcgccaatgatgtgaagagcaaggacctgctggccgacaaggagctgtgggcccggctggaggagctggagcggcaggaggagctgctgggggagctggacagcaagccagacacagtgattgccaatggagaggacaccaccagcagcgaggaggagaaggaggacaggaacaccaacgtgaatgccatgcaccaggtgacagacagccacaccccctgccacaaggatgtggccagcagcgagcccttcagcggccaggtgaacagccagctgaactgcagcgtgaatggcagcagcagctaccacagtgatgatgatgatgatgatgatgatgatgatgatgatgacaacattgatgatgatgatggagacaatgaccacgaggccctgggcgtgggggacaacagcatccccaccatctacttcagccacacagtggagcccaagagggtgcgcatcaacacaggcaagaacaccaccctgaagttcagcgagaagaaggaggaggccaagaggaagaggaagaacagcactggaagtggccacagcgcccaggagctgcccaccatccgcaccccagctgacatctaccgggcctttgtggatgtggtgaatggagaatatgtgcccaggaagagcatcctgaagagccgcagccgggagaacagcgtgtgcagcgacaccagcgagagcagcgctgctgagtttgatgaccggcggggcgtgctgcggagcatcagctgtgaggaggccacctgcagcgacaccagcgagagcatcctggaggaggagccccaggagaaccagaagaagctgctgcccctgtctgtgaccccagaggccttcagcggcaccgtcatcgagaaggagtttgtgagccccagcctgaccccacctccagccatcgcccacccagccctgcccaccatccctgagaggaaggaggtgctgctggaggccagcgaggagaccgggaagagggtgtccaagttcaaggccgcccggctgcagcagaaggactag

SEQ ID NO: 20327 - DNA, 1068 bp, Artificial Sequence
  Description of Artificial Sequence: Synthetic coding sequence
atgagggagatcgtgcacatccaggccggccagtgtggcaaccagatcggggccaagttctgggaggtgatcagtgatgagcacggcatcgaccccaccggcagctaccatggagacagcgacctgcagctgctgacccacagcctgggcggcggcactggaagtggcatgggcaccctgctgatcagcaagatccgggaggagtacccagaccgcatcatgaacaccttctctgtgatgcccagccccaaggtgtctgacacagtggtggagccctacaatgccaccctgtctgtgcaccagctggtggagaacacagatgagacctacagcattgacaatgaggccctgtatgacatctgcttccgcaccctgaagctgaccacccccacctacggggacctgaaccacctggtgtctgccaccatgtctggagtgaccacctgcctgcgcttccctggccagctgaatgctgacctgaggaagctggccgtgaacatggtgcccttcccccggctgcacttcttcatgcctggctttgcccccctgaccagccggggcagccagcagtaccgggccctgactgtgcctgagctgacccagcagatgtttgacagcaagaacatgatggccgcctgtgaccccaggcatggccgctacctgactgtggccgccatcttccggggccgcatgtccatgaaggaggtggatgagcagatgctgaatgtgcagaacaagaacagcagctactttgtggagtggatccccaacaacgtgaagacagctgtgtgtgacatccccccccggggcctgaagatgtctgccaccttcatcggcaacagcacagccatccaggagctgttcaagaggatcagcgagcagttcaccgccatgttccggaggaaggccttcctgcactggtacacaggagagggcatggatgagatggagttcacagaagctgagagcaacatgaatgacctggtgtctgagtaccagcagtaccaggatgccacagcagatgagcagggcgagtttgaggaggaggagggggaggatgaggcctag

SEQ ID NO: 20328 - DNA, 255 bp, Artificial Sequence; identical to SEQ ID NO: 19329
  Description of Artificial Sequence: Synthetic coding sequence

SEQ ID NO: 20329 - DNA, 1416 bp, Artificial Sequence
  Description of Artificial Sequence: Synthetic coding sequence
atgaagatgcaggtgttctgcaagagcattgaggacatgacagtgaaggccgagcagagccagcaggaggccgccaagaagcatgaggaggagaagaaggagctggagaggaagctgagtgacctggagaagaagatggagaccagccacaaccagtgccaggagctgaaggcccgctatgaaagagccaccagcgagaccaagaccaagcatgaggagatcctgcagaacctgcagaagaccctgctggacacagaggacaagctgaagggggcccgggaggagaacagcggcctgctgcaggagctggaggagctgaggaagcaggccgacaaggccaaggccgcccagacagcagaagatgccatgcagatcatggagcagatgaccaaggagaagacagagaccctggccagcctggaggacaccaagcagaccaatgccaagctgcagaatgagctggacaccctgaaggagaacaacctgaagaatgtggaggagctgaacaagagcaaggagctgctgactgtggagaaccagaagatggaggagttcaggaaggagattgagaccctgaagcaggccgccgcccagaagagccagcagctgagcgccctgcaggaggagaatgtgaagctggccgaggagctgggccgcagcagagatgaggtgaccagccaccagaagctggaggaggagaggtctgtgctgaacaaccagctgctggagatgaagaagcgggagagcaagttcatcaaggatgctgatgaggagaaggccagcctgcagaagagcatcagcatcaccagcgccctgctgacagagaaggatgctgagctggagaagctgagaaatgaggtgacagtgctgcggggagaaaatgccagcgccaagagcctgcacagcgtggtgcagaccctggagagtgacaaggtgaagctggagctgaaggtgaagaacctggagctgcagctgaaggagaacaagaggcagctgagcagcagcagcggcaacacagacacccaggctgatgaagatgagcgggcccaggagagccaggtgatgattgacttcctgaacagcgtgattgtggacctgcagaggaagaaccaggacctgaagatgaaggtggagatgatgtctgaggccgccctgaatggaaatggagatgacctgaacaactatgacagtgatgaccaggagaagcagagcaagaagaagcccaggctcttctgtgacatctgtgactgctttgacctgcatgacacagaggactgccccacccaggcccagatgtctgaggaccccccccacagcacccaccacggcagcagaggagaggagcggccctactgtgagatctgtgagatgtttggccactgggccaccaactgcaatgatgatgagaccttctag

SEQ ID NO: 20330 - DNA, 1602 bp, Artificial Sequence
  Description of Artificial Sequence: Synthetic coding sequence
atgagcagctgtgtgagcagccagcccagcagcaacagagctgccccccaggatgagctgggcggccggggcagcagcagcagcgagagccagaagccctgtgaggccctgcggggcctgagcagcctgagcatccacctgggcatggagagcttcatcgtggtgacagaatgtgagcccggctgtgctgtggacctgggcctggcccgggaccggcccctggaggctgatggccaggaggtgcccctggacaccagcggcagccaggcccggccccacctgagcggcaggaagctgagcctgcaggagaggagccagggcggcctggccgccggcggcagcctggacatgaatggccgctgcatctgccccagcctgccctacagccctgtgagcagcccccagagcagcccccggctgccccggcggcccaccgtggagagccaccacgtgtccatcaccggcatgcaggactgtgtgcagctgaaccagtacaccctgaaggatgaaattggcaagggcagctatggagtggtgaagctggcctacaatgaaaatgacaacacctactatgccatgaaggtgctgagcaagaagaagctgatccggcaggccggcttcccccggcggcccccaccccggggcaccaggcctgcccctgggggctgcatccagccccggggccccatcgagcaggtgtaccaggagatcgccatcctgaagaagctggaccaccccaacgtggtgaagctggtggaggtgctggatgaccccaatgaagaccacctgtacatggtgtttgagctggtgaaccagggccctgtgatggaggtgcccaccctgaagcccctgtctgaggaccaggcccgcttctacttccaggacctgatcaagggcatcgagtacctgcactaccagaagatcatccaccgggacatcaagcccagcaacctgctggtgggggaggatggccacatcaagattgctgactttggagtgtccaatgagttcaagggcagtgatgccctgctgagcaacacagtgggcaccccagccttcatggcccctgagagcctgtctgagaccaggaagatcttcagcggcaaggccctggatgtgtgggccatgggcgtgaccctgtactgctttgtgtttggccagtgccccttcatggatgagcgcatcatgtgcctgcacagcaagatcaagagccaggccctggagttcccagaccagcctgacattgctgaggacctgaaggacctgatcaccaggatgctggacaagaaccctgagagcagaattgtggtgcctgagatcaagctgcacccctgggtgaccaggcatggagctgagcccctgcccagtgaagatgagaactgcaccctggtggaggtgacagaggaggaggtggagaacagcgtgaagcacatccccagcctggccaccgtcatcctggtgaagaccatgatcaggaagaggagctttggaaacccctttgagggcagccggcgggaggagaggagcctgagcgcccctggcaacctgctgaccaagaagcccacccgggagtgtgagagcctgtctgagctgaagacctag

SEQ ID NO: 20331 - DNA, 1671 bp, Artificial Sequence
  Description of Artificial Sequence: Synthetic coding sequence
atgagcagctgtgtgagcagccagcccagcagcaacagagctgccccccaggatgagctgggcggccggggcagcagcagcagcgagagccagaagccctgtgaggccctgcggggcctgagcagcctgagcatccacctgggcatggagagcttcatcgtggtgacagaatgtgagcccggctgtgctgtggacctgggcctggcccgggaccggcccctggaggctgatggccaggaggtgcccctggacaccagcggcagccaggcccggccccacctgagcggcaggaagctgagcctgcaggagaggagccagggcggcctggccgccggcggcagcctggacatgaatggccgctgcatctgccccagcctgccctacagccctgtgagcagcccccagagcagcccccggctgccccggcggcccaccgtggagagccaccacgtgtccatcaccggcatgcaggactgtgtgcagctgaaccagtacaccctgaaggatgaaattggcaagggcagctatggagtggtgaagctggcctacaatgaaaatgacaacacctactatgccatgaaggtgctgagcaagaagaagctgatccggcaggccggcttcccccggcggcccccaccccggggcaccaggcctgcccctgggggctgcatccagccccggggccccatcgagcaggtgtaccaggagatcgccatcctgaagaagctggaccaccccaacgtggtgaagctggtggaggtgctggatgaccccaatgaagaccacctgtacatggtgtttgagctggtgaaccagggccctgtgatggaggtgcccaccctgaagcccctgtctgaggaccaggcccgcttctacttccaggacctgatcaagggcatcgagtacctgcactaccagaagatcatccaccgggacatcaagcccagcaacctgctggtgggggaggatggccacatcaagattgctgactttggagtgtccaatgagttcaagggcagtgatgccctgctgagcaacacagtgggcaccccagccttcatggcccctgagagcctgtctgagaccaggaagatcttcagcggcaaggccctggatgtgtgggccatgggcgtgaccctgtactgctttgtgtttggccagtgccccttcatggatgagcgcatcatgtgcctgcacagcaagatcaagagccaggccctggagttcccagaccagcctgacattgctgaggacctgaaggacctgatcaccaggatgctggacaagaaccctgagagcagaattgtggtgcctgagatcaagctgcacccctgggtgaccaggcatggagctgagcccctgcccagtgaagatgagaactgcaccctggtggaggtgacagaggaggaggtggagaacagcgtgaagcacatccccagcctggccaccgtcatcctggtgaagaccatgatcaggaagaggagctttggaaacccctttgagggcagccggcgggaggagaggagcctgagcgcccctggcaacctgctgaccaagaagcccacccgggagtgtgagagcctgtctgagctgaagggcaccaagaagaagaagggcctggacagcatgaccagcacagtggccgccggctggctggaccggcgggtgtag

SEQ ID NO: 20332 - DNA, 309 bp, Artificial Sequence
  Description of Artificial Sequence: Synthetic coding sequence
atgctgtctgaggaggagaaggaggagctgaaggccgagctggtgcagctggaggatgagatcaccaccctgcggcaggtgctgagcgccaaggagcggcacctggtggagatcaagcagaagctgggcatgaacctgatgaatgagctgaagcagaacttcagcaagtcctggcatgacatgcagaccaccacagcctacaagaagacccatgagaccctgagccatgctggccagaaggccacagctgccttcagcaatgtgggcacagccatcagcaagaagtttggagacatgaggaggaagtag

SEQ ID NO: 20333 - DNA, 615 bp, Artificial Sequence
  Description of Artificial Sequence: Synthetic coding sequence
atggaggccgagcccaagggcctgctggagacagagcccctgcagggcacagatgaagatgctgtggccagcgctgacttcagctccatgctgtctgaggaggagaaggaggagctgaaggccgagctggtgcagctggaggatgagatcaccaccctgcggcaggtgctgagcgccaaggagcggcacctggtggagatcaagcagaagctgggcatgaacctgatgaatgagctgaagcagaacttcagcaagtcctggcatgacatgcagaccaccacagcctacaagaagacccatgagaccctgagccacgccggccagaaggccacagctgccttcagcaatgtgggcacagccatcagcaagaagtttggagacatgagctacagcatccgccacagcatctccatgcctgccatgaggaacagccccaccttcaagagctttgaggagcgggtggagaccaccgtgaccagcctgaagaccaaggtgggcggcaccaaccccaatggaggcagctttgaggaggtgctgagcagcacagcccacgccagcgcccagagcctggccggcggcagcaggaggaccaaggaggaggagctgcagtgctag

SEQ ID NO: 20334 - DNA, 369 bp, Artificial Sequence
  Description of Artificial Sequence: Synthetic coding sequence
tgatacctggtggccctgggctgcatcaagcccctgtgtgacctgctgactgtgatggacagcaagatcgtgcaggtggccctgaatggcctggagaacatcctgcggctgggggagcaggagagcaagcagaatggaattggcatcaacccctactgtgccctgattgaggaggcctacggcctggacaagattgagttcctgcagagccatgagaaccaggagatctaccagaaggcctttgacctgattgagcactactttggagtggaggaggatgaccccagcatcgtgccccaggtggatgagaaccagcagcagttcatcttccagcagcaggaggcccccatggatggcttccagctgtag

SEQ ID NO: 20335 - DNA, 1137 bp, Artificial Sequence
  Description of Artificial Sequence: Synthetic coding sequence
atggaggtgaagcccccacctggccggccccagcctgacagcggcagaagaagaagaagaagaggagaggagggccatgaccccaaggagcctgagcagctgaggaagctgttcatcggcggcctgagctttgagaccacagatgacagcctgcgggagcactttgagaagtggggcaccctgacagactgtgtggtgatgagggacccccagaccaagaggagccggggcttcggctttgtgacctacagctgtgtggaggaggtggatgctgccatgtgtgcccggccccacaaggtggatggccgggtggtggagcccaagagagctgtgtcccgggaggacagcgtgaagccaggggcccacctgactgtgaagaagatctttgtgggcggcatcaaggaggacacagaggagtacaacctgcgggactactttgagaagtatggcaagattgagaccatcgaggtgatggaggaccggcagagcggcaagaagaggggctttgcctttgtgacctttgatgaccatgacacagtggacaagatcgtggtgcagaagtaccacaccatcaatggccacaactgtgaggtgaagaaggccctgagcaagcaggagatgcagagcgctggcagccagaggggccggggcggcggcagcggcaacttcatgggccggggcggcaactttggaggcggcggcggcaactttggccggggcggcaactttggaggccggggcggctatggaggcggcggcggcggcagccggggcagctatggaggaggagatggcggctacaacggctttggaggagatggcggcaactatggaggcggccctggctacagcagcagaggaggctatggaggcggcggccctggctacggcaaccagggcggcggctatggaggcggcggcggctatgatggctacaatgaaggaggcaactttggaggcggcaactatggaggcggcggcaactacaatgactttggaaactacagcggccagcagcagagcaactacggccccatgaagggcggcagctttggaggccgcagcagcggcagcccctacggcggcggctacggcagcggcggcggcagcggcggctacggcagccgccgcttctag

SEQ ID NO: 20336 - DNA, 3063 bp, Artificial Sequence
  Description of Artificial Sequence: Synthetic coding sequence
atgaggcgcttcctgcggcccggccatgaccctgtgcgggagcggctgaagagggacctcttccagttcaacaagacagtggagcacggcttcccccaccagcccagcgccctgggctacagccccagcctgcgcatcctggccatcggcaccaggtctggggccatcaagctgtatggagcccctggggtggagttcatgggcctgcaccaggagaacaatgctgtgacccagatccacctgctgcccggccagtgccagctggtgaccctgctggatgacaacagcctgcacctgtggagcctgaaggtgaagggcggggccagcgagctgcaggaggatgagagcttcaccctgcggggccccccaggagctgcccccagcgccacccagatcaccgtggtgctgccccacagcagctgtgagctgctgtacctgggcacagagagcggaaatgtgtttgtggtgcagctgcctgccttccgggccctggaggacaggaccatcagcagtgatgctgtgctgcagaggctgcctgaggaggcccggcacagaagagtgtttgagatggtggaggccctgcaggagcacccccgggaccccaaccagatcctgattggctacagccggggcctggtggtgatctgggacctgcagggcagccgggtgctgtaccacttcctgagcagccagcagctggagaacatctggtggcagagagatggccgcctgctggtgtcctgccacagtgatggcagctactgccagtggcctgtgtcctctgaggcccagcagcctgagcccctgcggagcctggtgccctacggccccttcccctgcaaggccatcacccgcatcctgtggctgaccacccggcagggcctgcccttcaccatcttccagggcggcatgccccgggccagctatggagacagacactgcatcagcgtcatccatgatggccagcagacagcctttgacttcaccagccgggtgattggcttcaccgtgctgacagaagctgaccctgctgccacctttgatgacccctatgccctggtggtgctggccgaggaggagctggtggtgattgacctgcagacagctggctggccccctgtgcagctgccctacctggccagcctgcactgcagcgccatcacctgcagccaccacgtgagcaacatccccctgaagctgtgggagcgcatcatcgctgctggcagccggcagaatgcccacttcagcaccatggagtggcccattgatggcggcaccagcctgaccccagccccaccccagagggacctgctgctgaccggccatgaagatggcaccgtgcgcttctgggatgccagcggcgtgtgcctgcggctgctgtacaagctgagcacagtgcgggtcttcctgacagacacagaccccaatgaaaacttcagcgcccagggagaagatgagtggccacccctgaggaaggtgggcagctttgacccctacagtgatgacccccggctgggcatccagaagatcttcctgtgcaagtacagcggctacctggccgtggccggcacagctggccaggtgctggtgctggagctgaatgatgaagctgctgagcaggccgtggagcaggtggaggccgacctgctgcaggaccaggagggctaccgctggaagggccacgagcggctggccgcccggagcggccctgtgcgctttgagcccggcttccagccctttgtgctggtgcagtgccagcccccagctgtggtgaccagcctggccctgcacagcgagtggaggctggtggccttcggcaccagccacggcttcggcctgtttgaccaccagcagaggcggcaggtgtttgtgaagtgcaccctgcaccccagcgaccagctggccctggagggccccctgagccgggtgaagagcctgaagaagagcctgcggcagagcttccggaggatgaggaggagccgggtgagcagcaggaagaggcaccctgctggccccccaggagaggcccaggagggcagcgccaaggccgagcggcccggcctgcagaacatggagctggcccctgtgcagaggaagattgaggcccggtctgctgaggacagcttcaccggctttgtgaggaccctgtactttgctgacacctacctgaaggacagcagccgccactgccccagcctgtgggccggcaccaacggcggcaccatctatgccttcagcctgcgggtgcccccagctgagaggaggatggatgagcctgtgcgggcagagcaggccaaggagatccagctgatgcaccgggcccctgtggtgggcatcctggtgctggatggccacagcgtgcccctgcctgagcccctggaggtggcccatgacctgagcaagagcccagacatgcagggcagccaccagctgctggtggtgtctgaggagcagttcaaggtgttcaccctgcccaaggtgtctgccaagctgaagctgaagctgacagccctggagggcagccgggtgcggcgggtgtctgtggcccacttcggcagccggcgggcagaagattatggagagcaccacctggccgtgctgaccaacctgggggacatccaggtggtgtccctgcccctgctgaagccccaggtgcgctacagctgcatcagaagagaagatgtgtctggcatcgccagctgtgtgttcaccaagtatggccagggcttctacctgatcagccccagcgagtttgagcgcttcagcctgagcaccaagtggctggtggagccccgctgcctggtggacagcgctgagaccaagaaccacaggcctggaaatggagctggccccaagaaggcccccagccgggccagaaattctggcacccagagtgatggagaggagaagcagcccggcctggtgatggagcgggccctgctgagtgatgagcgggtgctgaaggagatccagagcaccctggagggggaccggggcagcggcaactggaggagccacagagctgctgtgggctgcagcctgagcaatggaggagctgagtag

SEQ ID NO: 20337 - DNA, 1458 bp, Artificial Sequence
  Description of Artificial Sequence: Synthetic coding sequence
atggctgctgagctgtatgccccagccagcgctgctgctgctgacctggccaacagcaatgctggagctgctgtgggcaggaaggccggccccaggagcccccccagcgccccagccccagcccctcctcctccagccccagccccacccaccctgggcaacaaccaccaggagagccctggctggcgctgctgccggcccaccctgcgggagagaaatgccctgatgttcaacaatgagctgatggctgatgtgcactttgtggtgggccccccaggggccaccaggacagtgcctgcccacaagtatgtgctggccgtgggcagcagcgtcttctacgccatgttttatggagacctggccgaggtgaagtctgagatccacatcccagatgtggagcctgctgccttcctgatcctgctgaagtacatgtacagtgatgaaattgacctggaggccgacacagtgctggccaccctgtatgctgccaagaagtacatcgtgcctgccctggccaaggcctgtgtgaacttcctggagaccagcctggaggccaagaatgcctgtgtgctgctgagccagagccggctgtttgaggagcctgagctgacccagcgctgctgggaggtgattgatgcccaggccgagatggccctgcggtctgagggcttctgtgaaattgaccggcagaccctggagatcatcgtgacccgggaggccctgaacaccaaggaggccgtggtgtttgaagctgtgctgaactgggccgaggccgagtgcaagaggcagggcctgcccatcacccccaggaacaagagacatgtgctgggccgggccctgtacctggtgcgcatccccaccatgaccctggaggagtttgccaatggagctgcccagagcgacatcctgaccctggaggagacccacagcatcttcctgtggtacacagccaccaacaagccccggctggacttccccctgaccaagaggaagggcctggccccccagcgctgccaccgcttccagagcagcgcctaccgcagcaaccagtggagataccggggccgctgtgacagcatccagtttgctgtggaccggcgggtcttcatcgccggcctgggcctgtatggcagcagcagcggcaaggccgagtacagcgtgaagattgagctgaagaggctgggcgtggtgctggcccagaacctgaccaagttcatgtctgatggcagcagcaacaccttccctgtgtggtttgagcaccctgtgcaggtggagcaggacaccttctacacagccagcgctgtgctggatggcagcgagctgagctacttcggccaggagggcatgacagaggtgcagtgtgggaaggtggccttccagttccagtgcagcagtgacagcaccaatggaactggagtgcagggcggccagatccctgagctgatcttctacgcctag

SEQ ID NO: 20338 - DNA, 2883 bp, Artificial Sequence; identical to SEQ ID NO: 18452
  Description of Artificial Sequence: Synthetic coding sequence

SEQ ID NO: 20339 - DNA, 669 bp, Artificial Sequence
  Description of Artificial Sequence: Synthetic coding sequence
atggagcgcatcgagggcgcctctgtgggccgctgtgccgccagcccctacctgcggcccctgaccctgcactaccggcagaatggagcccagaagtcctgggacttcatgaagacccatgacagcgtgacagtgctgctcttcaacagcagccgccgcagcctggtgctggtgaagcagttccggcctgctgtgtatgctggggaggtggagcggcgcttccctggcagcctggccgctgtggaccaggacggcccccgggagctgcagcctgccctgcccggcagcgctggggtgacagtggagctgtgtgccggcctggtggaccagcccggcctgagcctggaggaggtggcctgcaaggaggcctgggaggagtgtggctaccacctggcccccagcgacctgcggcgggtggccacctactggagcggcgtgggcctgaccggcagccggcagaccatgttctacacagaggtgacagatgcccagaggagcggccctgggggcggcctggtggaggagggggagctgattgaggtggtgcacctgcccctggagggcgcccaggcctttgctgatgatcctgacatccccaagaccctgggcgtcatcttcggcgtgtcctggttcctgagccaggtggcccccaacctggacctgcagtag

SEQ ID NO: 20340 - DNA, 876 bp, Artificial Sequence
  Description of Artificial Sequence: Synthetic coding sequence
atgaacatgatctggaggaacagcatcagctgcctgcggctgggcaaggtgccccaccgctaccagagcggctaccaccctgtggcccccctgggcagccgcatcctgacagatcctgccaaggtgtttgagcacaacatgtgggaccacatgcagtggagcaaggaggaggaggccgccgccaggaagaaggtgaaggaaaattctgctgtgcgggtgctgctggaggagcaggtgaagtatgagcgggaggccagcaagtactgggacaccttctacaagatccacaagaacaagttcttcaaggacaggaactggctgctgcgggagttccctgagatcctgcctgtggaccagaagccagaggagaaggcccgggagagctcctgggaccacgtgaagaccagcgccaccaaccgcttcagcaggatgcactgccccaccgtgcctgatgagaagaaccactatgagaagagcagcggcagcagcgagggccagagcaagacagaaagtgacttcagcaacctggacagcgagaagcacaagaagggccccatggagaccggcctcttccctggcagcaatgccaccttccgcatcctggaggtgggctgtggggccggcaacagcgtcttccccatcctgaacaccctggagaacagccctgagagcttcctgtactgctgtgactttgccagcggggctgtggagctggtgaagagccacagcagctaccgggccacccagtgctttgcctttgtgcatgatgtgtgtgatgatggcctgccctaccccttcccagatggcatcctggatgtgatcctgctggtgtttgtgctgagcagcatccacccagacaggaccctcttcatctag

SEQ ID NO: 20341 - DNA, 630 bp, Artificial Sequence; identical to SEQ ID NO: 18435
  Description of Artificial Sequence: Synthetic coding sequence

SEQ ID NO: 20342 - DNA, 504 bp, Artificial Sequence
  Description of Artificial Sequence: Synthetic coding sequence
atgcctgcctaccacagcagcctgatggaccctgacaccaagctgattggcaacatggccctgctgcccatccgcagccagttcaagggccctgccccccgggagaccaaggacacagacatcgtggatgaggccatctactacttcaaggccaacgtgttcttcaagaactatgagatcaagaatgaggccgacaggaccctcatctacatcaccctgtacatcagtgaatgtctgaagaagctgcagaagtgcaacagcaagagccagggcgagaaggagatgtacaccctgggcatcaccaacttccccatccctggagagcccggcttccccctgaatgccatctatgccaagccagccaacaagcaggaggatgaggtgatgagggcctacctgcagcagctgcggcaggagaccggcctgcggctgtgtgagaaggtgatcaagggggacctgaagttctctgctgccctgaagctggccctgaacaagaacaagtag

SEQ ID NO: 20343 - DNA, 4074 bp, Artificial Sequence; identical to SEQ ID NO: 19592
  Description of Artificial Sequence: Synthetic coding sequence

SEQ ID NO: 20344 - DNA, 288 bp, Artificial Sequence
  Description of Artificial Sequence: Synthetic coding sequence
atgctgaagaacaagggccacagcagcaagaaggacaacctggccgtgaatgctgtggccctgcaggaccacatcctgcatgacctgcagctgaggaacctgtctgtggccgaccacagcaagacccaggtgcagaagaaggagaacaagagcctgaagagggacaccaaggccatcatcgacaccggcctgaagaagaccacccagtgccccaagctggaggacagcgagaaggagtatgtgctggaccccaagcccccacccctgaccctgggctaccacagctag

SEQ ID NO: 20345 - DNA, 708 bp, Artificial Sequence
  Description of Artificial Sequence: Synthetic coding sequence
atgctgaagaacaagggccacagcagcaagaaggacaacctggccgtgaatgctgtggccctgcaggaccacatcctgcatgacctgcagctgaggaacctgtctgtggccgaccacagcaagacccaggtgcagaagaaggagaacaagagcctgaagagggacaccaaggccatcatcgacaccggcctgaagaagaccacccagtgccccaagctggaggacagcgagaaggagtatgtgctggaccccaagcccccacccctgaccctggcccagaagctgggcctcatcggccccccacctccacccctgagcagtgatgagtgggagaaggtgaagcagaggagcctgctgcagggcgacagcgtgcagccctgccccatctgcaaggaggagtttgagctgcggccccaggtgctgctgagctgcagccacgtgttccacaaggcctgcctgcaggcctttgagaagttcaccaacaagaagacctgccccctgtgcaggaagaaccagtaccagaccagggtcatccatgatggagcccggctcttccgcatcaagtgtgtgacccgcatccaggcctactggaggggctgtgtggtgaggaagtggtacagaaacctgaggaagacagtgcccccaacagatgccaagctgaggaagaagttctttgagaagaagacccaggactggaagccagcctag

SEQ ID NO: 20346 - DNA, 1089 bp, Artificial Sequence; identical to SEQ ID NO: 18944
  Description of Artificial Sequence: Synthetic coding sequence

SEQ ID NO: 20347 - DNA, 1278 bp, Artificial Sequence; identical to SEQ ID NO: 18416
  Description of Artificial Sequence: Synthetic coding sequence

SEQ ID NO: 20348 - DNA, 639 bp, Artificial Sequence
  Description of Artificial Sequence: Synthetic coding sequence
atggccccctggggcaagaggctggccggcgtgcggggcgtgctgctggacatctctggagtgctgtatgattctggagctgggggcggcacagccatcgccggctctgtggaggccgtggcccggctgaagaggagccggctgaaggtgcgcttctgcaccaatgaaagccagaagagcagagctgagctggtgggccagctgcagaggctgggctttgacatcagcgagcaggaggtgacagccccagccccagctgcctgccagatcctgaaggagcagggcctgcggccctacctgctgattcatgatggagtgcgctcagaatttgaccagattgacaccagcaaccccaactgtgtggtgattgctgatgctggggagagcttctcctaccagaacatgaacaatgccttccaggtgctgatggagctggagaagcctgtgctgatcagcctgggcaagggccgctactacaaggagaccagcggcctgatgctggatgtgggcccctacatgaaggccctggagtatgcctgtggcatcaaggccgaggtggtgggcaagcccagccctgagttcttcaagagcgccctgcaggccatcggcgtggaggcccaccagctgctgtctgtgtag

SEQ ID NO: 20349 - DNA, 2868 bp, Artificial Sequence
  Description of Artificial Sequence: Synthetic coding sequence
atggaggtgggcagcgaggaggagaagtgggagaagctggatgctgagtttgaccactttgtggtggacatgaagccctttgtgctgaagctgccccacaggacagagcggcagagatgtgccctgtggatcaggaagctgtgtgagcccagcggcactggagctggcatcatgggcaggaagaacagaaacctgtatgccaagctgctgctgcacatgctgaagagaggagccctggagggccccttcacccacaggcctgagcccggcaccctgaagatcctgcccagctacatgagcatctactttgatgagcccaacccagcccgggccaagggcagcagccctgagggcctgcctgcctgggtgctgggggagctggagaccagcgagcacaagctgaatgaatcctggaagctgagcagcggggaggacaacaccctggtgcagagccccacagatgtgtacagccgggagcagtacaccgggaagctgcgggtgcgcagccacagcctgagccccacccaccgggaggatggccagaacatcacccccaagatctgtgaggtgtacagcaagaagagccctgtgtccctggatgacagcgacatcgaggcccggctgaacagctggaacctgggcatcgagaacccccgctacctgcggcagaagcccatccctgtgtccctgatgacccccaagttcagcctgaggaagagcagcagcttccatgatgaccacttcctgagccgcatccgggagaaggagctggacatgaagaccaagatgatggaggccaagttccacgaggagaagctgaagctgcagcagaagcatgatgctgatgtgcagaagatcctggagaggaagaacaatgaaattgaggagctgaagaccctgtaccgcagcaagcagcacgagacagaggagaccatcaggaagctggagaagaaggtgcagaccctcatccgggactgccaggtgatccgggagaccaaggaggaccagattgctgagctgaagaagatctgtgagcagagcacagagagcctgaacaatgactgggagaagaagctgcacaatgctgtggccgagatggagcaggagaagtttgacctgcagaagcagcacacagagaacatccaggagctgctggaggacaccaacgtgcggctgaacaagatggagagcgagtacatggcccagacccagagcaccaaccacatgatcaaggagctggaggcccgggtgcagcagctgactggagaggccgagaacagcaacctgcagaggcagaagctgatccaggagaaggccgagctggagcgctgctaccagatcacctgcagcgagctgcaggaggtgaaggcccggaggaacaccctgcacaaggagaaggaccacctggtgaatgactatgagcagaacatgaagctgctgcagaccaagtatgatgctgacatcaacctgctgaagcaggagcacgccctgagcgccagcaaggccagctccatgattgaggagctggagcagaatgtgtgccagctgaagcagcagctgcaggagagcgagctgcagaggaagcagcagctgcgggaccaggagaacaagttccagatggagaagagccacctgaagcacatctatgagaagaaggcccatgacctgcagagcgagctggacaagggcaaggaggacacccagaagaagatccacaagtttgaggaggccctgaaggagaaggaggagcagctgaccagggtgacagaggtgcagaggctgcaggcccagcaggctgatgctgccctggaggagttcaagaggcaggtggagctgaacagcgagaaggtgtatgcagagatgaaggagcagatggagaaggtggaggccgacctgaccaggagcaagagcctgcgggagaagcagagcaaggagttcctgtggcagctggaggacatccggcagagatatgagcagcagatcgtggagctgaagctggagcacgagcaggagaagacccacctgctgcagcagcacaatgctgagaaggacagcctggtgcgggaccacgagcgggagattgagaacctggagaagcagctgcgggccgccaacatggagcacgagaaccagatccaggagttcaagaagagagatgcccaggtgattgctgacatggaggcccaggtgcacaagctgcgggaggagctgatcaacgtgaacagccagaggaagcagcagctggtggagctgggcctgctgcgggaggaggagaagcagagggccacccgggagcacgagatcgtggtgaacaagctgaaggccgagagcgagaagatgaagattgagctgaagaagacccatgctgctgagacagagatgaccctggagaaggccaacagcaagctgaagcagatcgagaaggagtacacccagaagctggccaagagcagccagatcatcgccgagctgcagaccaccatcagcagcctgaaggaggagaacagccagcagcagctggccgctgagcggcggctgcaggatgtgcggcagaagtttgaagatgagaagaagcagctgatccgggacaatgaccaggccatcaaggtgctgcaggatgagctggagaacagaagcaaccaggtgcgctgtgccgagaagaagctgcagcacaaggagctggagagccaggagcagatcacctacatccggcaggagtatgagaccaagctgaagggcctgatgcctgccagcctgcggcaggagctggaggacaccatcagcagcctgaagagccaggtgaacttcctgcagaagagggccagcatcctgcaggaggagctgaccacctaccagggcagaagatag

SEQ ID NO: 20350 - DNA, 1269 bp, Artificial Sequence
  Description of Artificial Sequence: Synthetic coding sequence
atgcccaggaagggcacccagcccagcacagccaggagaagagaggagggccccccaccacccagcccagatggagccagcagtgatgctgagcctgagccccccagcggccgcacagagagccctgccacagctgctgagacagccagcgaggagctggacaacagaagcctggaggagatcctgaacagcatccccccacctcctcctccagccatgaccaatgaagctggggccccccggctgatgatcacccacatcgtgaaccagaacttcaagagctatgctggggagaagatcctgggccccttccacaagcgcttcagctgcatcatcggccccaatggaagtggcaagagcaatgtgattgacagcatgctgtttgtgtttggctaccgggcccagaagatccgcagcaagaagctgtctgtgctgatccacaacagtgatgagcacaaggacatccagagctgcaccgtggaggtgcacttccagaagatcatcgacaaggagggagatgattatgaagtcatccccaacagcaacttctacgtgtccaggacagcctgccgggacaacacctctgtgtaccacatcagcggcaagaagaagaccttcaaggatgtgggcaacctgctgcggagccacggcatcgacctggaccacaaccgcttcctgatcctgcagggcgaggtggagcagatcgccatgatgaagcccaagggccagacagaacatgatgagggcatgctggagtacctggaggacatcatcggctgcggccgcctgaatgagcccatcaaggtgctgtgccggcgggtggagatcctgaatgagcacagaggagagaagctgaacagagtgaagatggtggagaaggagaaggatgccctggagggggagaagaacatcgccatcgagttcctgaccctggagaatgagatcttcaggaagaagaaccacgtgtgccagtactacatctatgagctgcagaagagaattgctgagatggagacccagaaggagaagatccacgaggacaccaaggagatcaatgagaagagcaacatcctgagcaatgagatgaaggccaagaacaaggatgtgaaggacacagagaagaagctgaacaagatcaccaagttcatcgaggagaacaaggagaagttcacccagctggacctggaggatgtgcaggtgcgggagaagctgaagcacgccaccagcaaggccaagacaggagagaccaccagcaagaggaagaagtag

SEQ ID NO: 20351 - DNA, 303 bp, Artificial Sequence
  Description of Artificial Sequence: Synthetic coding sequence
atgaggaagaggctgagcgcccctgagctgcggctgagcctgaccaagggccctggaaatgatggagccagccccacccagagcgcccccagcagcccagatggcagcagtgacctggagattgatgagctggagacccccagcgacagcgagcagctggacagcggccatgaatttgagtgggaggatgagctgcccagggctgagggcctgggcaccagcgagacagctgagcggctgggccggggctgcatgtgggatgtgactggagaagatggccaccactggagggtcttcagatag

SEQ ID NO: 20352 - DNA, 1059 bp, Artificial Sequence
  Description of Artificial Sequence: Synthetic coding sequence
atgggcaaggtggagaacagcaagagcgcccagggcctggccggcctgaggaacctgggcaacacctgcttcatgaacagcatcctgcagtgcctgagcaacacccgggagctgcgggactactgcctgcagaggctgtacatgagggacctgcaccacggcagcaatgcccacacagccctggtggaggagtttgccaagctgatccagaccatctggaccagcagccccaatgatgtggtgagccccagcgagttcaagacccagatccagagatatgcccccaggtttgtgggctacaaccagcaggatgcccaggagttcctgcgcttcctgctggatggcctgcacaatgaggtgaacagagtgaccctgcggcccaagagcaaccctgagaacctggaccacctgcctgatgatgagaagggccggcagatgtggaggaagtacctggagcgggaggacagccgcatcggggacctgtttgtgggccagctgaagagcagcctgacctgcacagactgtggctactgcagcacagtgtttgaccccttctgggacctgagcctgcccatcgccaagaggggctacccagaggtgaccctgatggactgcatgaggctcttcaccaaggaggatgtgctggatggagatgagaagcccacctgctgccgctgccggggcaggaagcgctgcatcaagaagttcagcatccagcgcttccccaagatcctggtgctgcacctgaagcgcttcagcgagagccgcatccgcaccagcaagctgaccacctttgtgaacttccccctgcgggacctggacctgcgggagtttgccagcgagaacaccaaccacgctgtgtacaacctgtatgctgtgagcaaccacagcggcaccaccatgggcggccactacacagcctactgccgcagccctggcaccggggagtggcacaccttcaatgacagctctgtgacccccatgagcagcagccaggtgaggaccagtgatgcctacctgctcttctatgagctggccagcccccccagcaggatgtag

SEQ ID NO: 20353 - DNA, 1497 bp, Artificial Sequence
  Description of Artificial Sequence: Synthetic coding sequence
atggtgattgaggaggtgaacttcatgcagaaccacctggagattgagaagacctgccgggagagcgctgaggccctggccaccaagctgaacaaggagaacaagaccctgaagaggatctccatgctgtacatggccaagctgggcccagatgtgatcacagaggagatcaacattgatgatgaggacagcaccacagacacagatggagctgctgagacctgtgtgtctgtgcagtgccagaagcagatcaaggagctgcgggaccagatcgtgtctgtgcaggaggagaagaagatcctggccatcgagctggagaacctgaagagcaagctggtggaggtgattgaggaggtgaacaaggtgaagcaggagaagacagtgctgaacagcgaggtgctggagcagaggaaggtgctggagaagtgcaacagagtgtccatgctggccgtggaggagtatgaggagatgcaggtgaacctggagctggagaaggacctgaggaagaaggccgagagctttgcccaggagatgttcatcgagcagaacaagctgaagaggcagagccacctgctgctgcagagcagcatcccagaccagcagctgctgaaggccctggatgaaaatgccaagctgacccagcagctggaggaggagcgcatccagcaccagcagaaggtgaaggagctggaggagcagctggagaatgagaccctgcacaaggagatccacaacctgaagcagcagctggagctgctggaggaggacaagaaggagctggagctgaagtaccagaacagcgaggagaaggccaggaacctgaagcacagcgtggatgagctgcagaagagggtgaaccagagtgaaaattctgtgcccccacctcctcctcctcctccacccctgcccccacctccacccaaccccatccgcagcctgatgtccatgatcaggaagaggagccaccccagcggcagcggggccaagaaggagaaggccacccagcctgagaccacagaggaggtgacagacctgaagaggcaggccgtggaggagatgatggaccgcatcaagaagggcgtgcacctgcggcctgtgaaccagacagcccggcccaagaccaagccagagagcagcaagggctgtgagagcgctgtggatgagctgaagggcatcctgggcaccctgaacaagagcaccagcagccgcagcctgaagagcctggaccctgaaaattctgaaacagagctggagcgcatcctgcggcggaggaaggtgacagctgaggccgacagcagcagccccaccggcatcctggccaccagcgagagcaagtccatgcctgtgctgggctctgtgtcctctgtgaccaagacagccctgaacaagaagaccctggaggccgagttcaacagccccagcccccccaccccagagcccggggagggccccaggaagctggagggctgcaccagcagcaaggtgaccttccagtag

SEQ ID NO: 20354 - DNA, 1950 bp, Artificial Sequence
  Description of Artificial Sequence: Synthetic coding sequence
atgaacagcagtgatgaggagaagcagctgcagctgatcaccagcctgaaggagcaggccatcggggagtatgaggacctgcgggcagagaaccagaagaccaaggagaagtgtgacaagatccggcaggagagagatgaggccgtgaagaagctggaggagttccagaagatcagccacatggtgattgaggaggtgaacttcatgcagaaccacctggagattgagaagacctgccgggagagcgctgaggccctggccaccaagctgaacaaggagaacaagaccctgaagaggatctccatgctgtacatggccaagctgggcccagatgtgatcacagaggagatcaacattgatgatgaggacagcaccacagacacagatggagctgctgagacctgtgtgtctgtgcagtgccagaagcagatcaaggagctgcgggaccagatcgtgtctgtgcaggaggagaagaagatcctggccatcgagctggagaacctgaagagcaagctggtggaggtgattgaggaggtgaacaaggtgaagcaggagaagacagtgctgaacagcgaggtgctggagcagaggaaggtgctggagaagtgcaacagagtgtccatgctggccgtggaggagtatgaggagatgcaggtgaacctggagctggagaaggacctgaggaagaaggccgagagctttgcccaggagatgttcatcgagcagaacaagctgaagaggcagagccacctgctgctgcagagcagcatcccagaccagcagctgctgaaggccctggatgaaaatgccaagctgacccagcagctggaggaggagcgcatccagcaccagcagaaggtgaaggagctggaggagcagctggagaatgagaccctgcacaaggagatccacaacctgaagcagcagctggagctgctggaggaggacaagaaggagctggagctgaagtaccagaacagcgaggagaaggccaggaacctgaagcacagcgtggatgagctgcagaagagggtgaaccagagtgaaaattctgtgcccccacctcctcctcctcctccacccctgcccccacctccacccaaccccatccgcagcctgatgtccatgatcaggaagaggagccaccccagcggcagcggggccaagaaggagaaggccacccagcctgagaccacagaggaggtgacagacctgaagaggcaggccgtggaggagatgatggaccgcatcaagaagggcgtgcacctgcggcctgtgaaccagacagcccggcccaagaccaagccagagagcagcaagggctgtgagagcgctgtggatgagctgaagggcatcctgggcaccctgaacaagagcaccagcagccgcagcctgaagagcctggaccctgaaaattctgaaacagagctggagcgcatcctgcggcggaggaaggtgacagctgaggccgacagcagcagccccaccggcatcctggccaccagcgagagcaagtccatgcctgtgctgggctctgtgtcctctgtgaccaagacagccctgaacaagaagaccctggaggccgagttcaacagccccagcccccccaccccagagcccggggagggccccaggaagctggagggctgcaccagcagcaaggtgaccttccagccccccagcagcatcggctgcaggaagaagtacattgatggagagaagcaggccgagcctgtggtggtgctggaccctgtgtccacccatgagccccagaccaaggaccaggtggccgagaaggaccccacccagcacaaggaggatgaaggagagatccagcctgagaacaaggaggacagcattgagaacttcttccccttccacttcggctttgagggcgtgctgcccctggccggcgtgaccctgagcaccaaggcccgggaccccaagtag

SEQ ID NO: 20355 - DNA, 837 bp, Artificial Sequence; identical to SEQ ID NO: 18620
  Description of Artificial Sequence: Synthetic coding sequence

SEQ ID NO: 20356 - DNA, 1368 bp, Artificial Sequence
  Description of Artificial Sequence: Synthetic coding sequence
atgttcacagaaggagaggagatgtacctgcagggcagcacagtgtggcacccagactgcaagcagagcaccaagacagaggagaagctgcggctgcccaacatccgccgcagcagcagtgacttcttctacagcaagagcctcatccggaggacaggccgcagccccagcctgcagcccaccaggaccagcagcgagagcatctacagccggcccggcagcagcatccctggcagccctggccacaccatctatgccaaggtggacaatgagatcctggactacaaggacctggccgccatccccaaggtgaaggccatctatgacatcgagaggccagacctgatcacctatgagcccttctacaccagcggctatgatgacaagcaggagcggcagagcctgggggagagccccaggaccctgagccccaccccatctgctgagggctaccaggatgtgcgggacaggatgatccacaggagcaccagccagggcagcatcaacagccctgtgtacagccgccacagctacacccccaccaccagccgcagcccccagcacttccacaggccagaccagggcatcaacatctacaggaagccacccatctacaagcagcacgccgccctggccgcccagagcaagagcagcgaggacatcatcaagttcagcaagtttcctgctgcccaggccccagaccccagcgagacccccaagattgaaacagaccactggccaggccccccatcctttgctgtggtgggccctgacatgaagagaagaagcagcggccgggaggaggatgatgaggagctgctgcggcggcggcagctgcaggaggagcagctgatgaagctgaacagcggcctgggccagctgatcctgaaggaggagatggagaaggagagccgggagaggagcagcctgctggccagccgctatgacagccccatcaacagcgccagccacatccccagcagcaagacagccagcctgcccggctacggcagaaatggcctgcacaggcctgtgtccacagactttgcccagtacaacagctatggagatgtgtctggaggagtgcgggactaccagaccctgcctgatggccacatgcctgccatgaggatggacagaggagtgtccatgcccaacatgctggagcccaagatcttcccctatgagatgctgatggtgaccaacagaggaagaaacaagatcctgcgggaggtggacaggacccggctggagcggcacctggcccctgaggtgttccgggagatcttcggcatgagcatccaggagtttgaccggctgcccctgtggaggagaaatgacatgaagaagaaggccaagctgttctag

SEQ ID NO: 20357 - DNA, 1959 bp, Artificial Sequence
  Description of Artificial Sequence: Synthetic coding sequence
tgaagccacgccttcatcagccagtgggtgtgccgccactggagggaccctgtggcccacccccaggacccccaccaccccagcgagaagcctgtgatccactgccacaagtgtggggagccctgcaagggggaggtgctgcgggtgcagaccaagcacttccacatcaagtgcttcacctgcaaggtgtgtggctgtgacctggcccagggcggcttcttcatcaagaatggagagtacctgtgcaccctggactaccaccccaactgctttgcctgcaccatctgcaagaggcccttccccccaggggacagagtgaccttcaacggccgggactgcctgtgccagctgtgtgcccagcccatgagcagcagccccaaggagaccaccttcagcagcaactgtgccggctgcggccgggacatcaagaatggccaggccctgctggccctggacaagcagtggcacctgggctgcttcaagtgcaagagctgtgggaaggtgctgaccggggagtacatcagcaaggatggagccccctactgtgagaaggactaccagggcctgtttggagtgaagtgtgaggcctgccaccagttcatcaccgggaaggtgctggaggccggggacaagcactaccaccccagctgtgcccgctgcagccgctgcaaccagatgttcacagaaggagaggagatgtacctgcagggcagcacagtgtggcacccagactgcaagcagagcaccaagacagaggagaagctgcggcccaccaggaccagcagcgagagcatctacagcaggcctggcagcagcatccctggcagccctggccacaccatctatgccaaggtggacaatgagatcctggactacaaggacctggccgccatccccaaggtgaaggccatctatgacatcgagaggccagacctgatcacctatgagcccttctacaccagcggctatgatgacaagcaggagcggcagagcctgggggagagccccaggaccctgagccccacccccagcgctgagggctaccaggatgtgcgggacaggatgatccacaggagcaccagccagggcagcatcaacagccctgtgtacagccgccacagctacacccccaccaccagccgcagcccccagcacttccacaggccagaccagggcatcaacatctacaggaagccacccatctacaagcagcacgccgccctggccgcccagagcaagagcagcgaggacatcatcaagttcagcaagtttcctgctgcccaggccccagaccccagcgagacccccaagattgaaacagaccactggccaggcccccccagctttgctgtggtgggccctgacatgaagaggaggagcagcggccgggaggaggatgatgaggagctgctgcggcggcggcagctgcaggaggagcagctgatgaagctgaacagcggcctgggccagctgatcctgaaggaggagatggagaaggagagccgggagaggagcagcctgctggccagccgctatgacagccccatcaacagcgccagccacatccccagcagcaagacagccagcctgcccggctatggaagaaatggcctgcacaggcctgtgtccacagactttgcccagtacaacagctatggagatgtgtctgggggcgtgcgggactaccagaccctgcctgatggccacatgcctgccatgaggatggaccggggcgtgtccatgcccaacatgctggagcccaagatcttcccctatgagatgctgatggtgaccaacagaggaagaaacaagatcctgcgggaggtggacaggacccggctggagcggcacctggcccctgaggtgttccgggagatcttcggcatgagcatccaggagtttgaccggctgcccctgtggaggagaaatgacatgaagaagaaggccaagctgttctag

SEQ ID NO: 20358 - DNA, 837 bp, Artificial Sequence
  Description of Artificial Sequence: Synthetic coding sequence
atgacccagcagtggagggaggtgaatgaagatcgggaggccgtggcccaggcccgctcctggcagagcctgaacctgggggaccgggacatgggcgtgtccttcatcgagacagccctggccctgtctgctgcccgggcccggcggcccctgctgaccagccacccccccagccggcccttccagccccccaagcacacccccagccccccaccagccccccgggtgaacagccgccaccctggccgctctgtgtccctgagcctgcccagcgccagccaggcccctcctgtgcccctggccagccctgagggccggccccacacagtgggcgccccccacgccagcacctggaagaggacccggggccggcagagggcccggccccccaagatcgtgaaggaggccgaggtgccccaggccgccctgggcgtgcctgcccagggcaccggggacaatggccacacccctgtggaggaggaggtgggcggcatccctgtgcctgcccctggcctgctgcaggtgacagagcggcggcagcccctgagctctgtgagcagcctggaggtgcactttgacctgctggacctgacagagctgacagacatgtctgaccaggagctggccgaggtgtttgctgacagtgatgatgagaacctgaacacagagagccctgctggcctgcaccccctgccccgggccggctacctgcggagccccagctggaccaggaccagggctgagcagagccatgagaagcagcccctgggggaccctgagcggcaggccaccgtgctggacaccttcctgactgtggagcggccccaggaggactag

SEQ ID NO: 20359 - DNA, 540 bp, Artificial Sequence
  Description of Artificial Sequence: Synthetic coding sequence
atgacagacctggtggccgtgtgggatgtggccctgagtgatggagtgcacaagattgaatttgaacatggcaccaccagcggcaagagggtggtgtatgtggatggcaaggaggagatcaggaaggagtggatgttcaagctggtgggcaaggagaccttctacgtgggcgccgccaagaccaaggccaccatcaacattgatgccatcagcggctttgcctatgagtacaccctggagatcaacgggaagagcctgaagaagtacatggaggacaggagcaagaccaccaacacctgggtgctgcacatggatggagagaacttcagaattgtgctggagaaggatgccatggatgtgtggtgcaatggcaagaagctggagacagctggggagtttgtggatgatggaacagagacccacttcagcatcggcaaccacgactgctacatcaaggctgtgagcagcggcaagaggaaggagggcatcatccacaccctcatcgtggacaaccgggagatccctgagatcgccagctag

SEQ ID NO: 20360 - DNA, 540 bp, Artificial Sequence; identical to SEQ ID NO: 20359
  Description of Artificial Sequence: Synthetic coding sequence

SEQ ID NO: 20361 - DNA, 1053 bp, Artificial Sequence
  Description of Artificial Sequence: Synthetic coding sequence
atgggcccctgcaacctgagcagcgctgctggccccacagctgagaagtctgtgccctaccagaggaccctgaaggagggccagggcacctctgtggtggcccagggccccagccggcccctgcccagcacagccaacgtggtggtgattggaggcggcagcctgggctgccagaccctgtaccacctggccaagctgggcatgtctggagctgtgctgctggagcgggagcggctgaccagcggcaccacctggcacacagctggcctgctgtggcagctgcggcccagtgatgtggaggtggagctgctggcccacacccggcgggtggtgtcccgggagctggaggaggagaccggcctgcacacaggctggatccagaatggaggcctcttcatcgccagcaaccggcagaggctggatgagtacaagaggctgatgagcctgggcaaggcctatggagtggagagccacgtgctgagccctgctgagaccaagaccctgtaccccctgatgaatgtggatgacctgtatggcaccctgtatgtgccccatgatggcaccatggaccctgctggcacctgcaccaccctggcccgggccgccagcgcccggggggcccaggtgattgagaactgccctgtgacaggcatccgggtgtggacagatgactttggagtgcggcgggtggccggcgtggagacccagcacggcagcatccagaccccctgtgtggtgaactgtgccggcgtgtgggccagcgctgtgggccgcatggccggcgtgaaggtgcccctggtggccatgcaccacgcctacgtggtgacagaaagaattgagggcatccagaacatgcccaacgtgcgggaccatgatgcctctgtgtacctgcggctgcagggagatgccctgtctgtgggcggctatgaggccaaccccatcttctgggaggaggccgtgaagtaccggcccagggctgctgggggcctgtgcctgaagaccagcacagagaaggtgtgtgctgtgtggagcgatgacctgcggcgggcctag

SEQ ID NO: 20362 - DNA, 2001 bp, Artificial Sequence
  Description of Artificial Sequence: Synthetic coding sequence
atggcccgggccggcagctgtggcggcgctgctgctggggccggccggcctgagccctgggagctgagcctggaggaggtgctgaaggcctatgagcagcccctgaatgaggagcaggcctgggccgtgtgcttccagggctgccggggcctgcggggcagccctggaagaaggctgcgggacaccggggacctgctgctgcggggagatggctctgtgggcgcccgggagcctgaggccgctgagcccgccaccatggtggtgcccctggccagcagcgaggcccagacagtgcagagcctgggctttgccatctaccgggccctggactggggcctggatgagagcgaggagcgggagctgagcccccagctggagcggctgattgacctgatggccaacaatgattctgaggacagcggctgtggggctgctgatgagggctatggaggccctgaggaggaggaggaggccgagggcgtgcccaggtctgtgaggacctttgcccaggccatgaggctgtgtgccgcccggctgacagaccccaggggggcccaggcccactaccaggccgtgtgccgggccctgtttgtggagaccctggagctgcgggccttcctggcccgggtgcgggaggccaaggagatgctgcagaagctgcgggaggatgagccccacctggagacccccagggctgagctggacagcctgggccacacagactgggcccggctgtgggtgcagctgatgagggagctgcggcggggcgtgaagctgaagaaggtgcaggagcaggagttcaaccccctgcccacagagttccagctgaccccatttgagatgctgatgcaggacatccgggccaggaactacaagctgaggaaggtgatggtggatggagacatccccccccgggtgaagaaggatgcccacgagctgatcctggacttcatccgcagccggccccccctgaagcaggtgtctgagcggcggctgcggcccctgccccccaagcagaggagcctgcacgagaagatcctggaggagatcaagcaggagcggcggctgcggcctgtgcggggggagggctgggccgcccggggcttcggcagcctgccctgcatcctgaatgcctgcagcggagatgccaagagcaccagctgcatcaacctgtctgtgacagatgctgggggcagcgcccagaggccccggccccgggtgctgctgaaggcccccaccctggccgagatggaggagatgaacaccagcgaggaggaggagagcccctgtggggaggtgaccctgaagagggacaggagcttcagcgagcatgacctggcccagctgcggtctgaggtggccagcggcctgcagagcgccacccaccccccaggcggcacagagcccccccggccccgggccggcagcgcccacgtgtggaggcctggcagccgggaccagggcacctgcccagcctctgtgtctgaccccagccaccccctgctgagcaacagaggcagcagcggggacaggcctgaggcctccatgaccccagatgccaagcacctgtggctggagttcagccaccctgtggagagcctggccctgactgtggaggaggtgatggatgtgagaagagtgctggtgaaggccgagatggagaagttcctgcagaacaaggagctgttcagcagcctgaagaagggcaagatctgctgctgctgccgggccaagttccccctcttctcctggccacccagctgcctcttctgcaagaggagcctgcagggcccccagtggcagagcgtggaggaggccttcccccacatctacagccacggctgtgtgctgaaggatgtgtgcagtgaatgtaccagctttgtggctgatgtggtgcgcagcagcaggaagtctgtggatgtgctgaacaccaccccaagaagaagccggcagacccagagcctgtacatccccaacaccaggaccctggacttcaagtag

SEQ ID NO: 20363 - DNA, 474 bp, Artificial Sequence
  Description of Artificial Sequence: Synthetic coding sequence
atggagaccctgcagagcgagaccaagaccagggtgctgcccagctggctgacagcccaggtggccaccaagaatgtggcccccatgaaggcccccaagaggatgaggatggctgctgtgcctgtggccgccgcccggctgcctgccaccaggacagtgtactgcatgaatgaagctgagatcgtggatgtggccctgggcatcctgattgagagcaggaagcaggagaaggcctgtgagcagcctgccctggccggggctgacaaccctgagcacagccccccctgcagcgtgagcccccacaccagcagcggcagcagcagcgaggaggaggacagcggcaagcaggccctggcccctggcctgagccccagccagaggcctgggggcagcagcagcgcctgcagccgcagccctgaggaggaggaggaggaggatgtgctgaagtatgtgcgggagatcttcttctcctag

SEQ ID NO: 20364 - DNA, 804 bp, Artificial Sequence
  Description of Artificial Sequence: Synthetic coding sequence
atggccaactgtgagaggaccttcatcgccatcaagccagatggagtgcagaggggcctggtgggggagatcatcaagagatttgagcagaagggcttccggctggtgggcctgaagttcatgcaggccagcgaggacctgctgaaggagcactacgtggacctgaaggaccggcccttctttgctggcctggtgaagtacatgcacagcggccctgtggtggccatggtgtgggagggcctgaatgtggtgaagacaggccgggtgatgctgggggagaccaacccagctgacagcaagccaggcaccatccggggggacttctgcatccaggtgggccgcaccatggccaacctggagaggaccttcatcgccatcaagccagatggagtgcagaggggcctggtgggggagatcatcaagagatttgagcagaagggcttccggctggtggccatgaagttcctgcgggccagcgaggagcacctgaagcagcactacatcgacctgaaggaccggcccttcttccctggcctggtgaagtacatgaacagcggccctgtggtggccatggtgtgggagggcctgaatgtggtgaagacaggccgggtgatgctgggggagaccaacccagctgacagcaagccaggcaccatccggggggacttctgcatccaggtgggcaggaacatcatccacggcagtgacagcgtgaagtctgctgagaaggagatcagcctgtggttcaagccagaggagctggtggactacaagagctgtgcccatgactgggtgtatgaatag

SEQ ID NO: 20365 - DNA, 879 bp, Artificial Sequence
  Description of Artificial Sequence: Synthetic coding sequence
atggtgctgctgagcaccctgggcatcgtgttccagggcgagggcccccccatcagcagctgtgacaccggcaccatggccaactgtgagaggaccttcatcgccatcaagccagatggagtgcagaggggcctggtgggggagatcatcaagagatttgagcagaagggcttccggctggtgggcctgaagttcatgcaggccagcgaggacctgctgaaggagcactacgtggacctgaaggaccggcccttctttgctggcctggtgaagtacatgcacagcggccctgtggtggccatggtgtgggagggcctgaatgtggtgaagacaggccgggtgatgctgggggagaccaacccagctgacagcaagccaggcaccatccggggggacttctgcatccaggtgggccgcaccatggccaacctggagaggaccttcatcgccatcaagccagatggagtgcagaggggcctggtgggggagatcatcaagagatttgagcagaagggcttccggctggtggccatgaagttcctgcgggccagcgaggagcacctgaagcagcactacatcgacctgaaggaccggcccttcttccctggcctggtgaagtacatgaacagcggccctgtggtggccatggtgtgggagggcctgaatgtggtgaagacaggccgggtgatgctgggggagaccaacccagctgacagcaagccaggcaccatccggggggacttctgcatccaggtgggcaggaacatcatccacggcagtgacagcgtgaagtctgctgagaaggagatcagcctgtggttcaagccagaggagctggtggactacaagagctgtgcccatgactgggtgtatgaatag

SEQ ID NO: 20366 - DNA, 492 bp, Artificial Sequence
  Description of Artificial Sequence: Synthetic coding sequence
atgaagagcagccagacctttgaggagcagacagagtgcatcgtgaacaccctgctgatggacttcctgagccccaccctgcaggtggccagcaggaacctgtgctgcgtggatgaggtggacagcggggagccctgcagctttgatgtggccatcatcgccggccgcctgaggatgctgggggaccagttcaatggagagctggaggccagcgccaagaatgtgattgctgagaccatcaagggccagacaggagccatcctgcaggacacagtggagagcctgagcaagacctggtgtgcccaggacagcagcctggcctatgaaagagccttcctggccgtgtctgtgaagctgctggagtacatggcccacatcgcccctgaggtggtgggccaggtggccatccccatgacaggcatgatcaatggaaaccaggccatccgggagttcatccagggccagggcggctgggagaacctggagagctag

SEQ ID NO: 20367 - DNA, 558 bp, Artificial Sequence
  Description of Artificial Sequence: Synthetic coding sequence
atgggcaagaagcagaacaagaagaaggtggaggaggtgctggaggaggaggaggaggagtatgtggtggagaaggtgctggacagaagagtggtgaagggcaaggtggagtacctgctgaagtggaagggcttcagtgatgaggacaacacctgggagcctgaggagaacctggactgcccagacctgattgctgagttcctgcagagccagaagacagcccatgaaacagacaagtctgagggcggcaagaggaaggctgacagcgacagcgaggacaagggggaggagagcaagcccaagaagaagaaggaggagagcgagaagccccggggctttgcccggggcctggagcctgagcgcatcattggagccacagacagcagtggagagctgatgttcctgatgaagtggaagaacagtgatgaggccgacctggtgcctgccaaggaggccaacgtgaagtgcccccaggtggtgatctccttctatgaggagcggctgacctggcacagctaccccagtgaagatgatgacaagaaggatgacaagaactag

SEQ ID NO: 20368 - DNA, 1350 bp, Artificial Sequence; identical to SEQ ID NO: 19455
  Description of Artificial Sequence: Synthetic coding sequence

SEQ ID NO: 20369 - DNA, 741 bp, Artificial Sequence
  Description of Artificial Sequence: Synthetic coding sequence
atgtctggggccggggaggccctggcccctggccctgtgggcccccagagggtggccgaggccggcggcggccagctgggcagcacagcccagggcaaatgtgacaaggacaacacagagaaggacatcacccaggccaccaacagccacttcacccatggagagatgcaggaccagagcatctggggcaaccccagtgatggagagctgatccgcacccagccccagaggctgccccagctgcagaccagcgcccaggtgcccagcggggaggagatcggcaagatcaagaatggccacacaggcctgagcaatggaaatggcatccaccacggggccaagcacggcagcgctgacaacaggaagctgagcgcccctgtgtcccagaagatgcacaggaagatccagagcagcctgtctgtgaacagcgacatcagcaagaagagcaaggtgaatgctgtgttcagccagaagacaggcagcagccctgaggactgctgcgtgcactgcatcctggcctgcctcttctgtgagttcctgaccctgtgcaacatcgtgctgggccaggccagctgtggcatctgcaccagcgaggcctgctgctgctgctgcggagatgagatgggagatgactgcaactgcccctgtgacatggactgtggcatcatggatgcctgctgtgagagcagtgactgcctggagatctgcatggagtgctgcggcatctgcttccccagctag

SEQ ID NO: 20370 - DNA, 30 bp, Artificial Sequence
  Description of Artificial Sequence: Synthetic coding sequence
atgagctactaccagaggcccttctcctag

SEQ ID NO: 20371 - DNA, 2001 bp, Artificial Sequence
  Description of Artificial Sequence: Synthetic coding sequence
atgaacacaggccgggacagccagagcccagacagcgccaagggcttccgctctgtgcggcccaacctgcaggacaagaggagccccacccagagccagatcaccgtgaatggaaacagcggcggcgctgtgagccccatgagctactaccagaggcccttcagccccagcgcctacagcctgcctgccagcctgaacagcagcatcgtgatgcagcacggcaccagcctggacagcacagacacctacccccagcacgcccagagcctggatggcaccaccagcagcagcatccccctgtaccgcagcagcgaggaggagaagagggtgaccgtcatcaaggccccccactacccaggcatcggccctgtggatgaaagtggcatccccacagccatccgcaccaccgtggaccggcccaaggactggtacaagaccatgttcaagcagatccacatggtgcacaagccagatgatgacacagacatgtacaacaccccctacacctacaatgccggcctgtacaaccccccctacagcgcccagagccaccctgctgccaagacccagacctaccggcccctgagcaagagccacagcgacaacagccccaatgccttcaaggatgccagcagccctgtgcccccaccccacgtgcccccacctgtgccccccctgcggccccgggacaggagcagcacagagaagcatgactgggaccccccagacaggaaggtggacaccaggaagttccgctctgagcccaggagcatctttgaatatgagcccgggaagagcagcatcctgcagcacgagcggcccacagaccgcatcaacccagatgacatcgacctggagaatgagccctggtacaagttcttcagcgagctggagtttggccggcccccacccaagaagcccctggactatgtgcaggaccacagcagcggggtcttcaatgaggccagcctgtaccagagcagcattgacaggagcctggagcggcccatgagcagcgcctccatggccagtgacttcaggaagaggaggaagtctgagcctgctgtgggccccccccggggcctgggggaccagagcgccagcaggaccagccctggccgggtggacctgcccggcagcagcaccaccctgaccaagagcttcaccagcagcagccccagcagccccagccgggccaaggaccgggagagccccaggagctacagcagcaccctgacagacatgggccgcagcgccccccgggagcggcggggcaccccagagaaggagaagctgcctgccaaggctgtgtatgacttcaaggcccagaccagcaaggagctgtccttcaagaagggggacacagtgtacatcctgaggaagattgaccagaactggtatgaaggagagcaccacggccgggtgggcatcttccccatctcctatgtggagaagctgaccccacctgagaaggcccagcctgcccggcccccacctccagcccagcctggagagatcggggaggccatcgccaagtacaacttcaatgctgacaccaacgtggagctgagcctgaggaaaggagacagagtcatcctgctgaagagggtggaccagaactggtatgagggcaagatccctggcaccaaccggcagggcatcttccctgtgtcctatgtggaggtggtgaagaagaacaccaagggagctgaggactacccagacccccccatcccccacagctacagcagtgaccgcatccacagcctgagcagcaacaagccccagaggcctgtgttcacccatgagaacatccagggcggcggggagcccttccaggccctgtacaactacaccccaagaaatgaagatgagctggagctgcgggagagtgatgtgattgatgtgatggagaagtgtgatgatggctggtttgtgggcaccagcaggaggaccaagttcttcggcaccttccctggcaactacgtgaagaggctgtag

SEQ ID NO: 20372 - DNA, 2472 bp, Artificial Sequence
  Description of Artificial Sequence: Synthetic coding sequence
atgaccctgctgagcagccagagcagcagcctggtggcccccagcggctctgtgtctgcagaaaatcctgagcagaggatgctggagaagagggccaaggtgattgaggagctgctgcagacagagcgggactacatccgggacctggagatgtgcatcgagcgcatcatggtgcccatgcagcaggcccaggtgcccaacatcgactttgagggcctgtttggaaacatgcagatggtgatcaaggtgtccaagcagctgctggccgccctggagatcagtgatgctgtgggccctgtgttcctgggccacagagatgagctggagggcacctacaagatctactgccagaaccatgatgaggccatcgccctgctggagatctatgagaaggatgagaagatccagaagcacctgcaggacagcctggccgacctgaacagcctggtgctgaagaagggctgcaccaactacatcaacctgggcagcttcctgatcaagcctgtgcagagggtgatgagataccccctgctgctgatggagctgctgaacagcaccccagagagccacccagacaaggtgcccctgaccaatgctgtgctggccgtgaaggagatcaacgtgaacatcaatgagtacaagaggaggaaggacctggtgctgaagtacagaaaaggagatgaggacagcctgatggagaagatcagcaagctgaacatccacagcatcatcaagaagagcaacagagtgagcagccacctgaagcacctgaccggctttgccccccagatcaaggatgaggtgtttgaggagacagagaagaacttcaggatgcaggagcggctcatcaagagcttcatccgggacctgagcctgtacctgcagcacatccgggagagcgcctgtgtgaaggtggtggccgctgtgtccatgtgggatgtgtgcatggagcggggccaccgggacctggagcagtttgagcgggtgcaccgctacatcagtgaccagctgttcaccaacttcaaggagaggacagagcggctggtgatcagccccctgaaccagctgctgtccatgttcaccggcccccacaagctggtgcagaagagatttgacaagctgctggacttctacaactgcacagagcgggcagagaagctgaaggacaagaagaccctggaggagctgcagagcgccaggaacaactatgaggccctgaatgcccagctgctggatgagctgcccaagttccaccagtatgcccagggcctcttcaccaactgtgtgcacggctatgcagaggcccactgtgactttgtgcaccaggccctggagcagctgaagcccctgctgagcctgctgaaggtggccggccgggagggcaacctgattgccatcttccacgaggagcacagccgggtgctgcagcagctgcaggtgttcaccttcttccctgagagcctgcctgccaccaagaagccctttgagaggaagaccatcgaccggcagagcgccaggaagcccctgctgggcctgcccagctacatgctgcagagcgaggagctgcgggccagcctgctggcccgctacccacctgagaagctgttccaggccgagaggaacttcaatgctgcccaggacctggatgtgtccctgctggagggggacctggtgggcgtcatcaagaagaaggaccccatgggcagccagaaccgctggctgattgacaatggagtgaccaagggctttgtgtacagcagcttcctgaagccctacaaccccaggaggagccacagtgatgcctctgtgggcagccacagcagcacagaaagtgaacatggcagcagcagcccccgcttcccccggcagaacagcggcagcaccctgaccttcaaccccagctccatggctgtgtccttcaccagcggcagctgccagaagcagccccaggatgccagccccccacccaaggaatgtgaccagggcaccctgagcgccagcctgaaccccagcaacagcgagagcagccccagccgctgccccagcgaccctgacagcaccagccagcccaggtctggggacagcgcagatgtggccagagatgtgaagcagcccacagccacccccaggagctacagaaacttccgccaccctgagatcgtgggctacagcgtgcccggcagaaatggccagagccaggacctggtgaagggctgtgccaggacagcccaggccccagaagatagaagcacagagccagatggcagcgaggccgagggcaaccaggtgtactttgctgtgtacaccttcaaggccaggaaccccaatgagctgtctgtgtctgccaaccagaagctgaagatcctggagttcaaggatgtgactggaaacacagagtggtggctggccgaggtgaatggcaagaagggctacgtgcccagcaactacatcaggaagacagagtacacctag

SEQ ID NO: 20373 - DNA, 2964 bp, Artificial Sequence
  Description of Artificial Sequence: Synthetic coding sequence
atggccgagagcagcagcgagagtgaccacttccgctgccgggaccggctgagcccctgggccgcccggagcacccaccggggcaccaggagcctgcccaccgtggaggtgacagagaaggtgaacaccatcaccagcaccctgcaggacaccagcaggaacctgcggcaggtggaccagatgctgggccgctaccgggagtacagcaatggccaggccggggccatcgagcacctgaaggagagcctggagcagagcattgaccagctgcggagccagaggctgctgagaaattctgggggccgcagcatctctgtgaccagcctgagcgccagtgacctggatggcggcaccggcagcgagctgcaccacttcccccccaccagccccctgaaggactatggagacccccagggcatcaagaggatgaggagcaggactggagtgcgctttgtgcaggagacagatgacatgacccagctgcacggcttccaccagagcctgcgggacctgagcagcgagcagatccggctgggagatgacttcaaccgggagctgagccgccgcagcagaagtgatgctgagaccaagagggccctggaggagctgacagagaagctgaatgaggcccagaagcaggaggtggtgtctgacagagtggagcggcggctgcaggagctggagcgggagatgaggacagagcgggagctggtggagcggcggcaggaccagctgggcctgatgagcctgcagctgcaggaggccctgaagaagcaggaggccaaggcagatgagcacgagggcgccatcaagaacaagctgcggcagacagaaacagagaagaaccagctggagcaggagctggagctgagccggcggctgctgaaccagagcgagggcagccgggagaccctgctgcaccaggtggaggagctgcggacccagctgaccaaggccgagggggacaggaagggcctgcagcaccaggtgtcccagatcagcaagcagcagagcaactaccaggatgagcagggcgaggactggaggttcagaagaggagtggagcgggagaagcaggacctggagaagcagatgtctgacctgcgggtgcagctgaacttcagcgccatggccagcgagctggaggaggtgaagcgctgcatggagaggaaggacaaggagaaggcccacctggccagccaggtggagaacctgacccgggagctggagaatggagagaagcagcagctgcagatgctggaccggctgaaggagatccagaaccactttgacacctgtgaggccgagaggaagcacgccgacctgcagatcagcgagctgaccaggcatgctgaagatgccaccaagcaggccgagcgctacctgtctgagctgcagcagagcgaggccctgaaggaggaggccgagaagaggcgggaggacctgaagctgaaggcccaggagagcatccggcagtggaagctgaagcacaagaagctggagcgggccctggagaagcagagcgagaccgtggatgagctgaccgggaagaacaaccagatcctgaaggagaaggatgagctgaagacccagctgtatgctgccctgcagcagatcgagaacctgaggaaggagctgaatgatgtgctgaccaagagggccctgcaggaggaggagctgcacagcaaggaggagaagctgcgggacatcaagagccaccaggccgacctggagctggaggtgaagaacagcctggacaccatccaccggctggagagcgagctgaagaagcagagcaagatccagagccagatgaaggtggagaaggcccacctggaggaggagattgctgagctgaagaagagccaggcccaggacaaggccaagctgctggagatgcaggagagcatcaaggacctgagcgccatccgggctgacctggccaacaagctggccgaggaggagcgggccaagaaggctgtgctgaaggacctgagtgacctgacagcccaggccaagagcagagatgaggagacagccaccatcatcacccagctgaagctggagagagatgtgcaccagcgggagctgaaggacctgaccagcagcctgcagagcgtgaagaccaagcatgagcagaacatccaggagctgatgaagcacttcaagaaggagaagtctgaggccgagaaccacatccgcaccctgaaggccgagagcctggaggagaagaacatggccaagatccaccggggccagctggagaagctgaagagccagtgtgaccggctgacagaggagctgacccagaatgaaaatgaaaacaagaagctgaagctgaagtaccagtgcctgaaggaccagctggaggagcgggagaagcacatcagcattgaggaggagcacctgcggaggatggaggaggcccggctgcagctgaaggaccagctgctgtgcctggagacagagcaggagagcatcctgggcgtgattggcaaggagattgatgctgcctgcaagaccttcagcaaggacagcgtggagaagctgaaggtgttcagcagcggccctgacatccactatgacccccaccgctggctggccgagagcaagaccaagctgcagtggctgtgtgaggagctgaaggagagagaaaatcgggagaagaacctgcggcaccagctgatgctgtgccggcagcagctgaggaacctgacagagaacaaggagagcgagctgcagtgcctcttccagcagatcgagcggcaggagcagctgctggatgagatccaccgggagaagagggacctgctggaggagacccagaggaaggatgaggagatgggcagcctgcaggacagagtcatcgccctggagaccagcacccaggtggccctggaccacctggagagcgtgcctgagaagctgagcctgctggaggacttcaaggacttcagaagatag

SEQ ID NO: 20374 - DNA, 5157 bp, Artificial Sequence
  Description of Artificial Sequence: Synthetic coding sequence
atgagcggcaccagcagccctgaggccgtgaagaagctgctggagaacatgcagagcgacctgcgggccctgagcctggagtgcaagaagaagtttcctcctgtgaaggaggccgctgagagcggcatcatcaaggtgaagaccatcgccgccaggaacacagagatcctggccgccctgaaggagaacagcagcgaggtggtgcagcccttcctgatgggctgcggcaccaaggagcccaagatcacccagctgtgcctggccgccatccagaggctgatgagccatgaggtggtgtctgaaacagctgctggcaacatcatcaacatgctgtggcagctgatggagaacagcctggaggagctgaagctgctgcagacagtgctggtgctgctgaccaccaacacagtggtgcatgatgaggccctgagcaaggccatcgtgctgtgcttccggctgcacttcaccaaggacaacatcaccaacaacacagctgctgccaccgtgcggcaggtggtgacagtggtgtttgagaggatggtggctgaagatgagcggcaccgggacatcatcgagcagcctgtgctggtgcagggcaacagcaacagaagatctgtgtccaccctgaagccctgtgccaaggatgcctacatgctgttccaggacctgtgccagctggtgaatgctgatgccccctactggctggtgggcatgacagagatgaccaggaccttcggcctggagctgctggagagcgtgctgaatgacttcccccaggtgttcctgcagcaccaggagttctccttcctgctgaaggagcgggtgtgccccctggtgatcaagctgttcagccccaacatcaagttccggcagggcagcagcaccagcagcagccctgcccctgtggagaagccctacttccccatctgcatgaggctgctgcgggtggtgtctgtgctgatcaagcagttctacagcctgctggtgacagaatgtgagatcttcctgagcctgctggtgaagttcctggatgctgacaagccccagtggctgcgggctgtggccgtggagagcatccaccgcttctgtgtgcagccccagctgctgcgctccttctgccagagctatgacatgaagcagcacagcaccaaggtgttccgggacatcgtgaatgccctgggcagcttcatccagagcctcttcctggtgccccccaccggcaacccagccaccagcaaccaggccggcaacaacaacctgggcggctctgtgtctgccccagccaacagcggcatggtgggcattggaggcggcgtgaccctgctgcctgcctttgagtaccggggcacctggatccccatcctgaccatcaccgtgcagggcagcgccaaggccacctacctggagatgctggacaaggtggagccccccaccatccctgagggctacgccatgtctgtggccttccactgcctgctggacctggtgcggggcatcacctccatgattgaaggagagctgggggagctggagacagagtgccagaccaccacagaggagggcagcagccccacccagagcacagagcagcaggacctgcagagcaccagtgaccagatggacaaggagatcgtgtccagagctgtgtgggaggagatggtgaatgcctgctggtgtggcctgctggccgccctgagcctgctgctggatgccagcacagatgaggccgccacagagaacatcctgaaggccgagctgaccatggccgccctgtgtggccgcctgggcctggtgaccagcagagatgccttcatcacagccatctgcaagggcagcctgcccccccactacgccctgactgtgctgaacaccaccacagctgccaccctgagcaacaagagctacagcgtgcagggccagagcgtgatgatgatcagccccagcagcgagagccaccagcaggtggtggccgtgggccagcccctggccgtgcagccccagggcaccgtgatgctgaccagcaagaacatccagtgcatgaggaccctgctgaacctggcccactgccacggggctgtgctgggcacctcctggcagctggtgctggccaccctgcagcacctggtgtggatcctgggcctgaagcccagcagcggcggggccctgaagccaggccgggctgtggagggccccagcacagtgctgaccacagctgtgatgacagacctgcccgtcatcagcaacatcctgagccggctgtttgagagcagccagtacctggatgatgtgtccctgcaccacctgatcaatgccctgtgcagcctgagcctggaggccatggacatggcctacggcaacaacaaggagcccagcctgtttgctgtggccaagctgctggagaccggcctggtgaacatgcacagaattgagatcctgtggaggcccctgaccggccacctgctggagaaggtgtgccagcaccccaacagcaggatgagggagtggggcgctgaggccctgaccagcctcatcaaggccggcctgaccttcaaccacgacccccccctgagccagaaccagaggctgcagctgctgctgctgaaccccctgaaggagatgagcaacatcaaccacccagacatccggctgaagcagctggagtgtgtgctgcagatcctgcagagccagggcgacagcctgggccctggctggcccctggtgctgggcgtgatgggcgccatcagaaatgaccagggcgagagcctcatcagaacagccttccagtgcctgcagctggtggtgacagacttcctgcccaccatgccctgcacctgcctgcagatcgtggtggatgtggccggcagctttggcctgcacaaccaggagctgaacatcagcctgaccagcatcggcctgctgtggaacatcagtgactacttcttccagagaggagagaccatcgagaaggagctgaacaaggaggaggccgcccagcagaagcaggccgaggagaagggcgtggtgctgaaccggcccttccacccagcccccccatttgactgcctgtggctgtgcctgtatgccaagctgggggagctgtgtgtggaccccaggcctgctgtgaggaagtctgctggccagaccctcttcagcaccatcggggcccacggcaccctgctgcagcacagcacctggcacacagtcatctggaaggtgctcttccacctgctggacagagtgcgggagagcagcaccacagctgacaaggagaagattgagagcggcggcggcaacatcctgatccaccacagccgggacacagctgagaagcagtgggccgagacctgggtgctgaccctggccggcgtggcccgcatcttcaacacccggcgctacctgctgcagcccctgggggacttcagccgggcctgggatgtgctgctggaccacatccagagcgctgccctgagcaagaacaatgaggtgtccctggccgccctgaagagcttccaggagatcctgcagatcgtgtcccctgtgcgggacagcgacaagccagagaccccacctgtggtgaatgtgcctgtgcctgtgctgattggccccatcagcggcatgagccggccctttgtgaggacagacagcatcggggagaagctgggccgctacagcagcagcgagccccccatcgtgacagatgagctggaggacctgaacctgtggtgggccgcctggaacacctggtacagaattggcagcgagagcaccaagccacccatcacctttgacaagctgaccttcatccccagccagcccttcctgacagccctgatccagatcttccctgccctgtaccagcacatcaagacaggcttcaacatggatgacctgcagaagctgggcgtcatcctgcacagcgccatctctgtgcccatcagcagtgatgccagccccttcatcctgcccagctacacagaagctgtgctgaccagcctgcaggaggccgtgctgacagccctggatgtgctgcagaaggccatctgtgtgggccctgagaacatgcagatcatgtacccagccatctttgaccagctgctggcctttgtggagttcagctgcaagccaccccagtatggccagctggagaccaagcacatcgccaatgccaagtacaaccagatccagctgtttgccccagctgagtgggtggccctgaactacgtgccctttgctgagaggagcctggaggtggtggtggacctgtaccagaagacagcctgccacaaggctgtggtgaatgagaaggtgctgcagaacatcatcaagaccctgcgggtgcccctgagcctgaagtacagctgccccagcgagagcacctggaagctggccgtgagcagcctgctgcgggtgctgagcatcggcctgcctgtggcccggcagcacgccagcagcggcaagtttgacagcatgtggccagagctggccaacacctttgaggacttcctgttcaccaagagcatccccccagacaacctgagcatccaggagttccagagaaatgaaaatattgatgtggaggtggtgcagctgatcagcaatgagatcctgccctatgccaacttcatccccaaggagtttgtgggccagatcatgaccatgctgaacaagggcagcatccacagccagagcagcagcttcacagaagctgagattgacatccggctgcgggaggagttcagcaagatgtgctttgagaccctgctgcagttctccttcagcaacaaggtgaccaccccccaggagggctacatcagcaggatggccctgtctgtgctgctgaagaggagccaggatgtgctgcaccgctacattgaagatgagcggctgagcggcaagtgccccctgccccggcagcaggtgacagagatcatctttgtgctgaaggctgtgtccaccctgattgacagcctgaagaagacccagccagaaaatgtggatggcaacacctgggcccaggtgattgccctgtaccccaccctggtggagtgcatcacctgcagcagcagcgaggtgtgcagcgccctgaaggaggccctggtgcccttcaaggacttcatgcagcccccagccagccgggtgcagaatggagagagctag

SEQ ID NO: 20375 - DNA, 2100 bp, Artificial Sequence
  Description of Artificial Sequence: Synthetic coding sequence
atgagcagcaggaaggtgctggccatccaggccaggaagaggcggcccaagcgggagaagcaccccaagaagccagagccccagcagaaggcccccctggtgcccccacctcctcctcctcctcctcctcctcctccacccctgcctgaccccaccccacctgagcctgaggaggagatcctgggcagtgatgatgaggagcaggaggaccctgctgactactgcaagggcggctaccaccctgtgaagatcggggacctcttcaacggccgctaccacgtgatcaggaagctgggctggggccacttcagcacagtgtggctgtgctgggacatgcagggcaagagatttgtggccatgaaggtggtgaagagcgcccagcactacacagaaacagccctggatgagatcaagctgctgaagtgtgtgcgggagagtgaccccagcgaccccaacaaggacatggtggtgcagctgattgatgacttcaagatcagcggcatgaatggcatccacgtgtgcatggtgtttgaggtgctgggccaccacctgctgaagtggatcatcaagagcaactaccagggcctgcctgtgcgctgtgtgaagagcatcatccggcaggtgctgcagggcctggactacctgcacagcaagtgcaagatcatccacacagacatcaagccagagaacatcctgatgtgtgtggatgatgcctacgtgcggaggatggctgctgaggccacagagtggcagaaggccggggcccctcctccttctggcagcgctgtgtccacagccccccagcagaagcccatcggcaagatcagcaagaacaagaagaagaagctgaagaagaagcagaagaggcaggccgagctgctggagaagaggctgcaggagattgaggagctggagcgggaggccgagaggaagatcatcgaggagaacatcaccagcgctgcccccagcaatgaccaggatggagagtactgcccagaggtgaagctgaagaccaccggcctggaggaggccgctgaggccgagacagccaaggacaatggagaggccgaggaccaggaggagaaggaggatgctgagaaggagaacatcgagaaggatgaagatgatgtggaccaggagctggccaacatcgaccccacctggattgagagccccaagaccaacggccacattgaaaatggccccttcagcctggagcagcagctggatgatgaagatgatgatgaggaggactgccccaaccctgaggagtacaacctggatgagcccaatgctgagagtgactacacctacagcagcagctatgagcagttcaacggggagctgcccaacggccgccacaagatccctgagagccagtttcctgagttcagcaccagcctcttcagcggcagcctggagcctgtggcctgtggctctgtgctgtctgagggcagccccctgacagagcaggaggagagcagccccagccatgacaggagcaggacagtgtctgccagcagcactggagacctgcccaaggccaagaccagggctgctgacctgctggtgaaccccctggaccccagaaatgctgacaagatccgggtgaagattgctgacctgggcaatgcctgctgggtgcacaagcacttcacagaggacatccagacccggcagtaccgcagcattgaggtgctgattggagctggctacagcaccccagctgacatctggagcacagcctgcatggcctttgagctggccaccggggactacctgtttgagccccacagcggggaggactacagcagagatgaggaccacatcgcccacatcatcgagctgctgggcagcatccccaggcactttgccctgagcggcaagtacagccgggagttcttcaacagaagaggagagctgcggcacatcaccaagctgaagccctggagcctgtttgatgtgctggtggagaagtatggctggccccatgaagatgctgcccagttcacagacttcctgatccccatgctggagatggtgcctgagaagagggccagcgctggggagtgcctgcggcacccctggctgaacagctag

SEQ ID NO: 20376 - DNA, 1113 bp, Artificial Sequence
  Description of Artificial Sequence: Synthetic coding sequence
atgggcttcaaccggcccagcaagatccaggagaatgccctgcccctgatgctggccgagcccccccagaacctgattgcccagagccagagcggcaccgggaagacagctgcctttgtgctggccatgctgagccaggtggagcccgccaacaagtacccccagtgcctgtgcctgagccccacctatgagctggccctgcagacaggcaaggtgattgagcagatgggcaagttctacccagagctgaagctggcctatgctgtgcggggcaacaagctggagcggggccagaagatcagcgagcagatcgtcatcggcaccccaggcaccgtgctggactggtgcagcaagctgaagttcatcgaccccaagaagatcaaggtgtttgtgctggatgaagcagatgtgatgattgccacccagggccaccaggaccagagcatccgcatccagaggatgctgcccaggaactgccagatgctgctcttcagcgccacctttgaagattctgtgtggaagtttgcccagaaggtggtgcctgaccccaacgtcatcaagctgaagcgggaggaggagaccctggacaccatcaagcagtactacgtgctgtgcagcagcagagatgagaagttccaggccctgtgcaacctgtatggagccatcaccatcgcccaggccatgatcttctgccacaccaggaagacagcctcctggctggccgctgagctgagcaaggagggccaccaggtggccctgctgtctggagagatgatggtggagcagagagctgctgtgattgagcgcttccgggagggcaaggagaaggtgctggtgaccaccaacgtgtgtgcccggggcattgatgtggagcaggtgtctgtggtgatcaactttgacctgcctgtggacaaggatggcaacccagacaatgagacctacctgcaccgcatcggccgcacaggccgctttgggaagaggggcctggccgtgaacatggtggacagcaagcacagcatgaacatcctgaaccgcatccaggagcacttcaacaagaagattgaaaggctggacacagatgacctggatgaaattgagaagatcgccaactag

SEQ ID NO: 20377 - DNA, 2640 bp, Artificial Sequence
  Description of Artificial Sequence: Synthetic coding sequence
atgttctggaagtttgacctgcacagcagcagccacatcgacaccctgctggagcgggaggatgtgaccctgaaggagctgatggatgaagaagatgtgctgcaggagtgcaaggcccagaacaggaagctgattgagttcctgctgaaggccgagtgcctggaggacctggtgtccttcatcatcgaggagcccccccaggacatggatgagaagatccgctacaagtaccccaacatcagctgtgagctgctgaccagtgatgtgtcccagatgaatgaccggctgggggaggatgagagcctgctgatgaagctgtacagcttcctgctgaatgacagccccctgaaccccctgctggccagcttcttcagcaaggtgctgagcatcctgatcagcaggaagccagagcagatcgtggacttcctgaagaagaagcatgactttgtggacctgatcatcaagcacatcggcaccagcgccatcatggacctgctgctgcggctgctgacctgcatcgagcccccccagccccggcaggatgtgctgaactggctgaatgaggagaagatcatccagaggctggtggagatcgtgcaccccagccaggaggaggacagacacagcaatgccagccagagcctgtgtgagatcgtgcggctgagccgggaccagatgctgcagatccagaacagcacagagccagaccccctgctggccaccctggagaagcaggagatcatcgagcagctgctgagcaacatcttccacaaggagaagaatgaaagtgccatcgtgtctgccatccagatcctgctgaccctgctggagacccggcggcccacctttgagggccacatcgagatctgccccccaggcatgagccacagcgcctgcagcgtgaacaagtctgtgctggaggccatccggggccgcctgggcagcttccacgagctgctgctggagccccccaagaagtctgtgatgaagaccacctggggcgtgctggacccccctgtgggcaacacccggctgaatgtcatccgcctcatcagcagcctgctgcagaccaacaccagcagcatcaatggagacctgatggagctgaacagcattggagtcatcctgaacatgttcttcaagtacacctggaacaacttcctgcacacccaggtggagatctgcatcgccctgatcctggccagcccctttgaaaatacagaaaatgccaccatcacagaccaggacagcactggagacaacctgctgctgaagcacctgttccagaagtgccagctgattgaaagaatcctggaggcctgggagatgaatgagaagaagcaggccgagggcggcagaagacatggctacatgggccacctgacccgcatcgccaactgcatcgtgcacagcacagacaagggccccaacagcgccctggtgcagcagctgatcaaggacctgcctgatgaggtgcgggagcgctgggagaccttctgcaccagcagcctgggggagaccaacaagaggaacacagtggacctggtgaccacctgccacatccacagcagcagtgatgatgaaattgacttcaaggagaccggcttcagccaggacagcagcctgcagcaggccttcagtgactaccagatgcagcagatgaccagcaacttcatcgaccagtttggcttcaatgatgagaagtttgctgaccaggatgacattggaaatgtgtcctttgacagagtgtctgacatcaacttcaccctgaacaccaatgaaagtggcaacatcgccctgtttgaggcctgctgcaaggagcgcatccagcagtttgatgatggcggcagtgatgaggaggacatctgggaggagaagcacatcgccttcaccccagagagccagaggaggagcagcagcggcagcacagattctgaggagagcacagattctgaggaggaggatggagccaagcaggacctgtttgagcccagcagcgccaacacagaggacaagatggaggtggacctgtctgagccccccaactggagcgccaactttgatgtgcccatggagaccacccatggagcccccctggacagcgtgggcagtgatgtgtggagcacagaggagcccatgcccaccaaggagaccggctgggccagcttcagcgagttcaccagcagcctgagcaccaaggacagcctgcggagcaacagccctgtggagatggagaccagcacagagcccatggaccccctgaccccatctgctgctgccctggccgtgcagcctgaggccgccggctctgtggccatggaggccagcagtgatggagaagaagatgctgagagcacagacaaggtgacagagaccgtgatgaatggaggcatgaaggagaccctgagcctgactgtggatgccaagacagaaacagctgtgttcaagaggctgctgggcggctgcagcgaggagggcaagctgagcaccagccaggatgctgcctgcaaggatgctgaagaatgtcctgagacagctgaggccaagtgtgccgcccccaggcctcccagcagcagccctgagcagaggacaggccagcccagcgcccctggggacacctctgtgaatggacctgtgtag

SEQ ID NO: 20378 - DNA, 2622 bp, Artificial Sequence
  Description of Artificial Sequence: Synthetic coding sequence
atgttctggaagtttgacctgcacagcagcagccacatcgacaccctgctggagcgggaggatgtgaccctgaaggagctgatggatgaagaagatgtgctgcaggagtgcaaggcccagaacaggaagctgattgagttcctgctgaaggccgagtgcctggaggacctggtgtccttcatcatcgaggagcccccccaggacatggatgagaagatccgctacaagtaccccaacatcagctgtgagctgctgaccagtgatgtgtcccagatgaatgaccggctgggggaggatgagagcctgctgatgaagctgtacagcttcctgctgaatgacagccccctgaaccccctgctggccagcttcttcagcaaggtgctgagcatcctgatcagcaggaagccagagcagatcgtggacttcctgaagaagaagcatgactttgtggacctgatcatcaagcacatcggcaccagcgccatcatggacctgctgctgcggctgctgacctgcatcgagcccccccagccccggcaggatgtgctgaactggctgaatgaggagaagatcatccagaggctggtggagatcgtgcaccccagccaggaggaggacagacacagcaatgccagccagagcctgtgtgagatcgtgcggctgagccgggaccagatgctgcagatccagaacagcacagagccagaccccctgctggccaccctggagaagcaggagatcatcgagcagctgctgagcaacatcttccacaaggagaagaatgaaagtgccatcgtgtctgccatccagatcctgctgaccctgctggagacccggcggcccacctttgagggccacatcgagatctgccccccaggcatgagccacagcgcctgcagcgtgaacaagtctgtgctggaggccatccggggccgcctgggcagcttccacgagctgctgctggagccccccaagaagtctgtgatgaagaccacctggggcgtgctggacccccctgtgggcaacacccggctgaatgtcatccgcctcatcagcagcctgctgcagaccaacaccagcagcatcaatggagacctgatggagctgaacagcattggagtcatcctgaacatgttcttcaagtacacctggaacaacttcctgcacacccaggtggagatctgcatcgccctgatcctggccagcccctttgaaaatacagaaaatgccaccatcacagaccaggacagcactggagacaacctgctgctgaagcacctgttccagaagtgccagctgattgaaagaatcctggaggcctgggagatgaatgagaagaagcaggccgagggcggcagaagacatggctacatgggccacctgacccgcatcgccaactgcatcgtgcacagcacagacaagggccccaacagcgccctggtgcagcagctgatcaaggacctgcctgatgaggtgcgggagcgctgggagaccttctgcaccagcagcctgggggagaccaacaagaggaacacagtggacctggtgaccacctgccacatccacagcagcagtgatgatgaaattgacttcaaggagaccggcttcagccaggacagcagcctgcagcaggccttcagtgactaccagatgcagcagatgaccagcaacttcatcgaccagtttggcttcaatgatgagaagtttgctgaccaggatgacattggaaatgtgtcctttgacagagtgtctgacatcaacttcaccctgaacaccaatgaaagtggcaacatcgccctgtttgaggcctgctgcaaggagcgcatccagcagtttgatgatggcggcagtgatgaggaggacatctgggaggagaagcacatcgccttcaccccagagagccagaggaggagcagcagcggcagcacagattctgaggagagcacagattctgaggaggaggatggagccaagcaggacctgtttgagcccagcagcgccaacacagaggacaagatggaggtggacctgtctgagccccccaactggagcgccaactttgatgtgcccatggagaccacccatggagcccccctggacagcgtgggcagtgatgtgtggagcacagaggagcccatgcccaccaaggagaccggctgggccagcttcagcgagttcaccagcagcctgagcaccaaggacagcctgcggagcaacagccctgtggagatggagaccagcacagagcccatggaccccctgaccccatctgctgctgccctggccgtgcagcctgaggccgccggctctgtggccatggaggccagcagtgatggagaagaagatgctgagagcacagacaaggtgacagagaccgtgatgaatggaggcatgaaggagaccctgagcctgactgtggatgccaagacagaaacagctgtgttcaagtctgaggagggcaagctgagcaccagccaggatgctgcctgcaaggatgctgaagaatgtcctgagacagctgaggccaagtgtgccgcccccaggcctcccagcagcagccctgagcagaggacaggccagcccagcgcccctggggacacctctgtgaatggacctgtgtag

SEQ ID NO: 20379 - DNA, 2640 bp, Artificial Sequence
  Description of Artificial Sequence: Synthetic coding sequence
atgttctggaagtttgacctgcacagcagcagccacatcgacaccctgctggagcgggaggatgtgaccctgaaggagctgatggatgaagaagatgtgctgcaggagtgcaaggcccagaacaggaagctgattgagttcctgctgaaggccgagtgcctggaggacctggtgtccttcatcatcgaggagcccccccaggacatggatgagaagatccgctacaagtaccccaacatcagctgtgagctgctgaccagtgatgtgtcccagatgaatgaccggctgggggaggatgagagcctgctgatgaagctgtacagcttcctgctgaatgacagccccctgaaccccctgctggccagcttcttcagcaaggtgctgagcatcctgatcagcaggaagccagagcagatcgtggacttcctgaagaagaagcatgactttgtggacctgatcatcaagcacatcggcaccagcgccatcatggacctgctgctgcggctgctgacctgcatcgagcccccccagccccggcaggatgtgctgaactggctgaatgaggagaagatcatccagaggctggtggagatcgtgcaccccagccaggaggaggacagacacagcaatgccagccagagcctgtgtgagatcgtgcggctgagccgggaccagatgctgcagatccagaacagcacagagccagaccccctgctggccaccctggagaagcaggagatcatcgagcagctgctgagcaacatcttccacaaggagaagaatgaaagtgccatcgtgtctgccatccagatcctgctgaccctgctggagacccggcggcccacctttgagggccacatcgagatctgccccccaggcatgagccacagcgcctgcagcgtgaacaagtctgtgctggaggccatccggggccgcctgggcagcttccacgagctgctgctggagccccccaagaagtctgtgatgaagaccacctggggcgtgctggacccccctgtgggcaacacccggctgaatgtcatccgcctcatcagcagcctgctgcagaccaacaccagcagcatcaatggagacctgatggagctgaacagcattggagtcatcctgaacatgttcttcaagtacacctggaacaacttcctgcacacccaggtggagatctgcatcgccctgatcctggccagcccctttgaaaatacagaaaatgccaccatcacagaccaggacagcactggagacaacctgctgctgaagcacctgttccagaagtgccagctgattgaaagaatcctggaggcctgggagatgaatgagaagaagcaggccgagggcggcagaagacatggctacatgggccacctgacccgcatcgccaactgcatcgtgcacagcacagacaagggccccaacagcgccctggtgcagcagctgatcaaggacctgcctgatgaggtgcgggagcgctgggagaccttctgcaccagcagcctgggggagaccaacaagaggaacacagtggacctggtgaccacctgccacatccacagcagcagtgatgatgaaattgacttcaaggagaccggcttcagccaggacagcagcctgcagcaggccttcagtgactaccagatgcagcagatgaccagcaacttcatcgaccagtttggcttcaatgatgagaagtttgctgaccaggatgacattggaaatgtgtcctttgacagagtgtctgacatcaacttcaccctgaacaccaatgaaagtggcaacatcgccctgtttgaggcctgctgcaaggagcgcatccagcagtttgatgatggcggcagtgatgaggaggacatctgggaggagaagcacatcgccttcaccccagagagccagaggaggagcagcagcggcagcacagattctgaggagagcacagattctgaggaggaggatggagccaagcaggacctgtttgagcccagcagcgccaacacagaggacaagatggaggtggacctgtctgagccccccaactggagcgccaactttgatgtgcccatggagaccacccatggagcccccctggacagcgtgggcagtgatgtgtggagcacagaggagcccatgcccaccaaggagaccggctgggccagcttcagcgagttcaccagcagcctgagcaccaaggacagcctgcggagcaacagccctgtggagatggagaccagcacagagcccatggaccccctgaccccatctgctgctgccctggccgtgcagcctgaggccgccggctctgtggccatggaggccagcagtgatggagaagaagatgctgagagcacagacaaggtgacagagaccgtgatgaatggaggcatgaaggagaccctgagcctgactgtggatgccaagacagaaacagctgtgttcaagagggtgctgaagagctaccgggaggagggcaagctgagcaccagccaggatgctgcctgcaaggatgctgaagaatgtcctgagacagctgaggccaagtgtgccgcccccaggcctcccagcagcagccctgagcagaggacaggccagcccagcgcccctggggacacctctgtgaatggacctgtgtag

SEQ ID NO: 20380 - DNA, 1134 bp, Artificial Sequence
  Description of Artificial Sequence: Synthetic coding sequence
atgtctgatgaggtgttcagcaccaccctggcctacaccaagagccccaaggtgaccaagaggaccaccttccaggatgagctgatccgggccatcacagcccggagcgcccggcagaggagcagcgagtacagtgatgactttgacagtgatgaaattgtgtccctgggggacttcagtgacaccagcgcagatgagaacagcgtgaacaagaagatgaatgacttccacatcagtgatgatgaggagaagaaccccagcaagctgctcttcctgaagaccaacaagagcaatggaaacatcaccaaggatgagcctgtgtgtgccatcaagaatgaggaggagatggccccagatggctgtgaggacatcgtggtgaagagcttcagcgagagccagaacaaggatgaggagtttgagaaggacaagatcaagatgaagcccaagccccgcatcctgagcatcaagagcaccagcagcgctgagaacaacagcctggacacagatgaccacttcaagcccagcccccggcccaggtccatgctgaagaagaagagccacatggaggagaaggatggcctggaggacaaggagacagccctgtctgaggagctggagctgcacagcgcccccagcagcctgcccacccccaacggcatccagctggaggccgagaagaaggccttcagcgagaacctggaccctgaggacagctgcctgaccagcctggccagcagcagcctgaagcagatcctgggggacagcttcagccctggcagcgagggcaatgccagcggcaaggaccccaatgaggagatcacagagaaccacaacagcctgaagagtgatgagaacaaggaaaattccttctctgctgaccacgtgaccacagctgtggagaagagcaaggagagccaggtgacagcagatgacctggaggaggagaaggccaaggccgagctgatcatggatgatgacagaacagtggaccccctgctgagcaagagccagagcatcctgatcagcaccagcgccacagccagcagcaagaagaccatcgaggacaggaacatcaagaacaagaagagcaccaacaacagagccagcagcgccagcgccagcaaggccagctag

SEQ ID NO: 20381 - DNA, 576 bp, Artificial Sequence; identical to SEQ ID NO: 18830
  Description of Artificial Sequence: Synthetic coding sequence

SEQ ID NO: 20382 - DNA, 576 bp, Artificial Sequence; identical to SEQ ID NO: 18830
  Description of Artificial Sequence: Synthetic coding sequence

SEQ ID NO: 20383 - DNA, 570 bp, Artificial Sequence
  Description of Artificial Sequence: Synthetic coding sequence
atgggcaagagctgcaaggtggtggtgtgtggccaggcctctgtgggcaagaccagcatcctggagcagctgctgtatggcaaccacgtggtggccatgattgagacccaggaggacatctacgtgggcagcattgaaacagaccggggcgtgcgggagcaggtgcgcttctatgacacccggggcctgagagatggagctgagctgcccaggcactgcttcagctgcacagatggctacgtgctggtgtacagcacagacagccgggagagcttccagagggtggagctgctgaagaaggagattgacaagagcaaggacaagaaggaggtgaccatcgtggtgctgggcaacaagtgtgacctgcaggagcagaggagagtggaccctgatgtggcccagcactgggccaagtctgagaaggtgaagctgtgggaggtgtctgtggccgaccggcgcagcctgctggagccctttgtgtacctggccagcaagatgacccagccccagagcaagagcgccttccccctgagcaggaagaacaagggcagcggcagcctggatggatag

SEQ ID NO: 20384 - DNA, 576 bp, Artificial Sequence; identical to SEQ ID NO: 18830
  Description of Artificial Sequence: Synthetic coding sequence

SEQ ID NO: 20385 - DNA, 1005 bp, Artificial Sequence
  Description of Artificial Sequence: Synthetic coding sequence
atggccgaggaggtgcggcgggaggaggccagcggcgtgggccgggcccggacccccacccctggggccctgcgggccccccagctggtgacagaggccccacccctgcaccctggccacaccctgatgaaggccaccgtgctgatgaggcagcccggccgggtgcaggagatcgtgggcgccctgaggaagggcggcggggaccggctgcaggtgatcagtgactttgacatgaccctgagcagatttgcctacaacgggaagcgctgccccagcagctacaacatcctggacaacagcaagatcatcagcgaggagtgcaggaaggagctgacagccctgctgcaccactactaccccattgaaattgacccccacaggacagtgaaggagaagctgccccacatggtggagtggtggaccaaggcccacaacctgctgtgccagcagaagatccagaagttccagatcgcccaggtggtgcgggagagcaatgccatgctgcgggagggctacaagaccttcttcaacaccctgtaccacaacaacatccccctcttcatcttctctgctggcattggagacatcctggaggagatcatccggcagatgaaggtgttccaccccaacatccacatcgtgagcaactacatggacttcaatgaagatggcttcctgcagggcttcaagggccagctgatccacacctacaacaagaacagcagcgcctgtgaaaattctggctacttccagcagctggagggcaagaccaacgtcatcctgctgggggacagcatcggggacctgaccatggctgatggagtgcctggggtgcagaacatcctgaagattggcttcctgaatgacaaggtggaggagcggcgggagcgctacatggacagctatgacatcgtgctggagaaggatgagaccctggatgtggtgaatggcctgctgcagcacatcctgtgccagggcgtgcagctggagatgcagggcccctag

SEQ ID NO: 20386 - DNA, 531 bp, Artificial Sequence; identical to SEQ ID NO: 18672
  Description of Artificial Sequence: Synthetic coding sequence

SEQ ID NO: 20387 - DNA, 912 bp, Artificial Sequence
  Description of Artificial Sequence: Synthetic coding sequence
atggacagcctgcctgatgagttctttgtgcgccaccctgctgtggaggaccagaggaaggaggagacagagaacaagctggagaagagcagcggccagctgaacaagcaggagaatgacatccccacagacctggtgcctgtgaacctgctgctggaggtgaagaagctgctgaatgccatcaacaccctgcccaagggcgtggtgccccacatcaagaagttcctgcaggaggacttctccttccagaccatgcagcgggaggtggccgccaacagccagaatggagaggagatcgtgcctgccctgaccctgcgcttcctgatcacccagctggaggccgccctgaggaacatccaggccggcaactacacagcccaccagatcaacatcggctactacctgaccctgctcttcctgtatggagtggccctgacagagcggggcaagaaggaggactacacagaagctgagaacaagttcctggtgatgaagatgatgatccaggagaatgagatctgtgagaacttcatgagcctggtgtacttcggccggggcctgctgcgctgtgcccagaagcgctacaacggcggcctgctggagttccacaagagcctgcaggagattggagacaagaatgaccactggtttgatattgaccccacagaagatgaggacctgcccaccaccttcaaggacctgctgaacaacttcatcaagaccacagagagcaacatcatgaagcagaccatctgcagctacctggactgtgagaggagctgtgaggccgacatcctgaagaacaccagctacaagggcttcttccagctgatgtgcagcaagagctgctgcgtgtacttccacaagatctgctggaagaagttcaagaacctgaagtacccaggcttctag

SEQ ID NO: 20388 - DNA, 1869 bp, Artificial Sequence
  Description of Artificial Sequence: Synthetic coding sequence
atggacctgctgaccagagaaaatgtggccctgaaggtggagagcgcccagcagcccaagcaggtgctgaagatggaggtggccgtgctgaagaagctgcagggcaaggaccacgtgtgccgcttcatcggctgcggcagaaatgagaagttcaactacgtggtgatgcagctgcagggcaggaacctggccgacctgcggcgcagccagccccggggcaccttcaccctgagcaccaccctgcggctgggcaagcagatcctggagagcattgaggccatccacagcgtgggcttcctgcaccgggacatcaagcccagcaactttgccatgggccgcctgcccagcacctacaggaagtgctacatgctggactttggcctggcccggcagtacaccaacaccactggagatgtgcggcccccaagaaatgtggccggcttccggggcaccgtgcgctatgcctctgtgaatgcccacaagaaccgggagatgggcagacatgatgacctgtggagcctcttctacatgctggtggagtttgctgtgggccagctgccctggaggaagatcaaggacaaggagcaggtgggcatgatcaaggagaagtatgagcacaggatgctgctgaagcacatgcccagcgagttccacctgttcctggaccacatcgccagcctggactacttcaccaagccagactaccagctgatcatgtctgtgtttgaaaattccatgaaggagcggggcattgctgaaaatgaggcctttgactgggagaaggccggcacagatgccctgctgagcaccagcaccagcaccccaccccagcagaacacccggcagacagctgccatgtttggagtggtgaatgtgacccctgtgcctggggacctgctgcgggagaacacagaagatgtgctgcagggcgagcacctgagtgaccaggagaatgccccacccatcctgcccggccggcccagcgagggcctgggccccagcccccacctggtgccccaccctgggggccctgaggccgaggtgtgggaggagacagatgtgaacagaaacaagctgcgcatcaacatcggcaagagcccctgtgtggaggaggagcagagccggggcatgggcgtgcccagcagccctgtgcgggcccccccagacagccccaccacccctgtgcgcagcctgcgctacagaagagtgaacagccctgagagcgagcggctgagcacagcagatggccgggtggagctgcctgagaggaggagcaggatggacctgcccggcagccccagccggcaggcctgcagcagccagcctgcccagatgctgtctgtggacaccggccatgctgaccggcaggccagcggccgcatggatgtgtctgcctctgtggagcaggaggccctgagcaatgccttccgctctgtgcccctggccgaggaggaggactttgacagcaaggagtgggtgatcatcgacaaggagacagagctgaaggacttccccccaggagctgagcccagcaccagcggcaccacagatgaggagcctgaggagctgcggcccctgcctgaggagggggaggagcggcggcggctgggcgctgagccccccttccccctgaccccagccctgggcaccccacccagcacagagcgggtgggcccccaccggcccacagaaacagtgggcggcggccagaccctgggcgccctgcccccagctgtgcagcccccagccaccactggagtgctgcgggtgctgctgctgcatgctggagatggagccctgcccagccccaggagaagaaggctgctgggcctgctgcgcttcccccacagcgcccagcccctgggctag

SEQ ID NO: 20389 - DNA, 447 bp, Artificial Sequence
  Description of Artificial Sequence: Synthetic coding sequence
atggctgctgccatggtgcccggccgctctgagagctgggagcggggggagcccggccgcccagccctgtacttctgtggcagcatccggggcggccgggaggacaggaccctgtatgagcgcatcgtgtcccggctgcggagatttggaacagtgctgacagagcacgtggccgctgctgagctgggcgcccggggggaggaggccgccggcggggacaggctcatccacgagcaggacctggagtggctgcagcaggctgatgtggtggtggccgaggtgacccagcccagcctgggcgtgggctatgagctgggccgggctgtggccttcaacaagaggatcctgtgcctcttccggccccagagcggccgcggggagcaccccaagcccccatcctggctgtccatggaccctgccctgagcagcttccctgggggcctgtag

SEQ ID NO: 20390 - DNA, 606 bp, Artificial Sequence
  Description of Artificial Sequence: Synthetic coding sequence
atggtgaacagctgctgcggctctgtgtgcagcgaccagggctgcggcctggagaactgctgccggcccagctgctgccagaccacctgctgcaggaccacctgctgccggcccagctgctgcgtgagcagctgctgccggccccagtgctgccagagcgtgtgctgccagcccacctgctgccggcccagctgctgccagaccacctgctgcaggaccacctgctgccggcccagctgctgcgtgagcagctgctgccggccccagtgctgccagagcgtgtgctgccagcccacctgctgccggcccagctgctgccagaccacctgctgcaggaccacctgctgccggcccagctgctgcgtgagcagctgctgccggccccagtgctgccagagcgtgtgctgccagcccacctgctgccggcccagctgctgcatcagcagcagctgctgccccagctgctgtgagagcagctgctgccggccctgctgctgcctgcggcctgtgtgtggccgggtgtcctgccacaccacctgctaccggcccacctgtgtgatcagcacctgcccccggcccctgtgctgtgccagcagctgctgctag

SEQ ID NO: 20391 - DNA, 387 bp, Artificial Sequence; identical to SEQ ID NO: 20290
  Description of Artificial Sequence: Synthetic coding sequence

SEQ ID NO: 20392 - DNA, 1140 bp, Artificial Sequence
  Description of Artificial Sequence: Synthetic coding sequence
atgagcctgcggctgagcagcgccagccgccgcagctgcccccggcccaccaccggcagcctgcggctgtatggaggcggcaccagctttggcaccggcaacagctgtggcatctctggaattggcagcggcttcagcagcgcctttggaggcagcagcagcggcggcaacacaggaggcggcaacccctgtgccggcttcaccgtgaatgaaagaggcctgctgtctggaaatgagaaggtgaccatgcagaacctgaatgaccggctggccagctacctggacagcgtgcacgccctggaggaggccaatgctgacctggagcagaagatcaagggctggtatgagaagtttggacctggcagctgccggggcctggaccatgactacagccgctacttccccatcattgatgacctgaagaaccagatcatcgccagcaccaccagcaatgccaatgctgtgctgcagattgacaatgcccggctgacagcagatgacttccggctgaagtatgaaaatgagctggccctgcaccagagcgtggaggctgatgtgaatggcctgcggcgggtgctggatgagatcaccctgtgcaggacagacctggagatccagtatgagaccctgtctgaggagatgacctacctgaagaagaaccacaaggaggagatgcaggtgctgcagtgtgccgccggcggcaatgtgaatgtggagattgagctgcagagcctgctggccaccaagcacagcctggagtgcagcctgacagaaacagagagcaactactgtgcccagctggcccagatccaggcccagatcggggccctggaggagcagctgcaccaggtgaggacagaaacagagggccagaagctggagtatgagcagctgctggacatcaagctgcacctggagaaggagattgagacctactgcctgctgattggaggagatgatggagcctgcaagagcggcggctacaagagcaaggactatggcagcggaaatgtgggcagccaggtgaaggaccctgccaaggccatcgtggtgaagaaggtgctggaggaggtggaccagaggagcaagatcctgaccacccggctgcacagcctggaggagaagagccagagcaactag

SEQ ID NO: 20393 - DNA, 768 bp, Artificial Sequence
  Description of Artificial Sequence: Synthetic coding sequence
atggacaaggatgaggaggccctgaaggccgcccaggccgagctgaaggaggcccggcggcagtggcaccacctgcaggtggagattgagagcctgcatgctgtggagcggggcctggagaacagcctgcacgccagcgagcagcactaccagatgcagctgcaggacctggagaccgtgattgagggcctggagaaggagctgcaggaggtgcggcggggcatcgagaagcagctgcaggagcacgagatgctgctgaacaccaagatgaggctggagcaggagatcgccacctaccgccacctgctggagaaggaggagatccgctactacggctgcatccagggcggcaagaaggacaagaagcccaccaccagccgggtgggctttgtgctgcccagcgccatcatcaatgagatctccttcaccaccaaggtgccccagaagtatgaaaatgaaaatgtggagaccgtgaccaagcaggccatcctgaatggcagcatcgtgaaggagagcacagaggcccacggcaccatccagacagagaaggtggatgaagtcatcaaggagtgggagggcagcttcttcaaggacaacccccggctgaggaagaagtctgtgtccctgcgctttgacctgcacctggccgccacagatgagggctgcctggagaccaagcaggacaacctgcctgacatcgaggtgcggctcatcatgaggaggagctgcagcatccccagcatcaagccacccagcacagccaactag

SEQ ID NO: 20394 - DNA, 888 bp, Artificial Sequence
  Description of Artificial Sequence: Synthetic coding sequence
atggagctgagccagctgctgaatgagatccgggccaactatgagaagatcctgaccaggaaccagattgaaacagtgctgagcacccgcatccagctggaggaggacatcagcaagaagatggacaaggatgaggaggccctgaaggccgcccaggccgagctgaaggaggcccggcggcagtggcaccacctgcaggtggagattgagagcctgcatgctgtggagcggggcctggagaacagcctgcacgccagcgagcagcactaccagatgcagctgcaggacctggagaccgtgattgagggcctggagaaggagctgcaggaggtgcggcggggcatcgagaagcagctgcaggagcacgagatgctgctgaacaccaagatgaggctggagcaggagatcgccacctaccgccacctgctggagaaggaggagatccgctactacggctgcatccagggcggcaagaaggacaagaagcccaccaccagccgggtgggctttgtgctgcccagcgccatcatcaatgagatctccttcaccaccaaggtgccccagaagtatgaaaatgaaaatgtggagaccgtgaccaagcaggccatcctgaatggcagcatcgtgaaggagagcacagaggcccacggcaccatccagacagagaaggtggatgaagtcatcaaggagtgggagggcagcttcttcaaggacaacccccggctgaggaagaagtctgtgtccctgcgctttgacctgcacctggccgccacagatgagggctgcctggagaccaagcaggacaacctgcctgacatcgaggtgcggctcatcatgaggaggagctgcagcatccccagcatcaagccacccagcacagccaactag

SEQ ID NO: 20395 - DNA, 1860 bp, Artificial Sequence; identical to SEQ ID NO: 19352
  Description of Artificial Sequence: Synthetic coding sequence

SEQ ID NO: 20396 - DNA, 1860 bp, Artificial Sequence; identical to SEQ ID NO: 19352
  Description of Artificial Sequence: Synthetic coding sequence

SEQ ID NO: 20397 - DNA, 1170 bp, Artificial Sequence
  Description of Artificial Sequence: Synthetic coding sequence
atgctgcgctggacagtgcacctggagggcggccccaggagagtgaaccacgccgctgtggccgtgggccaccgggtgtacagctttggaggctactgcagcggggaggactatgagaccctgcggcagattgatgtgcacatcttcaatgctgtgtccctgcgctggaccaagctgccccctgtgaagagcgccatccggggccaggcccctgtggtgccctacatgagatatggccacagcacagtgctgattgatgacacagtgctgctgtggggcggcagaaatgacacagagggcgcctgcaatgtgctgtatgcctttgatgtgaacacccacaagtggttcaccccccgggtgtctggaacagtgcctggggccagagatggccacagcgcctgtgtgctgggcaagatcatgtacatctttggaggctatgagcagcaggccgactgcttcagcaatgacatccacaagctggacaccagcaccatgacctggaccctcatctgcaccaagggcagccctgcccgctggagggacttccacagcgccaccatgctgggcagccacatgtatgtgtttggaggccgggctgaccgcttcggccccttccacagcaacaatgagatctactgcaaccgcatccgggtgtttgacaccaggacagaggcctggctggactgcccccccacccctgtgctgcctgagggcagaagaagccacagcgccttcggctacaacggggagctgtacatctttggaggctacaatgcccggctgaacagacacttccatgacctgtggaagttcaaccctgtgtccttcacctggaagaagattgagcccaagggcaagggcccctgcccccggcggcggcagtgctgctgcatcgtgggggacaagatcgtgctgtttggaggcaccagccccagccctgaggagggcctgggagatgaatttgacctgattgaccacagcgacctgcacatcctggacttcagccccagcctgaagaccctgtgcaagctggccgtcatccagtacaacctggaccagagctgcctgccccatgacatccgctgggagctgaatgccatgaccaccaacagcaacatcagccggcccatcgtgagcagcccctttgcctaccccctgcccagcgcctag

SEQ ID NO: 20398 - DNA, 549 bp, Artificial Sequence
  Description of Artificial Sequence: Synthetic coding sequence
atgcccatccccccacctcctcctcctcctcctggccccccacctccacccaccttccaccaggccaacacagagcagcccaagctgagcagagatgagcagaggggccgcggggccctgctgcaggacatctgcaagggcaccaagctgaagaaggtgaccaacatcaatgacagaagtgcccccatcctggagaccccacctcctcctcctcctgtgatcagaaatggagccagagatgcccctcctcctcctccaccctacaggatgcacggcagcgagccccccagccggggcaagcccccacctccacccagcaggaccccagctggccccccacctcctcctcctccacccctgagaaatggccaccgggacagcatcaccaccgtgcgctccttcctggatgactttgagagcaagtacagcttccaccctgtggaggacttccctgcccctgaggagtacaagcacttccagaggatctaccccagcaagaccaacagagctgcccggggggccccacccctgccccccatcctgaggtag

SEQ ID NO: 20399 - DNA, 831 bp, Artificial Sequence
  Description of Artificial Sequence: Synthetic coding sequence
atgaccagcttccggctggccctgatccagctgcagatcagcagcatcaagagtgacaacgtgacccgggcctgcagcttcatccgggaggccgccacccagggcgccaagatcgtgtccctgcctgagtgcttcaacagcccctatggagccaagtacttcccagaatatgcagagaagatccctggagagagcacccagaagctgtctgaggtggccaaggaatgttccatctacctgattggaggcagcatccctgaggaggatgctgggaagctgtacaacacctgtgctgtgtttggaccagatggcaccctgctggccaagtacaggaagatccacctgtttgatattgatgtgcctgggaagatcaccttccaggagagcaagaccctgagccctggggacagcttcagcacctttgacaccccctactgccgggtgggcctgggcatctgctatgacatgagatttgctgagctggcccagatctatgcccagaggggctgccagctgctggtgtacccaggggccttcaacctgaccactggacctgcccactgggagctgctgcagaggagcagagctgtggacaaccaggtgtatgtggccacagccagccctgccagagatgacaaggccagctatgtggcctggggccacagcacagtggtgaacccctggggcgaggtgctggccaaggccggcacagaggaggccatcgtgtacagcgacatcgacctgaagaagctggccgagatccggcagcagatccctgtgttccggcagaagagaagtgacctgtatgctgtggagatgaagaagccctag

SEQ ID NO: 20400 - DNA, 1476 bp, Artificial Sequence; identical to SEQ ID NO: 18372
  Description of Artificial Sequence: Synthetic coding sequence

SEQ ID NO: 20401 - DNA, 1089 bp, Artificial Sequence
  Description of Artificial Sequence: Synthetic coding sequence
atggcccacagcagcttcttcccagatgagtacttcacctgcagcagcctgtgcctgagctgtggggtgggctgcaagaagtccatgaaccacggcaaggagggcgtgccccatgaggccaagagccgctgccgctacagccaccagtatgacaacagagtgtacacctgcaaggcctgctatgagcggggggaggaggtgtctgtggtgcccaagaccagcgccagcacagacagcccctggatgggcctggccaagtatgcctggagcggctacgtgattgaatgtcccaactgtggggtggtgtaccgcagccggcagtactggtttggaaaccaggaccctgtggacacagtggtgaggacagagatcgtgcacgtgtggccaggcacagatggcttcctgaaggacaacaacaatgctgcccagaggctgctggatggcatgaacttcatggcccagagcgtgtctgagctgagcctgggccccaccaaggctgtgacctcctggctgacagaccagatcgccccagcctactggaggcccaacagccagatcctgagctgcaacaagtgtgccaccagcttcaaggacaatgacaccaagcaccactgccgggcctgtggggagggcttctgtgacagctgcagcagcaagaccaggcctgtgcctgagcggggctggggccctgcccctgtgcgggtgtgtgacaactgctatgaggccagaaatgtgcagctggccgtgacagaggcccaggtggatgatgagggcggcaccctcatcgccaggaaggtgggggaggccgtgcagaacaccctgggcgctgtggtgacagccatcgacatccccctgggcctggtgaaggatgctgcccggcctgcctactgggtgcctgaccacgagatcctgcactgccacaactgcaggaaggagttcagcatcaagctgagcaagcaccactgccgggcctgtggccagggcttctgtgatgagtgcagccatgacagaagagctgtgcccagccggggctgggaccaccctgtgcgggtgtgcttcaactgcaacaagaagccaggggacctgtag

SEQ ID NO: 20402 - DNA, 348 bp, Artificial Sequence
  Description of Artificial Sequence: Synthetic coding sequence
atgtctggagagcccggccagacctctgtggcccctcctcctgaggaggtggagcccggcagcggcgtgagaattgtggtggagtactgtgagccctgtggctttgaggccacctacctggagctggccagcgctgtgaaggagcagtacccaggcattgaaattgagagccggctgggcggcaccggggcctttgaaattgagatcaatggccagctggtgttcagcaagctggagaatggaggcttcccctatgagaaggacctgattgaggccatccggcgggccagcaatggagagaccctggagaagatcaccaacagccggcccccctgcgtcatcctgtag

SEQ ID NO: 20403 - DNA, 507 bp, Artificial Sequence
  Description of Artificial Sequence: Synthetic coding sequence
atgctgttccggctgtctgagcacagcagccctgaggaggaggccagcccccaccagagggccagcggggagggccaccacctgaagagcaagaggcccaacccctgtgcctacaccccacccagcctgaaggctgtgcagagaattgctgagagccacctgcagagcatcagcaacctgaatgaaaaccaggccagcgaggaggaggatgagctgggggagctgcgggagctgggctacccccgggaggaggatgaggaggaggaggaggatgatgaggaggaggaggaggaggaggacagccaggccgaggtgctgaaggtgatccggcagagcgctggccagaagaccacctgtggccagggcctggagggcccctgggagcggcccccacccctggatgagagcgagagagatggcggcagcgaggaccaggtggaggaccctgccctgtctgagcccggggaggagccccagaggcccagccccagcgagcccggcacctag

SEQ ID NO: 20404 - DNA, 507 bp, Artificial Sequence; identical to SEQ ID NO: 20403
  Description of Artificial Sequence: Synthetic coding sequence

SEQ ID NO: 20405 - DNA, 648 bp, Artificial Sequence
  Description of Artificial Sequence: Synthetic coding sequence
atggaccccaaggacaggaagaagatccagttctctgtgcctgccccacccagccagctggacccccggcaggtggagatgatcagaagaagaagacccaccccagccatgctgttccggctgtctgagcacagcagccctgaggaggaggccagcccccaccaggtgacccccctgacctggcacttcccctggcagagggccagcggggagggccaccacctgaagagcaagaggcccaacccctgtgcctacaccccacccagcctgaaggctgtgcagagaattgctgagagccacctgcagagcatcagcaacctgaatgaaaaccaggccagcgaggaggaggatgagctgggggagctgcgggagctgggctacccccgggaggaggatgaggaggaggaggaggatgatgaggaggaggaggaggaggaggacagccaggccgaggtgctgaaggtgatccggcagagcgctggccagaagaccacctgtggccagggcctggagggcccctgggagcggcccccacccctggatgaaagtgaaagagatggcggcagcgaggaccaggtggaggaccctgccctgtctgagcctggagaggagccccagaggcccagccccagcgagcccggcacctag

SEQ ID NO: 20406 - DNA, 5169 bp, Artificial Sequence
  Description of Artificial Sequence: Synthetic coding sequence
atggagagcaacttcaaccaggagggcgtgccccggcccagctatgtgttttctgctgaccccatcgcccggcccagcgagatcaactttgatggcatcaagctggacctgagccatgagttcagcctggtggcccccaacacagaggccaacagctttgagagcaaggactacctgcaggtgtgcctgcgcatccggcccttcacccagagcgagaaggagctggagagcgagggctgtgtgcacatcctggacagccagacagtggtgctgaaggagccccagtgcatcctgggccgcctgtctgagaagagcagcggccagatggcccagaagttctccttcagcaaggtgtttggacctgccaccacccagaaggagttcttccagggctgcatcatgcagcctgtgaaggacctgctgaagggccagagccgcctcatcttcacctacggcctgaccaacagcggcaagacctacaccttccagggcacagaagaaaatattggcatcctgcccaggaccctgaatgtgctgtttgacagcctgcaggagcggctgtacaccaagatgaacctgaagccccacaggagccgggagtacctgcggctgagcagcgagcaggagaaggaggagatcgccagcaagagcgccctgctgcggcagatcaaggaggtgacagtgcacaatgacagtgatgacaccctgtatggcagcctgaccaacagcctgaacatcagcgagtttgaggagagcatcaaggactatgagcaggccaacctgaacatggccaacagcatcaagttctctgtgtgggtgtccttctttgagatctacaatgagtacatctatgacctgtttgtgcctgtgagcagcaagttccagaagaggaagatgctgcggctgagccaggatgtgaagggctacagcttcatcaaggacctgcagtggatccaggtgtctgacagcaaggaggcctaccgcctgctgaagctgggcatcaagcaccagagcgtggccttcaccaagctgaacaatgccagcagccgcagccacagcatcttcaccgtgaagatcctgcagattgaagattctgagatgagcagggtcatccgggtgtctgagctgagcctgtgtgacctggccggcagcgagaggaccatgaagacccagaatgaaggagagcggctgcgggagaccggcaacatcaacaccagcctgctgaccctgggcaagtgcatcaacgtgctgaagaacagcgagaagagcaagttccagcagcacgtgcccttccgggagagcaagctgacccactacttccagagcttcttcaacgggaagggcaagatctgcatgattgtgaacatcagccagtgctacctggcctatgatgagaccctgaatgtgctgaagttcagcgccatcgcccagaaggtgtgtgtgcctgacaccctgaacagcagccaggagaagctgtttggacctgtgaagagcagccaggatgtgtccctggacagcaacagcaacagcaagatcctgaatgtgaagagggccaccatctcctgggagaacagcctggaggacctgatggaggatgaggacctggtggaggagctggagaatgctgaggagacccagaatgtggagaccaagctgctggatgaggacctggacaagaccctggaggagaacaaggccttcatcagccatgaggagaagaggaagctgctggacctgattgaggacctgaagaagaagctgatcaatgagaagaaggagaagctgaccctggagttcaagatccgggaggaggtgacccaggagttcacccagtactgggcccagcgggaggccgacttcaaggagaccctgctgcaggagcgggagatcctggaggagaatgctgagcggcggctggccatcttcaaggacctggtgggcaaatgtgacacccgggaggaggccgccaaggacatctgtgccaccaaggtggagacagaggagacccacaactacgtgggctttgaggacatcatcgacagcctgcaggacaacgtggccgacatcaagaagcaggccgagatcgcccacctgtacatcgccagcctgcctgacccccaggaggccacagcctgcctggagctgaagttcaaccagatcaaggccgagctggccaagaccaagggggagctgatcaagaccaaggaggagctgaagaagcgggagaatgaaagtgacagcctcatccaggagctggagaccagcaacaagaagatcatcacccagaaccagaggatcaaggagctgatcaacatcatcgaccagaaggaggacaccatcaatgagttccagaacctgaagagccacatggagaacaccttcaagtgcaatgacaaggctgacaccagcagcctcatcatcaacaacaagctgatctgcaatgagaccgtggaggtgcccaaggacagcaagagcaagatctgcagcgagaggaagagggtgaatgaaaatgagctgcagcaggatgagcccccagccaagaagggcagcatccacgtgtcctctgccatcacagaggaccagaagaagtctgaggaggtgcggcccaacattgctgagattgaggacatccgggtgctgcaggagaacaatgaaggcctgcgggccttcctgctgaccattgaaaatgagctgaagaatgagaaggaggagaaggccgagctgaacaagcagatcgtgcacttccagcaggagctgagcctgtctgagaagaagaacctgaccctgagcaaggaggtgcagcagatccagagcaactatgacatcgccatcgccgagctgcacgtgcagaagagcaagaaccaggagcaggaggagaagatcatgaagctgagcaatgaaattgaaacagccaccaggagcatcaccaacaacgtgtcccagatcaagctgatgcacaccaagattgatgagctgcggaccctggacagcgtgtcccagatcagcaacatcgacctgctgaacctgcgggacctgagcaatggcagcgaggaggacaacctgcccaacacccagctggacctgctgggcaatgactacctggtgtccaagcaggtgaaggagtaccgcatccaggagcccaaccgggagaacagcttccacagcagcattgaggccatctgggaggagtgcaaggagatcgtgaaggccagcagcaagaagagccaccagatcgaggagctggagcagcagatcgagaagctgcaggccgaggtgaagggctacaaggatgagaacaaccggctgaaggagaaggagcacaagaaccaggatgacctgctgaaggagaaggagaccctcatccagcagctgaaggaggagctgcaggagaagaatgtgaccctggatgtgcagatccagcacgtggtggagggcaagagggccctgtctgagctgacccagggcgtgacctgctacaaggccaagatcaaggagctggagaccatcctggagacccagaaggtggagtgcagccacagcgccaagctggagcaggacatcctggagaaggagagcatcatcctgaagctggagaggaacctgaaggagttccaggagcacctgcaggacagcgtgaagaacaccaaggacctgaatgtgaaggagctgaagctgaaggaggagatcacccagctgaccaacaacctgcaggacatgaagcacctgctgcagctgaaggaggaggaggaggagaccaaccggcaggagacagagaagctgaaggaggagctgagcgccagcagcgcccggacccagaacctgaaggctgacctgcagaggaaggaggaggactatgctgacctgaaggagaagctgacagatgccaagaagcagatcaagcaggtgcagaaggaggtgtctgtgatgagagatgaggacaagctgctgcgcatcaagatcaatgagctggagaagaagaagaaccagtgcagccaggagctggacatgaagcagaggaccatccagcagctgaaggagcagctgaacaaccagaaggtggaggaggccatccagcagtatgaaagagcctgcaaggacctgaatgtgaaggagaagatcatcgaggacatgaggatgaccctggaggagcaggagcagacccaggtggagcaggaccaggtgctggaggccaagctggaggaggtggagcggctggccacagagctggagaagtggaaggagaagtgcaatgacctggagaccaagaacaaccagaggagcaacaaggagcacgagaacaacacagatgtgctgggcaagctgaccaacctgcaggatgagctgcaggagagcgagcagaagtacaatgctgacaggaagaagtggctggaggagaagatgatgctgatcacccaggccaaggaggccgagaacatccggaacaaggagatgaagaagtatgcagaagatcgggagcgcttcttcaagcagcagaatgagatggagatcctgacagcccagctgacagagaaggacagcgacctgcagaagtggagggaggagcgggaccagctggtggccgccctggagatccagctgaaggccctgatcagcagcaatgtgcagaaggacaatgaaattgagcagctgaagaggatcatcagcgagaccagcaagattgagacccagatcatggacatcaagcccaagaggatcagcagcgctgaccctgacaagctgcagacagagcccctgagcaccagctttgagatcagcaggaacaagattgaagatggctctgtggtgctggacagctgtgaggtgtccacagaaaatgaccagagcacccgcttccccaagccagagctggagatccagttcacccccctgcagcccaacaagatggctgtgaagcaccctggctgcaccacccctgtgacagtgaagatccccaaggccaggaagaggaagagcaatgagatggaggagagcgccagccccccacccaaggaatgtagcagcagccctgccatggagcagagctggaaggaaaatgactttgacaagctgcgggaggagggcttccgccgcagcaactacagcgagctgcaggaggagatccagaccaagggcaaggaggtggagaactttgagaagaacctggactag

SEQ ID NO: 20407 - DNA, 1215 bp, Artificial Sequence
  Description of Artificial Sequence: Synthetic coding sequence
atgagaagagatgtgaatggagtgaccaagagcagatttgagatgttcagcaacagtgatgaggccgtcatcaacaagaagctgcccaaggagctgctgctgcgcatcttctccttcctggatgtggtgaccctgtgccgctgtgcccaggtgtcccgggcctggaatgtgctggccctggatggcagcaactggcagagaattgacctgtttgacttccagagggacatcgagggccgggtggtggagaacatcagcaagagatgtggcggcttcctgaggaagctgagcctgcggggctgcctgggcgtgggggacaatgccctgcggacctttgcccagaactgcagaaatattgaggtgctgaacctgaatggctgcaccaagaccacagatgctgagggctgccccctgctggagcagctgaacatctcctggtgtgaccaggtgaccaaggatggcatccaggccctggtgcggggctgcggcggcctgaaggccctcttcctgaagggctgcacccagctggaggatgaggccctgaagtacatcggggcccactgcccagagctggtgaccctgaacctgcagacctgcctgcagatcacagatgagggcctcatcaccatctgccggggctgccacaagctgcagagcctgtgtgccagcggctgcagcaacatcacagatgccatcctgaatgccctgggccagaactgcccccggctgcgcatcctggaggtggcccgctgcagccagctgacagatgtgggcttcaccaccctggccaggaactgccacgagctggagaagatggacctggaggagtgtgtgcagatcacagacagcaccctcatccagctgagcatccactgcccccggctgcaggtgctgagcctgagccactgtgagctgatcacagatgatggcatccgccacctgggcaatggagcctgtgcccatgaccagctggaggtgattgagctggacaactgccccctcatcacagatgccagcctggagcacctgaagagctgccacagcctggagcgcatcgagctgtatgactgccagcagatcaccagggctggcatcaagaggctgcggacccacctgcccaacatcaaggtgcacgcctactttgcccctgtgaccccacctccttctgtgggcggcagccggcagcgcttctgccgctgctgcatcatcctgtag

SEQ ID NO: 20408 - DNA, 1251 bp, Artificial Sequence
  Description of Artificial Sequence: Synthetic coding sequence
atggcccacagccctgtggccgtgcaggtgcccggcatgcagaacaacattgctgaccctgaggagctgttcaccaagctggagcgcatcggcaagggcagctttggagaggtgttcaagggcatcgacaacagaacccagcaggtggtggccatcaagatcatcgacctggaggaggctgaagatgaaattgaggacatccagcaggagatcaccgtgctgagccagtgtgacagcagctatgtgaccaagtactacggcagctacctgaagggcagcaagctgtggatcatcatggagtacctgggcggcggcagcgccctggacctgctgcgggccggcccctttgatgagttccagatcgccaccatgctgaaggagatcctgaagggcctggactacctgcacagcgagaagaagatccaccgggacatcaaggccgccaacgtgctgctgtctgagcagggagatgtgaagctggccgactttggagtggccggccagctgacagacacccagatcaagaggaacacctttgtgggcacccccttctggatggcccctgaggtgatccagcagagcgcctatgacagcaaggctgacatctggagcctgggcatcacagccatcgagctggccaagggggagccccccaacagcgacatgcaccccatgagggtgctcttcctgatccccaagaacaacccccccaccctggtgggggacttcaccaagagcttcaaggagttcattgatgcctgcctgaacaaggaccccagcttccggcccacagccaaggagctgctgaagcacaagttcatcgtgaagaacagcaagaagaccagctacctgacagagctgattgaccgcttcaagcgctggaaggccgagggccacagtgatgatgaaagtgacagcgagggcagtgacagcgagagcaccagccgggagaacaacacccaccctgagtggagcttcaccaccgtgaggaagaagccagaccccaagaaggtgcagaatggagctgagcaggacctggtgcagaccctgagctgcctgtccatgatcatcaccccagcctttgctgagctgaagcagcaggatgaaaataatgccagcaggaaccaggccatcgaggagctggagaagagcattgctgtggccgaggccgcctgccccggcatcacagacaagatggtgaagaagctgattgagaagttccagaagtgcagcgcagatgagagcccctag

SEQ ID NO: 20409 - DNA, 1020 bp, Artificial Sequence
  Description of Artificial Sequence: Synthetic coding sequence
atggcccacagccctgtggccgtgcaggtgcccggcatgcagggcagcaagctgtggatcatcatggagtacctgggcggcggcagcgccctggacctgctgcgggccggcccctttgatgagttccagatcgccaccatgctgaaggagatcctgaagggcctggactacctgcacagcgagaagaagatccaccgggacatcaaggccgccaacgtgctgctgtctgagcagggagatgtgaagctggccgactttggagtggccggccagctgacagacacccagatcaagaggaacacctttgtgggcacccccttctggatggcccctgaggtgatccagcagagcgcctatgacagcaaggctgacatctggagcctgggcatcacagccatcgagctggccaagggggagccccccaacagcgacatgcaccccatgagggtgctcttcctgatccccaagaacaacccccccaccctggtgggggacttcaccaagagcttcaaggagttcattgatgcctgcctgaacaaggaccccagcttccggcccacagccaaggagctgctgaagcacaagttcatcgtgaagaacagcaagaagaccagctacctgacagagctgattgaccgcttcaagcgctggaaggccgagggccacagtgatgatgaaagtgacagcgagggcagtgacagcgagagcaccagccgggagaacaacacccaccctgagtggagcttcaccaccgtgaggaagaagccagaccccaagaaggtgcagaatggagctgagcaggacctggtgcagaccctgagctgcctgtccatgatcatcaccccagcctttgctgagctgaagcagcaggatgagaacaatgccagcaggaaccaggccatcgaggagctggagaagagcattgctgtggccgaggccgcctgccccggcatcacagacaagatggtgaagaagctgattgagaagttccagaagtgcagcgcagatgagagcccctag

SEQ ID NO: 20410 - DNA, 2625 bp, Artificial Sequence; identical to SEQ ID NO: 19569
  Description of Artificial Sequence: Synthetic coding sequence

SEQ ID NO: 20411 - DNA, 1449 bp, Artificial Sequence
  Description of Artificial Sequence: Synthetic coding sequence
atggagcagagcaacctggagaagctggagctgaatgtgaggaagctgcagcaggagctggaccagctgaacagagacaagctgagcctgcacaatgacatcagcgccatgcagcagcagctgcaggagaagcgggaggccgtgaacagcctgcaggaggagctggccaacgtgcaggaccacctgaacctggccaagcaggacctgctgcacaccaccaagcaccaggatgtgctgctgtctgagcagacccggctgcagaaggacatcagcgagtgggccaacagatttgaggactgccagaaggaggaggagaccaagcagcagcagctgcaggtgctgcagaatgaaattgaggagaacaagctgaagctggtgcagcaggagatgatgttccagaggctgcagaaggagcgggagagcgagaagagcaagctggaccaggtgctgagcaaggtgctggccgctgaggagcgggtgaggaccctgcaggaggaggagcgctggtgtgagagcctggagaagaccctgagccagaccaagaggcagctgtctgagcgggagcagcagctggtggagaagtctggagagctgctggccctgcagaaggaggccgacagcatgagagctgacttcagcctgctgaggaaccagttcctgacagagaggaagaaggccgagaagcaggtggccagcctgaaggaggccctgaagatccagaggagccagctggagaagaacctgctggagcagaagcaggagaacagctgcatccagaaggagatggccaccatcgagctggtggcccaggacaaccacgagcgggcccggcggctgatgaaggagctgaaccagatgcagtatgagtacacagagctgaagaagcagatggccaaccagaaggacctggagcggcggcagatggagatcagtgatgccatgaggaccctgaagtctgaggtgaaggatgagatccgcaccagcctgaagaacctgaaccagttcctgcctgagctgcctgctgacctggaggccatcctggagagaaatgaaaacctggagggggagctggagagcctgaaggagaacctgcccttcaccatgaatgaaggcccctttgaggagaagctgaacttcagccaggtgcacatcatggatgagcactggagaggagaggccctgcgggagaagctgcggcaccgggaggaccggctgaaggcccagctgcggcactgcatgagcaagcaggccgaggtgctgatcaagggcaagaggcagacagagggcaccctgcacagcctgcggcggcaggtggatgccctgggggagctggtgaccagcaccagcgctgacagcgccagcagccccagcctgagccagctggagagcagcctgacagaggacagccagctgggccagaaccaggagaagaatgccagcgccaggtag

SEQ ID NO: 20412 - DNA, 3780 bp, Artificial Sequence
  Description of Artificial Sequence: Synthetic coding sequence
atggccctgcggcctggagctggcagcggcggcggcggcgctgctggagctggagctggcagcgctgggggcggcggcttcatgtttcctgtggccggcggcatccggcccccccaggccggcctgatgcccatgcagcagcagggcttccccatggtgtctgtgatgcagcccaacatgcagggcatcatgggcatgaactacagcagccagatgagccagggccccatcgccatgcaggccggcatccccatgggccccatgcctgctgctggcatgccctacctgggccaggcccccttcctgggcatgaggcctcctggcccccagtacaccccagacatgcagaagcagtttgctgaggagcagcagaagagatttgagcagcagcagaagctgctggaggaggagaggaagaggcggcagtttgaggagcagaagcagaagctgcggctgctgagctctgtgaagcccaagacaggagagaagagcagagatgatgccctggaggccatcaagggcaacctggatggcttcagcagagatgccaagatgcaccccaccccagccagccaccccaagaagccaggagtgggcgtcttccccagccaggaccctgcccagcccaggatgccaccctggatctacaatgaaagcctggtgcctgatgcctacaagaagatcctggagaccaccatgacccccaccggcatcgacacagccaagctgtaccccatcctgatgagcagcggcctgccccgggagaccctgggccagatctgggccctggccaacagaaccaccccaggcaagctgaccaaggaggagctgtacacagtgctggccatgattgctgtgacccagaggggcgtgcctgccatgagcccagatgccctgaaccagtttcctgctgcccccatccccaccctgagcggcttctccatgaccctgcccacccctgtgtcccagcccaccgtcatccccagcggccctgctggctccatgcccctgagcctgggccagcctgtgatgggcatcaacctggtgggccctgtgggcggggccgccgcccaggccagcagcggcttcatccccacctacccagccaaccaggtggtgaagccagaagaagatgacttccaggacttccaggatgccagcaagagcggcagcctggatgacagcttcagtgacttccaggagctgcctgccagcagcaagaccagcaacagccagcacggcaacagcgcccccagcctgctgatgcccctgcccggcaccaaggccctgcccagcatggacaagtatgctgtgttcaagggcattgctgctgacaagagcagtgaaaatacagtgcccccaggggaccccggggacaagtacagcgccttccgggagctggagcagacagctgagaacaagcccctgggggagagctttgctgagttccgctctgctggaacagatgatggcttcacagacttcaagacagctgacagcgtgagccccctggagccccccaccaaggacaagaccttcccccccagcttccccagcggcaccatccagcagaagcagcagacccaggtgaagaaccccctgaacctggccgacctggacatgttcagctctgtgaactgcagcagcgagaagcccctgtccttctctgctgtgttcagcaccagcaagtctgtgtccaccccccagagcactggatctgctgccaccatgacagccctggccgccaccaagaccagcagcctggctgatgactttggagagttcagcctgtttggagagtacagcggcctggcccctgtgggggagcaggatgactttgctgacttcatggccttcagcaacagcagcatcagcagcgagcagaagccagatgacaagtatgatgccctgaaggaggaggccagccctgtgcccctgaccagcaatgtgggcagcacagtgaagggcggccagaacagcacagctgccagcaccaagtatgatgtgttccggcagctgagcctggagggcagcggcctgggcgtggaggacctgaaggacaacaccccatctgggaagagtgatgatgactttgctgacttccacagcagcaagttcagcagcatcaacagcgacaagagcctgggggagaaggctgtggccttccgccacaccaaggaggacagcgcctctgtgaagagcctggacctgcccagcatcggcggcagctctgtgggcaaggaggacagtgaagatgccctgtctgtgcagtttgacatgaagctggctgatgtgggcggggacctgaagcacgtgatgtctgacagcagcctggacctgcccaccgtgtctggccagcaccccccagctgctgacatcgaggacctgaagtatgctgccttcggcagctacagcagcaactttgctgtgtccaccctgaccagctatgactggagcgacagagatgatgccacccagggcaggaagctgagcccctttgtgctgtctgctggcagcggcagccccagcgccaccagcatcctgcagaagaaggagaccagctttggcagcagcgagaacatcaccatgaccagcctgagcaaggtgaccacctttgtgtctgaagatgccctgcctgagaccaccttccctgccctggccagcttcaaggacaccatcccccagaccagcgagcagaaggagtatgaaaatagagactacaaggacttcaccaagcaggacctgcccacagctgagaggagccaggaggccacctgccccagccctgccagcagcggggccagccaggagaccccaaatgaatgttctgatgactttggagagttccagagcgagaagcccaagatcagcaagtttgacttcctggtggccaccagccagagcaagatgaagagcagcgaggagatgatcaagtctgagctggccacctttgacctgtctgtgcagggcagccacaagaggagcctgagcctgggggacaaggagatcagccgcagcagccccagccctgccctggagcagcccttccgggacaggagcaacaccctgaatgagaagccagccctgcccgtcatccgggacaagtacaaggacctgaccggggaggtggaggagaatgaaagatatgcctatgagtggcagcgctgcctgggcagcgccctgaatgtcatcaagaaggccaatgacaccctgaatggcatcagcagcagctctgtgtgcacagaggtgatccagagcgcccagggcatggagtacctgctgggcgtggtggaggtgtacagagtgaccaagagggtggagctgggcatcaaggccacagctgtgtgcagcgagaagctgcagcagctgctgaaggacatcgacaaggtgtggaacaacctgattggcttcatgagcctggccaccctgacctgctgctgggagaagatgaccgtcatcaccaagcacctgagcccctaccacgagctgctggaggagaagccagatgagaacagcctggacttcagcagctgcatgctgcggcccggcatcaagaatgcccaggagctggcctgtggggtgtgcctgctgaatgtggacagccgcagcaggaaggaggagaagccagctgaggagcaccccaagaaggccttcaacagcgagacagacagcttcaagctggcctatggaggccaccagtaccacgccagctgtgccaacttctggatcaactgtgtggagcccaagcccccaggcctggtgctgcctgacctgctgtag

SEQ ID NO: 20413 - DNA, 1158 bp, Artificial Sequence
  Description of Artificial Sequence: Synthetic coding sequence
atggccctgcggcctggagctggcagcggcggcggcggcgctgctggagctggagctggcagcgctgggggcggcggcttcatgtttcctgtggccggcggcatccggcccccccaggccggcctgatgcccatgcagcagcagggcttccccatggtgtctgtgatgcagcccaacatgcagggcatcatgggcatgaactacagcagccagatgagccagggccccatcgccatgcaggccggcatccccatgggccccatgcctgctgctggcatgccctacctgggccaggcccccttcctgggcatgaggcctcctggcccccagtacaccccagacatgcagaagcagtttgctgaggagcagcagaagagatttgagcagcagcagaagctgctggaggaggagaggaagaggcggcagtttgaggagcagaagcagaagctgcggctgctgagctctgtgaagcccaagacaggagagaagagcagagatgatgccctggaggccatcaagggcaacctggatggcttcagcagagatgccaagatgcaccccaccccagccagccaccccaagaagccagactgccccaccagcagccacagcaccaagacagtgagccccagccctgccttcctggatgaggaggagttcagtgacttcatgcagggccctgtggaggtgcccccctgtggccccagcagcaccagccagcccttccagagcttccaccccagcacccccctgggccagctgcacacccagaaggccggcacccagcccctgccccccagccagagccctgtgccctttgccctgcacggcgtgcccggccagatcccctacttcagcacagccagcgccagccacagcgtgcctgaggccggccccagcctggaggagaagttcctggtgtcctgtgacatcagcaccagcggccaggagcagatcaagctgaacaccagcgaggtgggccacaaggccctgggccctggcagcagcaagaagtaccccagcctgatggccagcaatggagtggccgtggatggctgtgtgtgggagtacttcccccaccgcatcctgctgagcccagaatgtctgctgggcttcaccatgagggtgtggttccagatgcccatcaggaagagctag

SEQ ID NO: 20414 - DNA, 939 bp, Artificial Sequence
  Description of Artificial Sequence: Synthetic coding sequence
atggctgactttggcatctctgctggccagtttgtggccgtggtgtgggacaagagcagccctgtggaggccctgaagggcctggtggacaagctgcaggccctgactggaaatgaaggccgggtgtctgtggagaacatcaagcagctgctgcagagcgcccacaaggagagcagctttgacatcatcctgagcggcctggtgcccggcagcaccaccctgcacagcgctgagatcctggccgagatcgcccgcatcctgcggcctgggggctgcctcttcctgaaggagcctgtggagacagctgtggacaacaacagcaaggtgaagacagccagcaagctgtgcagcgccctgaccctgagcggcctggtggaggtgaaggagctgcagcgggagcccctgaccccagaggaggtgcagagcgtgcgggagcacctgggccatgaaagtgacaacctgctgtttgtgcagatcaccgggaagaagcccaactttgaggtgggcagcagccggcagctgaagctgagcatcaccaagaagagcagccccagcgtgaagccagctgtggaccctgctgctgccaagctgtggaccctgagcgccaatgacatggaggatgacagcatggacctgattgacagtgatgagctgctggaccctgaggacctgaagaagccagaccctgccagcctgcgggccgccagctgtggggagggcaagaagaggaaggcctgcaagaactgcacctgtggcctggccgaggagctggagaaggagaagagccgggagcagatgagcagccagcccaagagcgcctgtggcaactgctacctgggagatgccttccgctgtgccagctgcccctacctgggcatgcctgccttcaagccaggagagaaggtgctgctgagtgacagcaacctgcatgatgcctag

SEQ ID NO: 20415 - DNA, 1056 bp, Artificial Sequence
  Description of Artificial Sequence: Synthetic coding sequence
atgaatgaaagcaatgacagcaccaactatgacatggccccctactatgaggccctgtgcaagagcctggactggcagattgatgtggacctgctgaacaagatgaagaaggccaatgaagatgagctgaagaggctggatgaggagctggaggatgctgagaagaacctgggggagagcgagatcagagatgccatgatggccaaggccgagtacctgtgccgcatcggggacaaggagggcgccctgacagccttcaggaagacctatgacaagacagtggccctgggccaccggctggacatcgtgttctacctgctgagaattggcctcttctacatggacaatgacctgatcaccaggaacacagagaaggccaagagcctcatcgaggagggcggggactgggacagaagaaaccggctgaaggtgtaccagggcctgtactgtgtggccatccgggacttcaagcaggccgctgagctgttcctggacacagtgtccaccttcaccagctatgagctgatggactacaagacctttgtgacctacacagtgtatgtgtccatgattgccctggagaggccagacctgcgggagaaggtgatcaagggagctgagatcctggaggtgctgcacagcctgcctgctgtgcggcagtacctgttcagcctgtatgaatgtcgctacagcgtcttcttccagagcctggccgtggtggagcaggagatgaagaaggactggctgtttgccccccactaccgctactacgtgcgggagatgaggatccacgcctacagccagctgctggagagctaccgcagcctgaccctgggctacatggccgaggcctttggagtgggcgtggagttcatcgaccaggagctgagccgcttcatcgccgccggccgcctgcactgcaagattgacaaggtgaatgaaattgtggagaccaacagaccagacagcaagaactggcagtaccaggagaccatcaagaagggggacctgctgctgaacagagtgcagaagctgagcagggtcatcaacatgtag

SEQ ID NO: 20416 - DNA, 414 bp, Artificial Sequence; identical to SEQ ID NO: 19462
  Description of Artificial Sequence: Synthetic coding sequence

SEQ ID NO: 20417 - DNA, 2796 bp, Artificial Sequence; identical to SEQ ID NO: 18546
  Description of Artificial Sequence: Synthetic coding sequence

SEQ ID NO: 20418 - DNA, 318 bp, Artificial Sequence; identical to SEQ ID NO: 19356
  Description of Artificial Sequence: Synthetic coding sequence

SEQ ID NO: 20419 - DNA, 663 bp, Artificial Sequence
  Description of Artificial Sequence: Synthetic coding sequence
atgaacagcatggacagacacatccagcagaccaatgaccggctgcagtgcatcaagcagcacctgcagaacccagccaacttccacaatgctgccacagagctgctggactggtgtggggacccccgggccttccagaggccctttgagcagagcctgatgggctgcctgactgtggtgtcccgggtggccgcccagcagggctttgacctggacctgggctaccgcctgctggccgtgtgtgccgccaacagagacaagttcacccccaagtctgctgccctgctgagctcctggtgtgaggagctgggccgcctgctgctgctgcggcaccagaagagccggcagagcgaccccccaggcaagctgcccatgcagccccccctgagctccatgagctccatgaagcccaccctgagccacagtgatggcagcttcccctatgacagcgtgccctggctgcctgcctacccagcctgcaccccaccacccagccagagccaccccaacagctgcagcctgaagcagaagcagcccctggccttccccccacccctgtgcagcatctggctgaccaccctgcagggcctgctgggcagcctgagctgtgtgcactttgtgtctggctggagcgtgccccgggagccccacggcctgggctag

SEQ ID NO: 20420 - DNA, 354 bp, Artificial Sequence
  Description of Artificial Sequence: Synthetic coding sequence
atggtgcagaggctgacctacagaagaaggctgagctacaacacagccagcaacaagacccggctgagcaggaccccaggcaaccgcatcgtgtacctgtacaccaagaaggtgggcaaggcccccaagagcgcctgtggggtgtgccccggccgcctgcggggcgtgcgggctgtgcggcccaaggtgctgatgaggctgagcaagaccaagaagcacgtgtcccgggcctacggcggctccatgtgtgccaagtgtgtgcgggaccgcatcaagagggccttcctgattgaggagcagaagatcgtggtgaaggtgctgaaggcccaggcccagagccagaaggccaagtag

SEQ ID NO: 20421 - DNA, 354 bp, Artificial Sequence; identical to SEQ ID NO: 20420
  Description of Artificial Sequence: Synthetic coding sequence

SEQ ID NO: 20422 - DNA, 354 bp, Artificial Sequence; identical to SEQ ID NO: 20420
  Description of Artificial Sequence: Synthetic coding sequence

SEQ ID NO: 20423 - DNA, 1902 bp, Artificial Sequence; identical to SEQ ID NO: 19558
  Description of Artificial Sequence: Synthetic coding sequence

SEQ ID NO: 20424 - DNA, 1641 bp, Artificial Sequence
  Description of Artificial Sequence: Synthetic coding sequence
atgaaggccatcaagaagagcctgacagaggaggagtacctgtacctggacttcagccaccagacagagggctgcatcttccccctgcacacctctgtgaccctcttcctgctgagctactgtgactgcaagatcttcaagatctgcctggtggtgaccaaggaggtgtcccagtggacccggctgtgtgagctgaccatccccctggccatcgagaacttcctgcgggagagcagtgaccagccccccaccatccctgtggagatcctgcagctggagaagaagctgtctgagcctgtgcgggtgcacaatgatgacaagctgcggcggcagaagctgaagcagcagaaggcagatggagtgggcccccccctgaccaagggcaaggccaagagcaaggtgcacacccaggagaccagcgagggcctggacagcagcagcaagagcctggagctgaaggtggccttcagcaagctgactgtgcaggaggagcccgccaccaccaaccgggagcccagccacatcaggaaggccaaggccagtgacctgccccccctggagcacgtgtttgctgagggcctgtacttcaccctggccgacatcgtgctgctgccctgcatccaccacttcctggtgatcatcagcaggaagttcagcgagaagctggtggagttccccctgctggcctcctggtaccagaggatccaggaggtgcctggggtgaagacagctgccagcaaatgtggcatccagttcctgcacctgcccaagctgctgaccaccagcacagagcagcaccccaacctgtgtgaggtgcctggggtggaggagcagagcgaccccctcttcatcggcggcccccggcccaccatggccaagctgatggagaagggcatcgaggtgatgttcagcccccacccctgccccacctggaccctggactggaatgtgctgcctgctgctgtgagccccaaggagggcaagatgagcagtgaccgggccctgaggaagcagcagcagctgaacaacctggtgtatgtggtgaccaaccaggccaagccaggggaccgcatcgtggacttctgcagcggcggcggccacgtgggcatcgtgctggcccacatgctgcccagctgccaggtgaccctgattgagaacaaggagctgagcctcatccgggccaagaagagaagtgatgagctgggcctgagcaacatctggttcatccaggccaacatggagtacttcaccggcatgttcaacatcggcgtggccctgcacgcctgtggggtggccacagacatggtgattgagcactgcatcaagacccgggccagctttgtgacctgcccctgctgctacggcttcatccagaacaccagcaagttcaacttccccaagtctgagcagttcaagaagaccctgagctacaaggagcacatgatcctgtgccgctttgctgaccagacagctgtgcagctgcccccccagaggcggctgattggcaagcagtgcatgtgcctggtggacctggaccgggcccgggctgctgaagaatgtggctacagcgtgcaggtgatctccatggagcctgagagctgcagccccaagaacaacatgattgtgggcgtgcccatctag

SEQ ID NO: 20425 - DNA, 1542 bp, Artificial Sequence
  Description of Artificial Sequence: Synthetic coding sequence
atgctgctggagaacctgacagacaatgaaagtgagaacaccaacctgaagaagaaggtgtttgagaaggaggcccacatccaggagctgagctgcctcttccagagcgagaaggccaacaccctgaaggccaaccgcttcagccagagcgtgaaggtggtgcatgagcggctgcagatccagatccacaagcgggaggccgagaatgacaagctgaaggagtatgtgaagagcctggagaccaagatcgccaagtggaacctgcagagcaggatgaacaagaatgaggccatcgtgatgaaggaggccagccggcagaagacagtggccctgaagaaggccagcaaggtgtacaagcagaggctggaccacttcaccggggccatcgagaagctgaccagccagatccgggaccaggaggccaagctgtctgagaccatcagcgccagcaatgcctggaagagccactatgagaagatcgtcatcgagaagacagagctggaggtgcagatcgagaccatgaagaagcagatcatcaacctgctggaggacctgaagaagatggaggaccacggcaagaacagctgtgaggagatcctgaggaaggtgcacagcattgaatatgaaaatgagaccctgaacctggagaacaccaagctgaagaccaccctggccgccctgaaggatgaggtggtgtctgtggagaatgagctgtctgagctgcaggaggtggagaagaagcagaagaccctcatcgagatgtacaagacccaggtgcagaagctgcaggaggccgctgagatcgtgaagagccgctgtgagaacctgctgcacaagaacaaccagatcaccaagaccaagaacaagaatgtggagaagatgaggggccagatggagagccacctgaaggagctggagcgggtgtgtgacagcctgacagctgctgagcggcggctgcacgagtgccaggagagcctgcagtgctgcaagggcaaatgtgccgaccaggagcacaccatccgggagctgcagggccaggtggatggcaaccacaacctgctgaccaagctgagcctggaggaggagaactgcctgatccagctgaagtgtgagaacctgcagcagaagctggagcagatggatgctgagaacaaggagctggagaagaagctggccaaccaggaggagtgcctgaagcacagcaacctgaagttcaaggagaagtctgctgagtacacagccctggcccggcagctggaggccgccctggaggagggccggcagaaggtggccgaggagattgagaagatgagcagccgggagagcgccctgcagatcaagatcctggacctggagacagagctgaggaagaagaatgaggagcagaaccagctggtgtgcaagatgaacagcaaggcccagcaccaggaggtgtgcctgaaggaggtgcagaacagcctggagaagtctgagaaccagaatgaaagcatcaagaactacctgcagttcctgaagaccagctatgtgaccatgtttgaatag

SEQ ID NO: 20426 - DNA, 1167 bp, Artificial Sequence
  Description of Artificial Sequence: Synthetic coding sequence
atggctgctgctgctgccctggcccggctggagcagaagcagagccgggcctggggccccaccagccaggacaccatccggaaccaggtgaggaaggagctgcaggccgaggccaccgtgtctggcagccctgaggcccctggcaccaacgtggtgtctgagccccgggaggagggcagcgcccacctggccgtgcctggggtgtacttcacctgccccctgactggagccaccctgaggaaggaccagagagatgcctgcatcaaggaggccatcctgctgcacttcagcacagatcctgtggccgccagcatcatgaagatctacaccttcaacaaggaccaggacagagtgaagctgggcgtggacaccatcgccaagtacctggacaacatccacctgcaccctgaggaggagaagtacaggaagatcaagctgcagaacaaggtgttccaggagcgcatcaactgcctggagggcacccatgagttctttgaggccatcggcttccagaaggtgctgctgcctgcccaggaccaggaggaccctgaggagttctacgtgctgtctgagaccaccctggcccagccccagagcctggagcggcacaaggagcagctgctggccgctgagcctgtgcgggccaagctggaccggcagaggagggtcttccagcccagccccctggccagccagtttgagctgcccggggacttcttcaacctgacagctgaggagatcaagcgggagcagaggctgcggtctgaggccgtggagcggctgtctgtgctgcggaccaaggccatgagggagaaggaggagcagaggggcctgaggaagtacaactacaccctgctgcgggtgcggctgcctgatggctgcctgctgcagggcaccttctacgcccgggagcggctgggcgctgtgtatggctttgtgcgggaggccctgcagagcgactggctgccctttgagctgctggccagcggcggccagaagctgtctgaagatgagaacctggccctgaatgaatgtggcctggtgcccagcgccctgctgaccttctcctgggacatggctgtgctggaggacatcaaggccgccggggctgagccagacagcatcctgaagccagagctgctgagcgccatcgagaagctgctgtag

SEQ ID NO: 20427 - DNA, 2691 bp, Artificial Sequence
  Description of Artificial Sequence: Synthetic coding sequence
atggatggagctgctggccctggagatggccctgcccgggaggccctgcagagcctgagccagaggctgcgggtgcaggagcaggagatggagctggtgaaggccgccctggccgaggccctgcggctgctgcggctgcaggtgccccccagcagcctgcagggcagcggcaccccagcccctcctggggacagcctggccgcccctcctggcctgccccccacctgcacccccagcctggtgtcccggggcacccagacagaaacagaggtggagctgaagagcagccctggccccccaggcctgagcaatggccccccagccccccagggcgccagcgaggagcccagcggcacccagagcgagggcggcggcagcagcagcagtggagctggcagccctggccccccaggcatcctgcggcccctgcagcccccccagagagctgacaccccaagaagaaacagcagcagcagcagcagccccagcgagcggccccggcagaagctgagcaggaaggccatcagcagcgccaacctgctggtgcgcagcggcagcacagagagcagaggaggcaaggaccccctgagcagccctgggggccctggcagcagaagaagcaactacaacctggagggcatctctgtgaagatgttcctgcggggccggcccatcaccatgtacatccccagcggcatccgcagcctggaggagctgcccagcggccccccacctgagaccctgagcctggactgggtgtatggctaccggggccgggacagccgcagcaacctgtttgtgctgcggagcggggaggtggtgtacttcatcgcctgtgtggtggtgctgtacagacctgggggcggccctgggggccctgggggcggcggccagaggcactaccggggccacacagactgtgtgcgctgcctggccgtgcacccagatggagtgcgggtggccagcggccagacagctggggtggacaaggatggcaagcccctgcagcctgtggtgcacatctgggacagcgagaccctgctgaagctgcaggagatcggcctgggcgcctttgagcggggcgtgggcgccctggccttctctgctgctgaccagggcgccttcctgtgtgtggtggatgacagcaatgagcacatgctgtctgtgtgggactgcagccggggcatgaagctggccgagatcaagagcaccaatgattctgtgctggccgtgggcttcaacccccgggacagcagctgcatcgtgaccagcggcaagagccacgtgcacttctggaactggagcggaggagtgggcgtgcctggaaatggcaccctgaccaggaagcagggcgtgtttgggaagtacaagaagcccaagttcatcccctgctttgtgttcctgcctgatggagacatcctgactggagacagcgagggcaacatcctgacctggggccgcagccccagcgacagcaagaccccaggccggggcggggccaaggagacctacggcatcgtggcccaggcccacgcccacgagggcagcatctttgccctgtgcctgcggagagatggcaccgtgctgagcggcggcggccgggaccggcggctggtgcagtggggccctggcctggtggccctgcaggaggccgagatccctgagcactttggagctgtgcgggccatcgccgagggcctgggcagcgagctgctggtgggcaccaccaagaatgccctgctgcggggggacctggcccagggcttcagccctgtgatccagggccacacagatgagctgtggggcctgtgcacccaccccagccagaaccgcttcctgacctgtggccatgaccggcagctgtgcctgtgggatggagagagccacgccctggcctggagcattgacctgaaggagaccggcctgtgtgccgacttccaccccagcggggctgtggtggccgtgggcctgaacacaggccgctggctggtgctggacacagagacccgggagatcgtgtctgatgtgattgatggaaatgagcagctgtctgtggtgcgctacagcccagatggcctgtacctggccatcggcagccatgacaacgtcatctacatctacagcgtgtccagtgatggagccaagagcagcagatttggccgctgcatgggccacagcagcttcatcacccacctggactggagcaaggatggcaacttcatcatgagcaacagcggggactatgagatcctgtactgggatgtggccggcggctgcaagcagctgaagaacagatatgagagccgggaccgggagtgggccacctacacctgtgtgctgggcttccacgtgtatggagtgtggccagatggcagtgatggaacagacatcaacagcctgtgccgcagccacaatgaaagagtggtggccgtggctgatgacttctgcaaggtgcacctgttccagtacccctgtgcccgggccaaggcccccagcaggatgtatggaggccacggcagccacgtgacctctgtgcgcttcacccatgatgacagccacctggtgtccctgggcggcaaggatgccagcatcttccagtggagggtgctgggcgctgggggcgccggccctgccccagccacccccagcaggacccccagcctgagccctgccagcagcctggatgtgtag

SEQ ID NO: 20428 - DNA, 2934 bp, Artificial Sequence
  Description of Artificial Sequence: Synthetic coding sequence
atgggcgctgaggaggaggtgctggtgaccctgagcggcggggccccctggggcttccggctgcacggcggcgctgagcagaggaagcccctgcaggtgtccaagatcagaagaagaagccaggccggccgggccggcctgcgggagcgggaccagctgctggccatcaatggagtgtcctgcaccaacctgagccacgccagcgccatgagcctgattgatgccagcggcaaccagctggtgctgactgtgcagaggctggctgatgagggccctgtgcagagccccagcccccatgagctgcaggtgctgagccccctgagccccctgagccctgagcccccaggggcccctgtgccccagcccctgcagcccggcagcctgcggagccccccagacagcgaggcctactacggggagacagacagtgatgctgatggccctgccacccaggagaagccccggcggcccaggagaagaggccccacccggcccaccccacctggggcccccccagatgaggtgtacctgagtgacagccctgctgagcccgcccccaccatccctggcccccccagccagggcgacagccgggtgagcagccccagctgggaggatggagctgccctgcagcccccacctgctgaggccctgctgctgccccacggccccctgcggcccggcccccacctgatccccatggtgggccctgtgccccaccctgtggccgaggacctgaccaccacctacacccagaaggccaagcaggccaagctgcagagagctgagagcctgcaggagaagagcatcaaggaggccaagaccaagtgcaggaccatcgccagcctgctgacagctgcccccaacccccacagcaaaggagtgctgatgttcaagaagaggcggcagagggccaagaagtacaccctggtgtcctttggagctgctgctggcactggagctgaggaggaggatggagtgccccccaccagcgagagcgagctggatgaggaggccttcagtgatgcccggagcctgaccaaccagagcgactgggacagcccctacctggacatggagctggcccgggccggcagccgggccagcgagggccagggcagcggcctgggcggccagctgtctgaggtgtctggccggggcgtgcagctgtttgagcagcagaggcagagagctgacagcagcacccaggagctggcccgggtggagcctgctgccatgctgaatggagagggcctgcagagccccccccgggcccagagcgcccctcctgaggccgctgtgctgccccccagccccctgcctgcccctgtggccagcccccggcccttccagcccggcggcggggcccccaccccagcccccagcatcttcaacagaagtgcccggcccttcaccccaggcctgcagggccagaggcccaccaccaccagcgtcatcttccggcccctggcccccaagagggccaatgacagcctgggcggcctgagccctgcccccccacccttcctgagcagccagggccccacccccctgcccagcttcaccagcggcgtgcccagccacgcccctgtgtctggcagccccagcacccccaggagcagcggccctgtgacagccaccagcagcctgtacatcccagcccccagcaggcctgtgaccccaggaggagcccctgagcccccagccccacccagcgctgctgccatgaccagcacagccagcatcttcctgagcgcccccctgcggcccagcgcccggcctgaggccccagcccctggccctggggcccctgagccccccagcgcccgggagcagaggatctctgtgcctgctgccaggacaggcatcctgcaggaggccaggagaagaggcaccaggaagcagatgttccggcctgggaaggaggagaccaagaacagccccaaccctgagctgctgagcctggtgcagaacctggatgagaagcccagggctggaggagctgagagcggccctgaggaggatgccctgagcctgggcgctgaggcctgcaacttcatgcagcctgtgggcgcccggagctacaagaccctgccccacgtgacccccaagaccccaccacccatggcccccaagaccccaccacccatgacccccaagaccccacctcctgtggcccccaagccacccagccggggcctgctggatggcctggtgaatggagctgccagcagcgctggcatccctgagcccccccggctgcagggccggggcggggagctgtttgccaagaggcagagcagagctgaccgctacgtggtggagggcaccccaggccctggcctgggcccccggcccaggagccccagccccacccccagcctgccccccagctggaagtacagccccaacatccgggcccccccacccatcgcctacaaccccctgctgagccccttcttcccccaggccgcccggaccctgcccaaggcccagagccagggcccccgggccacccccaagcagggcatcaaggccctggacttcatgaggcaccagccctaccagctgaagacagccatgttctgctttgatgaggtgccccccaccccaggccccatcgccagcggcagccccaagacagcccgggtgcaggagatccgccgcttcagcaccccagccccccagcccacagctgagcccctggcccccaccgtgctggcccccagggctgccaccaccctggatgagcccatctggaggacagagctggccagcgcccctgtgcccagccctgcccctcctcctgaggccccccggggcctgggcgccagccccagcagctgtggcttccaggtggcccggccccgcttcagcgccaccaggacaggcctgcaggcccacgtgtggaggcctggggccggccaccagtag

SEQ ID NO: 20429 - DNA, 2757 bp, Artificial Sequence
  Description of Artificial Sequence: Synthetic coding sequence
atgggcaccacagcccctggccccatccacctgctggagctgtgtgaccagaagctgatggagttcctgtgcaacatggacaacaaggacctggtgtggctggaggagatccaggaggaggccgagaggatgttcacccgggagttcagcaaggagcctgagctgatgcccaagacccccagccagaagaacagaaggaagaagaggcgcatctcctatgtgcaggatgaaaatagagaccccatcagaagaaggctgagcaggaggaagagccgcagcagccagctgagcagccggcggctgcggagcaaggacagcgtggagaagctggccaccgtggtgggggagaatggatctgtgctgcggcgggtgaccagggctgctgctgctgctgctgctgccaccatggccctggccgcccccagcagccccaccccagagagccccaccatgctgaccaagaagccagaggacaaccacacccagtgccagctggtgcctgtggtggagatcggcatcagcgagcggcagaatgctgagcagcacgtgacccagctgatgagcacagagcccctgcccaggaccctgagccccaccccagccagcgccacagcccccaccagccagggcatccccaccagtgatgaggagagcacccccaagaagagcaaggcccgcatcctggagagcatcaccgtgagcagcctgatggccaccccccaggaccccaagggccagggcgtgggcaccggccgcagcgccagcaagctgagaattgcccaggtgtccccaggcccccgggacagccctgccttcccagacagcccctggagggagcgggtgctggcccccatcctgcctgacaacttcagcacccccaccggcagcaggacagacagccagagcgtgcgccacagccccatcgcccccagcagccccagcccccaggtgctggcccagaagtacagcctggtggccaagcaggagagcgtggtgagaagagccagccggcggctggccaagaagacagctgaggagcctgctgccagcggccgcatcatctgccacagctacctggagcggctgctgaatgtggaggtgccccagaaggtgggcagcgagcagaaggagcccccagaggaggccgagcctgtggccgctgctgagcctgaggtgcctgagaacaacggcaacaacagctggccccacaatgacacagagatcgccaacagcacccccaaccccaagccagctgccagcagccctgagacccccagcgctggccagcaggaggccaagacagaccaggctgatggcccccgggagcccccccagagcgcccggaggaagaggagctacaagcaggccgtgtctgagctggatgaggagcagcacctggaggatgaggagctgcagcccccaagaagcaagacccccagcagcccctgcccagccagcaaggtggtgcggcccctgcggaccttcctgcacacagtgcagaggaaccagatgctgatgacccccaccagcgcccccaggtctgtgatgaagagcttcatcaagaggaacacccccctgaggatggaccccaagtgcagctttgtggagaaggagcggcagaggctggagaacctgcggaggaaggaggaggccgagcagctgcggcggcagaaggtggaggaggacaagagaagaaggctggaggaggtgaagctgaagcgggaggagcggctgaggaaggtgctgcaggcccgggagcgggtggagcagatgaaggaggagaagaagaagcagatcgagcagaagtttgcccagattgatgagaagacagagaaggccaaggaggagcggctggccgaggagaaggccaagaagaaggccgccgccaagaagatggaggaggtggaggcccggaggaagcaggaggaggaggcccggcggctgcgctggctgcagcaggaggaggaggagcggcggcaccaggagctgctgcagaagaagaaggaggaggagcaggagcggctgaggaaggctgctgaggccaagaggctggccgagcagcgggagcaggagcggcgggagcaggagcggcgggagcaggagcggcgggagcaggagcggcgggagcaggagcggcgggagcaggagcggcagctggccgagcaggagaggagaagagagcaggagcggctgcaggccgagcgggagctgcaggagcgggagaaggccctgcggctgcagaaggagcagctgcagcgggagctggaggagaagaagaagaaggaggagcagcagaggctggccgagcggcagctgcaggaggagcaggagaagaaggccaaggaggccgccggggccagcaaggccctgaatgtgacagtggatgtgcagagccctgcctgcaccagctaccagatgaccccccagggccaccgggccccacccaagatcaacccagacaactacggcatggacctgaacagtgatgacagcacagatgatgaggcccaccccaggaagcccatccccacctgggcccggggcacccccctgagccaggccatcatccaccagtactaccacccccccaacctgctggagctgtttggcaccatcctgcccctggacctggaggacatcttcaagaagagcaagccccgctaccacaagaggaccagcagcgctgtgtggaacagcccccccctgcagggcgcccgggtgcccagcagcctggcctacagcctgaagaagcactag

SEQ ID NO: 20430 - DNA, 1728 bp, Artificial Sequence
  Description of Artificial Sequence: Synthetic coding sequence
atgaccagcaagaagctggtgaacagcgtggccggctgtgctgatgatgccctggccggcctggtggcctgcaaccccaacctgcagctgctgcagggccaccgggtggccctgcggagtgacctggacagcctgaagggccgggtggccctgctgagcggcggcggcagcggccacgagcccgcccacgccggcttcatcggcaagggcatgctgactggagtgattgctggagctgtgttcaccagccctgctgtgggcagcatcctggccgccatccgggctgtggcccaggccggcaccgtgggcaccctgctgattgtgaagaactacaccggggaccggctgaactttggcctggcccgggagcaggcccgggcagagggcatccctgtggagatggtggtgattggagatgattctgccttcaccgtgctgaagaaggccggcagaagaggcctgtgtggcaccgtgctgatccacaaggtggccggggccctggccgaggccggcgtgggcctggaggagatcgccaagcaggtgaatgtggtggccaaggccatgggcaccctgggcgtgtccctgagcagctgcagcgtgcccggcagcaagcccacctttgagctgtctgcagatgaggtggagctgggcctgggcatccatggagaggccggcgtgcggcgcatcaagatggccacagcagatgaaattgtgaagctgatgctggaccacatgaccaacaccaccaatgccagccacgtgcctgtgcagcccggcagctctgtggtgatgatggtgaacaacctgggcggcctgtccttcctggagctgggcatcatcgcagatgccaccgtgcgcagcctggagggccggggcgtgaagatcgcccgggccctggtgggcaccttcatgtctgccctggagatgcctggcatcagcctgaccctgctgctggtggatgagcccctgctgaagctgattgatgctgagaccacagctgctgcctggcccaacgtggccgctgtgtccatcactggaaggaagaggagccgggtggccccagctgagccccaggaggccccagacagcacagctgctgggggcagcgccagcaagaggatggccctggtgctggagcgggtgtgcagcaccctgctgggcctggaggagcacctgaatgccctggacagagctgctggagatggagactgtggcaccacccacagcagagctgcccgggccatccaggagtggctgaaggagggccccccaccagccagccctgcccagctgctgagcaagctgtctgtgctgctgctggagaagatgggcggcagcagcggggccctgtatggcctcttcctgacagctgctgcccagcccctgaaggccaagaccagcctgcctgcctggagcgctgccatggatgctggcctggaggccatgcagaagtatggcaaggccgcccctggggacaggaccatgctggacagcctgtgggccgccggccaggagctgcaggcctggaagagccctggagctgacctgctgcaggtgctgaccaaggctgtgaagtctgctgaggccgctgctgaggccaccaagaacatggaggccggggccggccgggccagctacatcagcagcgcccggctggagcagcctgaccctggagctgtggccgctgctgccatcctgcgggccatcctggaggtgctgcagagctag

SEQ ID NO: 20431 - DNA, 1080 bp, Artificial Sequence
  Description of Artificial Sequence: Synthetic coding sequence
atggccgccccctgtgccgaggaccccagcctggagcggcacttcaagggccacagagatgctgtgacctgtgtggacttcagcatcaacaccaagcagctggccagcggctccatggacagctgcctgatggtgtggcacatgaagccccagagccgggcctaccgcttcaccggccacaaggatgctgtgacctgtgtgaacttcagccccagcggccacctgctggccagcggcagccgggacaagacagtgcgcatctgggtgcccaacgtgaagggggagagcacagtgttccgggcccacacagccaccgtgcgctctgtgcacttctgcagtgatggccagagctttgtgacagccagtgatgacaagacagtgaaggtgtgggccacccaccggcagaagttcctgttcagcctgagccagcacatcaactgggtgcgctgtgccaagttctccccagatggccgcctcatcgtgtctgccagtgatgacaagacagtgaagctgtgggacaagagcagccgggagtgtgtgcacagctactgtgagcacggcggctttgtgacctacgtggacttccaccccagcggcacctgcatcgctgctgctggcatggacaacacagtgaaggtgtgggatgtgaggacccaccggctgctgcagcactaccagctgcacagcgctgctgtgaatggcctgtccttccaccccagcggcaactacctgatcacagccagcagtgacagcaccctgaagatcctggacctgatggagggccgcctgctgtacaccctgcacggccaccagggccctgccaccaccgtggccttcagcaggactggagagtactttgccagcggcggcagtgatgagcaggtgatggtgtggaagagcaactttgacatcgtggaccatggagaggtgaccaaggtgccccggcccccagccaccctggccagctccatgggcaacctgactgtgtccatcctggagcagaggctgaccctgacagaggacaagctgaagcagtgcctggagaaccagcagctgatcatgcagagggccaccccctag

SEQ ID NO: 20432 - DNA, 633 bp, Artificial Sequence; identical to SEQ ID NO: 19581
  Description of Artificial Sequence: Synthetic coding sequence

SEQ ID NO: 20433 - DNA, 1491 bp, Artificial Sequence
  Description of Artificial Sequence: Synthetic coding sequence
atggaccaggactatgaaagaaggctgctgcggcagatcgtcatccagaatgaaaacaccatgccccgggtgacagagatgaggaggaccctgaccccagccagcagccctgtgagcagccccagcaagcacggggaccgcttcatccccagcagagctggggccaactggagcgtgaacttccaccgcatcaatgaaaatgagaagagccccagccagaacaggaaggccaaggatgccaccagtgacaacgggaaggatggcctggcctacagcgccctgctgaagaatgagctgctgggcgccggcatcgagaaggtgcaggacccccagacagaagatagaaggctgcagcccagcaccccagagaagaagggcctcttcacctacagcctgagcaccaagaggagcagcccagatgatggaaatgatgtgagcccctacagcctgagccctgtgagcaacaagagccagaagctgctgcggagccccaggaagcccaccaggaagatcagcaagatccccttcaaggtgctggatgcccctgagctgcaggatgacttctacctgaacctggtggactggagcagcctgaatgtgctgtctgtgggcctgggcacctgtgtgtacctgtggagcgcctgcaccagccaggtgacccggctgtgtgacctgtctgtggagggggacagcgtgacctctgtgggctggagcgagcggggcaacctggtggccgtgggcacccacaagggctttgtgcagatctgggatgctgctgctgggaagaagctgtccatgctggagggccacacagcccgggtgggcgccctggcctggaatgctgagcagctgagcagcggcagccgggacaggatgatcctgcagagggacatccgcaccccacccctgcagagcgagcggcggctgcagggccaccggcaggaggtgtgtggcctgaagtggagcacagaccaccagctgctggccagcggcggcaatgacaacaagctgctggtgtggaaccacagcagcctgagccctgtgcagcagtacacagagcacctggccgctgtgaaggccatcgcctggagcccccaccagcacggcctgctggccagcggcggcggcacagctgaccgctgcatccgcttctggaacaccctgaccggccagcccctgcagtgcatcgacaccggcagccaggtgtgcaacctggcctggagcaagcacgccaatgagctggtgtccacccacggctacagccagaaccagatcctggtgtggaagtaccccagcctgacccaggtggccaagctgaccggccacagctacagagtgctgtacctggccatgagcccagatggagaggccatcgtgactggagctggagatgagaccctgcgcttctggaatgtgttcagcaagaccaggagcaccaaggtgaagtgggagagcgtgtctgtgctgaacctcttcacccgcatcagatag

SEQ ID NO: 20434 - DNA, 390 bp, Artificial Sequence; identical to SEQ ID NO: 19988
  Description of Artificial Sequence: Synthetic coding sequence

SEQ ID NO: 20435 - DNA, 888 bp, Artificial Sequence; identical to SEQ ID NO: 19226
  Description of Artificial Sequence: Synthetic coding sequence

SEQ ID NO: 20436 - DNA, 888 bp, Artificial Sequence; identical to SEQ ID NO: 19226
  Description of Artificial Sequence: Synthetic coding sequence

SEQ ID NO: 20437 - DNA, 354 bp, Artificial Sequence
  Description of Artificial Sequence: Synthetic coding sequence
atgctgtgctggggcaatgccagctttggccagctgggcctgggcggcattgatgaggagatcgtgctggagcccaggaagagtgacttcttcatcaacaagagggtgagagatgtgggctgcggcctgcggcacacagtgtttgtgctggatgatggcaccgtgtacacctgtggctgcaatgacctgggccagctgggccacgagaagagcaggaagaagccagagatcctgaaggtgtgccagatcagccggctgtaccgcctgctggtggtgaccatcatccacctgcacttcctgaagcaggtgaagagctctgtgggggaccgcatcaacatggccaactgggtgtag

SEQ ID NO: 20438 - DNA, 3174 bp, Artificial Sequence
  Description of Artificial Sequence: Synthetic coding sequence
atgctgtgctggggcaatgccagctttggccagctgggcctgggcggcattgatgaggagatcgtgctggagcccaggaagagtgacttcttcatcaacaagagggtgagagatgtgggctgcggcctgcggcacacagtgtttgtgctggatgatggcaccgtgtacacctgtggctgcaatgacctgggccagctgggccacgagaagagcaggaagaagccagagcaggtggtggccctggatgcccagaacatcgtggccgtgtcctgtggggaggcccacaccctggccctgaatgacaagggccaggtgtatgcctggggcctggacagtgatggccagctgggcctggtgggcagcgaggagtgcatccgggtgcccaggaacatcaagagcctgagtgacatccagatcgtgcaggtggcctgtggctactaccacagcctggccctgagcaaggccagcgaggtgttctgctggggccagaacaagtatggccagctgggcctgggcacagactgcaagaagcagaccagcccccagctgctgaagagcctgctgggcatccccttcatgcaggtggccgccggcggggcccacagctttgtgctgaccctgagcggggccatcttcggctggggcaggaacaagtttggccagctgggcctgaatgatgaaaatgacagatatgtgcccaacctgctgaagagcctgcggagccagaagatcgtgtacatctgctgcggggaggaccacacagctgccctgaccaaggagggcggcgtcttcaccttcggggccggcggctacggccagctgggccacaacagcaccagccatgagatcaaccccaggaaggtgtttgagctgatgggcagcatcgtgacagaaattgcctgtggccggcagcacaccagcgcctttgtgcccagcagcggccgcatctacagctttggcctgggcggcaatggccagctgggcaccggcagcaccagcaacaggaagagccccttcaccgtgaagggcaactggtacccctacaacggccagtgcctgcctgacatcgacagcgaggagtacttctgtgtgaagaggatcttctctggaggagaccagagcttcagccactacagcagcccccagaactgtggccccccagatgacttccgctgccccaaccccaccaagcagatctggacagtgaatgaggccctgatccagaagtggctgagctaccccagcggccgcttccctgtggagatcgccaatgaaattgatggcaccttcagcagcagcggctgcctgaatggcagcttcctggccgtgtccaatgatgaccactacagaacaggcacccgcttcagcggcgtggacatgaatgctgcccggctgctcttccacaagctgatccagcctgaccacccccagatcagccagcaggtggccgccagcctggagaagaacctgatccccaagctgaccagcagcctgcctgatgtggaggccctgcgcttctacctgaccctgcctgagtgccccctgatgtctgacagcaacaacttcaccaccatcgccatcccctttggaacagccctggtgaacctggagaaggcccccctgaaggtgctggagaactggtggagcgtgctggagcccccactcttcctgaagatcgtggagctgttcaaggaggtggtggtgcacctgctgaagctgtacaagattggcatccccccatctgaaagacgcatcttcaacagcttcctgcacacagccctgaaggtgctggagatcctgcaccgggtgaatgagaagatgggccagatcatccagtatgacaagttctacatccacgaggtgcaggagctgattgacatcagaaatgactacatcaactgggtgcagcagcaggcctacggcatggatgtgaaccacggcctgacagagctggccgacatccctgtgaccatctgcacctacccctttgtgtttgatgcccaggccaagaccaccctgctgcagacagatgctgtgctgcagatgcagatggccatcgaccaggcccaccggcagaatgtgagcagcctcttcctgcccgtcatcgagagcgtgaacccctgcctgatcctggtggtgcggcgggagaacatcgtgggagatgccatggaggtgctgaggaagaccaagaacatcgactacaagaagcccctgaaggtgatctttgtgggagaagatgctgtggatgctgggggcgtgaggaaggagttcttcctgctgatcatgagggagctgctggaccccaagtatggcatgttccgctactatgaggacagccgcctcatctggttcagtgacaagacctttgaggacagcgacctcttccacctgattggagtcatctgtggcctggccatctacaactgcaccatcgtggacctgcacttccccctggccctgtacaagaagctgctgaagaagaagcccagcctggatgacctgaaggagctgatgccagatgtgggccgctccatgcagcagctgctggactacccagaagatgacatcgaggagaccttctgcctgaacttcaccatcaccgtggagaactttggagccacagaggtgaaggagctggtgctgaatggagctgacacagctgtgaacaagcagaaccggcaggagtttgtggatgcctacgtggactacatcttcaacaagtctgtggccagcctgtttgatgccttccacgccggcttccacaaggtgtgtggcggcaaggtgctgctgctcttccagcccaatgagctgcaggccatggtgattggcaacaccaactatgactggaaggagctggagaagaacacagagtacaagggggagtactgggccgagcaccccaccatcaagatcttctgggaggtgttccacgagctgcccctggagaagaagaagcagttcctgctcttcctgaccggcagtgaccgcatccccatcctgggcatgaagagcctgaagctggtgatccagagcactggaggaggagaggagtacctgcctgtgagccacacctgcttcaacctgctggacctgcccaagtacacagagaaggagaccctgcggagcaagctgatccaggccatcgaccacaatgaaggcttcagcctcatctag

SEQ ID NO: 20439 - DNA, 1080 bp, Artificial Sequence; identical to SEQ ID NO: 18418
  Description of Artificial Sequence: Synthetic coding sequence

SEQ ID NO: 20440 - DNA, 714 bp, Artificial Sequence
  Description of Artificial Sequence: Synthetic coding sequence
atggaggtgatggagggccccctgaacctggcccaccagcagagccggcgggctgaccggctgctggccgccggcaagtatgaggaggccatcagctgccacaagaaggccgccgcctacctgtctgaggccatgaagctgacccagagcgagcaggcccacctgagcctggagctgcagagggacagccacatgaagcagctgctgctgatccaggagcgctggaagagggcccagcgggaggagcggctgaaggcccagcagaacacagtgctgtacctgctgcagcagaagtctgagcctgctgagccctgcatcggcagcaaggcccccaaggatgacaagaccatcatcgaggagcaggccaccaagattgctgacctgaagagacatgtggagttcctggtggccgagaatgaaaggctgaggaaagaaaacaagcagctgaaggccgagaaggcccggctgctgaagggccccatcgagaaggagctggatgtggatgctgactttgtggagaccagcgagctgtggagcctgccccctcatgctgagacagccacagccagcagcacctggcagaagtttgctgccaacacaggcaaggccaaggacatccccatccccaacctgccccccctggacttccccagccctgagctgcccctgatggagctgtctgaggacatcctgaagggcttcatgaacaactag

SEQ ID NO: 20441 - DNA, 1458 bp, Artificial Sequence
  Description of Artificial Sequence: Synthetic coding sequence
atgaatggcaccctggaccacccagaccagcctgacctggatgccatcaagatgtttgtgggccaggtgcccaggacctggagcgagaaggacctgcgggagctgtttgagcagtatggagctgtgtatgagatcaacgtgctgcgggacaggagccagaaccccccccagagcaagggctgctgctttgtgaccttctacaccaggaaggccgccctggaggcccagaatgccctgcacaacatgaaggtgctgcccggcatgcaccaccccatccagatgaagccagctgacagcgagaagaacaacgtggaggacaggaagctgttcatcggcatgatcagcaagaagtgcacagaaaatgacatccgggtgatgttcagcagctttggccagattgaagaatgtcgcatcctgcggggcccagatggcctgagccggggctgtgcctttgtgaccttcaccacccgggccatggcccagacagccatcaaggccatgcaccaggcccagaccatggagggctgcagcagccccatggtggtgaagtttgctgacacccagaaggacaaggagcagaagaggatggcccagcagctgcagcagcagatgcagcagatctctgctgcctctgtgtggggcaacctggccggcctgaacaccctgggcccccagtacctggccctgtacctgcagctgctgcagcagacagccagcagcggcaacctgaacaccctgagcagcctgcaccccatgggcggcctgaatgccatgcagctgcagaacctggccgccctggccgctgctgccagcgctgcccagaacacccccagcggcaccaatgccctgaccaccagcagcagccccctgtctgtgctgaccagcagcggcagcagccccagcagcagcagcagcaacagcgtgaaccccatcgccagcctgggcgccctgcagaccctggccggggccacagctggcctgaatgtgggcagcctggccggcatggccgccctgaatggaggcctgggcagcagcggcctgagcaatggaacaggcagcaccatggaggccctgacccaggcctacagcggcatccagcagtatgctgctgctgccctgcccaccctgtacaaccagaacctgctgacccagcagagcattggagctgctggcagccagaaggagggccctgagggcgccaacctcttcatctaccacctgccccaggagtttggagaccaggacctgctgcagatgttcatgccctttggaaatgtggtgtctgccaaggtgttcatcgacaagcagaccaacctgagcaaatgttttggatttgtgtcctatgacaaccctgtgtctgcccaggccgccatccagagcatgaatggcttccagatcggcatgaagaggctgaaggtgcagctgaagaggagcaagaatgacagcaagccctactag

SEQ ID NO: 20442 - DNA, 1452 bp, Artificial Sequence
  Description of Artificial Sequence: Synthetic coding sequence
atgaatggcaccctggaccacccagaccagcctgacctggatgccatcaagatgtttgtgggccaggtgcccaggacctggagcgagaaggacctgcgggagctgtttgagcagtatggagctgtgtatgagatcaacgtgctgcgggacaggagccagaaccccccccagagcaagggctgctgctttgtgaccttctacaccaggaaggccgccctggaggcccagaatgccctgcacaacatgaaggtgctgcccggcatgcaccaccccatccagatgaagccagctgacagcgagaagaacaatgctgtggaggacaggaagctgttcatcggcatgatcagcaagaagtgcacagaaaatgacatccgggtgatgttcagcagctttggccagatcgaggagtgccgcatcctgcggggcccagatggcctgagccggggctgtgcctttgtgaccttcaccacccgggccatggcccagacagccatcaaggccatgcaccaggcccagaccatggagggctgcagcagccccatggtggtgaagtttgctgacacccagaaggacaaggagcagaagaggatggcccagcagctgcagcagcagatgcagcagatctctgctgcctctgtgtggggcaacctggccggcctgaacaccctgggcccccagtacctggccctgctgcagcagacagccagcagcggcaacctgaacaccctgagcagcctgcaccccatgggcggcctgaatgccatgcagctgcagaacctggccgccctggccgccgccgccagcgctgcccagaacaccccatctggcaccaatgccctgaccaccagcagcagccccctgtctgtgctgaccagcagcgctggcagcagccccagcagcagcagcagcaacagcgtgaaccccatcgccagcctgggcgccctgcagaccctggccggggccacagctggcctgaatgtgggcagcctggccggcatggccgccctgaatggaggcctgggcagcagcggcctgagcaatggaacaggcagcaccatggaggccctgacccaggcctacagcggcatccagcagtatgctgctgctgccctgcccaccctgtacaaccagaacctgctgacccagcagagcattggagctgctggcagccagaaggagggccctgagggcgccaacctcttcatctaccacctgccccaggagtttggagaccaggacctgctgcagatgttcatgccctttggaaatgtggtgtctgccaaggtgttcatcgacaagcagaccaacctgagcaaatgttttggatttgtgtcctatgacaaccctgtgtctgcccaggccgccatccagagcatgaatggcttccagatcggcatgaagaggctgaaggtgcagctgaagaggagcaagaatgacagcaagccctactag

SEQ ID NO: 20443 - DNA, 3570 bp, Artificial Sequence
  Description of Artificial Sequence: Synthetic coding sequence
atggatgacaagggggaccccagcaatgaggaggcccccaaggccatcaagcccaccagcaaggagttcaggaagacctggggcttccggaggaccaccatcgccaagcgggagggcgctggagatgctgaggccgaccccctggagcccccaccaccccagcagcagctgggcctgagcctgcggcgcagcggccggcagcccaagaggacagagcgggtggagcagttcctgaccatcgccaggagaagaggccgccgctccatgcctgtgtccctggaggacagcggggagcccaccagctgcccagccacagatgctgagacagccagcgagggctctgtggagagcgccagcgagaccaggagcggcccccagagcgccagcacagctgtgaaggagaggcctgccagcagcgagaaggtgaagggaggagatgaccatgatgacaccagtgacagcgacagtgatggcctgaccctgaaggagctgcagaaccggctgcggaggaagcgggagcaggagcccacagagcggcccctgaagggcatccagagccggctgaggaagaagaggcgggaggagggccctgctgagaccgtgggcagcgaggccagtgacacagtggagggcgtgctgcccagcaagcaggagccagaaaatgaccagggcgtggtgtcccaggccggcaaggatgaccgggagagcaagctggagggcaaggccgcccaggacatcaaggatgaggagcccggggacctgggccggcccaagccagaatgtgagggctatgaccccaatgccctgtactgcatctgccggcagccccacaacaaccgcttcatgatctgctgtgacagatgtgaggagtggttccatggagactgtgtgggcatcagcgaggcccggggccgcctgctggagagaaatggagaggactacatctgccccaactgcaccatcctgcaggtgcaggatgagacccacagcgagacagctgaccagcaggaggccaagtggaggcctggagatgctgatggaacagactgcaccagcatcggcaccatcgagcagaagagcagcgaggaccagggcatcaagggccgcatcgagaaggccgccaaccccagcggcaagaagaagctgaagatcttccagcctgtgattgaggcccctggggccagcaagtgcatcggccctggctgctgccacgtggcccagcctgacagcgtgtactgcagcaatgactgcatcctgaagcacgccgccgccaccatgaagttcctgagcagcggcaaggagcagaagcccaagcccaaggagaagatgaagatgaagccagagaagcccagcctgcccaagtgtggggcccaggccggcatcaagatcagctctgtgcacaagaggcctgcccctgagaagaaggagaccaccgtgaagaaggctgtggtggtgcctgcccggtctgaggccctgggcaaggaggccgcctgtgagagcagcacccccagctgggccagtgaccacaactacaatgctgtgaagccagagaagacagctgcccccagccccagcctgctgtacaagagcaccaaggaggacagaagaagtgaggagaaggccgccgccatggccgccagcaagaagacagcccctcctggcagcgctgtgggcaagcagcctgcccccaggaacctggtgcccaagaagagcagctttgccaacgtggccgccgccaccccagccatcaagaagccacccagcggcttcaagggcaccatccccaagaggccctggctgagcgccacccccagcagcggggccagcgctgcccggcaggccggccctgccccagctgctgccacagctgccagcaagaagtttcctggcagcgctgccctggtgggcgctgtgaggaagcctgtggtgcccagcgtgcccatggccagccctgcccctggccgcctgggcgccatgtctgctgcccccagccagcccaacagccagatccggcagaacatcagaagaagcctgaaggagatcctgtggaagagggtgaatgacagtgatgacctgatcatgacagaaaatgaggtgggcaagatcgccctgcacatcgagaaggagatgttcaacctcttccaggtgacagacaaccgctacaagagcaagtaccgcagcatcatgttcaacctgaaggaccccaagaaccagggcctcttccaccgggtgctgcgggaggagatcagcctggccaagctggtgcggctgaagccagaggagctggtgtccaaggagctgagcacctggaaggagaggcctgcccggtctgtgatggagagcaggaccaagctgcacaatgaaagcaagaagacagccccccggcaggaggccatcccagacctggaggacagcccccctgtgtctgattctgaggagcagcaggagagcgcccgggctgtgcctgagaagagcacagcccccctgctggatgtgttcagctccatgctgaaggacaccaccagccagcaccgggcccacctgtttgacctgaactgcaagatctgcaccggccaggtgcccagcgcagaagatgagcccgcccccaagaagcagaagctgagcgcctctgtgaagaaggaggacctgaagagcaagcatgacagcagcgccccagaccctgccccagacagcgcagatgaggtgatgcctgaggccgtgcctgaggtggccagcgagcccggcctggagagcgccagccaccccaacgtggacaggacctacttccctggccccccaggagatggccaccctgagcccagccccctggaggacctgagcccctgcccagccagctgtggcagcggcgtggtgaccaccgtgacagtgtctggccgggaccccaggacagcccccagcagcagctgcacagctgtggccagcgctgccagcaggccagacagcacccacatggtggaggcccggcaggatgtgcccaagcctgtgctgacctctgtgatggtgcccaagagcatcctggccaagcccagcagcagcccagacccccgctacctgtctgtgccccccagccccaacatcagcaccagcgagagccgcagccccccagagggggacaccaccctcttcctgagccggctgagcaccatctggaagggcttcatcaacatgcagagcgtggccaagtttgtgaccaaggcctaccctgtgtctggctgctttgactacctgtctgaggacctgcctgacaccatccacatcggcggcagaattgcccccaagacagtgtgggactatgtgggcaagctgaagagctctgtgtccaaggagctgtgcctgatccgcttccacccagccacagaggaggaggaggtggcctacatcagcctgtacagctacttcagcagccggggccgcttcggcgtggtggccaacaacaacagacatgtgaaggacctgtacctgatccccctgagcgcccaggaccctgtgcccagcaagctgctgccctttgagggccctgggaagaggcggctgagcggctggaggtag

SEQ ID NO: 20444 - DNA, 3570 bp, Artificial Sequence; identical to SEQ ID NO: 20443
  Description of Artificial Sequence: Synthetic coding sequence

SEQ ID NO: 20445 - DNA, 6723 bp, Artificial Sequence; identical to SEQ ID NO: 18530
  Description of Artificial Sequence: Synthetic coding sequence

SEQ ID NO: 20446 - DNA, 888 bp, Artificial Sequence; identical to SEQ ID NO: 19226
  Description of Artificial Sequence: Synthetic coding sequence

SEQ ID NO: 20447 - DNA, 834 bp, Artificial Sequence; identical to SEQ ID NO: 19947
  Description of Artificial Sequence: Synthetic coding sequence

SEQ ID NO: 20448 - DNA, 1245 bp, Artificial Sequence
  Description of Artificial Sequence: Synthetic coding sequence
atgggcaccgtgacagaggacctgatcagaagaaatgctgagcacaatgactgtgtgatcttcagcctggaggagctgagcctgcaccagcaggagattgagcggctggagcacatcgacaagtggtgccgggacctgaagatcctgtacctgcagaacaacctgattggcaagattgaaaatgtgtccaagctgaagaagctggagtacctgaacctggccctgaacaacatcgagaagattgagaacctggagggctgtgaggagctggccaagctggacctgactgtgaacttcatcggggagctgagcagcatcaagaacctgcagcacaacatccacctgaaggagctgttcctgatgggcaacccctgtgccagctttgaccactaccgggagtttgtggtggccaccctgccccagctgaagtggctggatggcaaggagattgagcccagcgagcgcatcaaggccctgcaggactacagcgtgattgagccccagatccgggagcaggagaaggaccactgcctgaagagggccaagctgaaggaggaggcccagaggaagcaccaggaggaggacaagaatgaagacaagaggagcaatgccggctttgatggccgctggtacacagacatcaatgccaccctgagcagcctggagagcaaggaccacctgcaggccccagacacagaggagcacaacaccaagaagctggacaacagtgaagatgacctggagttctggaacaagccctgcctcttcaccccagagagccggctggagaccctgcggcacatggagaagcagaggaagaagcaggagaagctgtctgagaagaagaagaaggtgaagccacccaggaccctcatcacagaagatggcaaggccctgaatgtgaatgagcccaagattgacttcagcctgaaggacaatgagaagcagatcatcctggacctggccgtgtaccgctacatggacaccagcctgattgatgtggatgtgcagcccacctacgtgcgggtgatgatcaagggcaagcccttccagctggtgctgcctgctgaggtgaagccagacagcagcagcgccaagaggagccagaccaccggccacctggtgatctgcatgcccaaggtgggggaggtgatcaccggcggccagagggccttcaagtccatgaagaccaccagtgacaggagccgggagcagaccaacaccagctacagcacaggcttctag

SEQ ID NO: 20449 - DNA, 2529 bp, Artificial Sequence
  Description of Artificial Sequence: Synthetic coding sequence
atgagcagcagccactttgccagccgccacaggaaggacatcagcacagagatgatccgcaccaagatcgcccacaggaagagcctgagccagaaggaaaatagacacaaggagtatgaaagaaacagacacttcggcctgaaggatgtgaacatccccaccctggagggccgcatcctggtggagctggatgagaccagccagggcctggtgcctgagaagaccaacgtgaagccccgggccatgaagaccatcctgggggaccagaggaagcagatgctgcagaagtacaaggaggagaagcagctgcagaagctgaaggagcagcgggagaaggccaagaggggcatcttcaaggtgggccgctacagaccagacatgccctgcttcctgctgagcaaccagaatgctgtgaaggccgagcccaagaaggccatccccagctctgtgcgcatcaccaggagcaaggccaaggaccagatggagcagaccaagattgacaatgaaagtgatgtgcgggccatccggcccggcccccggcagaccagcgagaagaaggtgtctgacaaggagaagaaggtggtgcagcctgtgatgcccaccagcctgaggatgaccaggtctgccacccaggccgccaagcaggtgcccaggacagtgagcagcaccacagccaggaagcctgtgacccgggccgccaatgaaaatgaacctgagggcaaggtgcccagcaagggccggcctgccaagaatgtggagaccaagccagacaagggcatcagctgcaaggtggacagcgaggagaacaccctgaacagccagaccaatgccaccagcggcatgaacccagatggagtgctgagcaagatggagaacctgcctgagatcaacacagccaagatcaagggcaagaacagctttgcccccaaggacttcatgttccagcccctggatggcctgaagacctaccaggtgacccccatgacccccaggtctgccaatgccttcctgacccccagctacacctggacccccctgaagacagaggtggatgagagccaggccaccaaggagatcctggcccagaagtgcaagacctacagcaccaagaccatccagcaggacagcaacaagctgccctgccccctgggccccctgactgtgtggcatgaggagcacgtgctgaacaagaatgaggccaccaccaagaacctgaatggcctgcccatcaaggaggtgcccagcctggagagaaatgaaggaagaattgcccagccccaccacggcgtgccctacttcaggaacatcctgcagagcgagacagagaagctgaccagccactgctttgagtgggacaggaagctggagctggacatcccagatgatgccaaggacctgatcagaacagctgtgggccagacccggctgctgatgaaggagcgcttcaagcagtttgagggcctggtggatgactgtgagtacaagaggggcatcaaggagaccacctgcacagacctggatggcttctgggacatggtgtccttccagattgaagatgtgatccacaagttcaacaacctgatcaagctggaggagagcggctggcaggtgaacaacaacatgaaccacaacatgaacaagaatgtgttcaggaagaaggtggtgtctggcatcgccagcaagcccaagcaggatgatgctggaagaattgctgccaggaaccggctggccgccatcaagaatgccatgagggagcgcatccggcaggaggagtgtgccgagacagctgtgtctgtcatccccaaggaggtggacaagatcgtgtttgatgctggcttcttccgggtggagagccctgtgaagctgttcagcggcctgtctgtgagcagcgagggccccagccagaggctgggcacccccaagtctgtgaacaaggctgtgtcccagagcagaaatgagatgggcatcccccagcagaccaccagcccagaaaatgccggcccccagaacaccaagtcagaacatgtgaagaagaccctcttcctgagcatccctgagagccgcagcagcattgaagatgcccagtgccccggcctgcctgacctgattgaagaaaatcatgtggtgaacaagacagacctgaaggtggactgcctgagcagcgagaggatgagcctgcccctgctggccggcggcgtggctgatgacatcaacaccaacaagaaggagggcatcagtgatgtggtggagggcatggagctgaacagcagcatcaccagccaggatgtgctgatgagcagccctgagaagaacacagccagccagaacagcatcctggaggagggggagaccaagatcagccagagcgagctgtttgacaacaagagcctgaccacagagtgccacctgctggacagcgtgggcagctgctacgtggcccgggccggcctggaggtgctgggcagcagtgaccccaccaccagcgccagccgggtggccggcaccacagcccggagcaagctgcagtag

SEQ ID NO: 20450 - DNA, 1710 bp, Artificial Sequence
  Description of Artificial Sequence: Synthetic coding sequence
atgctgtgcagccccagcttctgcaagctgtgctggaagaggcagagagaaaatggccagaggaaatatggaggccccccacctggctgggatgctgcccctcctgagcggggctgtgagatcttcatcggcaagctgccccgggacctgtttgaagatgagctgatccccctgtgtgagaagattggcaagatctatgagatgaggatgatgatggacttcaatggaaacaacagaggctacgcctttgtgaccttcagcaacaaggtggaggccaagaatgccatcaagcagctgaacaactatgagatcagaaatggccgcctgctgggcgtgtgtgcctctgtggacaactgccgcctgtttgtgggcggcatccccaagaccaagaagcgggaggagatcctgtctgagatgaagaaggtgacagaaggagtggtggatgtgattgtgtaccccagcgctgctgacaagaccaagaacagaggatttgcctttgtggagtatgagagccacagagctgctgccatggcccggaggaagctgctgcccggccgcatccagctgtggggccacggcattgctgtggactgggccgagcctgaggtggaggtggatgaggacaccatgagctctgtgaagatcctgtatgtgaggaacctgatgctgagcaccagcgaggagatgattgagaaggagttcaacaacatcaagccaggagctgtggagcgggtgaagaagatccgggactatgcctttgtgcacttcagcaaccgggaggatgctgtggaggccatgaaggccctgaatggcaaggtgctggatggcagccccatcgaggtgaccctggccaagcctgtggacaaggacagctatgtgcgctacacccggggcactggaggccggggcaccatgctgcagggcgagtacacctacagcctgggccaggtgtatgaccccaccaccacctacctgggcgcccctgtgttctacgccccccagacctatgctgccatccccagcctgcacttccctgccaccaagggccacctgagcaacagagccatcatccgggcccccagcgtgagaggagctgctggggtgcggggcctgggcggccggggctacctggcctacacaggcctgggccggggctaccaggtgaagggggacaagcgggaggacaagctgtatgacatcctgcccggcatggagctgacccccatgaaccctgtgaccctgaagccccagggcatcaagctggccccccagatcctggaggagatctgccagaagaacaactggggccagcctgtgtaccagctgcacagcgccatcggccaggaccagaggcagctgttcctgtacaagatcaccatcccagccctggccagccagaacccagccatccaccccttcaccccacccaagctgagcgcctttgtggatgaggccaagacctatgctgctgagtacaccctgcagaccctgggcatccccacagatggaggagatggcaccatggccacagctgctgctgctgccacagccttccctggctatgctgtgcccaatgccacagcccctgtgtctgctgcccagctgaagcaggccgtgaccctgggccaggacctggccgcctacaccacctatgaggtgtaccccacctttgctgtgacagcccggggagatggctacggcaccttctag

SEQ ID NO: 20451 - DNA, 1764 bp, Artificial Sequence
  Description of Artificial Sequence: Synthetic coding sequence
atgagcacagccatccctggcctgaagaagggcaacaatgccctgcagagcatcatcctgcagaccctgctggagaaggaaaatggccagaggaaatatggaggccccccacctggctgggatgctgcccctcctgagcggggctgtgagatcttcatcggcaagctgccccgggacctgtttgaagatgagctgatccccctgtgtgagaagattggcaagatctatgagatgaggatgatgatggacttcaatggaaacaacagaggctacgcctttgtgaccttcagcaacaaggtggaggccaagaatgccatcaagcagctgaacaactatgagatcagaaatggccgcctgctgggcgtgtgtgcctctgtggacaactgccgcctgtttgtgggcggcatccccaagaccaagaagcgggaggagatcctgtctgagatgaagaaggtgacagaaggagtggtggatgtgattgtgtaccccagcgctgctgacaagaccaagaacagaggatttgcctttgtggagtatgagagccacagagctgctgccatggcccggaggaagctgctgcccggccgcatccagctgtggggccacggcattgctgtggactgggccgagcctgaggtggaggtggatgaggacaccatgagctctgtgaagatcctgtatgtgaggaacctgatgctgagcaccagcgaggagatgattgagaaggagttcaacaacatcaagccaggagctgtggagcgggtgaagaagatccgggactatgcctttgtgcacttcagcaaccgggaggatgctgtggaggccatgaaggccctgaatggcaaggtgctggatggcagccccatcgaggtgaccctggccaagcctgtggacaaggacagctatgtgcgctacacccggggcactggaggccggggcaccatgctgcagggcgagtacacctacagcctgggccaggtgtatgaccccaccaccacctacctgggcgcccctgtgttctacgccccccagacctatgctgccatccccagcctgcacttccctgccaccaagggccacctgagcaacagagccatcatccgggcccccagcgtgcgggagatctacatgaatgtgcctgtgggcgccgccggcgtgcggggcctgggcggccggggctacctggcctacacaggcctgggccggggctaccaggtgaagggggacaagcgggaggacaagctgtatgacatcctgcccggcatggagctgacccccatgaaccctgtgaccctgaagccccagggcatcaagctggccccccagatcctggaggagatctgccagaagaacaactggggccagcctgtgtaccagctgcacagcgccatcggccaggaccagaggcagctgttcctgtacaagatcaccatcccagccctggccagccagaacccagccatccaccccttcaccccacccaagctgagcgcctttgtggatgaggccaagacctatgctgctgagtacaccctgcagaccctgggcatccccacagatggaggagatggcaccatggccacagctgctgctgctgccacagccttccctggctatgctgtgcccaatgccacagcccctgtgtctgctgcccagctgaagcaggccgtgaccctgggccaggacctggccgcctacaccacctatgaggtgtaccccacctttgctgtgacagcccggggagatggctacggcaccttctag

SEQ ID NO: 20452 - DNA, 1620 bp, Artificial Sequence
  Description of Artificial Sequence: Synthetic coding sequence
atggagagcaaccacaagtctggagatggcctgagcggcacccagaaggaggccgccctgcgggccctggtgcagaggacaggctacagcctggtgcaggagaatggccagaggaaatatggaggccccccacctggctgggatgctgcccctcctgagcggggctgtgagatcttcatcggcaagctgccccgggacctgtttgaagatgagctgatccccctgtgtgagaagattggcaagatctatgagatgaggatgatgatggacttcaacggcaacaacagaggctacgcctttgtgaccttcagcaacaaggtggaggccaagaatgccatcaagcagctgaacaactatgagatcagaaatggccgcctgctgggcgtgtgtgcctctgtggacaactgccgcctgtttgtgggcggcatccccaagaccaagaagcgggaggagatcctgtctgagatgaagaaggtgacagagggcgtggtggatgtgattgtgtaccccagcgctgctgacaagaccaagaacagaggatttgcctttgtggagtatgagagccacagagctgctgccatggcccggaggaagctgctgcctggagctgtggagcgggtgaagaagatccgggactatgcctttgtgcacttcagcaaccgggaggatgctgtggaggccatgaaggccctgaatggcaaggtgctggatggcagccccatcgaggtgaccctggccaagcctgtggacaaggacagctatgtgcgctacacccggggcactggaggccggggcaccatgctgcagggcgagtacacctacagcctgggccaggtgtatgaccccaccaccacctacctgggcgcccctgtgttctacgccccccagacctatgctgccatccccagcctgcacttccctgccaccaagggccacctgagcaacagagccatcatccgggcccccagcgtgcgggagatctacatgaatgtgcctgtgggcgccgccggcgtgcggggcctgggcggccggggctacctggcctacacaggcctgggccggggctaccaggtgaagggggacaagcgggaggacaagctgtatgacatcctgcccggcatggagctgacccccatgaaccctgtgaccctgaagccccagggcatcaagctggccccccagatcctggaggagatctgccagaagaacaactggggccagcctgtgtaccagctgcacagcgccatcggccaggaccagaggcagctgttcctgtacaagatcaccatcccagccctggccagccagaacccagccatccaccccttcaccccacccaagctgagcgcctttgtggatgaggccaagacctatgctgctgagtacaccctgcagaccctgggcatccccacagatggaggagatggcaccatggccacagctgctgctgctgccacagccttccctggctatgctgtgcccaatgccacagcccctgtgtctgctgcccagctgaagcaggccgtgaccctgggccaggacctggccgcctacaccacctatgaggtgtaccccacctttgctgtgacagcccggggagatggctacggcaccttctag

SEQ ID NO: 20453 - DNA, 1044 bp, Artificial Sequence
  Description of Artificial Sequence: Synthetic coding sequence
ttcagcctcttccctgctgtggacaatgaggaggccgccctgctgcacgaggaggccaccatgaccatcgaggagctgctgaccaggtatggccagaactgccacaagggccccccccacagcaagagcggggccagtgacaagctgccccgggtggccaagagcaagttctttgaagattctgaagatgaaagtgatgaggccgaggaggaggaggaggacagtgaagaatgttctgaggaggaggatggctacagcagcgaggaggctgaaaatgaggaggatgaagatgacacagaggaggccgaggaggatgatgaggaggaggaggaggagatgatggtgcccggcatggagggcaaggaggagcccggcagtgacagcggcaccacagctgtggtggccctgatccggggcaagcagctgattgtggccaatgctggggacagccgctgtgtggtgtctgaggccggcaaggccctggacatgtcctatgaccacaagccagaagatgaggtggagctggcccgcatcaagaatgccggcggcaaggtgaccatggatggccgggtgaatggaggcctgaacctgagccgggccatcggggaccacttctacaagaggaacaagaacctgcccccagaggagcagatgatcagcgccctgcctgacatcaaggtgctgaccctgacagatgaccacgagttcatggtgattgcctgtgatggcatctggaatgtgatgagcagccaggaggtggtggacttcatccagagcaagatcagccagagagatgaaaatggagagctgcggctgctgagcagcatcgtggaggagctgctggaccagtgcctggccccagacaccagcggagatggcaccggctgtgacaacatgacctgcatcatcatctgcttcaagcccaggaacacagctgagctgcagcctgagagcggcaagaggaagctggaggaggtgctgagcacagaaggagctgaggagaatggaaacagcgacaagaagaagaaggccaagagggactag

SEQ ID NO: 20454 - DNA, 1218 bp, Artificial Sequence
  Description of Artificial Sequence: Synthetic coding sequence
atggagacagacctgaacagccaggacaggaaggacctggacaagttcatcaagttctttgccctgaagacagtgcaggtgattgtgcaggcccggctgggggagaagatctgcaccaggagcagcagcagccccaccggcagtgactggttcaacctggccatcaaggacatccctgaggtgacccatgaggccaagaaggccctggccggccagctgcctgctgtgggccgctccatgtgtgtggagatcagcctgaagaccagcgagggggacagcatggagctggagatctggtgcctggagatgaatgagaagtgtgacaaggagatcaaggtgtcctacacagtgtacaaccggctgagcctgctgctgaagagcctgctggccatcaccagggtgaccccagcctaccgcctgagcaggaagcagggccacgagtatgtgatcctgtaccgcatctactttggagaggtgcagctgagcggcctgggggagggcttccagacagtgcgggtgggcaccgtgggcacccctgtgggcaccatcaccctgagctgtgcctaccgcatcaacctggccttcatgagcacccggcagtttgagaggaccccacccatcatgggcatcatcatcgaccactttgtggaccggccctaccccagcagcagccccatgcacccctgcaactacagaacagctggggaggacaccggggtcatctaccccagcgtggaggacagccaggaggtgtgcaccaccagcttcagcaccagcccccccagccagctgatggtgcctgggaaggagggcggcgtgcccctggcccccaaccagcctgtgcacggcacccaggccgaccaggagcggctggccacctgcacccccagcgacaggacccactgtgccgccacccccagcagcagcgaggacacagagaccgtgagcaacagcagcgagggccgggccagcccccatgatgtgctggagaccatctttgtgaggaaggtgggcgcctttgtgaacaagcccatcaaccaggtgaccctgaccagcctggacatcccctttgccatgtttgcccccaagaacctggagctggaggacacagaccccatggtgaaccccccagacagccctgagacagagagccccctgcagggcagcctgccctgctcctggcccctgccctgcctgctgagccccagcacagtgtag

SEQ ID NO: 20455 - DNA, 2025 bp, Artificial Sequence; identical to SEQ ID NO: 19458
  Description of Artificial Sequence: Synthetic coding sequence

SEQ ID NO: 20456 - DNA, 2640 bp, Artificial Sequence
  Description of Artificial Sequence: Synthetic coding sequence
atgaactacccaggccggggcagccccaggagccctgagcacaacggccggggcggcggcggcggggcctgggagctgggcagtgatgcccggcctgccttcggcggcggcgtgtgctgctttgagcacctgcctggaggagaccctgatgatggagatgtgcccctggccctgctgcggggggagcccggcctgcacctggcccctggaacagatgaccacaaccaccacctggccctggacccctgcctgagtgatgaaaattatgacttcagcagcgctgagagcggcagcagcctgcgctactacagcgagggggagagcggcggcggcggcagcagcctgagcctgcaccccccccagcagccccccctggtgcccaccaacagcggcggcggcggggccaccggcggcagccctggagagaggaagaggacccggctgggcggccctgctgcccggcacagatatgaggtggtgacagagctgggccctgaggaggtgcgctggttctacaaggaggacaagaagacctggaagcccttcatcggctatgacagcctgcgcatcgagctggccttccgcaccctgctgcagaccactggagcccggccccagggcggggacagagatggagaccacgtgtgcagccccactggacctgccagcagcagtggagaagatgatgatgaagatcgggcctgtggcttctgccagagcaccaccggccacgagcctgagatggtggagctggtgaacatcgagcctgtgtgtgtgcggggcggcctgtatgaggtggatgtgacccagggcgagtgctaccctgtgtactggaaccaggccgacaagatccctgtgatgaggggccagtggttcattgatggcacctggcagcccctggaggaggaggagagcaacctgattgagcaggagcacctgaactgcttccggggccagcagatgcaggagaactttgatattgaggtgtccaagagcattgatggcaaggatggcagcggcatcaactacagcgctgtgcacagcttcaagctgagcagaaatcatgtggactggcacagcgtggatgaggtgtacctgtacagtgatgccaccaccagcaagatcgccaggacagtgacccagaagctgggcttcagcaaggccagcagcagcggcacccggctgcaccggggctacgtggaggaggccaccctggaggacaagcccagccagaccacccacatcgtgtttgtggtgcacggcatcggccagaagatggaccagggccgcatcatcaagaacacagccatgatgagggaggccgccaggaagattgaggagcggcacttcagcaaccacgccacccacgtggagttcctgcctgtggagtggaggagcaagctgaccctggatggagacacagtggacagcatcaccccagacaaggtgcggggcctgcgggacatgctgaacagcagcgccatggacatcatgtactacaccagccccctgtacagagatgagctggtgaagggcctgcagcaggagctgaaccggctgtacagcctcttctgcagcagaaatccagactttgaggagaagggcggcaaggtgtccatcgtgagccacagcctgggctgtgtgatcacctatgacatcatgacaggctggaaccctgtgcggctgtatgagcagctgctgcagaaggaggaggagctgcctgatgagcgctggatgtcctatgaggagcggcacctgctggatgagctgtacatcaccaagaggcggctgaaggagattgaggagcggctgcacggcctgaaggccagctccatgacccagaccccagccctgaagttcaaggtggagaacttcttctgcatgggcagccccctggccgtgttcctggccctgcggggcatccggcccggcaacacaggcagccaggaccacatcctgccccgggagatctgcaaccggctgctgaacatcttccaccccacagatcctgtggcctaccgcctggagcccctcatcctgaagcactacagcaacatcagccctgtgcagatccactggtacaacaccagcaaccccctgccctatgagcacatgaagcccagcttcctgaacccagccaaggagcccacctctgtgtctgaaaatgaaggcatcagcaccatccccagccctgtgaccagccctgtgctgagcagaagacactacggggagagcatcaccaacatcggcaaggccagcatcctgggcgccgccagcatcggcaagggcctgggcggcatgctgttcagccgcttcggccgcagcagcaccacccagagcagcgagaccagcaaggacagcatggaggatgagaagaagcctgtggccagccccagcgccaccaccgtgggcacccagaccctgccccacagcagcagcggcttcctggacagcgccctggagctggaccacagaattgactttgagctgcgggagggcctggtggagagccgctactggagcgctgtgaccagccacacagcctactggagcagcctggatgtggccctcttcctgctgaccttcatgtacaagcatgaacatgatgatgatgccaagcccaacctggaccccatctag

SEQ ID NO: 20457 - DNA, 2316 bp, Artificial Sequence
  Description of Artificial Sequence: Synthetic coding sequence
atgaactacccaggccggggcagccccaggagccctgagcacaacggccggggcggcggcggcggggcctgggagctgggcagtgatgcccggcctgccttcggcggcggcgtgtgctgctttgagcacctgcctggaggagaccctgatgatggagatgtgcccctggccctgctgcggggggagcccggcctgcacctggcccctggaacagatgaccacaaccaccacctggccctggacccctgcctgagtgatgaaaattatgacttcagcagcgctgagagcggcagcagcctgcgctactacagcgagggggagagcggcggcggcggcagcagcctgagcctgcaccccccccagcagccccccctggtgcccaccaacagcggcggcggcctgtatgaggtggatgtgacccagggcgagtgctaccctgtgtactggaaccaggccgacaagatccctgtgatgaggggccagtggttcattgatggcacctggcagcccctggaggaggaggagagcaacctgattgagcaggagcacctgaactgcttccggggccagcagatgcaggagaactttgacatcgaggtgtccaagagcattgatggcaaggatgctgtgcacagcttcaagctgagcagaaatcatgtggactggcacagcgtggatgaggtgtacctgtacagtgatgccaccaccagcaagatcgccaggacagtgacccagaagctgggcttcagcaaggccagcagcagcggcacccggctgcaccggggctacgtggaggaggccaccctggaggacaagcccagccagaccacccacatcgtgtttgtggtgcacggcatcggccagaagatggaccagggccgcatcatcaagaacacagccatgatgagggaggccgccaggaagattgaggagcggcacttcagcaaccacgccacccacgtggagttcctgcctgtggagtggaggagcaagctgaccctggatggagacacagtggacagcatcaccccagacaaggtgcggggcctgcgggacatgctgaacagcagcgccatggacatcatgtactacaccagccccctgtacagagatgagctggtgaagggcctgcagcaggagctgaaccggctgtacagcctcttctgcagcagaaatccagactttgaggagaagggcggcaaggtgtccatcgtgagccacagcctgggctgtgtgatcacctatgacatcatgacaggctggaaccctgtgcggctgtatgagcagctgctgcagaaggaggaggagctgcctgatgagcgctggatgtcctatgaggagcggcacctgctggatgagctgtacatcaccaagaggcggctgaaggagattgaggagcggctgcacggcctgaaggccagctccatgacccagaccccagccctgaagttcaaggtggagaacttcttctgcatgggcagccccctggccgtgttcctggccctgcggggcatccggcccggcaacacaggcagccaggaccacatcctgccccgggagatctgcaaccggctgctgaacatcttccaccccacagatcctgtggcctaccgcctggagcccctcatcctgaagcactacagcaacatcagccctgtgcagatccactggtacaacaccagcaaccccctgccctatgagcacatgaagcccagcttcctgaacccagccaaggagcccacctctgtgtctgaaaatgaaggcatcagcaccatccccagccctgtgaccagccctgtgctgagcagaagacactacggggagagcatcaccaacatcggcaaggccagcatcctgggcgccgccagcatcggcaagggcctgggcggcatgctgttcagccgcttcggccgcagcagcaccacccagagcagcgagaccagcaaggacagcatggaggatgagaagaagcctgtggccagccccagcgccaccaccgtgggcacccagaccctgccccacagcagcagcggcttcctggacagcgcctacttccggctgcaggagagcttcttcaacctgccccagctgctcttcccagaaaatgtgatgcagaacaaggacaatgccctggtggagctggaccacagaattgactttgagctgcgggagggcctggtggagagccgctactggagcgctgtgaccagccacacagcctactggagcagcctggatgtggccctcttcctgctgaccttcatgtacaagcatgaacatgatgatgatgccaagcccaacctggaccccatctag

SEQ ID NO: 20458 - DNA, 1179 bp, Artificial Sequence
  Description of Artificial Sequence: Synthetic coding sequence
atgggcaccacctgcctgcacctgggcaccctggagcagagcctggtgtttgagaacaaggtgaacagcgagaaggtgaagctgagcctgaggaacttcccccacaatgactatgaagatgtgtttgaggagcccagcgagagcggcagtgaccccagcatgtggacagcccggggccccttccggcgggaccgctggagcagtgaagatgaggaggccgccggccccagccaggccctgagccccctgctgagtgacaccaggaagatcgtgtctgagggggagctggaccagctggcccagatccggcccctcatcttcaacttccacgagcagacagccatcaaggactgcctgaagatcctggaggagaagacagctgcctatgacatcatgcaggagttcatggccctggagctgaagaacctgcccggggagttcaacagcggcaaccagcccagcaaccgggagaagaaccgctacagagacatcctgccctatgacagcaccagggtgcccctgggcaagagcaaggactacatcaatgccagctacatccgcatcgtgaactgtggggaggagtacttctacatcgccacccagggccccctgctgagcaccattgatgacttctggcagatggtgctggagaacaacagcaatgtgattgccatgatcacccgggagattgagggcggcatcatcaagtgctaccactactggcccatcagcctgaagaagcccctggagctgaagcacttccgggtcttcctggagaactaccagatcctgcagtacttcatcatccgcatgttccaggtggtggagaagagcacaggcaccagccacagcgtgaagcagctgcagttcaccaagtggccagaccacggcaccccagccagcgctgacagcttcatcaagtacatccgctatgccaggaagagccacctgaccggccccatggtggtgcactgcagcgctggcattggaagaactggagtcttcctgtgtgtggatgtggtgttctgtgccatcgtgaagaactgcagcttcaacatcatggacatcgtggcccagatgagggagcagaggagcggcatggtgcagaccaaggagcagtaccacttctgctatgacatcgtgctggaggtgctgaggaagctgctgaccctggactag

SEQ ID NO: 20459 - DNA, 621 bp, Artificial Sequence
  Description of Artificial Sequence: Synthetic coding sequence
atgagcagcccccgggacttccgggcagagcctgtgaatgactatgagggcaatgacagcgaggccgaggacctgaacttccgggagaccctgcccagcagcagccaggagaacacccccaggagcaaggtgtttgagaacaaggtgaacagcgagaaggtgaagctgagcctgaggaacttcccccacaatgactatgaagatgtgtttgaggagcccagcgagagcggcagtgaccccagcatgtggacagcccggggccccttccggcgggaccgctggagcagtgaagatgaggaggccgccggccccagccaggccctgagccccctgctgagtgacaccaggaagatcgtgtctgagggggagctggaccagctggcccagatccggcccctcatcttcaacttccacgagcagacagccatcaaggactgcctgaagatcctggaggagaagacagctgcctatgacatcatgcaggagttcatgttcaacatcatggacatcgtggcccagatgagggagcagaggagcggcatggtgcagaccaaggagcagtaccacttctgctatgacatcgtgctggaggtgctgaggaagctgctgaccctggactag

SEQ ID NO: 20460 - DNA, 438 bp, Artificial Sequence
  Description of Artificial Sequence: Synthetic coding sequence
atgtggacagcccggggccccttcagaagagaccgctggagcagtgaagatgaggaggccgccggccccagccaggccctgagccccctgctgagtgacaccaggaagatcgtgtctgagggggagctggaccagctggcccagatccggcccctcatcttcaacttccacgagcagacagccatcaaggactgcctgaagatcctggaggagaagacagctgcctatgacatcatgcaggagttcatggccctggagctgaagaacctgcctggagagttcaacagcggcaaccagcccagcaaccgggagaagaaccgctacagagacatcctgcccttccagcaccacggctacagcggccccaatgaaagaaccaccttctggcacggcagcaatgaaggagctgtgtccctgctgctgcgctactgtgcctag

SEQ ID NO: 20461 - DNA, 1020 bp, Artificial Sequence; identical to SEQ ID NO: 19098
  Description of Artificial Sequence: Synthetic coding sequence

SEQ ID NO: 20462 - DNA, 1047 bp, Artificial Sequence
  Description of Artificial Sequence: Synthetic coding sequence
atgcagtttggagagctgctggccgctgtgaggaaggcccaggccaacgtgatgctgttcctggaggagaaggagcaggccgccctgagccaggccaacggcatcaaggcccacctggagtacagatctgctgagatggagaagagcaagcaggagctggagaccatggccgccatcagcaacacagtgcagttcctggaggagtactgcaagttcaagaacacagaggacatcaccttccccagcgtgtacatcggcctgaaggacaagctgagcggcatcaggaaggtgatcacagagagcacagtgcacctgatccagctgctggagaactacaagaagaagctgcaggagttcagcaaggaggaggagtatgacatccgcacccaggtgtctgccatcgtgcagaggaagtactggaccagcaagccagagcccagcacccgggagcagttcctgcagtatgtgcatgacatcacctttgatcctgacacagcccacaagtacctgcggctgcaggaggagaacaggaaggtgaccaacaccaccccctgggagcacccctacccagacctgcccagccgcttcctgcactggaggcaggtgctgagccagcagagcctgtacctgcaccgctactactttgaggtggagatctttggagctggcacctacgtgggcctgacctgcaagggcatcgaccagaagggggaggagaggagcagctgcatcagcggcaacaacttctcctggagcctgcagtggaatggcaaggagttcaccgcctggtacagcgacatggagacccccctgaaggccggccccttctggaggctgggcgtgtacatcgacttccctgggggcatcctgtccttctatggagtggagtatgacagcatgaccctggtgcacaagtttgcctgcaagttcagcgagcctgtgtatgctgccttctggctgagcaagaaggaaaatgccatcagaattgtggacctgggggaggagcctgagaagccagcccccagcctggtgggcacagccccctag

SEQ ID NO: 20463 - DNA, 1047 bp, Artificial Sequence; identical to SEQ ID NO: 20462
  Description of Artificial Sequence: Synthetic coding sequence

SEQ ID NO: 20464 - DNA, 687 bp, Artificial Sequence
  Description of Artificial Sequence: Synthetic coding sequence
atgattgatgacagcaccagggtgcccctgggcaagagcaaggactacatcaatgccagctacatccgcatcgtgaactgtggggaggagtacttctacatcgccacccagggccccctgctgagcaccattgatgacttctggcagatggtgctggagaacaacagcaatgtgattgccatgatcacccgggagattgagggcggcatcatcaagtgctaccactactggcccatcagcctgaagaagcccctggagctgaagcacttccgggtcttcctggagaactaccagatcctgcagtacttcatcatccgcatgttccaggtggtggagaagagcacaggcaccagccacagcgtgaagcagctgcagttcaccaagtggccagaccacggcaccccagccagcgctgacagcttcatcaagtacatccgctatgccaggaagagccacctgaccggccccatggtggtgcactgcagcgctggcattggaagaactggagtcttcctgtgtgtggatgtggtgttctgtgccatcgtgaagaactgcagcttcaacatcatggacatcgtggcccagatgagggagcagaggagcggcatggtgcagaccaaggagcagtaccacttctgctatgacatcgtgctggaggtgctgaggaagctgctgaccctggactag

SEQ ID NO: 20465 - DNA, 1449 bp, Artificial Sequence; identical to SEQ ID NO: 19534
  Description of Artificial Sequence: Synthetic coding sequence

SEQ ID NO: 20466 - DNA, 1020 bp, Artificial Sequence; identical to SEQ ID NO: 19098
  Description of Artificial Sequence: Synthetic coding sequence

SEQ ID NO: 20467 - DNA, 621 bp, Artificial Sequence; identical to SEQ ID NO: 20459
  Description of Artificial Sequence: Synthetic coding sequence

SEQ ID NO: 20468 - DNA, 438 bp, Artificial Sequence; identical to SEQ ID NO: 20460
  Description of Artificial Sequence: Synthetic coding sequence

SEQ ID NO: 20469 - DNA, 687 bp, Artificial Sequence; identical to SEQ ID NO: 20464
  Description of Artificial Sequence: Synthetic coding sequence

SEQ ID NO: 20470 - DNA, 2802 bp, Artificial Sequence
  Description of Artificial Sequence: Synthetic coding sequence
atgttctggaagtttgacctgaacaccaccagccacgtggacaagctgctggacaaggagcacgtgaccctgcaggagctgatggatgaagatgacatcctgcaggagtgcaaggcccagaaccagaagctgctggacttcctgtgccggcagcagtgcatggaggagctggtgtccctcatcacccaggacccccccctggacatggaggagaaggtgcgcttcaagtaccccaacacagcctgtgagctgctgacctgtgatgtgccccagatcagtgaccggctgggcggagatgagagcctgctgagcctgctgtatgacttcctggaccacgagccccccctgaaccccctgctggccagcttcttcagcaagaccatcggcaacctgattgccaggaagacagagcaggtgatcaccttcctgaagaagaaggacaagttcatcagcctggtgctgaagcacatcggcaccagcgccctgatggacctgctgctgcggctggtgtcctgtgtggagcccgccggcctgcggcaggatgtgctgcactggctgaatgaggagaaggtgatccagaggctggtggagctgatccaccccagccaggatgaagatcggcagagcaatgccagccagaccctgtgtgacatcgtgcggctgggccgggaccagggcagccagctgcaggaggccctggagccagaccccctgctgacagccctggagagccggcaggactgtgtggagcagctgctgaagaacatgtttgatggagacagaacagagagctgcctggtgtctggcacccaggtgctgctgaccctgctggagacccggcgggtgggcacagagggcctggtggacagcttcagccagggcctggagaggagctatgctgtgagcagctctgtgctgcatggaattgagccccggctgaaggacttccaccagctgctgctgaacccccccaagaagaaggccatcctgaccaccatcggcgtgctggaggagcccctgggcaatgcccggctgcacggggcccggctgatggccgccctgctgcacaccaacacccccagcatcaaccaggagctgtgccgcctgaacaccatggacctgctgctggacctcttcttcaagtacacctggaacaacttcctgcacttccaggtggagctgtgcatcgccgccatcctgagccatgctgcccgggaggagaggacagaggccagcggcagcgagagccgggtggagccccctcatgaaaatggaaacagaagcctggagaccccccagcctgctgccagcctgcctgacaacaccatggtgacccacctgttccagaagtgctgcctggtgcagaggatcctggaggcctgggaggccaatgaccacacccaggccgccggcggcatgaggcggggcaacatgggccacctgacccgcatcgccaatgctgtggtgcagaacctggagcggggccctgtgcagacccacatcagcgaggtgatccggggcctgcctgctgactgccggggccgctgggagagctttgtggaggagaccctgacagagaccaacagaagaaacacagtggacctggccttcagtgactaccagatccagcagatgacagccaactttgtggaccagtttggcttcaatgatgaggagtttgctgaccaggatgacaacatcaatgccccctttgacagaattgctgagatcaacttcaacattgatgctgatgaggacagccccagcgctgccctgtttgaggcctgctgcagcgaccgcatccagccctttgatgatgatgaagatgaggacatctgggaggacagcgacacccgctgtgccgcccgggtgatggcccggcccaggtttggagccccccacgccagcgagagctgcagcaagaatggacctgagcggggcggccaggacggcaaggccagcctggaggcccacagagatgcccctggggccggggcccccccagcccctgggaagaaggaggcccctcctgtggagggggacagcgagggcgccatgtggacagctgtgtttgatgagcccgccaacagcacccccacagcccctggggtggtgagagatgtgggcagctctgtgtgggccgccggcaccagcgcccctgaggagaagggctgggccaagttcacagacttccagcccttctgctgcagcgagagcggcccccgctgcagcagccctgtggacacagagtgcagccacgccgagggcagccgcagccagggccctgagaaggccttcagccctgccagcccctgtgcctggaatgtgtgtgtgaccaggaaggcccccctgctggccagtgacagcagcagcagcggcggcagccacagtgaagatggagaccagaaggccgccagcgccatggatgctgtgtcccggggccctggccgggaggccccacccctgcccaccgtggccaggacagaggaggccgtgggccgggtgggctgtgccgacagccggctgctgagccctgcctgcccagcccccaaggaggtgacagctgccccagctgtggccgtgcccccagaggccaccgtggccatcaccacagccctgagcaaggccggccctgccatccccaccccagctgtgtcctctgccctggccgtggccgtgcccctgggccccatcatggctgtgacagctgccccagccatggtggccaccctgggcaccgtgaccaaggatggcaagacagatgcccctcctgagggcgccgccctgaatggacctgtgtag

SEQ ID NO: 20471 - DNA, 2799 bp, Artificial Sequence
  Description of Artificial Sequence: Synthetic coding sequence
atgttctggaagtttgacctgaacaccaccagccacgtggacaagctgctggacaaggagcacgtgaccctgcaggagctgatggatgaagatgacatcctgcaggagtgcaaggcccagaaccagaagctgctggacttcctgtgccggcagcagtgcatggaggagctggtgtccctcatcacccaggacccccccctggacatggaggagaaggtgcgcttcaagtaccccaacacagcctgtgagctgctgacctgtgatgtgccccagatcagtgaccggctgggcggagatgagagcctgctgagcctgctgtatgacttcctggaccacgagccccccctgaaccccctgctggccagcttcttcagcaagaccatcggcaacctgattgccaggaagacagagcaggtgatcaccttcctgaagaagaaggacaagttcatcagcctggtgctgaagcacatcggcaccagcgccctgatggacctgctgctgcggctggtgtcctgtgtggagcccgccggcctgcggcaggatgtgctgcactggctgaatgaggagaaggtgatccagaggctggtggagctgatccaccccagccaggatgaagatcggcagagcaatgccagccagaccctgtgtgacatcgtgcggctgggccgggaccagggcagccagctgcaggaggccctggagccagaccccctgctgacagccctggagagccaggactgtgtggagcagctgctgaagaacatgtttgatggagacagaacagagagctgcctggtgtctggcacccaggtgctgctgaccctgctggagaccaggagagtgggcacagagggcctggtggacagcttcagccagggcctggagaggagctatgctgtgagcagctctgtgctgcacggcatcgagccccggctgaaggacttccaccagctgctgctgaacccccccaagaagaaggccatcctgaccaccatcggcgtgctggaggagcccctgggcaatgcccggctgcatggagcccggctgatggccgccctgctgcacaccaacacccccagcatcaaccaggagctgtgccgcctgaacaccatggacctgctgctggacctcttcttcaagtacacctggaacaacttcctgcacttccaggtggagctgtgcatcgccgccatcctgagccacgccgcccgggaggagaggacagaggccagcggcagcgagagccgggtggagccccctcatgaaaatggaaacagaagcctggagaccccccagcctgctgccagcctgcctgacaacaccatggtgacccacctgttccagaagtgctgcctggtgcagaggatcctggaggcctgggaggccaatgaccacacccaggccgccggcggcatgagaagaggcaacatgggccacctgaccagaattgccaatgctgtggtgcagaacctggagcggggccctgtgcagacccacatcagcgaggtgatccggggcctgcctgctgactgccggggccgctgggagagctttgtggaggagaccctgacagagaccaacagaagaaacacagtggacctggccttcagtgactaccagatccagcagatgacagccaactttgtggaccagtttggcttcaatgatgaggagtttgctgaccaggatgacaacatcaatgccccctttgacagaattgctgagatcaacttcaacattgatgctgatgaggacagccccagcgctgccctgtttgaggcctgctgcagcgaccgcatccagccctttgatgatgatgaagatgaggacatctgggaggacagcgacacccgctgtgccgcccgggtgatggcccggcccaggtttggagcccctcatgccagcgagagctgcagcaagaatggacctgagcggggcggccaggacggcaaggccagcctggaggcccacagagatgcccctggagctggggcccccccagcccctgggaagaaggaggcccctcctgtggagggggacagcgagggcgccatgtggacagctgtgtttgatgagcccgccaacagcacccccacagcccctggggtggtgagagatgtgggcagctctgtgtgggccgccggcaccagcgcccctgaggagaagggctgggccaagttcacagacttccagcccttctgctgcagcgagagcggcccccgctgcagcagccctgtggacacagaatgttctcatgctgagggcagccgcagccagggccctgagaaggccttctccccagccagcccctgtgcctggaatgtgtgtgtgaccaggaaggcccccctgctggccagtgacagcagcagcagcggcggcagccacagtgaagatggagaccagaaggccgccagcgccatggatgctgtgtcccggggccctggccgggaggccccacccctgcccaccgtggccaggacagaggaggccgtgggccgggtgggctgtgccgacagccggctgctgagccctgcctgcccagcccccaaggaggtgacagctgccccagctgtggccgtgcccccagaggccaccgtggccatcaccacagccctgagcaaggccggccctgccatccccaccccagctgtgagcagcgccctggccgtggccgtgcccctgggccccatcatggctgtgacagctgccccagccatggtggccaccctgggcaccgtgaccaaggatggcaagacagatgcccctcctgagggcgccgccctgaatggacctgtgtag

SEQ ID NO: 20472 - DNA, 789 bp, Artificial Sequence; identical to SEQ ID NO: 19488
  Description of Artificial Sequence: Synthetic coding sequence

SEQ ID NO: 20473 - DNA, 2718 bp, Artificial Sequence
  Description of Artificial Sequence: Synthetic coding sequence
atggaggtgcaggtgtcccaggccagcctgggctttgagctgacctctgtggagaagagcctgcgggagtggagccggctgagccgggaggtgattgcctggctgtgccccagcagccccaacttcatcctgaacttccccccacctccttctgccagctctgtgtccatggtgcagctgttcagcagccccttcggctaccagagccccagcggccacagcgaggaggagcgggagggcaacatgaagagcgccaagccccaggtgaaccacagccagcacggggagagccagagggccctgagccccctgcagagcaccctgagcagcgctgccagccccagccaggcctatgagacctacattgaaaatggcctcatctgcctgaagcacaagatccggaacatcgagaagaagaagctgaagctggaggactacaaggaccggctgaagagcggggagcacctgaacccagaccagctggaggccgtggagaagtatgaggaggtgctgcacaacctggagtttgccaaggagctgcagaagaccttcagcggcctgagcctggacctgctgaaggcccagaagaaggcccagaggcgggagcacatgctgaagctggaggccgagaagaagaagctgcggaccatcctgcaggtgcagtatgtgctgcagaacctgacccaggagcacgtgcagaaggacttcaagggcggcctgaatggagctgtgtacctgcccagcaaggagctggactacctgatcaagttcagcaagctgacctgcccagagagaaatgaaagcctgtctgtggaggaccagatggagcagagcagcctgtacttctgggacctgctggagggcagcgagaaggctgtggtgggcaccacctacaagcacctgaaggacctgctgagcaagctgctgaacagcggctactttgagagcatccctgtgcccaagaatgccaaggagaaggaggtgcccctggaggaggagatgctgatccagagcgagaagaagacccagctgagcaagacagaatctgtgaaggagagcgagagcctgatggagtttgcccagcctgagatccagccccaggagttcctgaacagacgctacatgacagaggtggactacagcaacaagcagggcgaggagcagccctgggaggccgactatgccaggaagcccaacctgcccaagcgctgggacatgctgacagagccagatggccaggagaagaagcaggagagcttcaagtcctgggaggccagcggcaagcaccaggaggtgtccaagccagctgtgtccctggagcagaggaagcaggacaccagcaagctgcggagcaccctgcctgaggagcagaagaagcaggagatcagcaagagcaagcccagccccagccagtggaagcaggacacccccaagagcaaggccggctacgtgcaggaggagcagaagaagcaggagacccccaagctgtggcctgtgcagctgcagaaggagcaggaccccaagaagcagacccccaagtcctggacccccagcatgcagagcgagcagaacaccaccaagtcctggaccacccccatgtgtgaggagcaggacagcaagcagcctgagacccccaagtcctgggagaacaacgtggagagccagaagcacagcctgaccagccagagccagatcagccccaagtcctggggcgtggccacagccagcctcatccccaatgaccagctgctgcccaggaagctgaacacagagcccaaggatgtgcccaagcctgtgcaccagcctgtgggcagcagcagcaccctgcccaaggaccctgtgctgaggaaggagaagctgcaggacctgatgacccagatccagggcacctgcaacttcatgcaggagagcgtgctggactttgacaagcccagcagcgccatccccaccagccagcccccatctgccaccccaggcagccctgtggccagcaaggagcagaacctgagcagccagagcgacttcctgcaggagcccctgcaggccgccatccccccaggcaagcagcccagcagcctggccagccccaacccccccatggccaagggcagcgagcagggcttccagagccccccagccagcagcagctctgtgaccatcaacacagcccccttccaggccatgcagaccgtcttcaacgtgaatgcccccctgccccccaggaaggagcaggagatcaaggagagcccctacagccctggctacaaccagagcttcaccacagccagcacccagaccccaccccagtgccagctgcccagcatccacgtggagcagacagtgcacagccaggagacagcccagaccaacgtgttcccccggcccacccagccctttgtgaacagccggggctctgtgcggggctgcacccggggcggccgcctcatcaccaacagctaccgcagccctgggggctacaagggctttgacacctaccggggcctgcccagcatcagcaatggaaactacagccagctgcagttccaggcccgggagtacagcggggccccctacagccagagggacaacttccagcagtgctacaagagaggaggcaccagcggcggcccccgggccaacagccgggccaactgcttcatcatgaggaacagcctgctgctgatcaagcagcagggcggcgtcatcctgctgaggtag

SEQ ID NO: 20474 - DNA, 1107 bp, Artificial Sequence; identical to SEQ ID NO: 19823
  Description of Artificial Sequence: Synthetic coding sequence

SEQ ID NO: 20475 - DNA, 1107 bp, Artificial Sequence; identical to SEQ ID NO: 19823
  Description of Artificial Sequence: Synthetic coding sequence

SEQ ID NO: 20476 - DNA, 2745 bp, Artificial Sequence
  Description of Artificial Sequence: Synthetic coding sequence
atgagcagcagcggctacccacccaaccagggcgccttcagcacagagcagagccgctacccaccccacagcgtgcagtacaccttccccaacaccaggcaccagcaggaccctgccttcggcggcaagcatgaggcccccagcagccccatcagcggccagccctgtggagatgaccagaatgccagccccagcaagctgagcaaggaggagctgatccagagcatggacagagtggaccgggagatcgccaaggtggagcagcagatcctgaagctgaagaagaagcagcagcagctggaggaggaggccgccaagcccccagagcctgagaagcctgtgagccccccacctgtggagcagaagcacaggagcatcgtgcagatcatctatgatgaaaataggaagaaggccgaggaggcccacaagatctttgagggcctgggccccaaggtggagctgcccctgtacaaccagcccagcgacaccaaggtgtaccacgagaacatcaagaccaaccaggtgatgaggaagaagctgatcctcttcttcaagagaagaaatcatgccaggaagcagcgggagcagaagatctgccagagatatgaccagctgatggaggcctgggagaagaaggtggacagaattgagaacaaccccaggaggaaggccaaggagagcaagacccgggagtactatgagaagcagtttcctgagatcaggaagcagcgggagcagcaggagcgcttccagagggtgggccagagaggagctggcctgagcgccaccatcgcccggagtgaacatgagatcagcgagatcattgatggcctgtctgagcaggagaacaatgagaagcagatgaggcagctgagcgtcatcccccccatgatgtttgatgctgagcagaggagagtgaagttcatcaacatgaatggcctgatggaggaccccatgaaggtgtacaaggaccggcagttcatgaatgtgtggacagaccacgagaaggagatcttcaaggacaagttcatccagcaccccaagaactttggcctgattgccagctacctggagaggaagtctgtgcctgactgtgtgctgtactactacctgaccaagaagaatgaaaactacaaggccctggtgagaagaaactacggcaagagaagaggaagaaaccagcagatcgcccggcccagccaggaggagaaggtggaggagaaggaggaggacaaggccgagaagacagagaagaaggaggaggagaagaaggatgaggaggagaaggatgagaaggaggacagcaaagaaaacaccaaggagaaggacaagattgatggaacagctgaggagacagaggagcgggagcaggccaccccccggggcaggaagacagccaacagccagggccgcaggaagggccgcatcaccaggtccatgaccaatgaggccgccgccgccagcgctgctgctgctgctgccacagaggagcccccaccacccctgcccccacctcctgagcccatcagcacagagcctgtggagaccagccgctggacagaggaggagatggaggtggccaagaagggcctggtggagcacggcaggaactgggccgccatcgccaagatggtgggcaccaagtctgaggcccagtgcaagaacttctacttcaactacaagaggaggcacaacctggacaacctgctgcagcagcacaagcagaagaccagcaggaagccccgggaggagagagatgtgtcccagtgtgagagcgtggccagcacagtgtctgcccaggaggatgaagatattgaggccagcaatgaggaggagaacccagaagattctgagggcgctgagaacagcagtgacacagagagcgcccccagccccagccctgtggaggccgtgaagcccagcgaggacagcccagaaaatgccaccagccggggcaacacagagcctgctgtggagctggagcccaccacagaaacagcccccagcaccagccccagcctggccgtgcccagcaccaagccagcagaagatgagagcgtggagacccaggtgaatgacagcatctctgctgagacagctgagcagatggatgtggaccagcaggagcacagcgctgaggagggctctgtgtgtgaccccccaccagccaccaaggctgacagcgtggatgtggaggtgcgggtgcctgaaaatcatgccagcaaggtggagggggacaacaccaaggagcgggacctggaccgggccagcgagaaggtggagcccagagatgaggacctggtggtggcccagcagatcaatgcccagaggcctgagccccagagcgacaatgacagcagcgccacctgcagcgcagatgaagatgtggatggagagcctgagcggcagaggatgttccccatggacagcaagcccagcctgctgaaccccaccggcagcatcctggtgagcagccccctgaagcccaaccccctggacctgccccagctgcagcacagagctgctgtgattcctcccatggtgtcctgcaccccctgcaacatccccatcggcacccctgtgtctggctacgccctgtaccagaggcacatcaaggccatgcatgaaagtgccctgctggaggagcagaggcagaggcaggagcagattgacctggagtgccgcagcagcaccagcccctgtggcaccagcaagagccccaaccgggagtgggagggccgctag

SEQ ID NO: 20477 - DNA, 7032 bp, Artificial Sequence
  Description of Artificial Sequence: Synthetic coding sequence
atgagcagcagcggctacccacccaaccagggcgccttcagcacagagcagagccgctacccaccccacagcgtgcagtacaccttccccaacaccaggcaccagcaggaccctgccttcggcggcaagcatgaggcccccagcagccccatcagcggccagccctgtggagatgaccagaatgccagccccagcaagctgagcaaggaggagctgatccagagcatggacagagtggaccgggagatcgccaaggtggagcagcagatcctgaagctgaagaagaagcagcagcagctggaggaggaggccgccaagcccccagagcctgagaagcctgtgagccccccacctgtggagcagaagcacaggagcatcgtgcagatcatctatgatgaaaataggaagaaggccgaggaggcccacaagatctttgagggcctgggccccaaggtggagctgcccctgtacaaccagcccagcgacaccaaggtgtaccacgagaacatcaagaccaaccaggtgatgaggaagaagctgatcctcttcttcaagagaagaaatcatgccaggaagcagcgggagcagaagatctgccagagatatgaccagctgatggaggcctgggagaagaaggtggacagaattgagaacaaccccaggaggaaggccaaggagagcaagacccgggagtactatgagaagcagtttcctgagatcaggaagcagcgggagcagcaggagcgcttccagagggtgggccagagaggagctggcctgagcgccaccatcgcccggagtgaacatgagatcagcgagatcattgatggcctgtctgagcaggagaacaatgagaagcagatgaggcagctgagcgtcatcccccccatgatgtttgatgctgagcagaggagagtgaagttcatcaacatgaatggcctgatggaggaccccatgaaggtgtacaaggaccggcagttcatgaatgtgtggacagaccacgagaaggagatcttcaaggacaagttcatccagcaccccaagaactttggcctgattgccagctacctggagaggaagtctgtgcctgactgtgtgctgtactactacctgaccaagaagaatgaaaactacaaggccctggtgagaagaaactacggcaagagaagaggaagaaaccagcagatcgcccggcccagccaggaggagaaggtggaggagaaggaggaggacaaggccgagaagacagagaagaaggaggaggagaagaaggatgaggaggagaaggatgagaaggaggacagcaaagaaaacaccaaggagaaggacaagattgatggaacagctgaggagacagaggagcgggagcaggccaccccccggggcaggaagacagccaacagccagggccgcaggaagggccgcatcaccaggtccatgaccaatgaggccgccgccgccagcgctgctgctgctgctgccacagaggagcccccaccacccctgcccccacctcctgagcccatcagcacagagcctgtggagaccagccgctggacagaggaggagatggaggtggccaagaagggcctggtggagcacggcaggaactgggccgccatcgccaagatggtgggcaccaagtctgaggcccagtgcaagaacttctacttcaactacaagaggaggcacaacctggacaacctgctgcagcagcacaagcagaagaccagcaggaagccccgggaggagagagatgtgtcccagtgtgagagcgtggccagcacagtgtctgcccaggaggatgaagatattgaggccagcaatgaggaggagaacccagaagattctgagggcgctgagaacagcagtgacacagagagcgcccccagccccagccctgtggaggccgtgaagcccagcgaggacagcccagaaaatgccaccagccggggcaacacagagcctgctgtggagctggagcccaccacagaaacagcccccagcaccagccccagcctggccgtgcccagcaccaagccagcagaagatgagagcgtggagacccaggtgaatgacagcatctctgctgagacagctgagcagatggatgtggaccagcaggagcacagcgctgaggagggctctgtgtgtgaccccccaccagccaccaaggctgacagcgtggatgtggaggtgcgggtgcctgaaaatcatgccagcaaggtggagggggacaacaccaaggagcgggacctggaccgggccagcgagaaggtggagcccagagatgaggacctggtggtggcccagcagatcaatgcccagaggcctgagccccagagcgacaatgacagcagcgccacctgcagcgcagatgaagatgtggatggagagcctgagcggcagaggatgttccccatggacagcaagcccagcctgctgaaccccaccggcagcatcctggtgagcagccccctgaagcccaaccccctggacctgccccagctgcagcacagagctgctgtgattcctcccatggtgtcctgcaccccctgcaacatccccatcggcacccctgtgtctggctacgccctgtaccagaggcacatcaaggccatgcatgaaagtgccctgctggaggagcagaggcagaggcaggagcagattgacctggagtgccgcagcagcaccagcccctgtggcaccagcaagagccccaaccgggagtgggaggtgctgcagcctgccccccaccaggtgatcaccaacctgcctgagggcgtgcggctgcccaccacccggcccaccaggcctcctcctcctctcatccccagcagcaagaccaccgtggccagcgagaagcccagcttcatcatgggcggcagcatcagccagggcaccccaggcacctacctgaccagccacaaccaggccagctacacccaggagacccccaagcccagcgtgggcagcatcagcctgggcctgccccggcagcaggagagcgccaagagcgccaccctgccctacatcaagcaggaggagttcagccccaggagccagaacagccagcctgagggcctgctggtgcgggcccagcatgaaggagtggtgcggggcacagctggggccatccaggagggcagcatcacccggggcacccccaccagcaagatctctgtggagagcatccccagcctgcggggcagcatcacccagggcaccccagccctgccccagacaggcatccccacagaggccctggtgaagggcagcatcagcaggatgcccatcgaggacagcagccctgagaagggccgggaggaggccgccagcaagggccacgtgatctatgagggcaagagcggccacatcctgtcctatgacaacatcaagaatgcccgggagggcaccaggagccccaggacagcccacgagatcagcctgaagaggagctatgagagcgtggagggcaacatcaagcagggcatgtccatgagggagagccctgtgtctgcccccctggagggcctcatctgccgggccctgccccggggcagcccccacagcgacctgaaggagaggacagtgctgagcggcagcatcatgcagggcaccccccgggccaccacagagagctttgaagatggcctgaagtaccccaagcagatcaagcgggagagcccccccatccgggcctttgaaggagccatcaccaagggcaagccctatgatggcatcaccaccatcaaggagatgggccgcagcatccacgagatcccccggcaggacatcctgacccaggagagcaggaagaccccagaggtggtgcagagcacccggcccatcatcgagggcagcatcagccagggcacccccatcaagtttgacaacaacagcggccagagcgccatcaagcacaacgtgaagagcctcatcaccggccccagcaagctgagccggggcatgccacccctggagatcgtgcctgagaacatcaaggtggtggagcggggcaagtatgaagatgtgaaggccggggagaccgtgcgcagccgccacacctctgtggtgagcagcggccccagcgtgctgcggagcaccctgcacgaggcccccaaggcccagctgagccctggcatctatgatgacaccagcgcccggaggacccctgtgtcctaccagaacaccatgagccggggcagccccatgatgaacagaacatctgatgtgagcagcaacaagagcaccaaccacgagaggaagagcaccctgacccccacccagcgggagagcatcccagccaagagccctgtgcctggggtggaccctgtggtgagccacagcccctttgacccccaccaccggggcagcacagctggggaggtgtaccgcagccacctgcccacccacctggaccctgccatgcccttccaccgggccctggaccctgctgctgcctacctgttccagaggcagctgagccccaccccaggctaccccagccagtaccagctgtatgccatggagaacacccggcagaccatcctgaatgactacatcaccagccagcagatgcaggtgaacctgcggccagatgtggcccggggcctgagcccccgggagcagcccctgggcctgccctacccagccacccggggcatcatcgacctgaccaacatgccacccaccatcctggtgccccaccctgggggcaccagcaccccacccatggaccgcatcacctacatccctggcacccagatcaccttccccccccggccctacaacagcgcctccatgagccctggccaccccacccacctggccgctgctgccagcgctgagcgggagcgggagcgggagcgggagaaggagcgggagcgggagagaattgctgctgccagcagtgacctgtacctgcggcccggcagcgagcagcccggccggcccggcagccacggctacgtgcgcagccccagccccagcgtgaggacccaggagaccatgctgcagcagaggccttctgtgttccagggcaccaacggcaccagcgtcatcacccccctggaccccacagcccagctgcgcatcatgcccctgcctgctgggggccccagcatcagccagggcctgcctgccagccgctacaacacagctgctgatgccctggccgccctggtggatgctgctgccagcgccccccagatggatgtgtccaagaccaaggagagcaagcatgaggccgcccggctggaggagaacctgcggagccgctctgctgctgtgtctgagcagcagcagctggagcagaagaccctggaggtggagaagaggtctgtgcagtgcctgtacaccagcagcgccttccccagcggcaagccccagccccacagctctgtggtgtacagcgaggccggcaaggacaagggccccccacccaagagccgctatgaggaggagctgcggacccggggcaagaccaccatcacagctgccaacttcattgatgtgatcatcacccggcagatcgccagtgacaaggatgcccgggagcggggcagccagagcagtgacagcagcagcagcctgagcagccacagatatgagacccccagtgatgccattgaagtcatcagccctgccagcagccctgccccaccccaggagaagctgcagacctaccagcctgaggtggtgaaggccaaccaggctgaaaatgaccccacccggcagtatgagggccccctgcaccactaccggccccagcaggagagccccagcccccagcagcagctgccccccagcagccaggccgagggcatgggccaggtgcccaggacccacaggctcatcaccctggccgaccacatctgccagatcatcacccaggactttgccaggaaccaggtgagcagccagaccccccagcagccccccaccagcaccttccagaacagccccagcgccctggtgtccacccctgtgaggaccaagaccagcaaccgctacagccctgagagccaggcccagagcgtgcaccaccagaggcctggcagccgggtgtccccagagaacctggtggacaagagccggggcagcaggcctgggaagagccctgagaggagccacgtgagcagcgagccctatgagcccatcagccccccccaggtgcctgtggtgcatgagaagcaggacagcctgctgctgctgagccagagaggagctgagcctgctgagcagagaaatgatgcccggagccctggcagcatctcctacctgcccagcttcttcaccaagctggagaacaccagccccatggtgaagagcaagaagcaggagatcttcaggaagctgaacagcagcggcggcggggacagcgacatggccgccgcccagcctggaacagagatcttcaacctgcctgctgtgaccaccagcggctctgtgagcagccggggccacagctttgctgaccctgccagcaacctgggcctggaggacatcatcaggaaggccctgatgggcagctttgatgacaaggtggaggaccacggcgtggtgatgagccagcccatgggcgtggtgcccggcacagccaacacctctgtggtgaccagcggggagacccggcgggaggagggggaccccagcccccacagcggcgtgtgcaagcccaagctgatcagcaagagcaacagcaggaagagcaagagccccatccctggccagggctacctgggcacagagcggcccagctctgtgtcctctgtgcacagcgagggggactaccaccggcagaccccaggctgggcctgggaggaccggcccagcagcacaggcagcacccagttcccctacaaccccctgaccatgaggatgctgagcagcaccccacccacccccatcgcctgtgcccccagcgctgtgaaccaggccgccccccaccagcagaaccgcatctgggagcgggagcccgcccccctgctgagcgcccagtatgagaccctgagtgacagtgatgactag

SEQ ID NO: 20478 - DNA, 7014 bp, Artificial Sequence
  Description of Artificial Sequence: Synthetic coding sequence
atgagcagcagcggctacccacccaaccagggcgccttcagcacagagcagagccgctacccaccccacagcgtgcagtacaccttccccaacaccaggcaccagcaggagtttgctgtgcctgactaccgcagcagccacctggaggtgtcccaggccagccagctgctgcagcagcagcagcagcagcagctgcggcggcggcccagcctgctgtctgagttccaccctggcagtgaccggccccaggagaggaggaccagctatgagcccttccaccctggccccagccctgtggaccatgacagcctggagagcaagaggccccggctggagcaggtgtctgacagccacttccagagggtgtctgctgctgtgctgcccctggtgcaccccctgcctgagggcctgcgggccagcgcagatgccaagaaggaccctgcctttggaggcaagcatgaggcccccagcagccccatcagcggccagccctgtggagatgaccagaatgccagccccagcaagctgagcaaggaggagctgatccagagcatggacagagtggaccgggagatcgccaaggtggagcagcagatcctgaagctgaagaagaagcagcagcagctggaggaggaggccgccaagcccccagagcctgagaagcctgtgtccccacctcctgtggagcagaagcacaggagcatcgtgcagatcatctatgatgagaacaggaagaaggccgaggaggcccacaagatctttgagggcctgggccccaaggtggagctgcccctgtacaaccagcccagcgacaccaaggtgtaccacgagaacatcaagaccaaccaggtgatgaggaagaagctgatcctcttcttcaagagaagaaaccacgccaggaagcagcgggagcagaagatctgccagagatatgaccagctgatggaggcctgggagaagaaggtggacagaattgagaacaaccccaggaggaaggccaaggagagcaagacccgggagtactatgagaagcagtttcctgagatcaggaagcagcgggagcagcaggagcgcttccagagggtgggccagagaggagctggcctgagcgccaccatcgcccggtctgagcacgagatcagcgagatcattgatggcctgtctgagcaggagaacaatgagaagcagatgaggcagctgagcgtcatcccccccatgatgtttgatgctgagcagaggagagtgaagttcatcaacatgaatggcctgatggaggaccccatgaaggtgtacaaggaccggcagttcatgaatgtgtggacagaccacgagaaggagatcttcaaggacaagttcatccagcaccccaagaactttggcctcatcgccagctacctggagaggaagtctgtgcctgactgtgtgctgtactactacctgaccaagaagaatgaaaactacaaggccctggtgagaagaaattatggcaagaggcggggcaggaaccagcagatcgcccggcccagccaggaggagaaggtggaggagaaggaggaggacaaggccgagaagacagagaagaaggaggaggagaagaaggatgaggaggagaaggatgagaaggaggacagcaaggagaacaccaaggagaaggacaagattgatggaacagctgaggagacagaggagcgggagcaggccaccccccggggcaggaagacagccaacagccagggccgcaggaagggccgcatcaccaggtccatgaccaatgaagctgctgctgccagcgctgctgctgctgctgccacagaggagcccccaccacccctgcccccacctcctgagcccatcagcacagagcctgtggagaccagccgctggacagaggaggagatggaggtggccaagaagggcctggtggagcacggcaggaactgggccgccatcgccaagatggtgggcaccaagtctgaggcccagtgcaagaacttctacttcaactacaagagaagacacaacctggacaacctgctgcagcagcacaagcagaagaccagcaggaagccccgggaggagagagatgtgtcccagtgtgagagcgtggccagcacagtgtctgcccaggaggatgaggacatcgaggccagcaatgaggaggagaaccctgaggacagcgagggcgctgagaacagcagtgacacagaaagtgcccccagccccagccctgtggaggccgtgaagcccagcgaggacagcccagaaaatgccaccagccggggcaacacagagcctgctgtggagctggagcccaccacagaaacagcccccagcaccagccccagcctggccgtgcccagcaccaagccagcagaagatgaatctgtggagacccaggtgaatgacagcatctctgctgagacagctgagcagatggatgtggaccagcaggagcacagcgctgaggagggctctgtgtgtgaccccccaccagccaccaaggctgacagcgtggatgtggaggtgcgggtgcctgagaaccacgccagcaaggtggagggggacaacaccaaggagcgggacctggaccgggccagcgagaaggtggagcccagagatgaggacctggtggtggcccagcagatcaatgcccagaggcctgagccccagagcgacaatgacagcagcgccacctgcagcgcagatgaagatgtggatggagagcctgagcggcagaggatgttccccatggacagcaagcccagcctgctgaaccccaccggcagcatcctggtgagcagccccctgaagcccaaccccctggacctgccccagctgcagcacagagctgctgtgatcccccccatggtgtcctgcaccccctgcaacatccccatcggcacccctgtgtctggctacgccctgtaccagaggcacatcaaggccatgcatgagagcgccctgctggaggagcagaggcagaggcaggagcagattgacctggagtgccgcagcagcaccagcccctgtggcaccagcaagagccccaaccgggagtgggaggtgctgcagcctgccccccaccaggtgatcaccaacctgcctgagggcgtgcggctgcccaccacccggcccacccggcccccaccacccctcatccccagcagcaagaccaccgtggccagcgagaagcccagcttcatcatgggcggcagcatcagccagggcaccccaggcacctacctgaccagccacaaccaggccagctacacccaggagacccccaagcccagcgtgggcagcatcagcctgggcctgccccggcagcaggagagcgccaagagcgccaccctgccctacatcaagcaggaggagttcagccccaggagccagaacagccagcctgagggcctgctggtgcgggcccagcacgagggcgtggtgcggggcacagctggggccatccaggagggcagcatcacccggggcacccccaccagcaagatctctgtggagagcatccccagcctgcggggcagcatcacccagggcaccccagccctgccccagacaggcatccccacagaggccctggtgaagggcagcatcagcaggatgcccatcgaggacagcagccctgagaagggccgggaggaggccgccagcaaaggacatgtgatctatgagggcaagagcggccacatcctgtcctatgacaacatcaagaatgcccgggagggcaccaggagccccaggacagcccacgagatcagcctgaagaggagctatgaatctgtggagggcaacatcaagcagggcatgtccatgagggagagccctgtgtctgcccccctggagggcctcatctgccgggccctgccccggggcagcccccacagcgacctgaaggagaggacagtgctgagcggcagcatcatgcagggcaccccccgggccaccacagagagctttgaagatggcctgaagtaccccaagcagatcaagcgggagagcccccccatccgggcctttgagggcgccatcaccaagggcaagccctatgatggcatcaccaccatcaaggagatgggccgcagcatccacgagatcccccggcaggacatcctgacccaggagagcaggaagaccccagaggtggtgcagagcacccggcccatcatcgagggcagcatcagccagggcacccccatcaagtttgacaacaacagcggccagagcgccatcaagcacaacgtgaagagcctcatcaccggccccagcaagctgagccggggcatgccacccctggagatcgtgcctgagaacatcaaggtggtggagcggggcaagtatgaagatgtgaaggccggggagaccgtgcgcagccgccacacctctgtggtgagcagcggccccagcgtgctgcggagcaccctgcacgaggcccccaaggcccagctgagccctggcatctatgatgacaccagcgcccggaggacccctgtgtcctaccagaacaccatgagccggggcagccccatgatgaacagaacatctgatgtgaccatcagcagcaacaagagcaccaaccacgagaggaagagcaccctgacccccacccagcgggagagcatcccagccaagagccctgtgcctggggtggaccctgtggtgagccacagcccctttgacccccaccaccggggcagcacagctggggaggtgtaccgcagccacctgcccacccacctggaccctgccatgcccttccaccgggccctggaccctgctgctgctgcctacctgttccagaggcagctgagccccaccccaggctaccccagccagtaccagctgtatgccatggagaacacccggcagaccatcctgaatgactacatcaccagccagcagatgcaggtgaacctgcggccagatgtggcccggggcctgagcccccgggagcagcccctgggcctgccctacccagccacccggggcatcatcgacctgaccaacatgccacccaccatcctggtgccccaccctgggggcaccagcaccccacccatggaccgcatcacctacatccctggcacccagatcaccttccccccccggccctacaacagcgcctccatgagccctggccaccccacccacctggccgctgctgccagcgctgagcgggagcgggagcgggagcgggagaaggagcgggagcgggagagaattgctgctgccagcagtgacctgtacctgcggcccggcagcgagcagcccggccggcccggcagccacggctacgtgcgcagccccagccccagcgtgaggacccaggagaccatgctgcagcagaggccttctgtgttccagggcaccaacggcaccagcgtcatcacccccctggaccccacagcccagctgcgcatcatgcccctgcctgctgggggccccagcatcagccagggcctgcctgccagccgctacaacacagctgctgatgccctggccgccctggtggatgctgctgccagcgccccccagatggatgtgtccaagaccaaggagatcagcagccacagatatgagacccccagtgatgccatcgaggtgatcagccctgccagcagccctgccccaccccaggagaagctgcagacctaccagcctgaggtggtgaaggccaaccaggccgagaatgaccccacccggcagtatgagggccccctgcaccactaccggccccagcaggagagccccagcccccagcagcagctgccccccagcagccaggccgagggcatgggccaggtgcccaggacccacaggctcatcaccctggccgaccacatctgccagatcatcacccaggactttgccaggaaccaggtgagcagccagaccccccagcagccccccaccagcaccttccagaacagccccagcgccctggtgtccacccctgtgaggaccaagaccagcaaccgctacagccctgagagccaggcccagagcgtgcaccaccagaggcctggcagccgggtgtccccagagaacctggtggacaagagccggggcagcaggcctgggaagagccctgagaggagccacgtgtcctctgagccctatgagcccatcagccccccccaggtgcctgtggtgcatgagaagcaggacagcctgctgctgctgagccagagaggagctgagcctgctgagcagagaaatgatgcccggagccctggcagcatctcctacctgcccagcttcttcaccaagctggagaacaccagccccatggtgaagagcaagaagcaggagatcttcaggaagctgaacagcagcggcggcggggacagcgacatggctgctgcccagcccggcacagagatcttcaacctgcctgctgtgaccaccagcggctctgtgagcagccggggccacagctttgctgaccctgccagcaacctgggcctggaggacatcatcaggaaggccctgatgggcagctttgatgacaaggtggaggaccatggagtggtgatgagccagcccatgggcgtggtgcctggaacagccaacacctctgtggtgaccagcggggagacccggcgggaggagggggaccccagcccccacagcggaggagtgtgcaagcccaagctgatcagcaagagcaacagcaggaagagcaagagccccatccctggccagggctacctgggcacagagcggcccagctctgtgtcctctgtgcacagcgagggggactaccaccggcagaccccaggctgggcctgggaggaccggcccagcagcacaggcagcacccagttcccctacaaccccctgaccatgaggatgctgagcagcaccccacccacccccatcgcctgtgcccccagcgctgtgaaccaggccgccccccaccagcagaaccgcatctgggagcgggagcccgcccccctgctgagcgcccagtatgagaccctgagtgacagtgatgactag

SEQ ID NO: 20479 - DNA, 3075 bp, Artificial Sequence
  Description of Artificial Sequence: Synthetic coding sequence
atgccacccctggagatcgtgcctgagaacatcaaggtggtggagcggggcaagtatgaagatgtgaaggccggggagaccgtgcgcagccgccacacctctgtggtgagcagcggccccagcgtgctgcggagcaccctgcacgaggcccccaaggcccagctgagccctggcatctatgatgacaccagcgcccggaggacccctgtgtcctaccagaacaccatgagccggggcagccccatgatgaacagaacatctgatgtgaccatcagcagcaacaagagcaccaaccacgagaggaagagcaccctgacccccacccagcgggagagcatcccagccaagagccctgtgcctggggtggaccctgtggtgagccacagcccctttgacccccaccaccggggcagcacagctggggaggtgtaccgcagccacctgcccacccacctggaccctgccatgcccttccaccgggccctggaccctgctgctgctgcctacctgttccagaggcagctgagccccaccccaggctaccccagccagtaccagctgtatgccatggagaacacccggcagaccatcctgaatgactacatcaccagccagcagatgcaggtgaacctgcggccagatgtggcccggggcctgagcccccgggagcagcccctgggcctgccctacccagccacccggggcatcatcgacctgaccaacatgccacccaccatcctggtgccccaccctgggggcaccagcaccccacccatggaccgcatcacctacatccctggcacccagatcaccttccccccccggccctacaacagcgcctccatgagccctggccaccccacccacctggccgctgctgccagcgctgagcgggagcgggagcgggagcgggagaaggagcgggagcgggagagaattgctgctgccagcagtgacctgtacctgcggcccggcagcgagcagcccggccggcccggcagccacggctacgtgcgcagccccagccccagcgtgaggacccaggagaccatgctgcagcagaggccttctgtgttccagggcaccaacggcaccagcgtcatcacccccctggaccccacagcccagctgcgcatcatgcccctgcctgctgggggccccagcatcagccagggcctgcctgccagccgctacaacacagctgctgatgccctggccgccctggtggatgctgctgccagcgccccccagatggatgtgtccaagaccaaggagagcaagcatgaggccgcccggctggaggagaacctgcggagccgctctgctgctgtgtctgagcagcagcagctggagcagaagaccctggaggtggagaagaggtctgtgcagtgcctgtacaccagcagcgccttccccagcggcaagccccagccccacagctctgtggtgtacagcgaggccggcaaggacaagggccccccacccaagagccgctatgaggaggagctgcggacccggggcaagaccaccatcacagctgccaacttcattgatgtgatcatcacccggcagatcgccagtgacaaggatgcccgggagcggggcagccagagcagtgacagcagcagcagcctgagcagccacagatatgagacccccagtgatgccattgaagtcatcagccctgccagcagccctgccccaccccaggagaagctgcagacctaccagcctgaggtggtgaaggccaaccaggctgaaaatgaccccacccggcagtatgagggccccctgcaccactaccggccccagcaggagagccccagcccccagcagcagctgccccccagcagccaggccgagggcatgggccaggtgcccaggacccacaggctcatcaccctggccgaccacatctgccagatcatcacccaggactttgccaggaaccaggtgagcagccagaccccccagcagccccccaccagcaccttccagaacagccccagcgccctggtgtccacccctgtgaggaccaagaccagcaaccgctacagccctgagagccaggcccagagcgtgcaccaccagaggcctggcagccgggtgtccccagagaacctggtggacaagagccggggcagcaggcctgggaagagccctgagaggagccacgtgagcagcgagccctatgagcccatcagccccccccaggtgcctgtggtgcatgagaagcaggacagcctgctgctgctgagccagagaggagctgagcctgctgagcagagaaatgatgcccggagccctggcagcatctcctacctgcccagcttcttcaccaagctggagaacaccagccccatggtgaagagcaagaagcaggagatcttcaggaagctgaacagcagcggcggcggggacagcgacatggccgccgcccagcctggaacagagatcttcaacctgcctgctgtgaccaccagcggctctgtgagcagccggggccacagctttgctgaccctgccagcaacctgggcctggaggacatcatcaggaaggccctgatgggcagctttgatgacaaggtggaggaccacggcgtggtgatgagccagcccatgggcgtggtgcccggcacagccaacacctctgtggtgaccagcggggagacccggcgggaggagggggaccccagcccccacagcggcggcgtgtgcaagcccaagctgatcagcaagagcaacagcaggaagagcaagagccccatccctggccagggctacctgggcacagagcggcccagctctgtgtcctctgtgcacagcgagggggactaccaccggcagaccccaggctgggcctgggaggaccggcccagcagcacaggcagcacccagttcccctacaaccccctgaccatgaggatgctgagcagcaccccacccacccccatcgcctgtgcccccagcgctgtgaaccaggccgccccccaccagcagaaccgcatctgggagcgggagcccgcccccctgctgagcgcccagtatgagaccctgagtgacagtgatgactag

SEQ ID NO: 20480 - DNA, 4821 bp, Artificial Sequence
  Description of Artificial Sequence: Synthetic coding sequence
atgctgctgcacctgtgcagcgtgaagaacctgtaccagaaccgcttcctgggcctggccgccatggccagccccagcaggaacagccagagcagaagacgctgcaaggagcccctgcgctacagctacaacccagaccagttccacaacatggacctgcggggcggcccccatgatggagtgaccatccccaggagcaccagtgacacagacctggtgaccagtgacagccgcagcaccctgatggtgagcagcagctactacagcatcggccacagccaggacctggtgatccactgggacatcaaggaggaggtggatgctggggactggattggcatgtacctgattgatgaggtgctgtctgagaacttcctggactacaagaacagaggagtgaatggcagccaccggggccagatcatctggaagattgatgccagcagctactttgtggagcctgagaccaagatctgcttcaagtactaccacggcgtgtctggggccctgcgggccaccacccccagcgtgacagtgaagaacagcgctgcccccatcttcaagagcatcggggctgatgaaacagtgcagggccagggcagccggcggctcatctccttcagcctgagtgacttccaggccatgggcctgaagaagggcatgttcttcaacccagacccctacctgaagatcagcatccagcccgggaagcacagcatcttccctgccctgccccaccacggccaggagaggaggagcaagatcatcggcaacacagtgaaccccatctggcaggccgagcagttctcctttgtgtccctgcccacagatgtgctggagattgaggtgaaggacaagtttgccaagagccggcccatcatcaagcgcttcctgggcaagctgtccatgcctgtgcagaggctgctggagagacatgccatcggggacagagtggtgtcctacaccctgggccgccgcctgcccacagaccacgtgtctggccagctgcagttccgctttgagatcaccagcagcatccacccagatgatgaggagatcagcctgagcacagagcctgagagcgcccagatccaggacagccccatgaacaacctgatggagagcggcagcggggagcccaggtctgaggcccctgagagcagcgagagctggaagccagagcagctgggggagggctctgtgcctgatggccctggcaaccagagcattgagctgagcaggcctgctgaggaggccgccgtcatcacagaagctggggaccagggcatggtgtctgtgggccctgagggcgctggggagctgctggcccaggtgcagaaggacatccagcctgcccccagcgctgaggagctggccgagcagctggacctgggggaggaggccagcgccctgctgctggaggatggagaggccccagccagcaccaaggaggagcccctggaggaggaggccaccacccagagcagagctggccgggaggaggaggagaaggagcaggaggaggagggagatgtgtccaccctggagcagggcgagggccgcctgcagctgcgggcctctgtgaagaggaagagccggccctgcagcctgcctgtgtctgagctggagaccgtcatcgccagcgcctgtggggaccctgagacccccaggacccactacatccgcatccacaccctgctgcacagcatgcccagcgcccagggcggcagcgctgctgaggaggaggatggagctgaggaggagagcaccctgaaggacagcagcgagaaggatggcctgtctgaggtggacacagtggccgctgaccccagcgccctggaggaggaccgggaggagcctgagggcgccaccccaggcacagcccaccctggccacagcggcggccacttccccagcctggccaacggggccgcccaggatggagacacccaccccagcacaggcagcgagagtgacagcagcccccggcagggcggggaccacagctgtgagggctgtgatgccagctgctgcagccccagctgctacagcagcagctgctacagcaccagctgctacagcagcagctgctacagcgccagctgctacagccccagctgctacaatggaaacagatttgccagccacacccgcttcagctctgtggacagcgccaagatcagcgagagcacagtgttcagcagccaggatgatgaggaggaggagaacagcgcctttgagagcgtgcctgacagcatgcagagccctgagctggaccctgagagcaccaacggggccggcccctggcaggatgagctggccgcccccagcggccacgtggagaggagccctgagggcctggagagccctgtggccggccccagcaacagaagagaaggagaatgtcccatcctgcacaacagccagcctgtgtcccagctgcccagcctgcggcctgagcaccaccactaccccaccattgatgagcccctgccccccaactgggaggccagaattgacagccacggccgggtcttctacgtggaccacgtgaacagaaccaccacctggcagaggcccacagctgctgccaccccagatggcatgaggaggagcggcagcatccagcagatggagcagctgaacagacgctaccagaacatccagaggaccatcgccacagagaggagtgaagaagattctggcagccagagctgtgagcaggccccagctgggggcggcggcggcggcggcagtgacagcgaggccgagagcagccagagcagcctggacctgcggcgggagggcagcctgagccctgtgaacagccagaagatcaccctgctgctgcagagccctgctgtgaagttcatcaccaaccctgagttcttcaccgtgctgcacgccaactacagcgcctacagagtcttcaccagcagcacctgcctgaagcacatgatcctgaaggtgagaagagatgccaggaactttgagcgctaccagcacaacagagacctggtgaacttcatcaacatgtttgctgacacccggctggagctgccccggggctgggagatcaagacagaccagcagggcaagagcttctttgtggaccacaacagccgggccaccaccttcatcgacccccgcatccccctgcagaatggccgcctgcccaaccacctgacccaccggcagcacctgcagaggctgcggagctacagcgctggggaggccagcgaggtgtccaggaacagaggagccagcctgctggcccggcccggccacagcctggtggccgccatccgcagccagcaccagcacgagagcctgcccctggcctacaatgacaagatcgtggccttcctgcggcagcccaacatctttgagatgctgcaggagcggcagcccagcctggccaggaaccacaccctgcgggagaagatccactacatcagaacagagggcaaccacggcctggagaagctgagctgtgatgctgacctggtgatcctgctgagcctgtttgaggaggagatcatgtcctatgtgcccctgcaggccgccttccaccctggctacagcttcagcccccgctgcagcccctgcagcagcccccagaacagccctggcctgcagagggccagcgcccgggcccccagcccctaccgccgggactttgaggccaagctgaggaacttctacaggaagctggaggccaagggcttcggccagggccctgggaagatcaagctgatcatcagaagagaccacctgctggagggcaccttcaaccaggtgatggcctacagcaggaaggagctgcagaggaacaagctgtatgtgacctttgtgggggaggagggcctggactacagcggccccagccgggagttcttcttcctgctgagccaggagctgttcaacccctactacggcctgtttgagtacagcgccaatgacacctacacagtgcagatcagccccatgtctgcctttgtggagaaccacctggagtggttccgcttcagcggccgcatcctgggcctggccctgatccaccagtacctgctggatgccttcttcacccggcccttctacaaggccctgctgcggctgccctgtgacctgagtgacctggagtacctggatgaggagttccaccagagcctgcagtggatgaaggacaacaacatcacagacatcctggacctgaccttcaccgtgaatgaggaggtgtttggccaggtgacagagcgggagctgaagagcggcggggccaacacccaggtgacagagaagaacaagaaggagtacatcgagaggatggtgaagtggagggtggagcggggcgtggtgcagcagacagaggccctggtgcggggcttctatgaggtggtggacagccggctggtgtctgtgtttgatgcccgggagctggagctggtgattgctggaacagctgagattgacctgaatgactggaggaacaacacagagtacagaggaggctaccatgatggccacctggtgatccgctggttctgggccgctgtggagcgcttcaacaatgagcagaggctgcggctgctgcagtttgtgacaggcaccagctctgtgccctatgagggctttgctgccctgcggggcagcaatggcctgcggcgcttctgcatcgagaagtggggcaagatcaccagcctgccccgggcccacacctgcttcaaccggctggacctgcccccctaccccagctacagcatgctgtatgagaagctgctgacagctgtggaggagaccagcaccttcggcctggagtag

SEQ ID NO: 20481 - DNA, 1209 bp, Artificial Sequence
  Description of Artificial Sequence: Synthetic coding sequence
atggccgccctgtgcaggacagctgagagccaggccgagctgcagtgcacccagctggacctggagaggaagctgaagctgaatgaaaatgccatcagccggctgcaggccaaccagaagtctgtgctggtgtctgtgtctgaggtgaaggctgtggccgagatgcagtttggagagctgctggccgctgtgaggaaggcccaggccaacgtgatgctgttcctggaggagaaggagcaggccgccctgagccaggccaacggcatcaaggcccacctggagtacagatctgctgagatggagaagagcaagcaggagctggagaccatggccgccatcagcaacacagtgcagttcctggaggagtactgcaagttcaagaacacagaggacatcaccttccccagcgtgtacatcggcctgaaggacaagctgagcggcatcaggaaggtgatcacagagagcacagtgcacctgatccagctgctggagaactacaagaagaagctgcaggagttcagcaaggaggaggagtatgacatccgcacccaggtgtctgccatcgtgcagaggaagtactggaccagcaagccagagcccagcacccgggagcagttcctgcagtatgtgcatgacatcacctttgatcctgacacagcccacaagtacctgcggctgcaggaggagaacaggaaggtgaccaacaccaccccctgggagcacccctacccagacctgcccagccgcttcctgcactggaggcaggtgctgagccagcagagcctgtacctgcaccgctactactttgaggtggagatctttggagctggcacctacgtgggcctgacctgcaagggcatcgaccagaagggggaggagaggagcagctgcatcagcggcaacaacttctcctggagcctgcagtggaatggcaaggagttcaccgcctggtacagcgacatggagacccccctgaaggccggccccttctggaggctgggcgtgtacatcgacttccctgggggcatcctgtccttctatggagtggagtatgacagcatgaccctggtgcacaagtttgcctgcaagttcagcgagcctgtgtatgctgccttctggctgagcaagaaggaaaatgccatcagaattgtggacctgggggaggagcctgagaagccagcccccagcctggtgggcacagccccctag

SEQ ID NO: 20482 - DNA, 1677 bp, Artificial Sequence
  Description of Artificial Sequence: Synthetic coding sequence
atgcacaggtctgcccccagccagaccaccaagaggagccgcagccccttcagcaccaccaggaggtcctgggatgattctgagagcagcggcaccaacctgaacatcgacaatgaagactacagccgctacccaccccgggagtaccgggccagcggcagcagaagaggcatggcctacggccacatcgacagctatggagcagatgattctgaggaggagggcgccggccctgtggagcggccccctgtgcggggcaagacaggcaagttcaaggatgacaagctgctggaccctgtgcctgctgcccgctgcagcgccagcagagctgacttcctgccccagagctctgtggccagccagagcagcagcgagggcaagctggccaccaagggggacagcagcgagcgggagcggcgggagcagaacctgcctgcccggcccagccgggcccctgtgtccatctgtggcggcggggagaacaccagcaagtctgctgaggagcctgtggtgcggcccaagatccggaacctggccagccccaactgtgtgaagcccaagatcttctttgacacagatgatgatgatgacatgccccacagcaccagccgctggagggacacagccaatgacaatgaaggccacagtgatggcctggcccggcggggccgcggggagagcagcagcggctacccagagcccaagtacccagaggacaagcgggaggcccggagtgaccaggtgaagccagagaaggtgcccaggagaagaaggaccatggctgaccctgacttctggacccacagtgatgactactacaagtactgtgatgaggacagcgacagcgacaaggagtggattgctgccctgcggaggaagtaccgcagccgggagcagaccctgagcagcagcggggagagctgggagaccctgcccgggaaggaggagcgggagcccccccaggccaaggtgtctgccagcacaggcaccagccctggccctggggccagcgccagcgctggggccggggccggggccagcgctggcagcaatggcagcaactacctggaggaggtgcgggagcccagcctgcaggaggagcaggccagcctggaggagggggagatcccctggctgcagtaccatgaaaatgacagcagcagcgagggggacaatgacagcggccacgagctgatgcagcccggggtcttcatgctggatggcaacaacaacctggaggatgacagctctgtgtctgaggacctggaggtggactggagcctgtttgatggctttgctgatggcctgggcgtggccgaggccatctcctatgtggacccccagttcctgacctacatggccctggaggagcggctggcccaggccatggagacagccctggcccacctggagagcctggccgtggatgtggaggtggccaaccccccagccagcaaggagagcattgatgccctgcctgagatcctggtgacagaagatcatggagctgtgggccaggagatgtgctgccccatctgctgcagtgaatatgtgaagggggaggtggccacagagctgccctgccaccactacttccacaagccctgtgtgtccatctggctgcagaagagcggcacctgccctgtgtgccgctgcatgtttcctccacccctgtag

SEQ ID NO: 20483 - DNA, 3591 bp, Artificial Sequence
  Description of Artificial Sequence: Synthetic coding sequence
gtgcccccctgcccagctgagctgcggtctgtgaccaacggccagagcaaccagcccagcaatgaaggagatgccatcaaggtgtttgtgcgcatccggcccccagctgagaggagcggcagcgcagatggagagcagaacctgtgcctgtctgtgctgagcagcaccagcctgcggctgcacagcaaccctgagcccaagaccttcacctttgaccacgtggctgatgtggacaccacccaggagagcgtgtttgccaccgtggccaagagcatcgtggagagctgcatgagcggctacaacggcaccatctttgcctacggccagacaggcagcggcaagaccttcaccatgatgggccccagcgagagtgacaacttcagccacaacctgcggggcgtcatccccaggagctttgagtacctgttcagcctgattgaccgggagaaggagaaggccggggccggcaagagcttcctgtgcaagtgcagcttcatcgagatctacaatgagcagatctatgacctgctggacagcgccagcgctggcctgtacctgcgggagcacatcaagaagggcgtgtttgtggtgggcgctgtggagcaggtggtgaccagcgctgctgaggcctaccaggtgctgagcggcggctggaggaacagaagagtggccagcacctccatgaaccgggagagcagccgcagccatgctgtgttcaccatcaccattgaatccatggagaagagcaatgagatcgtgaacatccgcaccagcctgctgaacctggtggacctggccggcagcgagcggcagaaggacacccacgccgagggcatgaggctgaaggaggccggcaacatcaacagaagcctgagctgcctgggccaggtgatcacagccctggtggatgtgggcaatggcaagcagagacatgtgtgctacagagacagcaagctgaccttcctgctgcgggacagcctgggcggcaatgccaagacagccatcatcgccaacgtgcaccctggcagccgctgcttcggggagaccctgagcaccctgaactttgcccagagggccaagctgatcaagaacaaggctgtggtgaatgaagacacccagggcaatgtgtcccagctgcaggccgaggtgaagaggctgaaggagcagctggccgagctggccagcggccagaccccacctgagagcttcctgacccgggacaagaagaagaccaactacatggagtacttccaggaggccatgctgttcttcaagaagtctgagcaggagaagaagagcctgattgagaaggtgacccagctggaggacctgaccctgaagaaggagaagttcatccagagcaacaagatgattgtgaagttccgggaggaccagatcatccggctggagaagctgcacaaggagagccggggcggcttcctgcctgaggagcaggaccggctgctgtctgagctgagaaatgagatccagaccctgcgggagcagatcgagcaccacccccgggtggccaagtatgccatggagaaccacagcctgcgggaggagaacagaaggctgcggctgctggagcctgtgaagagggcccaggagatggatgcccagaccatcgccaagctggagaaggccttcagcgagatcagcggcatggagaagagtgacaagaaccagcagggcttcagccccaaggcccagaaggagccctgcctgtttgccaacacagagaagctgaaggcccagctgctgcagatccagacagagctgaacaacagcaagcaggagtatgaggagttcaaggagctgaccaggaagaggcagctggagctggagagcgagctgcagagcctgcagaaggccaacctgaacctggagaacctgctggaggccaccaaggcctgcaagaggcaggaggtgtcccagctgaacaagatccacgccgagaccctgaagatcatcaccacccccaccaaggcctaccagctgcacagcaggcctgtgcccaagctgagccctgagatgggcagctttggcagcctgtacacccagaacagcagcatcctggacaatgacatcctgaatgaacctgtgcccccagagatgaatgagcaggcctttgaggccatcagcgaggagctgaggacagtgcaggagcagatgtctgccctgcaggccaagctggatgaggaggagcacaagaacctgaagctgcagcagcacgtggacaagctggagcaccacagcacccagatgcaggagctgttcagcagcgagagaattgactggaccaagcagcaggaggagctgctgagccagctgaatgtgctggagaagcagctgcaggagacccagaccaagaatgacttcctgaagtctgaggtgcatgacctgcgggtggtgctgcacagcgctgacaaggagctgagctctgtgaagctggagtacagcagcttcaagaccaaccaggagaaggagttcaacaagctgtctgagcggcacatgcacgtgcagctgcagctggacaacctgcggctggagaatgagaagctgctggagagcaaggcctgcctgcaggacagctatgacaacctgcaggagatcatgaagtttgaaattgaccagctgagcaggaacctgcagaacttcaagaaggaaaatgagaccctgaagagtgacctgaacaacctgatggagctgctggaggccgagaaggagaggaacaacaagctgagcctgcagtttgaggaggacaaggagaacagcagcaaggagatcctgaaggtgctggaggccgtgcggcaggagaagcagaaggagacagccaagtgtgagcagcagatggccaaggtgcagaagctggaggagagcctgctggccacagagaaggtgatcagcagcctggagaagagccgggacagcgacaagaaggtggtggccgacctgatgaaccagatccaggagctgcggacctctgtgtgtgagaagacagagaccatcgacaccctgaagcaggagctgaaggacatcaactgcaagtacaacagcgccctggtggaccgggaggagagccgggtgctgatcaagaagcaggaggtggacatcctggacctgaaggagaccctgcggctgcgcatcctgtctgaagatattgagcgggacatgctgtgtgaggacctggcccacgccacagagcagctgaacatgctgacagaggccagcaagaagcacagcggcctgctgcagagcgcccagaggacagaccaggagggcagcccagattctggcaccagcgcccaggccaagcccaaggagcggggcagcaggacagaggaggagtacaacttcaagatgaggcagctggagcacgtgatggattctgctgctgaggacccccagagccccaagaccccaccccacttccagacccacctggccaagctgctggagacccaggagcaggagattgaagatggccgggccagcaagaccagcctggagcacctggtgaccaagctgaatgaagatcgggaggtgaagaatgctgagatcctgaggatgaaggagcagctgaggtag

SEQ ID NO: 20484 - DNA, 3264 bp, Artificial Sequence
  Description of Artificial Sequence: Synthetic coding sequence
atggaccccttcacagagaagctgctggagaggacccgggcccggcgggagaacctgcagaggaagatggccgagcggcccacagctgcccccaggtccatgacccacgccaagagggcccggcagcccctgtctgaggccagcaaccagcagcccctgagcggcggggaggagaagagctgcaccaagcccagccccagcaagaagcgctgcagcgacaacacagaggtggaggtgagcaacctggagaacaagcagcctgtggagagcaccagcgccaagagctgcagccccagccctgtgagcccccaggtgcagccccaggccgctgacaccatcagtgacagcgtggccgtgcctgccagcctgctgggcatgagaagaggcctgaacagccggctggaggccacagctgccagctctgtgaagaccaggatgcagaagctggccgagcagaggcggcgctgggacaatgatgacatgacagatgacatccctgagagcagcctcttcagccccatgcccagcgaggagaaggccgccagccccccccggcccctgctgagcaatgccagcgccacccctgtgggccggcggggccgcctggccaacctggccgccaccatctgctcctgggaggatgatgtgaaccacagctttgccaagcagaacagcgtgcaggagcagcccggcacagcctgcctgagcaagttcagcagcgccagcggggccagcgcccgcatcaacagcagctctgtgaagcaggaggccaccttctgcagccagagagatggagatgccagcctgaacaaggccctgagcagcagcgcagatgatgccagcctggtgaatgccagcatcagcagctctgtgaaggccaccagccctgtgaagagcaccaccagcatcacagatgccaagagctgtgagggccagaaccctgagctgctgcccaagacccccatcagccccctgaagacaggagtgtccaagcccatcgtgaagagcaccctgagccagacagtgcccagcaaaggagagctgagccgggagatctgcctgcagagccagagcaaggacaagagcaccaccccaggcggcaccggcatcaagcccttcctggagagatttggagagcgctgccaggagcacagcaaggagagccctgcccggagcaccccccacaggacccccatcatcacccccaacaccaaggccatccaggagcggctcttcaagcaggacaccagcagcagcaccacccacctggcccagcagctgaagcaggagcggcagaaggagctggcctgcctgcggggccgctttgacaagggcaacatctggagcgctgagaagggcggcaacagcaagagcaagcagctggagaccaagcaggagacccactgccagagcacccccctgaagaagcaccagggcgtgtccaagacccagagcctgcctgtgacagagaaggtgacagagaaccagatcccagccaagaacagcagcacagagcccaaggaggtgatccgggagattgagatgtctgtggatgatgatgacatcaacagcagcaaggtgatcaatgacctcttcagtgatgtgctggaggagggggagctggacatggagaagagccaggaggagatggaccaggccctggccgagagcagcgaggagcaggaggatgccctgaacatcagctccatgagcctgctggcccccctggcccagacagtgggcgtggtgtccccagagagcctggtgtccaccccccggctggagctgaaggacaccagcagaagtgatgagagccccaagccaggcaagttccagaggaccagggtgcccagggctgagagcggggacagcctgggcagcgaggaccgggacctgctgtacagcattgatgcctaccgcagccagcgcttcaaggagacagagcggcccagcatcaagcaggtgattgtgaggaaggaggatgtgaccagcaagctggatgagaagaacaatgccttcccctgccaggtgaacatcaagcagaagatgcaggagctgaacaatgagatcaacatgcagcagaccgtcatctaccaggccagccaggccctgaactgctgcgtggatgaggagcacggcaagggcagcctggaggaggccgaggccgagcggctgctgctgattgccaccgggaagaggaccctgctgattgatgagctgaacaagctgaagaatgaaggcccccagaggaagaacaaggccagcccccagagcgagttcatgcccagcaagggctctgtgaccctgtctgagatccggctgcccctgaaggctgactttgtgtgcagcacagtgcagaagccagatgctgccaactactactacctgatcatcctgaaggccggggctgagaacatggtggccacccccctggccagcaccagcaacagcctgaatggagatgccctgaccttcaccaccaccttcaccctgcaggatgtgtccaatgactttgagatcaacatcgaggtgtacagcctggtgcagaagaaggaccccagcggcctggacaagaagaagaagaccagcaagagcaaggccatcacccccaagaggctgctgaccagcatcaccaccaagagcaacatccacagctctgtgatggccagccctgggggcctgtctgctgtgaggaccagcaactttgccctggtgggcagctacaccctgagcctgagctctgtgggcaacaccaagtttgtgctggacaaggtgcccttcctgagcagcctggagggccacatctacctgaagatcaagtgccaggtgaacagctctgtggaggagcggggcttcctgaccatctttgaagatgtgtctggctttggagcctggcaccggcgctggtgtgtgctgagcggcaactgcatctcctactggacctacccagatgatgagaagaggaagaaccccatcggccgcatcaacctggccaactgcaccagccggcagattgaaccagccaaccgggagttctgtgcccggaggaacacctttgagctgatcaccgtgcggccccagagagaagatgaccgggagaccctggtgtcccagtgccgggacaccctgtgtgtgaccaagaactggctgtctgctgacaccaaggaggagcgggacctgtggatgcagaagctgaaccaggtgctggtggacatccggctgtggcagccagatgcctgctacaagcccatcggcaagccctag

SEQ ID NO: 20485 - DNA, 648 bp, Artificial Sequence; identical to SEQ ID NO: 19225
  Description of Artificial Sequence: Synthetic coding sequence

SEQ ID NO: 20486 - DNA, 2976 bp, Artificial Sequence
  Description of Artificial Sequence: Synthetic coding sequence
atggaggagtatgagaagttctgtgagaagagcctggcccgcatccaggaggccagcctgagcacagagagcttcctgcctgcccagagcgagagcatcagcctcatccgcttccatggagtggccatcctgagccccctgctgaacatcgagaagaggaaggagatgcagcaggagaagcagaaggccctggatgtggaggccaggaagcaggtgaacaggaagaaggccctgctgaccagggtgcaggagatcctggacaacgtgcaggtgaggaaggccccaaatgccagtgactttgaccagtgggagatggagaccgtgtacagcaacagcgaggtgaggaacctgaatgtgcctgccaccttccccaacagcttccccagccacacagagcacagcacagctgccaagctggacaagattgctggcatcctgcccctggacaatgaagaccagtgcaagacagatggcatcgacctggcccgggacagcgagggcttcaacagccccaagcagtgtgacagcagcaacatcagccacgtggagaatgaggccttccccaagaccagcagcgccaccccccaggagaccctcatcagtgatggccccttctctgtgaatgagcagcaggacctgcccctgctggccgaggtgatcccagacccctacgtgatgagcctgcagaacctgatgaagaagagcaaggagtacatcgagcgggagcagagcagaagaagcctgcggggcagcatcaacagaattgtgaatgaaagccacctggacaaggagcatgatgctgtggaggtggccgactgtgtgaaggagaagggccagctgaccgggaagcactgtgtgtctgtcatcccagacaagcccagcctgaacaagagcaatgtgctgctgcagggcgccagcacccaggccagctccatgtccatgcctgtgctggccagcttcagcaaggtggacatccccatcagaacaggccaccccaccgtgctggagagcaacagcgacttcaaggtgatccccacctttgtgacagagaacaacgtcatcaagagcctgaccggcagctatgccaagctgcccagccctgagcccagcatgagccccaagatgcacagaagaagaagcaggaccagcagcgcctgccacatcctgatcaacaaccccatcaatgcctgtgagctgagccccaagggcaaggagcaggccatggacctgatcatccaggacacagatgagaacaccaacgtgcctgagatcatgcccaagctgcccacagacctggccggcgtgtgcagcagcaaggtgtatgtgggcaagaacaccagcgaggtgaaggaggatgtggtgctgggcaagagcaaccaggtgtgccagagcagcggcaaccacctggagaacaaggtgacccacggcctggtgacagtggagggccagctgaccagtgatgagcggggggcccacatcatgaacagcacctgtgccgccatgcccaagctgcacgagccctatgccagcagccagtgcatcgccagccccaactttggaacagtgtctggcctgaagccagcctccatgctggagaagaactgcagcctgcagacagagctgaacaagagctatgatgtgaagaaccccagccccctgctgatgcagaaccagaacacccggcagcagatggacacccccatggtgtcctgtggaaatgagcagttcctggacaacagctttgagaaggtgaagaggcggctggacctggacattgatggcctgcagaaggagaactgcccctacgtgatcaccagcggcatcacagagcaggagcggcagcacctgcctgagaagcgctaccccaagggcagcggctttgtgaacaagaacaagatgctgggcaccagcagcaaggagagcgaggagctgctgaagagcaagatgctggcctttgaggagatgaggaagaggctggaggagcagcacgcccagcagctgagcctgctgattgctgagcaggagcgggagcaggagcggctgcagaaggagattgaggagcaggagaagatgctgaaggagaagaaggccatgacagctgaggccagcgagctggacatcaacaatgctgtggagctggagtggaggaagatcagtgacagcagcctgctggagaccatgctgagccaggccgacagcctgcacaccagcaacagcaacagcagcggcttcaccaacagcgccatgcagtacagctttgtgtctgccaatgaggcccccttctacctgtggggcagcagcaccagcggcctgaccaagctgtctgtgacccggcccttcggccgggccaagacccgctggagccaggtgttcagcctggagatccaggccaagttcaacaagatcacagctgtggccaagggcttcctgacccggcggctgatgcagacagacaagctgaagcagctgcggcagacagtgaaggacaccatggagttcatccgctccttccagagcgaggcccccctgaagaggggcatcgtgtctgcccaggatgccagcctgcaggagcgggtgctggcccagctgcgggccgccctgtatggcatccatgacatcttctttgtgatggatgctgctgagaggatgagcatcctgcaccacgaccgggaggtgaggaaggagaagatgctgcggcagatggacaagatgaagagcccccgggtggccctgtctgctgccacccagaagagcctggacaggaagaagtacatgaaggctgctgagatgggcatgcccaacaagaagttcctggtgaagcagaaccccagcgagaccagggtgctgcagcccaaccagggccagaatgcccctgtgcaccggctgctgagccggcagggcagcatctgcaggaagaaccccaagaaggccgccaagtgctgtgacaacctgcggcggcagcacagcctgggctag

SEQ ID NO: 20487 - DNA, 2976 bp, Artificial Sequence; identical to SEQ ID NO: 20486
  Description of Artificial Sequence: Synthetic coding sequence

SEQ ID NO: 20488 - DNA, 999 bp, Artificial Sequence; identical to SEQ ID NO: 18607
  Description of Artificial Sequence: Synthetic coding sequence

SEQ ID NO: 20489 - DNA, 888 bp, Artificial Sequence; identical to SEQ ID NO: 18520
  Description of Artificial Sequence: Synthetic coding sequence

SEQ ID NO: 20490 - DNA, 1368 bp, Artificial Sequence
  Description of Artificial Sequence: Synthetic coding sequence
atggagggcgtgctgtacaagtggaccaactacctgagcggctggcagccccgctggttcctgctgtgtggcggcatcctgagctactatgacagcccagaagatgcctggaagggctgcaagggcagcatccagatggctgtgtgtgagatccaggtgcacagcgtggacaacaccaggatggacctgatcatccctggagagcagtacttctacctgaaggcccggtctgtggccgagcggcagcgctggctggtggccctgggcagcgccaaggcctgcctgacagacagcaggacccagaaggagaaggagtttgctgagaacacagagaacctgaagaccaagatgtctgagctgcggctgtactgtgacctgctggtgcagcaggtggacaagaccaaggaggtgaccaccaccggggtgagcaacagcgaggagggcattgatgtgggcaccctgctgaagagcacctgcaacaccttcctgaagaccctggaggagtgcatgcagatcgccaatgctgccttcaccagcgagctgctgtaccgcaccccacctggcagcccccagctggccatgctgaagagcagcaagatgaagcaccccatcatccccatccacaacagcctggagcggcagatggagctgagcacctgtgaaaatggcagcctgaacatggagatcaacggggaggaggagatcctgatgaagaacaagaacagcctgtacctgaagtctgctgagattgactgcagcatcagcagcgaggagaacacagatgacaacatcaccgtgcagggcgagatcagaaaagaagatggcatggagaacctgaagaaccacgacaacaacctgacccagagcggcagtgacagcagctgcagccctgagtgcctgtgggaggagggcaaggaggtgatccccaccttcttcagcaccatgaacaccagcttcagtgacatcgagctgctggaggacagcggcatccccacagaggccttcctggccagctgctatgctgtggtgcctgtgctggacaagctgggccccaccgtgtttgcccctgtgaagatggacctggtgggcaacatcaagaaggtgaaccagaagtacatcaccaacaaggaggagttcaccaccctgcagaagatcgtgctgcacgaggtggaggctgatgtggcccaggtgaggaacagcgccacagaggccctgctgtggctgaagaggggcctgaagttcctgaagggcttcctgacagaggtgaagaatggagagaaggacatccagacagccctgaacaatgcctacggcaagaccctgcggcagcaccacggctgggtggtgcggggcgtgtttgctgtgtag

SEQ ID NO: 20491 - DNA, 1320 bp, Artificial Sequence
  Description of Artificial Sequence: Synthetic coding sequence
atggagggcgtgctgtacaagtggaccaactacctgagcggctggcagccccgctggttcctgctgtgtggcggcatcctgagctactatgacagcccagaagatgcctggaagggctgcaagggcagcatccagatggctgtgtgtgagatccaggtgcacagcgtggacaacaccaggatggacctgatcatccctggagagcagtacttctacctgaaggcccggtctgtggccgagcggcagcgctggctggtggccctgggcagcgccaaggcctgcctgacagacagcaggacccagaaggagaaggagtttgctgagaacacagagaacctgaagaccaagatgtctgagctgcggctgtactgtgacctgctggtgcagcaggtggacaagaccaaggaggtgaccaccaccggggtgagcaacagcgaggagggcattgatgtgggcaccctgctgaagagcacctgcaacaccttcctgaagaccctggaggagtgcatgcagatcgccaatgctgccttcaccagcgagctgctgtaccgcaccccacctggcagcccccagctggccatgctgaagagcagcaagatgaagcaccccatcatccccatccacaacagcctggagcggcagatggagctgagcacctgtgaaaatggcagcctgaacatggagatcaacggggaggaggagatcctgatgaagaacaagaacagcctgtacctgaagtctgctgagattgactgcagcatcagcagcgaggagaacacagatgacaacatcaccgtgcagggcgagatcagaaaagaagatggcatggagaacctgaagaaccacgacaacaacctgacccagagcggcagtgacagcagctgcagccctgagtgcctgtgggaggagggcaaggaggtgatccccaccttcttcagcaccatgaacaccagcttcagtgacatcgagctgctggaggacagcggcatccccacagaggccttcctggccagctgctatgctgtggtgcctgtgctggacaagctgggccccaccgtgtttgcccctgtgaagatggacctggtgggcaacatcaagaaggtgaaccagaagtacatcaccaacaaggaggagttcaccaccctgcagaagatcgtgctgcacgaggtggaggctgatgtggcccaggtgaggaacagcgccacagaggccctgctgtggctgaagaggggcctgaagttcctgaagggcttcctgacagaggtgaagaatggagagaaggacatccagacagccctgtctgtgggcatgtgggtgtag

SEQ ID NO: 20492 - DNA, 984 bp, Artificial Sequence; identical to SEQ ID NO: 18841
  Description of Artificial Sequence: Synthetic coding sequence

SEQ ID NO: 20493 - DNA, 5229 bp, Artificial Sequence
  Description of Artificial Sequence: Synthetic coding sequence
atgatggagggcaatggaacagagaacagctgcagcaggacccggggctggctgcagcaggacaatgatgccaagccctggctgtggaagttcagcaactgcttcagcaggcctgagcagaccctgccccacagcccccagaccaaggagtacatggagaacaagaaggtggccgtggagctgaaggatgtgcccagccccctgcacgccggcagcaagctgtttcctgctgtgcccctgcctgacatccgcagcctgcagcagcccaagatccagctgagctctgtgcccaaggtgtcctgctgtgcccactgccccaatgagcccagcaccagccccatgagatttggaggcggcggcggcggcagcggcggcaccagcagcctcatccaccctggggccctgctggacagccagagcaccaggaccatcacctgccaggtgggcagcggctttgccttccagagcgccagcagcctgcagaatgccagcgccaggaacaacctggccggcatcgccagtgacttccccagcatgtgcctggagagcaacctgagcagctgcaagcacctgccctgctgcggcaagctgcacttccagagctgccacggcaatgtgcacaagctgcaccagttccccagcctgcagggctgcaccagcgctggctacttcccctgcagcgacttcaccagcggggcccctggccacctggaggagcacatcagccagagcgagctgaccccccacctgtgcaccaacagcctgcacctgaatgtggtgccccctgtgtgcctgaagggcagcctgtactgtgaggactgcctgaacaagccagccaggaacagcatcattgatgctgccaaggtgtggcccaacatccccccacccaacacccagcctgcccccctggccgtgcccctgtgcaatggctgcggcaccaagggcaccgggaaggagaccaccctgctgctggccaccagcctgggcaaggccgccagcaagtttggcagccctgaggtggccgtggccggccaggtgctggagaacctgccccccatcggggtcttctgggacatcgagaactgcagcgtgcccagcggccgcagcgccacagctgtggtgcagaggatccgggagaagttcttcaagggccaccgggaggccgagttcatctgtgtgtgtgacatcagcaaagaaaacaaggaggtgatccaggagctgaacaactgccaggtgacagtggcccacatcaatgccacagccaagaatgctgctgatgacaagctgcggcagagcctgcggagatttgccaacacccacacagccccagccaccgtggtgctggtgtccacagatgtgaactttgccctggagctgagtgacctgcggcaccgccacggcttccacatcatcctggtgcacaagaaccaggccagcgaggccctgctgcaccacgccaatgaactcatccgctttgaggagttcatcagtgacctgcccccccggctgcccctgaagatgccccagtgccacaccctgctgtatgtgtacaacctgcctgccaacaaggatggcaagtctgtgagcaaccggctgcggcggctgagtgacaactgtggcggcaaggtgctgagcatcaccggctgcagcgccatcctgcgcttcatcaaccaggacagcgctgagcgggcccagaagaggatggagaatgaagatgtgtttggaaaccgcatcatcgtgtccttcacccccaagaaccgggagctgtgtgagaccaagagcagcaatgccatcgctgacaaggtgaagagccccaagaagctgaagaaccccaagctgtgcctgatcaaggatgccagcgagcagagcagcagcgccaaggccacccctgggaagggcagccaggccaacagcggcagcgccaccaagaacaccaacgtgaagagcctgcaggagctgtgcaggatggagagcaagacaggccacagaaattctgagcaccagcagggccacctgcggctggtggtgcccacccacggcaacagcagcgctgctgtgtccacccccaagaacagcggcgtggccgagcctgtgtacaagaccagccagaagaaggagaacctgagcgcccggtctgtgaccagcagccctgtggagaagaaggacaaggaggagaccgtcttccaggtgtcctaccccagcgccttcagcaagctggtggccagccggcaggtgagccccctgctggccagccagagctggagcagccgctccatgagccccaacctgctgaacagagccagccccctggccttcaacatcgccaacagcagcagcgaggccgactgcccagacccctttgccaatggagcagatgtgcaggtgagcaacatcgactaccgcctgagcaggaaggagctgcagcagctgctgcaggaggcctttgcccggcacggcaaggtgaagtctgtggagctgagcccccacacagactaccagctgaaggctgtggtgcagatggagaacctgcaggatgccatcggggctgtgaacagcctgcaccgctacaagattggcagcaagaagatcctggtgtccctggccactggagctgccagcaagagcctgagcctgctgtctgctgagaccatgtctgtgctgcaggatgccccagcctgctgcctgcccctcttcaagttcacagacatctatgagaagaagtttggccacaagctgaatgtgtctgacctgtacaagctgacagacacagtggccatccgggagcagggcaatggccgcctggtgtgcctgctgcccagcagccaggcccggcagagccccctgggcagcagccagagccatgatggcagcagcaccaactgcagccccatcatctttgaggagctggagtaccacgagcctgtgtgccggcagcactgcagcaacaaggacttcagcgagcacgagtttgatcctgacagctacaagatcccctttgtgatcctgagcctgaagacctttgccccccaggtgcacagcctgctgcagacccatgagggcaccgtgcccctgctgtccttcccagactgctacatcgccgagtttggagacctggaggtggtgcaggagaaccagggcggcgtgcccctggagcacttcatcacctgtgtgcctggggtgaacatcgccacagcccagaatggcatcaaggtggtgaagtggatccacaacaagcccccaccacccaacacagacccctggctgctgcggagcaagagccctgtgggcaacccccagctgatccagttcagccgggaggtgattgacctgctgaagagccagcccagctgtgtgatccccatcagccacttcatccccagctaccaccaccactttgccaagcagtgccgggtgtctgactatggctacagcaagctgattgagctgctggaggccgtgccccacgtgctgcagatcctgggcatgggcagcaagaggctgctgaccctgacccaccgggcccaggtgaagcgcttcacccaggacctgctgaagctgctgaagagccaggccagcaagcaggtgattgtgcgggagttcagccaggcctaccactggtgcttcagcaaggactgggatgtgacagaatatggagtgtgtgagctgattgatattgtgtctgagatcccagacaccaccatctgcctgagccagcaggacaatgagatggtgatctgcatccccaagcgggagaggacccaggatgaaattgaaagaaccaagcagttcagcaaggatgtggtggacctgctgcggcaccagccccacttcaggatgcccttcaacaagttcatccccagctaccaccaccacttcggccggcagtgcaagctggcctactacggcttcaccaagctgctggagctgtttgaggccatcccagacaccctgcaggtgctggagtgtggggaggagaagatcctgaccctgacagaggtggagcgcttcaaggccctggccgcccagtttgtgaagctgctgcggagccagaaggacaactgcctgatgatgacagacctgctgacagaatatgccaagaccttcggctacaccttccggctgcaggactatgatgtgagcagcatcagcgccctgacccagaagctgtgccacgtggtgaaggtggccgacatcgagagcggccggcagatccagctgatcaacaggaagagcctgcggagcctgacagcccagctgctggtgctgctgatgtcctgggagggcaccacccacctgtctgtggaggagctgaagaggcactatgagagcacccacaacacccccctgaacccctgtgaatatggcttcatgaccctgacagagctgctgaagagcctgccctacctggtggaggtgttcaccaatgacaagatggaggagtgtgtgaagctgaccagcctgtacctgtttgccaagaatgtgcgcagcctgctgcacacctaccactaccagcagatcttcctgcacgagttctccatggcctacaccaagtatgtgggggagaccctgcagcccaagacctacggccacagctctgtggaggagctgctgggcgccatcccccaggtggtgtggatcaagggccacggccacaagagaattgtggtgctgaagaatgacatgaagagccggctgagcagcctgagcctgagccctgccaaccacgagaaccagcccagcgagggggagcgcatcctggaggtgcctgagagccacacagccagcgagctgaagctgggcgcagatggcagcggccccagccacacagagcaggagctgctgcggctgacagatgacagccctgtggacctgctgtgtgcccctgtgcccagctgcctgcccagcccccagctgcggccagaccccgtcatcctgcagagcgctgacctgatccagtttgaggagcggccccaggagcccagcgagatcatgatcctgaaccaggaggagaagatggagatccccatccctgggaagagcaagaccctgaccagtgacagcagcagcagctgcatctctgctgctgtgcctgtgcccccctgccccagcagcgagaccagcgagagcctgctgagcaaggaccctgtggagagccctgccaagaagcagcccaagaacagagtgaagctggccgccaacttcagcctggcccccatcaccaagctgtag

SEQ ID NO: 20494 - DNA, 831 bp, Artificial Sequence
  Description of Artificial Sequence: Synthetic coding sequence
atgtgcagcaccagcggctgtgacctggaggagatccccctggatgatgatgacctgaacaccatcgagttcaagatcctggcctactacaccaggcaccacgtgttcaagagcaccccagccctcttcagccccaagctgctgcggaccaggagcctgagccagaggggcctgggcaactgcagcgccaatgaatcctggacagaggtgtcctggccctgcaggaacagccagagcagcgagaaggccatcaacctgggcaagaagaagagctcctggaaggccttctttggagtggtggagaaggaggacagccagagcaccccagccaaggtgtctgcccagggccagaggaccctggagtaccaggacagccacagccagcagtggagccgctgcctgagcaatgtggagcagtgcctggagcatgaagctgtggaccccaaggtgatcagcatcgccaacagagtggccgagatcgtgtacagctggcccccaccccaggccacccaggccggcggcttcaagagcaaggagatctttgtgacagagggcctgtccttccagctgcagggccacgtgcctgtggccagcagcagcaagaaggatgaggaggagcagatcctggccaagatcgtggagctgctgaagtacagcggggaccagctggagaggaaggagaaggagtgggaggagagcgccaagaccaagatcaagatggccctgctgtggaggagcagcggcggcggcccccgggtgctgagcatccctgaggccttcatgaagaacagcttcaccctgaccccacctggcttcagcgagcacaactag

SEQ ID NO: 20495 - DNA, 552 bp, Artificial Sequence; identical to SEQ ID NO: 19212
  Description of Artificial Sequence: Synthetic coding sequence

SEQ ID NO: 20496 - DNA, 960 bp, Artificial Sequence
  Description of Artificial Sequence: Synthetic coding sequence
atgctgcgctgtggccagatgatctttgcccaggccctggtgtgccgccacctgggccgggactggcgctggacccagaggaagaggcagcctgacagctacttctctgtgctgaatgccttcatcgacaggaaggacagctactacagcatccaccagatcgcccagatgggcgtgggggagggcaagagcatcggccagtggtacggccccaacacagtggcccaggtgctgaagaagctggccgtgtttgacacctggagcagcctggccgtgcacatcgccatggacaacacagtggtgatggaggagatccggcggctgtgcaggacctctgtgccctgtgccggggccacagccttccctgctgacagcgacagacactgcaatggcttccctgctggagctgaggtgaccaaccggcccagcccctggaggcccctggtgctgctgatccccctgcggctgggcctgacagacatcaatgaggcctacgtggagaccctgaagcactgcttcatgatgccccagagcctgggcgtcatcggcggcaagcccaacagcgcccactacttcatcggctacgtgggggaggagctgatctacctggacccccacaccacccagcctgctgtggagcccacagatggctgcttcatcccagatgagagcttccactgccagcaccccccctgcaggatgagcattgctgagctggaccccagcattgctgtgggcttcttctgcaagacagaagatgacttcaatgactggtgccagcaggtgaagaagctgagcctgctgggcggggccctgcccatgtttgagctggtggagctgcagcccagccacctggcctgcccagatgtgctgaacctgagcctggacagcagtgatgtggagcggctggagcgcttctttgattctgaagatgaggactttgagatcctgagcctgtag

SEQ ID NO: 20497 - DNA, 564 bp, Artificial Sequence
  Description of Artificial Sequence: Synthetic coding sequence
atgaatggccgggctgacttccgggagcccaatgctgaggtgccccggcccatcccccacatcggccctgactacatccccacagaggaggagcggcgggtgtttgctgaatgtaatgatgagagcttctggttccgctctgtgcccctggccgccacctccatgctgatcacccagggcctcatcagcaagggcatcctgagcagccaccccaagtatggcagcatccccaagctgatcctggcctgcatcatgggctactttgctgggaagctgtcctatgtgaagacctgccaggagaagttcaagaagctggagaacagccccctgggggaggccctgcggagcggccaggcccggcgcagcagccccccaggccactactaccagaagagcaaatatgacagctctgtgtctggccagagcagctttgtgaccagccctgctgctgacaacatcgagatgctgccccactatgagcccatccccttcagcagctccatgaatgaaagtgcccccaccggcatcacagaccacatcgtgcagggcaggaacttctcctag

SEQ ID NO: 20498 - DNA, 270 bp, Artificial Sequence
  Description of Artificial Sequence: Synthetic coding sequence
atgtctgagcagggcgacctgaaccaggccatcgccgaggagggcggcacagagcaggagacagccaccccagaaaatggcatcgtgaagtctgagagcctggatgaggaggagaagctggagctgcagaggcggctggaggcccagaaccaggagaggaggaagagcaagagcggggccggcaagggcaagctgaccaggagcctggccgtgtgtgaggagagcagcgcccggcctggaggagagagcctgcaggaccagaccctgtag

SEQ ID NO: 20499 - DNA, 270 bp, Artificial Sequence; identical to SEQ ID NO: 20498
  Description of Artificial Sequence: Synthetic coding sequence

SEQ ID NO: 20500 - DNA, 1473 bp, Artificial Sequence
  Description of Artificial Sequence: Synthetic coding sequence
atggaggacagcgccagcgccagcctgagcagcgctgctgccaccggcaccagcaccagcaccccagctgcccccacagccaggaagcagctggacaaggagcaggtgaggaaggctgtggatgccctgctgacccactgcaagagcaggaagaacaactacggcctgctgctgaatgaaaatgaaagcctcttcctgatggtggtgctgtggaagatccccagcaaggagctgcgggtgcggctgaccctgccccacagcatccgcagtgacagcgaggacatctgcctcttcaccaaggatgagcccaacagcaccccagagaagacagagcagttctacaggaagctgctgaacaagcacggcatcaagacagtgtcccagatcatcagcctgcagaccctgaagaaggagtacaagagctatgaggccaagctgcggctgctgagcagctttgacttcttcctgacagatgcccgcatccggcggctgctgcccagcctgattggccgccacttctaccagaggaagaaggtgcctgtgtctgtgaacctgctgagcaagaacctgagccgggagatcaatgactgcatcggcggcaccgtgctgaacatcagcaagagcggcagctgcagcgccatccgcatcggccacgtgggcatgcagatcgagcacatcatcgagaacatcgtggccgtgaccaagggcctgtctgagaagctgcctgagaagtgggagagcgtgaagctgctgtttgtgaagacagagaagtctgctgccctgcccatcttcagcagctttgtgagcaactgggatgaggccaccaagaggagcctgctgaacaagaagaagaaggaggcccggaggaagagaagagagaggaactttgagaagcagaaggagaggaagaagaagaggcagcaggccaggaagacagcctctgtgctgagcaaggatgatgtggcccctgagagcggggacaccaccgtgaagaagccagagagcaagaaggagcagaccccagagcacggcaagaagaagaggggccggggcaaggcccaggtgaaggccaccaatgaaagtgaagatgagatcccccagctggtgcccatcggcaagaagaccccagccaatgagaaggtggagatccagaagcacgccaccgggaagaagagccctgccaagagccccaaccccagcaccccccggggcaagaagaggaaggccctgcctgccagcgagacccccaaggctgctgagagcgagacccctgggaagagccctgagaagaagcccaagatcaaggaggaggccgtgaaggagaagagccccagcctgggcaagaaggatgcccggcagacccccaagaagccagaggccaagttcttcaccacccccagcaagtctgtgaggaaggccagccacacccccaagaagtggcccaagaagcccaaggtgccccagagcacctag

SEQ ID NO: 20501 - DNA, 495 bp, Artificial Sequence
  Description of Artificial Sequence: Synthetic coding sequence
atggccgagcccgcctctgtggccgctgagagcctggccggcagccgggcccgggccgccaggacagtgctgggccaggtggtgctgcccggggaggagctgctgctgcctgagcaggaggatgctgagggccctggaggagctgtggagcggcccctgagcctgaatgcccgggcctgcagccgggtgcgggtggtgtgtggccctggcctgcggcgctgtggggaccggctgctggtgaccaagtgtggccgcctgcggcacaaggagcccggcagcggcagcggcggcggcgtgtactgggtggacagccagcagaagagatatgtgcctgtgaagggggaccacgtgattggcatcgtgacagccaagagcggggacatcttcaaggtggatgtgggcggcagcgagcccgccagcctgagctacctgagctttgagggcgccaccaagaggaaccggcccaacgtgcaggccatcagcagccggctgtag

SEQ ID NO: 20502 - DNA, 2508 bp, Artificial Sequence
  Description of Artificial Sequence: Synthetic coding sequence
atgacctgcaacaagcacggctgccggcaggccttccacgtgacctgtgcccagtttgctggcctgctgtgtgaggaggagggcaatggagctgacaacgtgcagtactgcggctactgcaagtaccacttcagcaagctgaagaagagcaagaggggcagcaacagaagctatgaccagagcctgagtgacagcagcagccacagccaggacaagcaccacgagaaggagaagaagaagtacaaggagaaggacaagcacaagcagaagcacaagaagcagcctgagcccagccctgccctggtgcccagcctgactgtgaccacagagaagacctacaccagcaccagcaacaacagcatcagcggcagcctgaagaggctggaggacaccacagcccgcttcaccaatgccaacttccaggaggtgtctgcccacaccagcagcggcaaggatgtgtctgagacccggggcagcgagggcaagggcaagaagagcagcgcccacagcagcggccagaggggcaggaagccaggcggcggcaggaaccctggcaccaccgtgtctgctgccagccccttcccccagggcagcttcagcggcaccccaggctctgtgaagagcagcagcggcagctctgtgcagagcccccaggacttcctgtccttcacagacagcgacctgagaaatgacagctacagccacagccagcagagcagcgccaccaaggatgtgcacaagggggagagcggcagccaggagggcggcgtgaacagcttcagcaccctcatcggcctgcccagcaccagcgctgtgaccagccagcccaagagctttgagaacagccctggggacctgggcaacagcagcctgcccacagctggctacaagagggcccagaccagcggcatcgaggaggagaccgtgaaggagaagaagaggaaaggaaacaagcagagcaagcacggccctggccggcccaagggcaacaagaaccaggagaatgtgagccacctgtctgtgtcctctgccagccccaccagctctgtggccagcgctgctggcagcatcaccagcagcagcctgcagaagagccccaccctgctgagaaatggcagcctgcagagcctgtctgtgggcagcagccctgtgggcagcgagatctccatgcagtacagacatgatggagcctgccccaccaccagcatctacaacagcaatgatgtggccgtgtccttccccaacgtggtgtctggcagcggcagcagcacccctgtgagcagcagccacctgccccagcagagcagcggccacctgcagcaggtgggcgccctgagccccagcgctgtgagcagcgctgccccagctgtggccaccacccaggccaacaccctgagcggcagcagcctgagccaggcccccagccacatgtatggcaacagaagcaacagctccatggccgccctgattgcccagagcgagaacaaccagacagaccaggacctgggggacaacagcaggaacctggtgggccggggcagcagcccccggggcagcctgagccccaggagccctgtgagcagcctgcagatccgctatgaccagcccggcaacagcagcctggagaacctgccccctgtggccgccagcattgagcagctgctggagcggcagtggagcgagggccagcagttcctgctggagcagggcacccccagcgacatcctgggcatgctgaagagcctgcaccagctgcaggtggagaacagaaggctggaggagcagatcaagaacctgacagccaagaaggagcggctgcagctgctgaatgcccagctgtctgtgcccttccccaccatcacagccaaccccagccccagccaccagatccacaccttcagcgcccagacagcccccaccacagacagcctgaacagcagcaagagcccccacatcggcaacagcttcctgcctgacaacagcctgcctgtgctgaaccaggacctgaccagcagcggccagagcaccagcagcagcagcgccctgagcaccccacctcctgctggccagagccctgcccagcagggcagcggcgtgtctggagtgcagcaggtgaatggagtgacagtgggcgccctggccagcggcatgcagcctgtgaccagcaccatcccagctgtgtctgctgtgggcggcatcatcggggccctgcccggcaaccagctggccatcaatggaattgtgggcgccctgaatggagtgatgcagacccctgtgaccatgagccagaaccccacccccctgacccacaccaccgtgcccccaaatgccacccaccccatgcctgccaccctgaccaacagcgccagcggcctgggcctgctgagtgaccagcagaggcagatcctgatccaccagcagcagttccagcagctgctgaacagccagcagctgacccccaacatggtgaaggagttcagcgcccagatcatcgcctggaggccctag

SEQ ID NO: 20503 - DNA, 1620 bp, Artificial Sequence; identical to SEQ ID NO: 19050
  Description of Artificial Sequence: Synthetic coding sequence

SEQ ID NO: 20504 - DNA, 444 bp, Artificial Sequence; identical to SEQ ID NO: 18869
  Description of Artificial Sequence: Synthetic coding sequence

SEQ ID NO: 20505 - DNA, 951 bp, Artificial Sequence; identical to SEQ ID NO: 19398
  Description of Artificial Sequence: Synthetic coding sequence

SEQ ID NO: 20506 - DNA, 951 bp, Artificial Sequence; identical to SEQ ID NO: 19398
  Description of Artificial Sequence: Synthetic coding sequence

SEQ ID NO: 20507 - DNA, 810 bp, Artificial Sequence; identical to SEQ ID NO: 18331
  Description of Artificial Sequence: Synthetic coding sequence

SEQ ID NO: 20508 - DNA, 1173 bp, Artificial Sequence; identical to SEQ ID NO: 18714
  Description of Artificial Sequence: Synthetic coding sequence

SEQ ID NO: 20509 - DNA, 381 bp, Artificial Sequence
  Description of Artificial Sequence: Synthetic coding sequence
atgcccttcttcggcaacaccttcagccccaagaagaccccacccaggaagagcgccagcctgagcaacctgcacagcctggacaggagcacccgggaggtggagctgggcctggagtatggcagccccaccatgaacctggccggccagagcctgaagtttgaaaatggccagtggattgctgagactggagtgtctgggggcgtggacagaagagaggtgcagaggctgcggcggaggaaccagcagctggaggaggagaacaacctgctgcggctgaaggtggacatcctgctggacatgctgtctgagagcacagctgagagccacctgatggagaaggagctggatgagctgcgcatcagcaggaagaggaagtag

SEQ ID NO: 20510 - DNA, 711 bp, Artificial Sequence
  Description of Artificial Sequence: Synthetic coding sequence
atgcaggtgcaggatgatggagtgaacctgatcccctttgccaagtgcagccgggtggtgagccgcagccccccaccccggctgcccagccagagcctgcggcccatgccccagagatatggagatgtgttctggaagaacctgaaccagaggcccacccccacctggctggaggagcagcacatcccccccatgctgcgggccaccggctgcagccagctgggcctgtacccacctgagcagctgcccccacctgagatgctgtggaggaggaagaagaggcggccctgcctggagggcatgcagcagcagggcctgggcggcgtgcctgcccgggtgcgggctgtgacctaccacctggaggacctgcggcggcggcagagcatcatcaatgagctgaagaaggcccagtggggcagcagtggagctgccagcgagcctgtggtgctgggggaggagggctgcggcttccccagcaccaatgagtacccagacctggaggaggagcgggccacctacccccaggaggaggaccgcttcctgaccccaggccgggcccagctgctgtggagcccctggagccccctggaccaggaggaggcctgtgccagccggcagctgcacagcctggccagcttcagcacagtgacagcccggaggaaccccctgcacaacccctggggcatggagctggccgccagcgaggagtag

SEQ ID NO: 20511 - DNA, 1680 bp, Artificial Sequence
  Description of Artificial Sequence: Synthetic coding sequence
atgaaccccctgtttggccccaacctcttcctgctgcagcaggagcagcagggcctggccggccccctgggggacagcctgggcggggaccactttgctgggggcggggacctgcccccagcccccctgagccctgctggccctgctgcctacagccccccaggccctggccctgcccccccagctgccatggccctgagaaatgacctgggcagcaacatcaacgtgctgaagaccctgaacctgcgcttccgctgcttcctggccaaggtgcatgagctggagaggaggaaccggctgctggagaagcagctgcagcaggccctggaggagggcaagcagggccggcggggcctgggcagaagagaccaggccgtgcagacaggctttgtgagccccatccggcccctgggcctgcagctgggcgcccggcctgctgctgtgtgcagccccagcgcccgggtgctgggcagccctgcccggagccctgctggccccctggcccccagcgctgccagcctgagcagcagcagcaccagcaccagcaccacctacagcagcagcgcccgcttcatgcctggcaccatctggagcttcagccacgcccggcggctgggccctggcctggagcccaccctggtgcagggccctggcctgtcctgggtgcacccagatggagtgggcgtgcagattgacaccatcaccccagagatccgggccctgtacaacgtgctggccaaggtgaagcgggagagagatgagtacaagaggcgctgggaggaggagtacacagtgcgcatccagctgcaggacagagtgaatgagctgcaggaggaggcccaggaggctgatgcctgccaggaggagctggccctgaaggtggagcagctgaaggccgagctggtggtgttcaagggcctgatgagcaacaacctgtctgagctggacaccaagatccaggagaaggccatgaaggtggacatggacatctgcagaagaattgacatcacagccaagctgtgtgatgtggcccagcagaggaactgtgaggacatgatccagatgttccaggtgcccagcatgggcggcaggaagcgggagaggaaggctgctgtggaggaggacaccagcctgtctgagagcgagggcccccggcagccagatggagatgaggaggagagcacagccctgagcatcaatgaggagatgcagaggatgctgaaccagctgcgggagtatgactttgaagatgactgtgacagcctgacctgggaggagacagaggagaccctgctgctgtgggaggacttcagcggctacgccatggctgctgctgaggcccagggcgagcaggaggacagcctggagaaggtgatcaaggacacagagagcctcttcaagacccgggagaaggagtaccaggagaccatcgaccagatcgagctggagctggccacagccaagaatgacatgaacagacacctgcacgagtacatggagatgtgcagcatgaagaggggcctggatgtgcagatggagacctgccggcggctcatcacccagagcggggacaggaagagccctgccttcaccgctgtgcccctgagtgaccccccacctcctccttctgaggccgaggacagcgacagagatgtgtccagtgacagctccatgaggtag

SEQ ID NO: 20512 - DNA, 1182 bp, Artificial Sequence
  Description of Artificial Sequence: Synthetic coding sequence
atggccagcggccgggcccgctgcaccaggaagctgaggaactgggtggtggagcaggtggagagcggccagtttcctggggtgtgctgggatgacacagccaagaccatgttccgcatcccctggaagcatgctgggaagcaggacttccgggaggaccaggatgctgccttcttcaaggcctgggccatcttcaagggcaagtacaaggagggggacaccggcggccctgctgtgtggaagacccggctgcgctgtgccctgaacaagagcagcgagttcaaggaggtgcctgagcggggccgcatggatgtggccgagccctacaaggtgtaccagctgctgcccccaggcatcgtgtctggccagcccggcacccagaaggtgcccagcaagaggcagcacagctctgtgagcagcgagaggaaggaggaggaggatgccatgcagaactgcaccctgagccccagcgtgctgcaggacagcctgaacaatgaggaggagggcgccagcggcggcgctgtgcacagcgacatcggcagcagcagcagcagcagcagccctgagccccaggaggtgacagacaccacagaggcccccttccagggcgaccagaggagcctggagttcctgctgcccccagagccagactacagcctgctgctgaccttcatctacaacggccgggtggtgggggaggcccaggtgcagagcctggactgccgcctggtggccgagcccagcggcagcgagagctccatggagcaggtgctcttccccaagccaggccccctggagcccacccagaggctgctgagccagctggagcggggcatcctggtggccagcaacccccggggcctgtttgtgcagaggctgtgccccatccccatctcctggaatgccccccaggcccctcctggccctggcccccacctgctgcccagcaatgaatgtgtggagctgttcagaacagcctacttctgccgggacctggtgcgctacttccagggcctgggccccccacccaagttccaggtgaccctgaacttctgggaggagagccacggcagcagccacaccccccagaacctgatcaccgtgaagatggagcaggcctttgcccgctacctgctggagcagaccccagagcagcaggccgccatcctgagcctggtgtag

SEQ ID NO: 20513 - DNA, 2454 bp, Artificial Sequence
  Description of Artificial Sequence: Synthetic coding sequence
atgtggagcctgacagccagcgagggggagagcaccacagcccacttcttcctgggcgctggagatgagggcctgggcacccggggcatcggcatgaggcctgaggagagtgacagcgagctgctggaggatgaggaggatgaggtgcccccagagccccagatcatcgtgggcatctgtgccatgaccaagaagagcaagagcaagcccatgacccagatcctggagcggctgtgccgctttgactacctgactgtggtgatcctgggagaagatgtgatcctgaatgaacctgtggagaactggcccagctgccactgcctgatctccttccacagcaagggcttccccctggacaaggctgtggcctacagcaagctgaggaaccccttcctgatcaatgacctggccatgcagtactacatccaggacagaagagaggtgtaccgcatcctgcaggaggagggcatcgacctgcccaggtatgctgtgctgaacagagatcctgcccggcctgaggagtgcaacctgattgaaggagaggaccaggtggaggtgaatggagctgtgttccccaagccctttgtggagaagcctgtgtctgctgaggaccacaacgtgtacatctactaccccagcagcgctgggggcggcagccagaggctcttcaggaagattggcagccgcagctctgtgtacagccctgagagctctgtgaggaagacaggcagctacatctatgaggagttcatgcccacagatggaacagatgtgaaggtgtacacagtgggccctgactatgcccacgccgaggccaggaagagccctgccctggatggcaaggtggagcgggacagcgagggcaaggagatccagtaccctgtgatgctgacagccatggagaagctggtggccaggaaggtgtgtgtggccttcaagcagacagtgtgtggctttgacctgctgcgggccaacggccacagctttgtgtgtgatgtgaatggcttctcctttgtgaagaacagcatgaagtactatgatgactgtgccaagatcctgggcaacaccatcatgagggagctggccccccagttccagatcccctggagcatccccacagaagctgaggacatccccatcgtgcccaccaccagcggcaccatgatggagctgcgctgtgtgattgccatcatccgccacggggacaggacccccaagcagaagatgaagatggaggtgaagcacccccgcttctttgccctgtttgagaagcatggaggctacaagacaggcaagctgaagctgaagaggcctgagcagctgcaggaggtgctggacatcacccggctgctgctggccgagctggagaaggagcctggaggagaaattgaggagaagacaggcaagctggagcagctgaagtctgtgctggagatgtatggccacttcagcggcatcaacaggaaggtgcagctgacctactacccccatggagtgaaggccagcaatgaaggccaggacccccagcgggagaccctggcccccagcctgctgctggtgctgaagtggggcggggagctgaccccagctggccgggtgcaggccgaggagctgggccgggccttccgctgcatgtacccaggcggccagggcgactatgccggcttccctggctgcggcctgctgcggctgcacagcaccttcagacatgacctgaagatctatgccagtgatgagggccgggtgcagatgacagctgctgcctttgccaagggcctgctggccctggagggggagctgacccccatcctggtgcagatggtgaagagcgccaacatgaatggcctgctggacagtgatggagacagcctgagcagctgccagcaccgggtgaaggcccggctgcaccacatcctgcagcaggatgccccctttggacctgaggactatgaccagctggcccccaccaggagcaccagcctgctgaacagcatgaccatcatccagaaccctgtgaaggtgtgtgaccaggtgtttgccctgattgagaacctgacccaccagatccgggagaggatgcaggaccccaggtctgtggacctgcagctgtaccacagcgagaccctggagctgatgctgcagcgctggagcaagctggagcgggacttccggcagaagagcggccgctatgacatcagcaagatcccagacatctatgactgtgtgaagtatgatgtgcagcacaacggcagcctgggcctgcagggcacagctgagctgctgcggctgagcaaggccctggctgatgtggtgatcccccaggagtatggcatcagccgggaggagaagctggagattgctgtgggcttctgcctgcccctgctgaggaagatcctgctggacctgcagaggacccatgaagatgagagcgtgaacaagctgcaccccctgtag

SEQ ID NO: 20514 - DNA, 417 bp, Artificial Sequence; identical to SEQ ID NO: 18355
  Description of Artificial Sequence: Synthetic coding sequence

SEQ ID NO: 20515 - DNA, 4302 bp, Artificial Sequence; identical to SEQ ID NO: 18796
  Description of Artificial Sequence: Synthetic coding sequence

SEQ ID NO: 20516 - DNA, 435 bp, Artificial Sequence
  Description of Artificial Sequence: Synthetic coding sequence
atggccgaggtgcaggtgctggtgctggatggccggggccacctgctgggccgcctggccgccatcgtggccaagcaggtgctgctgggcaggaaggtggtggtggtgcgctgtgagggcatcaacatcagcggcaacttctacagaaacaagctgaagtacctggccttcctgaggaagaggatgaacaccaaccccagccggggcccctaccacttccgggcccccagccgcatcttctggaggacagtgcggggcatgctgccccacaagaccaagaggggccaggccgccctggaccggctgaaggtgtttgatggcatccccccaccctacggcaaccggcccaggaggacctggaggaggaagctgaccaacacccagaggagcagccggcccacagacagctggagcgagcccaacaaggactgctag

SEQ ID NO: 20517 - DNA, 408 bp, Artificial Sequence
  Description of Artificial Sequence: Synthetic coding sequence
atggccgccctgcggcccctggtgaagcccaagatcgtgaagaagaggaccaagaagttcatccgccaccagagcgaccgctacgtgaagatcaagaggaactggaggaagccccggggcatcgacaacagagtgagaagacgcttcaagggccagatcctgatgcccaacatcggctacggcagcaacaagaagaccaagcacatgctgcccagcggcttcaggaagttcctggtgcacaacgtgaaggagctggaggtgctgctgatgtgcaacaagagctactgtgccgagatcgcccacaacgtgagcagcaagaacaggaaggccatcgtggagagagctgcccagctggccatccgggtgaccaaccccaatgcccggctgcggagtgaagaaaatgaatag

SEQ ID NO: 20518 - DNA, 408 bp, Artificial Sequence; identical to SEQ ID NO: 20517
  Description of Artificial Sequence: Synthetic coding sequence

SEQ ID NO: 20519 - DNA, 684 bp, Artificial Sequence
  Description of Artificial Sequence: Synthetic coding sequence
atggagccccagggctacccagccttcggctgggaccacagcctgcacaagaggaagaggctgccccctgtgaagaggagcctggtgtactacctgaagaaccgggaggtgcggctgcagaatgagaccagctacagccgggtgctgcacggctatgctgcccagcagctgcccagcctgctgaaggagcgggagttccacctgggcaccctgaacaaggtgtttgccagccagtggctgaaccaccggcaggtggtgtgtggcaccaagtgcaacaccctgtttgtggtggatgtgcagaccagccagatcaccaagatccccatcctgaaggaccgggagcctggaggagtgacccagcagggctgcggcatccacgccatcgagctgaaccccagcaggaccctgctggccactggaggagacaaccccaacagcctggccatctaccgcctgcccaccctggaccctgtgtgtgtgggagatgatggccacaaggactggatcttcagcatcgcctggatcagtgacaccatggctgtgtctggcagcagagatggctccatgggcctgtgggaggtgacagatgatgtgctgaccaagagtgatgcccggcacaacgtgtcccgggtgcctgtgtatgcccacatcacccacaaggccctgaaggacatccccaagtag

SEQ ID NO: 20520 - DNA, 1554 bp, Artificial Sequence
  Description of Artificial Sequence: Synthetic coding sequence
atgacccggctgggcaccgtgcccaggaaggccctggagatgagctgtgccatccagaaccagctggcccgcatcctggccgagtttgagatgaccctggagagagatgtgctgcagcccctgagccggctgtctgaggaggagctgcctgccatcctgaagcacaagaagagcctgcagaagctggtgtctgactggaacaccctgaagagccggctgagccaggccaccaagaacagcggcagcagccagggcctgggcggcagccctggcagccacagccacaccaccatggccaacaaggtggagaccctgaaggaggaggaggaggagctgaagaggaaggtggagcagtgcagagatgagtacctggccgacctgtaccactttgtgaccaaggaggacagctatgccaactacttcatccggctgctggagatccaggccgactaccacagaagaagcctgagcagcctggacacagccctggccgagctgcgggagaaccacggccaggccgaccacagccccagcatgacagccacccacttcccccgggtgtatggagtgtccctggccacccacctgcaggagctgggccgggagatcgccctgcccatcgaggcctgtgtgatgatgctgctgtctgagggcatgaaggaggagggcctcttccggctggccgccggggcctctgtgctgaagaggctgaagcagaccatggccagtgacccccacagcctggaggagttctgcagcgacccccatgctgtggccggggccctgaagagctacctgcgggagctgcctgagcccctgatgacctttgacctgtatgatgactggatgagagctgccagcctgaaggagcccggggcccggctgcaggccctgcaggaggtgtgcagccggctgcccccagagaacctgagcaacctgcgctacctgatgaagttcctggcccggctggccgaggagcaggaggtgaacaagatgacccccagcaacatcgccatcgtgctgggccccaacctgctgtggcccccagagaaggagggggaccaggcccagctggatgctgcctctgtgagcagcatccaggtggtgggcgtggtggaggccctgatccagagcgctgacaccctcttccctggggacatcaacttcaacgtgtctggcctcttctctgctgtgaccctgcaggacacagtgtctgaccggctggccagcgaggagctgcccagcacagctgtgcccaccccagccaccaccccagccccagccccagccccagccccagccccagccccagccctggccagcgctgccaccaaggagaggacagagagcgaggtgccccccaggcctgccagccccaaggtgaccaggagccccccagagacagctgcccctgtggaggacatggcccggcgcagccccaggggggccaccggcaggaaggagagatttgcctgcagctatggaacagacagcagcctggccgacatgttctttgtgcggctggtgaacaagctgttctggaccaagctgtag

SEQ ID NO: 20521 - DNA, 918 bp, Artificial Sequence; identical to SEQ ID NO: 18761
  Description of Artificial Sequence: Synthetic coding sequence

SEQ ID NO: 20522 - DNA, 927 bp, Artificial Sequence
  Description of Artificial Sequence: Synthetic coding sequence
atgattcatgatgcccagatggactactacggcacccggctggccacctgcagcagtgacagatctgtgaagatctttgatgtgagaaatggaggccagatcctgattgctgacctgcggggccacgagggccctgtgtggcaggtggcctgggcccaccccatgtatggcaacatcctggccagctgcagctatgacaggaaggtgatcatctggagagaagaaaatggcacctgggagaagagccatgaacatgctggccatgacagctctgtgaacagcgtgtgctgggcccctcatgactatggcctcatcctggcctgtggcagcagtgatggagccatcagcctgctgacctacacaggagagggccagtgggaggtgaagaagatcaacaatgcccacaccatcggctgcaatgctgtgtcctgggccccagctgtggtgcccggcagcctgattgaccaccccagcggccagaagcccaactacatcaagagatttgccagcggcggctgtgacaacctgatcaagctgtggaaggaggaggaggatggccagtggaaggaggagcagaagctggaggcccacagcgactgggtgagagatgtggcctgggcccccagcatcggcctgcccaccagcaccatcgccagctgcagccaggacggccgggtcttcatctggacctgtgatgatgccagcagcaacacctggagccccaagctgctgcacaagttcaatgatgtggtgtggcacgtgtcctggagcatcacagccaacatcctggccgtgtctggaggagacaacaaggtgaccctgtggaaggagagcgtggatggccagtgggtgtgcatcagtgatgtgaacaagggccagggctctgtgtctgcctctgtgacagagggccagcagaatgagcagtag

SEQ ID NO: 20523 - DNA, 1542 bp, Artificial Sequence
  Description of Artificial Sequence: Synthetic coding sequence
atgagcattgaaattgagagcagtgatgtgatccgcctcatcatgcagtacctgaaggagaacagcctgcaccgggccctggccaccctgcaggaggagaccaccgtgtccctgaacacagtggacagcattgagagctttgtggccgacatcaacagcggccactgggacacagtgctgcaggccatccagagcctgaagctgcctgacaagaccctgattgacctgtatgagcaggtggtgctggagctgattgagctgcgggagctgggcgccgcccggagcctgctgcggcagacagaccccatgatcatgctgaagcagacccagcctgagcgctacatccacctggagaacctgctggcccggagctactttgacccccgggaggcctacccagatggcagcagcaaggagaagagaagagctgccatcgcccaggccctggccggggaggtgtctgtggtgccccccagccggctgatggccctgctgggccaggccctgaagtggcagcagcaccagggcctgctgcccccaggcatgaccatcgacctcttccggggcaaggctgctgtgaaggatgtggaggaggagaagttccccacccagctgagccgccacatcaagtttggccagaagagccacgtggagtgtgcccgcttctccccagatggccagtacctggtgactggatctgtggatggcttcatcgaggtgtggaacttcaccaccgggaagatcaggaaggacctgaagtaccaggcccaggacaacttcatgatgatggatgatgctgtgctgtgcatgtgcttcagccgggacacagagatgctggccactggagcccaggacggcaagatcaaggtgtggaagatccagagcggccagtgcctgcggagatttgagcgggcccacagcaagggcgtgacctgcctgtccttcagcaaggacagcagccagatcctgagcgccagctttgaccagaccatccgcatccacggcctgaagagcggcaagaccctgaaggagttccggggccacagcagctttgtgaatgaggccaccttcacccaggacggccactacatcatcagcgccagcagtgatggcaccgtgaagatctggaacatgaagaccacagagtgcagcaacaccttcaagagcctgggcagcacagctggaacagacatcaccgtgaacagcgtcatcctgctgcccaagaaccctgagcactttgtggtgtgcaacagaagcaacacagtggtgatcatgaacatgcagggccagatcgtgcgctccttcagcagcggcaagcgggagggcggggactttgtgtgctgtgccctgagccccagaggagagtggatctactgtgtgggggaggactttgtgctgtactgcttcagcacagtgacaggcaagctggagaggaccctgactgtgcatgagaaggatgtgattggcatcgcccaccacccccaccagaacctgattgccacctacagtgaagatggcctgctgaagctgtggaagccctag

SEQ ID NO: 20524 - DNA, 2136 bp, Artificial Sequence
  Description of Artificial Sequence: Synthetic coding sequence
atgagctctgtgcagagccagcaggagcagctgagccagagcgaccccagccccagccccaacagctgcagcagctttgagctgattgacatggatgctggcagcctgtatgagcctgtgagcccccactggttctactgcaagatcatcgacagcaaggagacctggatccccttcaacagcgaggacagccagcagctggaggaggcctacagcagcggcaagggctgcaatggccgggtggtgcccacagatggcggccgctatgatgtgcacctgggggagaggatgagatatgctgtgtactgggatgagctggccagcgaggtgcggcgctgcacctggttctacaagggggacaaggacaacaagtatgtgccctacagcgagagcttcagccaggtgctggaggagacctacatgctggccgtgaccctggatgagtggaagaagaagctggagagccccaaccgggagatcatcatcctgcacaaccccaagctgatggtgcactaccagcctgtggccggcagtgatgactggggcagcacccccacagagcagggccggcccaggacagtgaagaggggcgtggagaacatctctgtggacatccactgtggggagcccctgcagattgaccacctggtgtttgtggtgcatggaattggccctgcctgtgacctgcgcttccgcagcatcgtgcagtgtgtgaatgacttccgctctgtgtccctgaacctgctgcagacccacttcaagaaggcccaggagaaccagcagatcggccgggtggagttcctgcctgtgaactggcacagccccctgcacagcactggagtggatgtggacctgcagaggatcaccctgcccagcatcaaccggctgcggcacttcaccaatgacaccatcctggatgtgttcttctacaacagccccacctactgccagaccatcgtggacacagtggccagcgagatgaaccgcatctacaccctcttcctgcagagaaatccagacttcaagggcggcgtgtccattgctggccacagcctgggcagcctcatcctgtttgacatcctgaccaaccagaaggacagcctgggggacattgattctgagaaggacagcctgaacatcgtgatggaccagggcgacacccccaccctggaggaggacctgaagaagctgcagctgtctgagttctttgacatctttgagaaggagaaggtggacaaggaggccctggccctgtgcacagaccgggacctgcaggagatcggcatccccctgggccccaggaagaagatcctgaactacttcagcaccaggaagaacagcatgggcatcaagaggcctgccccccagcctgccagcggggccaacatccccaaggagagcgagttctgcagcagcagcaacaccagaaatggagactacctggatgtgggcatcggccaggtgtctgtgaagtaccccaggctcatctacaagccagagatcttctttgccttcggcagccccatcggcatgttcctgactgtgcggggcctgaagagaattgaccccaactaccgcttccccacctgcaagggcttcttcaacatctaccacccctttgatcctgtggcctacagaattgagcccatggtggtgcctggggtggagtttgagcccatgctgatcccccaccacaagggcaggaagaggatgcacctggagctgcgggagggcctgaccaggatgtccatggacctgaagaacaacctgctgggcagcctgaggatggcctggaagagcttcacccgggccccctacccagccctgcaggccagcgagaccccagaggagacagaggccgagcctgagagcaccagcgagaagcccagtgatgtgaacacagaggagacctctgtggccgtgaaggaggaggtgctgcccatcaacgtgggcatgctgaatggaggccagagaattgattatgtgctgcaggagaagcccatcgagagcttcaatgagtacctgtttgccctgcagagccacctgtgctactgggagagcgaggacacagtgctgctggtgctgaaggagatctaccagacccagggcatcttcctggaccagcccctgcagtag

SEQ ID NO: 20525 - DNA, 3351 bp, Artificial Sequence; identical to SEQ ID NO: 19573
  Description of Artificial Sequence: Synthetic coding sequence

SEQ ID NO: 20526 - DNA, 1233 bp, Artificial Sequence
  Description of Artificial Sequence: Synthetic coding sequence
atgcagaacatccacggcaaggagattgacctgctgcggaccaccgtgaaggtgcctgggaagaggctgccccgggccaccccagccacagcccctggcaccagcccccgggccaacggcctgtctgtggagaggagcaacacccagctgggcggcggcacagccagcggccctgctgaggtgctgagcagcagccccaagctggaccccccacccagcccccacagcaacaggaagaagcacaggaggaagaagagcacaggcacccccaggccagatggccccagcagcgccacagaggaggccgaggagagctttgaatttgtggtggtgtccctgaccggccagacctggcactttgaggccagcacagctgaggagcgggagctgtgggtgcagagcgtgcaggcccagatcctggccagcctgcagggctgccgcagcgccaaggacaagacccggctgggcaaccagaatgctgccctggccgtgcaggccgtgaggacagtgcggggcaacagcttctgcatcgactgtgatgcccccaacccagactgggccagcctgaacctgggcgccctgatgtgcatcgagtgcagcggcatccaccgccacctgggcgcccacctgagccgggtgcgcagcctggacctggatgactggcccccagagctgctggccgtgatgacagccatgggaaatgccctggccaacagcgtgtgggagggcgccctgggcggctacagcaagccaggcccagatgcctgccgggaggagaaggagcgctggatccgggccaagtatgagcagaagctgttcctggcccccctgcccagcagtgatgtgcccctgggccagcagctgctgcgggctgtggtggaggatgacctgcggctgctggtgatgctgctggcccacggcagcaaggaggaggtgaatgagacctatggagatggagatggccgcacagccctgcacctgagcagcgccatggccaacgtggtgttcacccagctgctgatctggtatggagtggatgtgcgcagcagagatgcccggggcctgacccccctggcctatgcccggcgggccggcagccaggagtgtgccgacatcctgatccagcacggctgccctggagagggctgcggcctggcccccacccccaaccgggagcccgccaacggcaccaaccccagcgctgagctgcacaggagccccagcctgctgtag

SEQ ID NO: 20527 - DNA, 492 bp, Artificial Sequence
  Description of Artificial Sequence: Synthetic coding sequence
atgtctgacagccctgctggcagcaaccccaggaccccagagagcagcggcagcggcagcggcggcggcggcaagaggcctgctgtgcctgctgctgtgtccctgctgcccccagctgaccccctgcggcaggccaaccggctgcccatccgggtgctgaagatgctgagcgcccacacaggccacctgctgcaccctgagtacctgcagcccctgagcagcacccctgtgagccccatcgagctggatgccaagaagagccccctggccctgctggcccagacctgcagccagatcggcagccctggcagcctgagcctgaggaacccccacaccctgggcctgagccgctaccacccctacggcaagagccacctgagcacagctgggggcctggccgtgcccagcctgcccacagctggcccctactacagcccctatgccctgtatggccagaggctggccagcgccagcgccctgggctaccagtag

SEQ ID NO: 20528 - DNA, 2736 bp, Artificial Sequence
  Description of Artificial Sequence: Synthetic coding sequence
atgaacttccaggccggcggcggccagagcccccagcagcagcagagcctggccgcccctgggggcggcggggccgccgcccagcagctggtgtgtggcggccagtttggaggagctggccctggagctgggggcggcggcggccccagccagcagctggccggcggccccccccagcagtttgccctgagcaacagcgctgccatccgggcagagatccagagatttgagagcgtgcaccccaacatctatgccatctatgacctgattgaaagaattgaggacctggccctgcagaaccagatccgggagcacgtgatcagcattgaggacagctttgtgaacagccaggagtggaccctgagccgctctgtgcctgagctgaaggtgggcatcgtgggcaacctgagcagcggcaagagcgccctggtgcaccgctacctgaccggcacctacgtgcaggaggagagccctgagggcggccgcttcaagaaggagatcgtggtggatggccagagctacctgctgctgatcagagatgagggcggccccccagagctgcagtttgctgcctgggtggatgctgtggtgtttgtgttcagcctggaggatgagatctccttccagacagtgtacaactacttcctgcggctgtgcagcttcagaaatgccagcgaggtgcccatggtgctggtgggcacccaggatgccatctctgctgccaacccccgggtgattgatgacagccgggccaggaagctgagcacagacctgaagcgctgcacctactatgagacctgtgccacctacggcctgaatgtggagagggtcttccaggatgtggcccagaaggtggtggccctgaggaagaagcagcagctggccatcggcccctgcaagagcctgcccaacagccccagccacagcgctgtgtctgctgccagcatcccagctgtgcacatcaaccaggccaccaacggcggcggcagcgccttcagtgactacagcagctctgtgcccagcacccccagcatcagccagcgggagctgcgcatcgagaccatcgccgccagcagcacccccacccccatcaggaagcagagcaagaggaggagcaacatcttcaccagcaggaaaggagctgacctggaccgggagaagaaggctgctgagtgcaaggtggacagcatcggcagcggccgggccatccccatcaagcagggcatcctgctgaagaggtctgggaagagcctgaacaaggagtggaagaagaagtatgtgaccctgtgtgacaatggcctgctgacctaccaccccagcctgcatgactacatgcagaacatccacggcaaggagattgacctgctgcggaccaccgtgaaggtgcctgggaagaggctgccccgggccaccccagccacagcccctggcaccagcccccgggccaacggcctgtctgtggagaggagcaacacccagctgggcggcggcaccggggccccccacagcgccagcagcgccagcctgcacagcgagcggcccctgagcagcagcgcctgggccggccccaggcctgagggcctgcaccagaggagctgcagcgtgtcctctgctgaccagtggagcgaggccaccaccagcctgcccccaggcatgcagcacccagccagcggccctgctgaggtgctgagcagcagccccaagctggaccccccacccagcccccacagcaacaggaagaagcacaggaggaagaagagcacaggcacccccaggccagatggccccagcagcgccacagaggaggccgaggagagctttgaatttgtggtggtgtccctgaccggccagacctggcactttgaggccagcacagctgaggagcgggagctgtgggtgcagagcgtgcaggcccagatcctggccagcctgcagggctgccgcagcgccaaggacaagacccggctgggcaaccagaatgctgccctggccgtgcaggccgtgaggacagtgcggggcaacagcttctgcatcgactgtgatgcccccaacccagactgggccagcctgaacctgggcgccctgatgtgcattgaatgttctggcatccaccgccacctgggcgcccacctgagccgggtgcgcagcctggacctggatgactggcccccagagctgctggccgtgatgacagccatgggaaatgccctggccaacagcgtgtgggagggcgccctgggcggctacagcaagccaggcccagatgcctgccgggaggagaaggagcgctggatccgggccaagtatgagcagaagctgttcctggcccccctgcccagcagtgatgtgcccctgggccagcagctgctgcgggctgtggtggaggatgacctgcggctgctggtgatgctgctggcccacggcagcaaggaggaggtgaatgagacctatggagatggagatggccgcacagccctgcacctgagcagcgccatggccaacgtggtgttcacccagctgctgatctggtacggcgtggatgtgcgcagcagagatgcccggggcctgacccccctggcctatgccaggagagctggcagccaggagtgtgccgacatcctgatccagcacggctgccctggagagggctgcggcctggcccccacccccaaccgggagcccgccaacggcaccaaccccagcgctgagctgcacaggagccccagcctgctgtag

SEQ ID NO: 20529 - DNA, 1059 bp, Artificial Sequence; identical to SEQ ID NO: 20256
  Description of Artificial Sequence: Synthetic coding sequence

SEQ ID NO: 20530 - DNA, 507 bp, Artificial Sequence
  Description of Artificial Sequence: Synthetic coding sequence
atgacagccaccctgcggccctacctgtctgctgtgcgggccaccctgcaggccgccctgtgcctggagaacttcagcagccaggtggtggagcggcacaacaagccagaggtggaggtgcgcagcagcaaggagctgctgctgcagcctgtgaccatcagcagaaatgagaaggagaaggtgctgattgagggcagcatcaacagcgtgcgggtgtccattgctgtgaagcaggctgatgaaattgagaagatcctgtgccacaagttcatgaggttcatgatgatgagagctgagaacttcttcatcctgcggaggaagcctgtggagggctatgacatctccttcctgatcaccaacttccacacagagcagatgtacaagcacaagctggtggactttgtgatccacttcatggaggagattgacaaggagatcagcgagatgaagctgtctgtgaatgcccgggccagaattgtggccgaggagttcctgaagaacttctag

SEQ ID NO: 20531 - DNA, 993 bp, Artificial Sequence
  Description of Artificial Sequence: Synthetic coding sequence
atggagcgcttcatggagcaggtggtgttcaagtacctgcgggcagagcctgaggaccactacttcctgatgacagagccccccctgaacaccccagaaaatcgggagtacctggccgagatcatgtttgagagcttcaacgtgcccggcctgtacatcgctgtgcaggccgtgctggccctggccgcctcctggaccagccggcaggtgggggagaggaccctgaccggcatcgtcatcgacagcggagatggagtgacccacgtgattcctgtggccgagggctacgtgattggcagctgcatcaagcacatccccatcgccggccgggacatcacctacttcatccagcagctgctgcgggagcgggaggtgggcatccccccagagcagagcctggagacagccaaggccatcaaggagaagtactgctacatctgcccagacatcgtgaaggagtttgccaagtatgatgtggaccccaggaagtggatcaagcagtacacaggcatcaatgccatcaaccagaagaagtttgtgattgatgtgggctatgagcgcttcctgggccctgagatcttcttccaccctgagtttgccaacccagacttcatggagagcatcagtgatgtggtggatgaagtcatccagaactgccccattgatgtgcggcggcccctgtacaagaatgtggtgctgagcggcggcagcaccatgttccgggactttggaagaaggctgcagagggacctgaagagggtggtggatgcccggctgcggctgtctgaggagctgagcggcggccgcatcaagcccaagcctgtggaggtgcaggtggtgacccaccacatgcagagatatgctgtgtggtttggaggctccatgctggccagcaccccagagttcttccaggtgtgccacaccaagaaggactatgaggagtatggccccagcatctgccgccacaaccctgtgtttggagtgatgtcctag

SEQ ID NO: 20532 - DNA, 894 bp, Artificial Sequence
  Description of Artificial Sequence: Synthetic coding sequence
atgaagaccctgagcccagaccgcatccagccccacatcatgacagatgtgcctgccaccttcacccaggctgaatgtaatggagacaagcccccagaaaatggccagcagaccatcaccaagatcagcgaggagctgacagatgtggacagccccctgccccactacagagtggagcccagcctggagggcgccctgaccaagggcagccaggaggagaggaggaagctgcagggcaacatgctgctgaacagctccatggaggacaagatgctgaaggagaaccctgaggagaagctgttcatcgtgcacaaggccatcacagacctgagcctgcaggagaccagcgcagatgagatgaccttccgggagggccaccagtgggagaagatccccctgagcggcagcaaccaggagatccggcggcagaaggagcgcatcacagagcagcccctgaaggaggaggaggatgaggacaggaagaacaagggccaccaggccgctgagattgagtggctgggcttcaggaagcccagccaggccgacatgctgcacagcaagcatgatgaggagcagaaggtgtgggatgaggagattgatgatgatgatgatgacaactgcaacaatgatgaagatgaggtgcgggtgattgagttcaagaagaagcatgaggaggtgtcccagttcaaggaggagggagatgccagcgaggacagccccctgagcagcgccagcagccaggccgtgaccccagatgagcagcccaccctgggcaagaagagtgacatcagcagaaatgcctacagccgctacaacaccatctcctacaggaagatcagaaaaggaaacaccaagcagagaattgatgaatttgagagcatgatgcacctgtag

SEQ ID NO: 20533 - DNA, 1074 bp, Artificial Sequence
  Description of Artificial Sequence: Synthetic coding sequence
atggtgcagcccttcaccaccatccccttccccccaccaccccagaatggcatccccacagaatatggagtgccccacacccaggactatgccggccagacaggagagcacaacctgaccctgtatggcagcacccaggcccacggggagcagagcagcaacagccccagcacccagaatggcagcctgacccagacagagggcggggcccagacagatggccagcagagccagacccagagcagtgaaaattctgagagcaagagcacccccaagaggctgcacgtgagcaacatccccttccgcttccgggaccctgacctgcggcagatgtttggccagtttgggaagatcctggatgtggagatcatcttcaatgaaagaggcagcaaaggatttggatttgtgacctttgaaaattctgcagatgctgaccgggcccgggagaagctgcacggcaccgtggtggagggcaggaagattgaggtgaacaatgccacagcccgggtgatgaccaacaagaagatggtgaccccctatgccaacggctggaagctgagccctgtggtgggcgctgtgtatggccctgagctgtatgctgccagcagcttccaggctgatgtgtccctgggcaatgatgctgctgtgcccctgagcggccggggcggcatcaacacctacatccccctcatcatccctggcttcccctaccccacagctgccaccacagctgctgccttccggggggcccacctgcggggccggggccgcacagtgtatggagctgtgcgggctgtgcccccaacagccatcccagcctacccaggagtggtgtaccaggacggcttctacggggctgacctgtatggaggctatgctgcctaccgctatgcccagcctgccacagccacagctgccacagctgctgctgctgctgctgctgcctacagtgatggctacggccgggtgtacacagctgacccctaccacgccctggccccagctgccagctatggagtgggcgctgtggccagcctgtacagaggaggctacagcagatttgccccctactag

SEQ ID NO: 20534 - DNA, 387 bp, Artificial Sequence
  Description of Artificial Sequence: Synthetic coding sequence
atggtgcagcccttcaccaccatccccttccccccaccaccccagaatggcatccccacagaatatggagtgccccacacccaggactatgccggccagacaggagagcacaacctgaccctgtatggcagcacccaggcccacggggagcagagcagcaacagccccagcacccagaatggcagcctgaccacagaaggaggagcccagacagatggccagcagagccagacccagagcagcgagaacagcgagagcaagagcacccccaagaggctgcacgtgagcaacatccccttccgcttccgggaccctgacctgcggcagatgtttggatttgggaagatcctggatgtggagatcatcttcaatgaaagaggcagctag

SEQ ID NO: 20535 - DNA, 1071 bp, Artificial Sequence
  Description of Artificial Sequence: Synthetic coding sequence
atgcagggcatcctgctgctggtgtttgccaagtaccagcacctgccctacatccagatcctgagcaccaagagcacccccaccggcctgtttggctactggggcaacaagggcggcgtgaacatctgcctgaagctgtatggctactacgtgtccatcatcaactgccacctgcccccccacatcagcaacaactaccagaggctggagcactttgaccgcatcctggagatgcagaactgtgagggccgggacatccccaacatcctggaccatgacctgatcatctggtttggagacatgaacttcagaattgaggactttggcctgcactttgtgcgggagagcatcaagaaccgctgctacggcggcctgtgggagaaggaccagctgagcatcgccaagaagcatgaccccctgctgcgggagttccaggagggccgcctgctcttcccccccacctacaagtttgacaggaacagcaatgactatgacaccagcgagaagaagaggaagccagcctggacagaccgcatcctgtggaggctgaagaggcagccctgtgccggccctgacacccccatccccccagccagccacttcagcctgagcctgcggggctacagcagccacatgacctacggcatcagtgaccacaagcctgtgtctggcacctttgacctggagctgaagcccctggtgtctgcccccctgattgtgctgatgcctgaggacctgtggacagtggagaatgacatgatggtgtcctacagcagcaccagtgacttccccagcagcccctgggactggattggcctgtacaaggtgggcctgagagatgtgaatgactatgtgtcctatgcctgggtgggggacagcaaggtgtcctgcagcgacaacctgaaccaggtgtacatcgacatcagcaacatccccaccacagaagatgagttcctgctgtgctactacagcaacagcctgcggtctgtggtgggcatcagccggcccttccagatccccccaggcagcctgcgggaggaccccctgggggaggcccagccccagatctag

SEQ ID NO: 20536 - DNA, 1752 bp, Artificial Sequence; identical to SEQ ID NO: 19484
  Description of Artificial Sequence: Synthetic coding sequence

SEQ ID NO: 20537 - DNA, 1329 bp, Artificial Sequence
  Description of Artificial Sequence: Synthetic coding sequence
atggccaacagctttgctgcccgcatcttcaccaccctgagtgacctgcagaccaacatggccaacctgaaggtgattggcatcgtcatcggcaagacagatgtgaagggcttcccagacaggaagaacatcggcagcgagcgctacaccttctccttcaccatccgggacagccctgcccactttgtgaatgctgcctcctggggcaatgaagactacatcaagagcctgagtgacagcttccgggtgggggactgtgtgatcatcgagaaccccctcatccagaggaaggagattgagcgggaggagaagttctccccagccacccccagcaactgcaagctgctgctgtctgagaaccacagcacagtgaaggtgtgcagcagctatgaggtggacaccaagctgctgagcctcatccacctgcctgtgaaggagagccatgactactacagcctgggggacatcgtggccaacggccacagcctgaatggccgcatcatcaacgtgctggccgctgtgaagtctgtgggggagcccaagtacttcaccaccagtgacaggaggaagggccagagatgtgaggtgcggctgtatgatgaaacagagagcagctttgccatgacctgctgggacaatgaaagcatcctgctggcccagagctggatgccccgggagaccgtcatctttgccagtgatgtgcgcatcaactttgacaagttcaggaactgcatgacagccaccgtcatcagcaagaccatcatcaccaccaacccagacatccctgaggccaacatcctgctgaacttcatccgggagaacaaggagaccaacgtgctggatgatgaaattgacagctacttcaaggagagcatcaacctgagcaccatcgtggatgtgtacacagtggagcagctgaagggcaaggccctgaagaatgaaggcaaggctgaccccagctatggcatcctgtatgcctacatcagcaccctgaacattgatgatgagaccaccaaggtggtgaggaaccgctgcagcagctgtggctacatcgtgaatgaggccagcaacatgtgcaccacctgcaacaagaacagcctggacttcaagtctgtgttcctgtccttccacgtgctgattgacctgacagaccacacaggcaccctgcacagctgcagcctgactggatctgtggccgaggagaccctgggctgcacctttgtgctgagccaccgggcccggagcggcctgaagatctctgtgctgagctgcaagctggccgaccccacagaggccagcaggaacctgagcggccagaagcacgtgtag

SEQ ID NO: 20538 - DNA, 627 bp, Artificial Sequence
  Description of Artificial Sequence: Synthetic coding sequence
atggccggcacagcccggcatgaccgggagatggccatccaggccaagaagaagctgaccacagccacagaccccatcgagcggctgcggctgcagtgcctggcccggggcagcgctggcatcaagggcctgggccgggtcttccgcatcatggatgatgacaacaacagaaccctggacttcaaggagttcatgaagggcctgaatgactatgctgtggtgatggagaaggaggaggtggaggagctgttcagaagatttgacaaggatggaaatggcaccatcgacttcaatgagttcctgctgaccctgcggccccccatgagccgggccaggaaggaggtgatcatgcaggccttcaggaagctggacaagacaggagatggagtcatcaccatcgaggacctgcgggaggtgtacaatgccaagcaccaccccaagtaccagaatggagagtggagcgaggagcaggtgttcaggaagttcctggacaactttgacagcccctatgacaaggatggcctggtgaccccagaggagttcatgaactactatgctggggtgtctgccagcattgacacagatgtgtacttcatcatcatgatgaggacagcctggaagctgtag

SEQ ID NO: 20539 - DNA, 627 bp, Artificial Sequence; identical to SEQ ID NO: 20538
  Description of Artificial Sequence: Synthetic coding sequence

SEQ ID NO: 20540 - DNA, 789 bp, Artificial Sequence
  Description of Artificial Sequence: Synthetic coding sequence
cacagctacagcgagggcctgggccacccccgggtgtcccaggccctggtgaccttccaccagcagaagcccatcgagccccggcgggagctgctgacccagccctgccggcagaaggaccctgccaacgtggactatgaagatctcttcctgtacagcaatgctgtggccgaggaggccgcctgccctgtgtctgcccctgaggaggccagccccaagcctgtgctgtgccaccagagcaaggagaggaagcccagcgctgagatgaaccgcatcaccaccaaggaggccaccagcagctgcccccccaagagccccctgggggagacccggcagaagctgtggaggagcctgaagatgctgcctgagcggggccagagggtgcggcagcagaagagccacctggccaccgtgaacctgagcagcctgctggatgtgagaagaagcaccgtcatcagcggccctggcaccgggaagggcagccaggaccacagcggggaccccaccagcggggaccggggctacacagacccctgtgtggccaccagcctgaagagccccagccagccccaggcccccaaggacaggaaggtgcccaccaggaaggccgagaggtctgtgtcctgcatcgaggtgacccctggggaccgctcctggcaccagatggtggtgcgggccctgagcagccaggagagcaagccagagcaccagggcctggccgagccagaaaatgaccagctgcctgaggagtaccagcagcccccaccatttgcccctggctactgctag

SEQ ID NO: 20541 - DNA, 1941 bp, Artificial Sequence
  Description of Artificial Sequence: Synthetic coding sequence
atgagctacacaggctttgtgcagggcagcgagaccaccctgcagagcacctacagcgacaccagcgcccagcccacctgtgactatggctacggcacctggaacagcggcaccaacagaggctatgagggctacggctacggctacggctacggccaggacaacaccaccaactacggctacggcatggccaccagccacagctgggagatgcccagcagtgacaccaatgccaacaccagcgccagcggcagcgccagcgctgacagcgtgctgagccgcatcaaccagaggctggacatggtgccccacctggagacagacatgatgcagggcggcgtgtatggcagcggcggggagagatatgacagctatgagagctgtgacagcagagctgtgctgtctgagcgggacctgtaccgcagcggctatgactacagcgagctggaccctgagatggagatggcctatgagggccagtatgatgcctacagagaccagttcaggatgagaggaaatgacaccttcggcccccgggcccagggctgggccagagatgcccggagcggccggcccatggccagcggctacggccgcatgtgggaggaccccatgggcgcccggggccagtgcatgtctggggccagccggctgcccagcctcttcagccagaacatcatcccagaatatggcatgttccagggcatgaggggcggcggggccttccctgggggcagccgcttcggcttcggctttggaaatggcatgaagcagatgaggaggacctggaagacctggaccacagctgacttccgcaccaagaagaagaagaggaagcagggcggcagcccagatgagccagacagcaaggccaccaggacagactgcagcgacaacagcgacagcgacaatgatgagggcacagaaggagaggccacagagggcctggagggcacagaagctgtggagaagggcagccgggtggatggagaagatgaggagggcaaggaggatggccgggaggagggcaaggaggaccctgagaagggggccctgaccacccaggatgaaaatggccagaccaagaggaagctgcaggccggcaagaagagccaggacaagcagaagaagaggcagagggacaggatggtggagcgcatccagtttgtgtgcagcctgtgcaagtaccgcaccttctatgaagatgagatggccagccacctggacagcaagttccacaaggagcacttcaagtatgtgggcaccaagctgcccaagcagacagctgacttcctgcaggagtatgtgaccaacaagaccaagaagacagaggagctgaggaagacagtggaggacctggatggcctcatccaccagatctacagagaccaggacctgacccaggagatcgccatggagcactttgtgaagaaggtggaggccgcccactgtgccgcctgtgacctcttcatccccatgcagtttggcatcatccagaagcacctgaagaccatggaccacaacagaaacagaaggctgatgatggagcagagcaagaagagcagcctgatggtggcccggagcatcctgaacaacaagctgatcagcaagaagctggagcgctacctgaagggggagaaccccttcacagacagccctgaggaggagaaggagcaggaggaggccgagggcggggccctggatgagggcgcccagggcgaggccgccggcatcagcgagggcgctgagggcgtgcctgcccagccccctgtgcccccagagcccgcccctggagctgtgagccccccacctcctcctcctcctgaggaggaggaggagggcgctgtgcccctgctgggcggggccctgcagaggcagatccggggcatccctggcctggatgtggaggatgatgaggagggcggcggcggggccccctag

SEQ ID NO: 20542 - DNA, 1401 bp, Artificial Sequence
  Description of Artificial Sequence: Synthetic coding sequence
atgaggggccccaacagcggcacagagaagggccgcctggtgattcctgagaagcagggctttgacttcctgtgcatgcctgtgttccacccccgcttcaagcgggagttcatccaggagcccgccaagaaccggcccggcccccagaccaggagtgacctgctgctgagcggccgggactggaacaccctgattgtgggcaagctgagcccctggatccggccagacagcaaggtggagaagatcagaagaaacagcgaggccctggaggtgcagttcatcatcaccggcaccaaccaccacagcgagaaggagttctgcagctacctgcagtacctggagtacctgagccagaacagacctcctccaaatgcctatgagctgtttgccaagggctatgaggactacctgcagagccccctgcagcccctgatggacaacctggagagccagacctatgaggtgtttgagaaggaccccatcaagtacagccagtaccagcaggccatctacaagtgcctgctggacagagtgcctgaggaggagaaggacaccaacgtgcaggtgctgatggtgctgggcgccggccggggccccctggtgaatgccagcctgcgggccgccaagcaggccgaccggcgcatcaagctgtatgctgtggagaagaaccccaatgctgtggtgaccctggagaactggcagtttgaggagtggggcagccaggtgacagtggtgtccagtgacatgagggagtgggtggcccctgagaaggctgacatcatcgtgtctgagctgctgggcagctttgctgacaatgagctgagcccagaatgtctggatggagcccagcacttcctgaaggatgatggagtgtccatccctggagagtacaccagcttcctggcccccatcagcagcagcaagctgtacaatgaggtgcgggcctgccgggagaaggaccgggaccctgaggcccagtttgagatgccctacgtggtgcggctgcacaacttccaccagctgagcgccccccagccctgcttcaccttcagccaccccaacagagaccccatgattgacaacaaccgctactgcaccctggagttccctgtggaggtgaacacagtgctgcacggctttgctggctactttgagaccgtgctgtaccaggacatcaccctgagcatccggcctgagacccacagccctggcatgttctcctggttccccatcctcttccccatcaagcagcccatcaccgtgcgggagggccagaccatctgtgtgcgcttctggcgctgcagcaacagcaagaaggtgtggtatgagtgggccgtgacagcccctgtgtgcagcgccatccacaaccccaccggccgcagctacaccatcggcctgtag

SEQ ID NO: 20543 - DNA, 1863 bp, Artificial Sequence
  Description of Artificial Sequence: Synthetic coding sequence
atgaggggccccaacagcggcacagagaagggccgcctggtgattcctgagaagcagggctttgacttcctgtgcatgcctgtgttccacccccgcttcaagcgggagttcatccaggagcccgccaagaaccggcccggcccccagaccaggagtgacctgctgctgagcggccgggactggaacaccctgattgtgggcaagctgagcccctggatccggccagacagcaaggtggagaagatcagaagaaacagcgaggccgccatgctgcaggagctgaactttggagcctacctgggcctgcctgccttcctgctgcccctgaaccaggaggacaacaccaacctggcccgggtgctgaccaaccacatccacacaggccaccacagctccatgttctggatgagggtgcccctggtggcccctgaggacctgagagatgacatcattgaaaatgcccccaccacccacacagaggagtacagcggggaggagaagacctggatgtggtggcacaacttccgcaccctgtgtgactacagcaagagaattgctgtggccctggagattggagctgacctgcccagcaaccacgtgattgaccgctggctgggggagcccatcaaggccgccatcctgcccaccagcatcttcctgaccaacaagaagggcttccctgtgctgagcaagatgcaccagaggctcatcttccggctgctgaagctggaggtgcagttcatcatcaccggcaccaaccaccacagcgagaaggagttctgcagctacctgcagtacctggagtacctgagccagaacagacctcctccaaatgcctatgagctgtttgccaagggctatgaggactacctgcagagccccctgcagcccctgatggacaacctggagagccagacctatgaggtgtttgagaaggaccccatcaagtacagccagtaccagcaggccatctacaagtgcctgctggacagagtgcctgaggaggagaaggacaccaacgtgcaggtgctgatggtgctgggcgccggccggggccccctggtgaatgccagcctgcgggccgccaagcaggccgaccggcgcatcaagctgtatgctgtggagaagaaccccaatgctgtggtgaccctggagaactggcagtttgaggagtggggcagccaggtgacagtggtgtccagtgacatgagggagtgggtggcccctgagaaggctgacatcatcgtgtctgagctgctgggcagctttgctgacaatgagctgagcccagaatgtctggatggagcccagcacttcctgaaggatgatggagtgtccatccctggagagtacaccagcttcctggcccccatcagcagcagcaagctgtacaatgaggtgcgggcctgccgggagaaggaccgggaccctgaggcccagtttgagatgccctacgtggtgcggctgcacaacttccaccagctgagcgccccccagccctgcttcaccttcagccaccccaacagagaccccatgattgacaacaaccgctactgcaccctggagttccctgtggaggtgaacacagtgctgcacggctttgctggctactttgagaccgtgctgtaccaggacatcaccctgagcatccggcctgagacccacagccctggcatgttctcctggttccccatcctcttccccatcaagcagcccatcaccgtgcgggagggccagaccatctgtgtgcgcttctggcgctgcagcaacagcaagaaggtgtggtatgagtgggccgtgacagcccctgtgtgcagcgccatccacaaccccaccggccgcagctacaccatcggcctgtag

SEQ ID NO: 20544 - DNA, 2271 bp, Artificial Sequence
  Description of Artificial Sequence: Synthetic coding sequence
atgcccagcgtgtccaaggctgctgctgctgccctgagcggcagccccccccagacagagaagcccacccactaccgctacctgaaggagttcagaacagagcagtgccccctcttcagccagcacaagtgtgcccagcaccggcccttcacctgcttccactggcacttcctgaaccagaggagaagaagacccctgcggaggagagatggcaccttcaactacagcccagatgtgtactgcagcaagtacaatgaggccaccggggtgtgcccagatggagatgagagcctgctgggcgtgctgtaccccctgtgggcccctcctcctgtgcctgcccctgtgggcgcccccaccgtgcaccccttcctggcccgctggttcagccacgtgccctgggagcccgccggcagcgctgacccccgggccagcagcaccccagctgggggcaccacctgggccaccggcctgctgggggactttgatgcctgtggcagccagagccgggagtgtgtgaagggcgtgtggtggaccctgctgggcttccgctgcccctacctgcacaggaccactggagacacagagaggaagtaccacctgcgctactacaagacaggcacctgcatccacgagacagatgcccggggccactgtgtgaagaatggcctgcactgtgcctttgcccacggccccctggacctgcggccccctgtgtgtgatgtgcgggagctgcaggcccaggaggccctgcagaatggccagctgggcggcggggagggcgtgcctgacctgcagcccggggtgctggccagccaggccatgattgagaagatcctgtctgaggacccccgctggcaggccctgctgcctgtggccctgctgcggcaccgggtggcccacttcagtgatgccaactttgtgctgggcagctacaagacagagcagtgccccaagccaccccggctgtgccggcagggctacgcctgcccccactaccacaacagccgggacagaagaagaaacccccggcgcttccagtaccgcagcaccccctgccccagcgtgaagcatggagatgagtggggcgagcccagccgctgtgatggaggagatggctgccagtactgccacagcaggacagagcagcagttccaccctgagggccctgtgggcagccctgtgtctggggccttctctgtgttcagccacgccggcctggtggccgaccccagcctgtggtacccagctgagtggagctggcaccacgtgggccacagcaggaccatcaaccctgagggggacaagcccagccggctgggccctgcccctgagaacatcaagagaggaaatgactttgcctgtgatggccgggcagatgctgctggcatggccccccacgtgtgtgtgttccccatctacaagagcaccaagtgcaatgacatgaggcagacaggctactgcccccggggccccttctgtgcctttgcccacgtggagaagagcctgggcatggtgaatgagtggggctgccacgacctgcacctgaccagccccagcagcactggaagtggccagcctggaaatgccaagagaagagacagccctgctgagggcggcccccggggcagcgagcaggacagcaagcagggcgtgcgggcccacggcgtgtatgtgtttgagcagaaccacctggccgtgtttgctgctgtgcaccccccagcccccagcgtgagcagctctgtggccagcagcctggccagcagcgctggcagcggcagcagcagccccacagccctgcctgcccccccagcccgggccctgcccctgggccctgccagcagcacagtggaggccgtgctggccctggagcccacccccagcagccccaccagcagcgctgtgcagggcgtggccggggagctgggcatgggcagcggcggccagggctgctggagccacgtggtgggcgccctggccgctgtgcctgcctggacccacagcggggacctggagtgggaccccagcaccatccgcaccagggtgaatgtgggcggcggccctgctgcccggcctgccatgaccctggcccgggagccccagctgctggtggtgggcggctgccccaccaggaactgcagcggccctgctgccagcccccagcagctgctggatgatgctggccagggcggccgcggggagcgggacagcagccagaggcccctgcggccccagaccacccaccggcaggacaccaggcctgtgcccagctag

SEQ ID NO: 20545 - DNA, 549 bp, Artificial Sequence
  Description of Artificial Sequence: Synthetic coding sequence
atgaccccaccccagcagcccccacccctgcggtctgagcccggcaccctgggcagcgctgccagcagctacagccccctgggcctgaatggagtgcccggcagcatctgggactttgtgtctggcagcttcagccccagccccagccccatcctgtctgctggcccccccagcagcagcagcgccagccccaatggagctgagctggcccgggtgcggcggcagctggatgaggccaagaggaagatccggcagtgggaggagagctggcagcaggtgaagcaggtgtgtgatgcctggcagcgggaggcccaggaggccaaggagcgggcccgggtggccgacagcgaccggcagctggccctgcagaagaaggaggaggtggaggcccaggtgatcttccagctgcgggccaagcagtgtgtggcctgccgggagcgggcccatggagctgtgctgcggccctgccagcaccacatcctgtgtgagccctgtgccgccacagccccagaatgtccctactgcaagggccagcccctgcagtggtag

SEQ ID NO: 20546 - DNA, 444 bp, Artificial Sequence
  Description of Artificial Sequence: Synthetic coding sequence
atggagggggagcccccacctgtggaggagcggcggcggctgcaggaggagctgaatgaatttgtggagagcggctgcaggaccctggaggaggtgacagccagcctgggctgggacctggacagcctggaccctggagaggaggaggccgcagaagatgaggtggtgatctgcccctatgacagcaaccaccacatgcccaagagcagcctggccaagcacatggccagctgccgcctgaggaagatgggctacaccaaggaggaggaggatgagatgtacaaccctgagttcttctatgaaaatgtgaagatccccagcatcaccctgaacaaggacagccagttccagatcatcaagcaggccaggacagctgtgggcaaggacagcgactgctacaaccagatcattggagtgtccatcaagaggaactacaagatctag

SEQ ID NO: 20547 - DNA, 522 bp, Artificial Sequence
  Description of Artificial Sequence: Synthetic coding sequence
atgggcacctttgacctgtggacagactacctgggcctggcccacctggtgcgggccctgagcggcaaggagggccctgagacccggctgagcccccagcctgagcctgagcccatgctggagccagaccagaagaggagcctggagagcagccctgcccctgagcggctgtgcagcttctgcaagcacaacggggagagccgggccatctaccagagccacgtgctgaaggatgaggccggccgggtgctgtgccccatcctgcgggactatgtgtgcccccagtgtggggccacccgggagcgggcccacacccggcgcttctgccccctgaccggccagggctacacctctgtgtacagccacaccaccagaaattctgctgggaagaagctggtgcggccagacaaggccaagacccaggacaccggccaccggcggggcggcggcggcggggccggcttccggggggccggcaagtctgagcccagccccagctgcagccccagcatgagcacctag

SEQ ID NO: 20548 - DNA, 1722 bp, Artificial Sequence
  Description of Artificial Sequence: Synthetic coding sequence
atgtctgccttctgcctgggcctggtgggccgggccagcgccccagctgagccagacagcgcctgctgcatggagctgcctgctgctgctggagatgctgtgcgcagccctgctgctgctgctgccctgatcttccctgggggcagcggggagctggagctggccctggaggaggagctggccctgctggccgccggggagcggcccagcgaccccggggagcacccccaggccgagcccggcagcctggccgagggcgccggcccccagcccccacccagccaggaccctgagctgctgagcgtcatccggcagaaggagaaggacctggtgctggccgcccggctgggcaaggccctgctggagaggaaccaggacatgagccggcagtatgagcagatgcacaaggagctgacagacaagctggagcacctggagcaggagaagcatgagctgcggaggagatttgaaaatcgggagggggagtgggagggccgggtgtctgagctggagagtgatgtgaagcagctgcaggatgagctggagcggcagcagatccacctgcgggaggccgaccgggagaagagcagagctgtgcaggagctgtctgagcagaaccagaggctgctggaccagctgagccgggccagcgaggtggagcggcagctgtccatgcaggtgcacgccctgcgggaggacttccgggagaagaacagcagcaccaaccagcacatcatccggctggagagcctgcaggccgagatcaagatgctgagtgacaggaagcgggagctggagcaccggctgagcgccaccctggaggagaatgacctgctgcagggcaccgtggaggagctgcaggacagagtgctgatcctggagcggcagggccatgacaaggacctgcagctgcaccagagccagctggagctgcaggaggtgcggctgagctgccggcagctgcaggtgaaggtggaggagctgacagaggagaggagcctgcagagcagcgctgccaccagcaccagcctgctgtctgaaattgagcagagcatggaggccgaggagctggagcaggagcgggagcagctgcggctgcagctgtgggaggcctactgccaggtgcgctacctgtgcagccacctgcggggaaatgattctgctgacagcgctgtgtccacagacagctccatggatgagagcagcgagaccagcagcgccaaggatgtgcctgctggcagcctgaggacagccctgaatgagctgaagaggctcatccagagcatcgtggatggcatggagcccaccgtgaccctgctgtctgtggagatgacagccctgaaggaggagcgggaccggctgcgggtgaccagcgaggacaaggagcccaaggagcagctgcagaaggccatccgggacagagatgaggccatcgccaagaagaatgctgtggagctggagctggccaagtgcaggatggacatgatgagcctgaacagccagctgctggatgccatccagcagaagctgaacctgagccagcagctggaggcctggcaggatgacatgcaccgggtgattgaccggcagctgatggacacccacctgaaggagaggagccagcctgctgctgccctgtgccggggccacagcgctggaagaggagatgagcccagcattgctgagggcaagaggctcttctccttcttcaggaagatctag

SEQ ID NO: 20549 - DNA, 1086 bp, Artificial Sequence; identical to SEQ ID NO: 19303
  Description of Artificial Sequence: Synthetic coding sequence

SEQ ID NO: 20550 - DNA, 3099 bp, Artificial Sequence
  Description of Artificial Sequence: Synthetic coding sequence
atggccttcaccaactacagcagcctgaacagagcccagctgacctttgagtacctgcacaccaacagcaccacccatgagttcctgtttggagccctggccgagctggtggacaatgccagagatgctgatgccaccagaattgacatctatgcagagcggcgggaggacctgcggggcggcttcatgctgtgcttcctggatgatggagctggcatggaccccagtgatgctgccagcgtcatccagtttgggaagagcgccaagaggaccccagagagcacccagatcggccagtatggaaatggcctgaagagcggctccatgagaattggcaaggacttcatcctcttcaccaagaaggaggacaccatgacctgcctcttcctgagcaggaccttccacgaggaggagggcattgatgaagtcatcgtgcccctgcccacctggaatgcccggacccgggagcctgtgacagacaacgtggagaagtttgccattgaaacagagctgatctacaagtacagccccttcagaacagaggaggaggtgatgacccagttcatgaagatccctggggacagcggcaccctggtgatcatcttcaacctgaagctgatggacaatggagagcctgagctggacatcatcagcaacccccgggacatccagatggccgagaccagccctgagggcaccaagccagagaggaggagcttccgggcctatgctgctgtgctgtacatcgaccccaggatgaggatcttcatccacggccacaaggtgcagaccaagaggctgagctgctgcctgtacaagcccaggatgtacaagtacaccagcagccgcttcaagaccagggctgagcaggaggtgaagaaggccgagcacgtggccagaattgctgaggagaaggcccgggaggccgagagcaaggcccggaccctggaggtgcggctgggcggggacctgacccgggacagccgggtgatgctgcggcaggtgcagaacagagccatcaccctgcggcgggaggctgatgtgaagaagaggatcaaggaggccaagcagagggccctgaaggagcccaaggagctgaactttgtgtttggagtgaacatcgagcaccgggacctggatggcatgttcatctacaactgcagccgcctcatcaagatgtatgagaaggtgggcccccagctggagggcggcatggcctgtggcggcgtggtgggcgtggtggatgtgccctacctggtgctggagcccacccacaacaagcaggactttgctgatgccaaggagtaccgccacctgctgcgggccatgggagagcacctggcccagtactggaaggacatcgccatcgcccagaggggcatcatcaagttctgggatgaatttggctacctgagcgccaactggaaccagccccccagcagcgagctgcgctacaagagaagaagagccatggagatccccaccaccatccagtgtgacctgtgcctgaagtggaggaccctgcccttccagctgagctctgtggagaaggactacccagacacctgggtgtgcagcatgaacccagaccctgagcaggacagatgtgaggccagcgagcagaagcagaaggtgcccctgggcaccttcaggaaggacatgaagacccaggaggagaagcagaagcagctgacagagaagatccggcagcagcaggagaagctggaggccctgcagaagaccacccccatccgcagccaggccgacctgaagaagctgcccctggaggtgaccacccggcccagcacagaggagcctgtgcggcggccccagaggcccaggagcccccccctgcctgctgtgatcagaaatgcccccagcaggcctcccagcctgcccacccccaggcctgccagccagcccaggaaggcccctgtgatcagcagcacccccaagctgcctgccctggccgcccgggaggaggccagcaccagccggctgctgcagcccccagaggcccccaggaagccagccaacaccctggtgaagacagccagcaggcctgcccccctggtgcagcagctgagccccagcctgctgcccaacagcaagagcccccgggaggtgcccagccccaaggtgatcaagacccctgtggtgaagaagacagagagccccatcaagctgagccctgccacccccagcaggaagaggtctgtggccgtgtctgatgaggaggaggtggaggaggaggccgagaggaggaaggagcgctgcaagaggggccgctttgtggtgaaggaggagaagaaggacagcaatgagctgagtgacagcgctggggaggaggacagcgctgacctgaagagggcccagaaggacaagggcctgcacgtggaggtgcgggtgaaccgggagtggtacacaggccgggtgacagctgtggaggtgggcaagcacgtggtgcgctggaaggtgaagtttgattatgtgcccacagacaccaccccccgggaccgctgggtggagaagggctctgaagatgtgcggctgatgaagccacccagccctgagcaccagagcctggacacccagcaggagggcggggaggaggaggtgggccctgtggcccagcaggccatcgctgtggccgagcccagcaccagcgagtgcctgcgcatcgagccagacaccacagccctgagcaccaaccacgagaccatcgacctgctggtgcagatcctgaggaactgcctgcgctacttcctgccccccagcttccccatcagcaagaagcagctgagcgccatgaacagtgatgagctgatctccttccccctgaaggagtacttcaagcagtatgaggtgggcctgcagaacctgtgcaacagctaccagagcagagctgacagccgggccaaggccagcgaggagagcctgcggaccagcgagaggaagctgcgggagacagaggagaagctgcagaagctgcggaccaacatcgtggccctgctgcagaaggtgcaggaggacatcgacatcaacacagatgatgagctggatgcctacattgaagatctcatcaccaagggggactag

SEQ ID NO: 20551 - DNA, 5943 bp, Artificial Sequence; identical to SEQ ID NO: 18674
  Description of Artificial Sequence: Synthetic coding sequence

SEQ ID NO: 20552 - DNA, 513 bp, Artificial Sequence; identical to SEQ ID NO: 19318
  Description of Artificial Sequence: Synthetic coding sequence

SEQ ID NO: 20553 - DNA, 291 bp, Artificial Sequence
  Description of Artificial Sequence: Synthetic coding sequence
atgtgccacaccagctgcagccctgcctgccagcccacctgctgcatccacagcccctgccaggccagctgctacgtgcctgtgtcctgccagagctctgtgtgcatgcctgtgtcctgcaccagaattgtgtgtgtggcccccagctgccagcccagcgtgtgtgtgcctgtgtcctgccggcccatcatctacgtgacccccagctgccagagcagcggctgctgccagcccccctgcaccacagccctgtgccggcccatcagctgcagcacccccagctgctgctag

SEQ ID NO: 20554 - DNA, 879 bp, Artificial Sequence
  Description of Artificial Sequence: Synthetic coding sequence
atggccgccagcaccatgagcatccgcagcagcgcctacagcgacagctggcaggtggatgactgcccagagagctgctgtgagcccccctgctgtgccaccagctgctgtgccccagccccctgcctgaccctggtgtgcacccctgtgtcccgggtgagcagcccctgctgccaggtgacctgtgagcccagcccctgccagagcggctgcaccagcagctgcacccccagctgctgccagcagagcagctgccagcctgcctactgcaccagcagcccctgccagcaggcctgctgcgtgcctgtgtgctgcaagcctgtgtgctgcgtgcctgtgtgctgcggggccagcagctgctgccagcagagcagctaccagcctgcctgctgtgccagcagcagctgccagcctgcctgctgcgtgcctgtgtgctgcaagcctgtgtgctgtgcccccacctgcagtgaagattcctacagctgctgccagcagagcagctgccagcctgcctgctgcaccagcagcccctgccagcagagctactgtgtgcctgtgtgctgcaagcctgtgtgctgcaagcccatctgctgcgtgcctgtgtgcagcggggccagcagcctgtgctgccagcagagcggctgccagcctgcctgctgcaccaccagctgctgccggcccagcagctctgtgtccctgctgtgcaggcctgtgtgcaggcctgcctgctgcgtgcctgtgagcagctgctgtgcccccaccagcagccggcagcccagctactgccggcaggccagctgtgtgtccctgctgtgcaggcctgtgtgcagcaggcctgcctgctacagcttcagcagcggccagaagagcagctgctag

SEQ ID NO: 20555 - DNA, 1608 bp, Artificial Sequence
  Description of Artificial Sequence: Synthetic coding sequence
atgaagaagatcagcctgaagaccctgaggaagagcttcaacctgaacaagagcaaggaggagacagacttcatggtggtgcagcagcccagcctggccagtgactttgggaaggatgacagcctgtttggcagctgctacggcaaggacatggccagctgtgacatcaatggagaagatgagaagggcggcaagaacagaagcaagtctgagagcctgatgggcaccctgaagaggcggctgagcgccaagcagaagagcaagggcaaggccggcaccccatctggcagcagcgcagatgaggacaccttcagcagcagcagcgcccccatcgtgttcaaggatgtgcgggcccagaggcccatccgcagcaccagcctgcggagccaccactacagccctgccccctggcccctgcggcccaccaacagcgaggagacctgcatcaagatggaggtgcgggtgaaggccctggtgcacagcagcagccccagccctgccctgaatggagtgaggaaggacttccatgacctgcagagcgagaccacctgccaggagcaggccaacagcctgaagagcagcgccagccacaacggggacctgcacctgcacctggatgagcacgtgcctgtggtgattggcctgatgccccaggactacatccagtacacagtgcccctggatgagggcatgtaccccctggagggcagccgcagctactgcctggacagcagcagccccatggaggtgtctgctgtgcccccccaggtgggcggccgggccttcccagaagatgagagccaggtggaccaggacctggtggtggcccctgagatctttgtggaccagagcgtgaatggcctgctgattggcaccactggagtgatgctgcagagcccccgggccggccatgatgatgtgccccccctgagccccctgctgccccccatgcagaacaaccagatccagaggaacttcagcggcctgaccggcacagaggcccacgtggccgagagcatgcgctgccacctgaactttgaccccaacagcgcccctggggtggcccgggtgtatgacagcgtgcagagcagcggccccatggtggtgaccagcctgacagaggagctgaagaagctggccaagcagggctggtactggggccccatcacccgctgggaggccgagggcaagctggccaacgtgcctgatggcagcttcctggtgcgggacagcagtgatgaccgctacctgctgagcctgtccttccgcagccacggcaagaccctgcacaccagaattgagcacagcaatggccgcttctccttctatgagcagccagatgtggagggccacaccagcatcgtggacctgattgagcacagcatccgggacagtgaaaatggagccttctgctacagccgcagccggctgcccggcagcgccacctaccctgtgcggctgaccaaccctgtgagccgcttcatgcaggtgcgcagcctgcagtacctgtgccgcttcgtcatccggcagtacaccagaattgacctgatccagaagctgcccctgcccaacaagatgaaggactacctgcaggagaagcactactag

SEQ ID NO: 20556 - DNA, 1260 bp, Artificial Sequence
  Description of Artificial Sequence: Synthetic coding sequence
atggccgccagcagcctggagcagaagctgagccggctggaggccaagctgaagcaggagaaccgggaggcccggaggagaattgacctgaacctggacatcagcccccagaggccccggcccaccctgcagctgcccctggccaatgatggcggcagccgcagccccagcagcgagagcagcccccagcaccccaccccaccagcccggcccaggcacatgctgggcctgcccagcaccctcttcacccccaggtccatggagagcattgaaattgaccagaagctgcaggagatcatgaagcagacaggctacctgaccatcggcggccagcgctaccaggccgagatcaatgacctggagaacctgggggagatgggcagcggcacctgtggccaggtgtggaagatgaggttcaggaagacaggccacgtgattgctgtgaagcagatgaggaggagcggcaacaaggaggagaacaagaggatcctgatggacctggatgtggtgctgaagagccatgactgcccctacatcgtgcagtgcttcggcaccttcatcaccaacacagatgtgttcatcgccatggagctgatgggcacctgtgccgagaagctgaagaagaggatgcagggccccatccctgagcgcatcctgggcaagatgacagtggccatcgtgaaggccctgtactacctgaaggagaagcatggagtcatccacagagatgtgaagcccagcaacatcctgctggatgagcggggccagatcaagctgtgtgactttggcatcagcggccgcctggtggacagcaaggccaagaccaggtctgctggctgtgccgcctacatggcccctgagagaattgatcctccagaccccaccaagccagactatgacatccgggcagatgtgtggagcctgggcatcagcctggtggagctggccaccggccagttcccctacaagaactgcaagacagactttgaggtgctgaccaaggtgctgcaggaggagccccccctgctgcccggccacatgggcttcagcggggacttccagagctttgtgaaggactgcctgaccaaggaccacaggaagaggcccaagtacaacaagctgctggagcacagcttcatcaagagatatgagaccctggaggtggatgtggcctcctggttcaaggatgtgatggccaagacagagagccccaggaccagcggcgtgctgagccagccccacctgcccttcttcagatag

SEQ ID NO: 20557 - DNA, 963 bp, Artificial Sequence; identical to SEQ ID NO: 19292
  Description of Artificial Sequence: Synthetic coding sequence

SEQ ID NO: 20558 - DNA, 1737 bp, Artificial Sequence
  Description of Artificial Sequence: Synthetic coding sequence
atggagctggagaacatcgtggccaacagcctgctgctgaaggcccggcagggcggctacggcaagaagagcggccgcagcaagaagtggaaggagatcctgaccctgccccctgtgtcccagtgcagcgagctgcggcacagcattgagaaggactacagcagcctgtgtgacaagcagcccatcggccggcggctcttccggcagttctgtgacaccaagcccaccctgaagaggcacatcgagttcctggatgctgtggccgagtatgaggtggctgatgatgaggacagaagtgactgtggcctgagcatcctggaccgcttcttcaatgacaagctggccgcccccctgcctgagatccccccagatgtggtgacagagtgccgcctgggcctgaaggaggagaaccccagcaagaaggcctttgaagaatgtaccagggtggcccacaactacctgcggggggagccctttgaggagtaccaggagagcagctacttcagccagttcctgcagtggaagtggctggagcggcagcctgtgaccaagaacaccttccgccactacagagtgctgggcaaaggaggctttggagaggtgtgtgcctgccaggtgcgggccaccgggaagatgtatgcctgcaagaagctgcagaagaagaggatcaagaagaggaaaggagaggccatggccctgaatgagaagaggatcctggagaaggtgcagagcagatttgtggtgtccctggcctatgcctatgagaccaaggatgccctgtgcctggtgctgaccatcatgaatggaggagacctgaagttccacatctacaacctgggcaaccctggctttgatgagcagagagctgtgttctatgctgctgagctgtgctgcggcctggaggacctgcagcgggagcgcatcgtgtacagagacctgaagccagagaacatcctgctggatgaccggggccacatccgcatcagtgacctgggcctggccacagagatccctgagggccagagggtgcggggccgggtgggcaccgtgggctacatggcccctgaggtggtgaacaatgagaagtacaccttctccccagactggtggggcctgggctgcctgatctatgagatgatccagggccacagccccttcaagaagtacaaggagaaggtgaagtgggaggaggtggaccagaggatcaagaatgacacagaggagtacagcgagaagttctctgaagatgccaagagcatctgcaggatgctgctgaccaagaaccccagcaagaggctgggctgccgcggggagggcgctgctggggtgaagcagcaccctgtgttcaaggacatcaacttccggcggctggaggccaacatgctggagccccccttctgcccagacccccatgctgtgtactgcaaggatgtgctggacatcgagcagttctctgtggtgaagggcatctacctggacacagcagatgaggacttctacgccaggtttgccaccggctgtgtgtccatcccctggcagaatgagatgattgaaagtggctgcttcaaggacatcaacaagtctgagagcgaggaggccctgcccctggacctggacaagaacatccacacccctgtgtcccggcccaacagaggcttcttctaccgcctcttcagaagaggaggctgcctgaccatggtgcccagcgagaaggaggtggagcccaagcagtgctag

SEQ ID NO: 20559 - DNA, 2625 bp, Artificial Sequence
  Description of Artificial Sequence: Synthetic coding sequence
atgaaccagaggagccacctgggcaccacctacctggacacagccaagggagctgtggagaccttcatgaagctgcgggcccgggaccctgccagcagaggagaccgctacatgctggtgacctttgaggagcccccctatgccatcaaggccggctggaaggaaaatcatgccaccttcatgaatgagctgaagaacctgcaggccgagggcctgaccaccctgggccagagcctgaggacagcctttgacctgctgaacctgaaccggctggtgactggaattgacaactacggccagggcaggaaccccttcttcctggagcccgccatcatcatcaccatcacagatggcagcaagctgaccaccaccagcggcgtgcaggatgagctgcacctgcccctgaacagccccctgcccggcagcgagctgaccaaggagcccttccgctgggaccagaggctgtttgccctggtgctgcggctgcccggcaccatgtctgtggagagcgagcagctgactggagtgcccctggatgattctgccatcacccccatgtgtgaggtgactggaggccgcagctacagcgtgtgcagccccaggatgctgaaccagtgcctggagagcctggtgcagaaggtgcagagcggcgtggtgatcaactttgagaaggccggccctgaccccagccctgtggaggatggccagcctgacatcagccggcccttcggcagccagccctggcacagctgccacaagctgatctacgtgcggcccaaccccaagacaggagtgcccatcggccactggcctgtgcctgagagcttctggccagaccagaacagccccaccctgccccccaggaccagccaccctgtggtgaagttcagctgcacagactgtgagcccatggtgattgacaagctgccctttgacaagtatgagctggagcccagccccctgacccagttcatcctggagaggaagagcccccagacctgctggcaggtgtatgtgagcaacagcgccaagtacagcgagctgggccaccccttcggctacctgaaggccagcacagccctgaactgtgtgaacctgtttgtgatgccctacaactaccctgtgctgctgcccctgctggatgacctcttcaaggtgcacaaggccaagcccaccctgaagtggaggcagagctttgagagctacctgaagaccatgccaccctactacctgggccccctgaagaaggctgtgaggatgatgggcgcccccaacctgattgctgacagcatggagtatggcctgagctacagcgtcatctcctacctgaagaagctgagccagcaggccaagattgaaagtgacagagtcatcggctctgtgggcaagaaggtggtgcaggagaccggcatcaaggtgcgcagccgcagccacggcctgtccatggcctacaggaaggacttccagcagctgctgcagggcatcagtgaagatgtgccccaccggctgctggacctgaacatgaaggagtacacaggcttccaggtggccctgctgaacaaggacctgaagccccagaccttcagaaatgcctatgacatccccaggaggaacctgctggaccacctgaccaggatgaggagcaacctgctgaagagcacccggcgcttcctgaagggccaggatgaggaccaggtgcacagcgtgcccatcgcccagatgggcaactaccaggagtacctgaagcaggtgcccagccccctgcgggagctggaccctgaccagccccggcggctgcacaccttcggcaaccccttcaagctggacaagaagggcatgatgattgatgaagcagatgaatttgtggccggcccccagaacaagcacaagaggcctggagagcccaacatgcagggcatccccaagagaagacgctgcatgagccccctgctgcggggccggcagcagaaccctgtggtgaacaaccacatcggcggcaaaggacctccagcccccaccacccaggcccagcctgacctgatcaagcccctgcccctgcacaagatcagcgagaccaccaatgacagcatcatccatgatgtggtggagaaccacgtggccgaccagctgagcagtgacatcaccccaaatgccatggacacagagttcagcgccagcagccctgccagcctgctggagcggcccaccaaccacatggaggccctgggccatgaccacctgggcaccaatgacctgactgtgggcggcttcctggagaaccacgaggagccccgggacaaggagcagtgtgccgaggagaacatcccagccagcagcctgaacaagggcaagaagctgatgcactgccgcagccatgaggaggtgaacacagagctgaaggcccagatcatgaaggagatcaggaagccaggcaggaaatatgaaagaatcttcaccctgctgaagcacgtgcagggcagcctgcagaccaggctcatcttcctgcagaatgtcatcaaggaggccagccgcttcaagaagaggatgctgattgagcagctggagaacttcctggatgagatccacagaagagccaaccagatcaaccacatcaacagcaactag

SEQ ID NO: 20560 - DNA, 2340 bp, Artificial Sequence
  Description of Artificial Sequence: Synthetic coding sequence
atggctgactacagcaacaagctgtactaccagctggagcaggagaccggcatccagacaggctacaccaggacaggcagcatcttcctggcccagacccaggacaggctcatcagcctgaagaggatcaatgccggcctgaatgtcatcggcatccccagcgagatcatcagccccaagaaggtggccgagctgcaccacctgctgaatgtgcatgacctggtgggcgccatgcacgtgcctgaagatgctgtggtgagcagcgcagatgtggccctggccctggccagcgctgccagccagaatggagtgcagatctatgacaggacctctgtgctgcacgtgatggtgaagaagggccaggtgactggagtggagacagacaagggccagatcgagtgccagtactttgtgaactgtgccggccagtgggcctatgagctgggcctgagcaatgaggagcctgtgtccatccccctgcacgcctgtgagcacttctacctgctgacccggcccctggagacccccctgcagagcagcacccccaccatcgtggatgctgatggccgcatctacatccggaactggcagggcggcatcctgagcggcggctttgagaagaaccccaagcccatcttcacagagggcaagaaccagctggagatccagaacctgcaggaggactgggaccactttgagcccctgctgagcagcctgctgcggaggatgcctgagctggagaccctggagatcatgaagctggtgaactgcccagagaccttcaccccagacatgcgctgcatcatgggagagagccctgctgtgcagggctactttgtgctggccggcatgaacagcgctggcctgagctttggaggaggagctgggaagtacctggccgagtggatggtgcacggctaccccagtgaaaatgtgtgggagctggacctgaagagatttggagccctgcagagcagcaggaccttcctgcggcaccgggtgatggaggtgatgcccctgatgtatgacctgaaggtgccccgctgggacttccagacaggccggcagctgcggaccagccccctgtatgaccggctggatgcccagggcgcccgctggatggagaagcacggctttgagcggcccaagtactttgtgcccccagacaaggacctgctggccctggagcagagcaagaccttctacaagccagactggtttgatattgtggagagcgaggtgaagtgctgcaaggaggccgtgtgtgtgattgacatgagcagcttcaccaagtttgagatcaccagcactggagaccaggccctggaggtgctgcagtacctgttcagcaatgacctggatgtgcctgtgggccacatcgtgcacacaggcatgctgaatgaaggaggcggctatgaaaatgactgcagcatcgcccggctgaacaagaggagcttcttcatgatcagccccacagaccagcaggtgcactgctgggcctggctgaagaagcacatgcccaaggacagcaacctgctgctggaggatgtgacctggaagtacacagccctgaacctgattggccccagggctgtggatgtgctgtctgagctgtcctatgcccccatgaccccagaccacttccccagcctcttctgcaaggagatgtctgtgggctacgccaacggcatccgggtgatgtccatgacccacactggagagcccggcttcatgctgtacatccccattgaatatgccctgcacgtgtacaatgaggtgatgtctgtgggccagaagtatggcatcagaaatgccggctactatgccctgcggagcctgagaattgagaagttctttgccttctggggccaggacatcaacaacctgaccacccccctggagtgtggccgggagagccgggtgaagctggagaagggcatggacttcatcggcagagatgccctgctgcagcagaagcagaatggagtgtacaagaggctgaccatgttcatcctggatgaccatgacagcgacctggacctgtggccctggtggggcgagcccatctacagaaatggccagtatgtgggcaagaccaccagcagcgcctacagctacagcctggagagacatgtgtgcctgggctttgtgcacaacttcagcgaggacaccggggaggagcaggtggtgacagctgacttcatcaacagaggagaatatgaaattgatattgctggctaccgcttccaggccaaggccaagctgtaccctgtggccagcctcttcacccagaagaggaggaaggatgacatggagctgagtgacctgcacggcaagtag

SEQ ID NO: 20561 - DNA, 1191 bp, Artificial Sequence
  Description of Artificial Sequence: Synthetic coding sequence
atggccaccagggtggaggaggccgcccggggccggggcggcggcgctgaggaggccacagaggccggccggggcggcagaagaagaagcccccggcagaagctggaggagagccgctctgtgcagaagcagatgaagatcctgcagaagaagcaggcccagatcgtgaaggagaaggtgcacctgcagagcgagcacagcaaggccatcctggcccggagcaagctggagagcctgtgccgggagctgcagaggcacaacaagaccctgaaggaggagaacatgcagcaggcccgggaggaggaggagaggaggaaggaggccacagcccacttccagatcaccctgaatgagatccaggcccagctggagcagcacgacatccacaatgccaagctgcggcaggagaacatcgagctgggggagaagctgaagaagctgattgagcagtatgccctgcgggaggagcacatcgacaaggtgttcaagcacaaggagctgcagcagcagctggtggatgccaagctgcagcagaccacccagctgatcaaggaggctgatgagaagcaccagcgggagcgggagttcctgctgaaggaggccacagagagccgccacaagtatgagcagatgaagcagcaggaggtgcagctgaagcagcagctgagcctgtacatggacaagtttgaggagttccagaccaccatggccaagagcaatgagctgttcaccaccttccggcaggagatggagaagatgaccaagaagatcaagaagctggagaaggagaccatcatctggaggaccaagtgggagaacaacaacaaggccctgctgcagatggccgaggagaagacagtgcgggacaaggagtacaaggccctgcagatcaagctggagcggctggagaagctgtgccgggccctgcagacagaaagaaatgagctgaatgagaaggtggaggtgctgaaggagcaggtgtccatcaaggccgccatcaaggccgccaacagagacctggccacccctgtgatgcagccctgcacagccctggacagccacaaggagctgaacaccagcagcaagagggccctgggcgcccacctggaggccgagcccaagagccagaggtctgctgtgcagaagccacccagcacaggcagcgccccagccatcgagagcgtggactag

SEQ ID NO: 20562 - DNA, 1443 bp, Artificial Sequence; identical to SEQ ID NO: 19905
  Description of Artificial Sequence: Synthetic coding sequence

SEQ ID NO: 20563 - DNA, 3774 bp, Artificial Sequence
  Description of Artificial Sequence: Synthetic coding sequence
atggcccacttcagcagcgaggaccaggccatgctgcaggccatgctgcggcggctcttccagagcgtgaaggagaagatcaccggggcccccagcctggagtgtgccgaggagatcctgctgcacctggaggagacagatgagaacttccacaactatgaatttgtgaagtacctgcggcagcacatcggcaacaccctgggctccatgattgaggaggagatggagaagtgcaccagtgacaggaaccagggcgaggagtgtggctatgacacagtggtgcagcaggtgaccaagaggacccaggagagcaaggagtacaaggagatgatgcactacctgaagaacatcatgattgctgtggtggagagcatgatcaacaagtttgaagaagatgagaccaggaaccaggagcggcagaagaagatccagaaggagaagagccacagctacagaacagacaactgcagcgacagcgacagcagcctgaaccagagctacaagttctgccagggcaagctgcagctgatcctggaccagctggaccccggccagcccaaggaggtgcgctatgaggccctgcagaccctgtgcagcgcccccccatctgatgtgctgaactgtgagaactggaccaccctgtgtgagaagctgactgtgtccctgagtgaccctgaccctgtgttcagtgaccgcatcctgaagttctgtgcccagaccttcctgctgagccccctgcacatgaccaaggagatctacaccagcctggccaagtacctggagagctacttcctgagccgggagaaccacatccccaccctgtctgctggggtggacatcaccaaccccaacatgacccggctgctgaagaaggtgcggctgctgaatgagtaccagaaggaggcccccagcttctggatccgccaccctgagaagtacatggaggagatcgtggagagcaccctgagcctgctgactgtgaagcacaaccagagccacgtggtgtcccagaagatcctggaccccatctacttctttgccctggtggacaccaaggctgtgtggttcaagaagtggatgcacgcccactacagcaggaccaccgtgctgcggctgctggagaccaagtacaagagcctggtgaccacagccatccagcagtgtgtgcagtactttgagatgtgcaagaccaggaaggcagatgagaccctgggccacagcaagcactgcaggaacaagcagaagaccttctactacctgggccaggagctgcagtacatctacttcatccacagcctgtgcctgctgggccgcctgctgatctacaagcagggcaggaagctgttccccatcaagctgaagaacaagaagggcctggtgtccctgattgacctgctggtgctcttcacccagctgatctactacagccccagctgccccaagatgaccagcgctgcccacagcgagaactacagccctgcctccatggtgacagaggtgctgtggatcctgagtgaccagaaggaatgtgctgtggagtgcctgtacaacaacatcgtgattgagaccctgctgcagcccatccacaacctgatgaagggaaatgaggccagccccaactgcagcgagacagccctgatccacatcgccggcatcctggcccgcatcgcctctgtggaggagggcctcatcctgctgctgtatggagccaacatgaacagcagcgaggagagccccaccggggcccacatcatcgcccagttcagcaagaagctgctggatgaggacatcagcatcttcagcggcagcgagatgctgcctgtggtgaagggggccttcatctctgtgtgccgccacatctacagcacctgtgagggcctgcaggtgctgatcacctacaacctgcacgagagcatcgccaaggcctggaagaagaccagcctgctgtctgagcgcatccccacccctgtggagggcagtgacagcgtgtcctctgtgtcccaggagagccagaacatcatggcctgggaggacaacctgctggatgacctgctgcactttgctgccacccccaagggcctgctgctgctgcagaggactggagccatcaatgaatgtgtgaccttcatcttcaacagatatgccaagaagctgcaggtgagccgccacaagaagtttggctacggcgtgctggtgaccagggtggccagcacagctgctgggggcatcgccctgaagaagagcggcttcatcaatgagctgatcacagagctgtggagcaacctggagtatggaagagatgatgtgcgggtgacccaccccaggaccacccctgtggaccccatcgacaggagctgccagaagagcttcctggccctggtgaacctgctgagctacccagccatctatgagctggtgaggaaccaggacctgcccaacaagacagagtacagcctgcgggaggtgcccacctgtgtgattgacatcatcgacaggctcatcatcctgaacagcgaggccaagatccgcagcctcttcaactatgagcagagccacatcttcggcctgcgggacttcatcattgatggcctgtctgtggagaggaaccacgtgctggtgcgcatcaacctggtgggcggccccctggagcgcatcctgcccccccggctgctggagaagagtgacaacccctacccctggcccatgttcagcagctaccccctgcccaactgctacctgagtgacatcaccagaaatgccggcatcaagcaggacaatgacctggacaagctgctgctgtgcctgaagatcagtgacaagcagacagagtggattgagaactgccagaggcagttctgcaagatgatgaaggccaagccagacatcatcagcggggaggccctgattgagctgctggagaagtttgtgctgcacctgacagagagccccagcgagtgctacttccccagcgtggagtacacagccacagatgccaacgtgaagaatgaaagcctgagctctgtgcagcagctgggcatcaagatgacagtgcgctatggcaagttcctgagcctgctgaaggatggagcagaaaatgacctgacctgggtgctgaagcactgtgagcgcttcctgaagcagcagcagaccagcatcaagagcagcctgctgtgcctgcagggcaactatgccggccatgactggtttgtgagcagcctcttcatgatcatgctgggggacaaggagaagaccttccagttcctgcaccagttcagccggctgctgaccagcgccttcctgtggctgccccggctgcacatcagcagctacctgcccaatgacacagtggagagcggcatccaccctgtgtacttctgcagcacccactacatcgagatgctgctgaaggccgagctgcccctggtgttcagcgccttccacatgagcggctttgcccccagccagatctgcctgcagtggatcacccagtgcttctggaactacctggactggattgagatctgccactacatcgccacctgtgtgttcctgggccctgactaccaggtgtacatctgcatcgctgtgttcaagcacctgcagcaggacatcctgcagcacacccagacccaggacctgcaggtgttcctgaaggaggaggccctgcacggcttccgggtgtctgactactttgagtacatggagatcctggagcagaactacagaacagtgctgctgcgggacatgaggaacatccggctgcagagcacctag

SEQ ID NO: 20564 - DNA, 612 bp, Artificial Sequence
  Description of Artificial Sequence: Synthetic coding sequence
atggccaccccctacgtgacagatgagaccggcggcaagtacatcgccagcacccagaggccagatggcacctggaggaagcagaggagagtgaaggagggctacgtgccccaggaggaggtgcctgtgtatgagaacaagtatgtgaagttcttcaagagcaagccagagctgcccccaggcctgagccctgaggccacagcccctgtgacccccagcaggcctgagggcggggagcccggcctgagcaagacagccaagaggaacctgaagaggaaggagaagaggcggcagcagcaggagaagggggaggccgaggccctgagcaggaccctggacaaggtgtccctggaggagacagcccagctgcccagcgccccccagggcagccgggccgcccccacagctgccagtgaccagccagattctgctgccaccacagagaaggccaagaagatcaagaacctgaagaagaagctgcggcaggtggaggagctgcagcagaggatccaggccggggaggtgtcccagcccagcaaggagcagctggagaagctggccaggagaagagccctggaggaggagctggaggacctggagctgggcctgtag

SEQ ID NO: 20565 - DNA, 729 bp, Artificial Sequence; identical to SEQ ID NO: 20180
  Description of Artificial Sequence: Synthetic coding sequence

SEQ ID NO: 20566 - DNA, 738 bp, Artificial Sequence; identical to SEQ ID NO: 18740
  Description of Artificial Sequence: Synthetic coding sequence

SEQ ID NO: 20567 - DNA, 1020 bp, Artificial Sequence
  Description of Artificial Sequence: Synthetic coding sequence
atgatggacagccagctggtggccggcgtggccttcaagaagaccttctcctatgccggctttgagatgcagcccaagaagtaccacaaccccaagatcgccctgctgaatgtggagctggagctgaaggccgagaaggacaatgctgagatccgggtgcacacagtggaggactaccaggccatcgtggatgctgagtggaacatcctgtatgacaagctggagaagatccaccacagcggggccaaggtggtgctgagcaagctgcccatcggagatgtggccacccagtactttgctgaccgggacatgttctgtgccggccgggtgcctgaggaggacctgaagaggaccatgatggcctgtggcggcagcatccagacctctgtgaatgccctgtctgcagatgtgctgggccgctgccaggtgtttgaggagacccagattggaggagagcgctacaacttcttcaccggctgccccaaggccaagacctgcaccttcatcctgcggggcggcgctgagcagttcatggaggagacagagaggagcctgcatgatgccatcatgattgtgagaagagccatcaagaatgacagcgtggtggccggcggcggggccatcgagatggagctgagcaagtacctgcgggactacagcaggaccatccctgggaagcagcagctgctgattggagcctatgccaaggccctggagatcatcccccggcagctgtgtgacaatgccggctttgatgccaccaacatcctgaacaagctgcgggcccggcatgcccagggcggcacctggtatggagtggacatcaacaatgaagatattgctgacaactttgaggcctttgtgtgggagcccgccatggtgcgcatcaatgccctgacagctgccagcgaggccgcctgcctgattgtgtctgtggatgagaccatcaagaaccccaggagcacagtggatgcccccacagctgctggccggggccggggccggggccggccccactag

SEQ ID NO: 20568 - DNA, 768 bp, Artificial Sequence; identical to SEQ ID NO: 18637
  Description of Artificial Sequence: Synthetic coding sequence

SEQ ID NO: 20569 - DNA, 441 bp, Artificial Sequence
  Description of Artificial Sequence: Synthetic coding sequence
atggtgaacagctgctgcggctctgtgtgcagcgaccagggctgtgaccagggcctgtgccaggagacctgctgccggcccagctgctgccagaccacctgctgctgccccagctgtgtggtgagcagctgctgccggcccagctgcagccagaccacctgctgccagaccacctgctgccggcccagctgctgccaccctgtgtgctgccagaccacctgccggcccagctgtggggtgagcagctgctgccggcccctgtgctgccagaccacctgccaccccagctgtggcatgagcagctgctgccggcccctgtgctgccagaccacctgccggcccagctgtggggtgagcagctgctgccggcccctgtgctgccagaccacctgctgccgggccacctgctgccggcccagctgctgcggcagcagctgctag

SEQ ID NO: 20570 - DNA, 1296 bp, Artificial Sequence; identical to SEQ ID NO: 20076
  Description of Artificial Sequence: Synthetic coding sequence

SEQ ID NO: 20571 - DNA, 471 bp, Artificial Sequence
  Description of Artificial Sequence: Synthetic coding sequence
atgggctgctgcggctgcagcggcggctgcggcagcggctgcggcggctgcggcagcggcagcggcggctgcggcagcggctgcggcggctgcggcagcagctgctgcgtgcccatctgctgctgcaagcctgtgtgctgctgcgtgcctgcctgcagctgcagcagctgtggcagctgtggcggcagcaagggcggctgcggcagctgtggcagcagcaagggcggctgcggcagctgtggctgcagccagagcaactgctgcaagccctgctgcagcagcagcggctgcggcagcttctgctgccagagcagctgcagcaagccctgctgctgccagagcagctgctgccagagcagctgctgcaagccctgctgctgccagagcagctgctgccagagcagctgcttcaagccctgctgctgccagagcagctgctgcgtgcctgtgtgctgccagtgcaagatctag

SEQ ID NO: 20572 - DNA, 609 bp, Artificial Sequence
  Description of Artificial Sequence: Synthetic coding sequence
atgggctgctgcggctgcagcggcggctgcggcagcggctgcggcggctgcggcagcggctgcggcggctgcggcagcggctgcggcggctacggcagcggctgcggcggctgcggcagcagctgctgcgtgcctgtgtgctgctgcaagcctgtgtgctgctgcgtgcctgcctgcagctgcagcagctgtggcagctgtggcggcagcaaaggagactgtggcagctgtggcggcagcaaaggaggctgcggcagctgtggcggcagcaaaggaggctgcggcagctgtggcggcagcaaaggaggctgcggcagctgtggcggcagcaaaggaggctgcggcagctgtggcggcagcaaaggaggctgcggcagctgtggcggcagcaaaggaggctgcggcagctgtggctgcagccagtgcaactgctgcaagccctgctgctgcagcagcggctgcggcagctgctgccagagcagctgctgcaacccctgctgctgccagagcagctgctgcgtgcctgtgtgctgccagagcagctgctgcaagccctgctgctgccagagcagctgctgcgtgcctgtgtgctgccagtgcaagatctag

SEQ ID NO: 20573 - DNA, 498 bp, Artificial Sequence
  Description of Artificial Sequence: Synthetic coding sequence
atgggctgctgcggctgcagcgagggctgcggcagcggctgcggcggctgcggcagcggctgcggcggctgcggcagcggctgcggcggctgcggcagcagctgctgcgtgcctgtgtgctgctgcaagcctgtgtgctgctgcgtgcctgcctgcagctgcagcagctgtggcagctgtggcggcagcaagggcggctgcggcagctgtggcggcagcaagggcggctgcggcagctgtggcggcagcaagggcggctgcggcagctgtggctgcagccagtgcagctgctacaagccctgctgctgcagcagcggctgcggcagcagctgctgccagagcagctgctgcaagccctgctgctgccagagcagctgctgcaagccctgctgctgcagcagcggctgcggcagcagctgctgccagagcagctgctgcaacccctgctgcagccagagcagctgctgcgtgcctgtgtgctgccagtgcaagatctag

SEQ ID NO: 20574 - DNA, 3105 bp, Artificial Sequence
  Description of Artificial Sequence: Synthetic coding sequence
atggcctctgtgttcatgtgtggggtggaggacctgctcttcagcggcagcagatttgtgtggaacctgactgtgtccaccctgcggcgctggtacacagagcggctgcgggcctgccaccaggtgctgcggacctggtgtggcctgcaggatgtgtaccagatgacagagggccgccactgccaggtgcacctgctggatgaccggcggctggagctgctggtgcagcccaagctgctggcccgggagctgctggacctggtggccagccacttcaacctgaaggagaaggagtacttcggcatcaccttcattgatgacaccggccagcagaactggctgcagctggaccaccgggtgctggaccatgacctgcccaagaagccaggccccaccatcctgcactttgctgtgcgcttctacatcgagagcatctccttcctgaaggacaagaccaccgtggagctgttcttcctgaatgccaaggcctgtgtgcacaagggccagatcgaggtggagagcgagaccatcttcaagctggccgccttcatcctgcaggaggccaagggggactacaccagtgatgaaaatgccaggaaggacctgaagaccctgcctgccttccccaccaagaccctgcaggagcaccccagcctggcctactgtgaagatagagtgattgagcactacctgaagatcaagggcctgacccggggccaggccgtggtgcagtacatgaagatcgtggaggccctgcccacctatggagtgcactactatgctgtgaaggacaagcagggcctgccctggtggctgggcatctcctacaagggcatcggccagtatgacatccaggacaaggtgaagcccaggaagctgttccagtggaagcagctggagaacctgtacttccgggagaagaagtttgctgtggaggtgcatgacccccggcgcatctctgtgtccaggaggaccttcggccagagcggcctgtttgtgcagacctggtacgccaacagcagcctcatcaagagcatctgggtgatggccatcagccagcaccagttctacctggacaggaagcagagcaaggccaagatccccagcgcccggagcctggatgagatcgccatggacctgacagaaacaggcacccagagggccagcaagctggtgaccctggagaccaagagccagttcatcatggccagcaatggcagcctcatcagcagcggcagccaggacagcgaggtgtctgaggagcagaagcgggagaagatcctggagctgaagaagaaggagaagctgctgcaggagaagctgctgaagaaggtggaggagctgaagaagatctgcctgcgggaggccgagctgaccgggaagatgcccaaggagtaccccctgaacatcggggagaagccaccccaggtgagaagaagagtgggcacagccttcaagctggatgacaacctgctgcccagcgaggaggaccctgccctgcaggagctggagagcaacttcctgatccagcagaagctggtggaggccgccaagaagctggccaatgaaccagacctgtgcaagacagtgaagaagaagaggaagcaggactacacagatgccatgaagaagctgcaggagattgaaaatgccatcaatgagtaccgcatccgctgtgggaagaagcccagccagaaggccaccgtgctgcctgaggacatcatccccagcgagagcagcagcctgagtgacaccaccacctatgatgaccccagtgatgccttcaccttccctggccagaggagcagctctgtgccccacagcccccgcatcctgccccccaagagcctgggcatcgagcgcatccacttcaggaagagcagcatcaatgagcagtttgtggacacccggcagagccgggagatgctgagcacccacagcagcccctacaagaccctggagcggcggccccagggcggccgctccatgcccaccacccctgtgctgaccagaaatgcctacagcagcagccacctggagcctgagagcagcagccagcactgccggcagaggagcggcagcctggagagccagagccacctgctgtctgagatggacagcgacaagcccttcttcagcctgagcaagagccagaggagcagcagcacagagatcctggatgatggcagcagctacaccagccagagcagcacagagtactactgtgtgacccctgtgacaggcccctactacaccacccagaccctggacaccaggacccggggcagaagaagaagcaagaagcagaatgtgtccaccagcaacagcggctccatgcccaacctggcccagaaggacagcctgagaaatggagtgtacagcaagagccaggagccccccagcagcagctactacatcgccggctacaccccctatgcagaatgtgacttctactacagcggcggctacgtgtatgaaaatgacacagagggccagtacagcgtgaaccccagctaccgcagcagcgcccactacggctatgagcggcagagggactacagccgctccttccatgaagatgaggtggacagagtgccccacaacccctatgccaccctgcggctgcccaggaaggccgccgccaagtctgagcacatcaccaagaacatccacaaggccctggtggccgagcacctgcggggctggtaccagagggccagcggccagaaggaccagggccacagcccccagaccagctttgacagcgaccggggcagccagcgctgcctgggctttgctggcctgcaggtgccctgcagccccagcagccgggccagcagctacagctctgtgagcagcaccaatgccagcggcaactggaggacccagctgaccatcggcctgagtgactatgagaccccagcccacagcagctacaccagctgctatggaaatgtgtacaaccccctgcccagccccagccggcagtacacagagatcagccagctggatggaacagatggcaaccagctggaggacaacctggagagcagcgagcagaggctcttctggcatgaggacagcaagccaggcaccctggtgtag

SEQ ID NO: 20575 - DNA, 501 bp, Artificial Sequence
  Description of Artificial Sequence: Synthetic coding sequence
atgctgagccagagctgcaacctggaccccctgacagagacctacggcatccccttctacctgcagtacctggcccactggccagagtacttcatcgtggccgaggcccctggaggagagctgatgggctacatcatgggcaaggccgagggctctgtggcccgggaggagtggcacggccacgtgacagccctgtctgtggcccctgagttccggcggctgggcctggccgccaagctgatggagctgctggaggagatcagcgagaggaaaggaggcttctttgtggacctgtttgtgcgggtgagcaaccaggtggccgtgaacatgtacaagcagctgggctacagcgtgtacagaacagtgattgagtactacagcgccagcaatggagagccagatgaagatgcctatgacatgaggaaggccctgagccgggacacagagaagaagagcatcatccccctgccccaccctgtgcggccagaagatattgaatag

SEQ ID NO: 20576 - DNA, 399 bp, Artificial Sequence; identical to SEQ ID NO: 20168
  Description of Artificial Sequence: Synthetic coding sequence

SEQ ID NO: 20577 - DNA, 375 bp, Artificial Sequence; identical to SEQ ID NO: 19268
  Description of Artificial Sequence: Synthetic coding sequence

SEQ ID NO: 20578 - DNA, 336 bp, Artificial Sequence
  Description of Artificial Sequence: Synthetic coding sequence
ctgatggacctggacagcggagatgtgaagagaagagtgcacctgtttgagacccagaggaggaccaaggaggaggaccccatcatccccttcagtgatggccccatcatcagcaagtggggcgccatcagccgcagcagcaggacaggctaccacaccacagatcctgtgcaggccacagccagccagggcagcgccaccaagcccatctctgtgtctggaggagtgcacatggccacccggccccaccaccagcacaccatgctgaagggcacagacagcctgctgctgatctacctggtgattgagagcatccctgtgctgggcaccttctag

SEQ ID NO: 20579 - DNA, 399 bp, Artificial Sequence; identical to SEQ ID NO: 20168
  Description of Artificial Sequence: Synthetic coding sequence

SEQ ID NO: 20580 - DNA, 375 bp, Artificial Sequence; identical to SEQ ID NO: 19268
  Description of Artificial Sequence: Synthetic coding sequence

SEQ ID NO: 20581 - DNA, 1038 bp, Artificial Sequence
  Description of Artificial Sequence: Synthetic coding sequence
atgctgcccaacacaggccgcctggccggctgcaccgtcttcatcaccggggccagccggggcatcggcaaggccatcgccctgaaggccgccaaggatggagccaacatcgtgattgctgccaagacagcccagccccaccccaagctgctgggcaccatctacacagctgctgaggagattgaagctgtgggcggcaaggccctgccctgcatcgtggatgtgagagatgagcagcagatctctgctgctgtggagaaggccatcaagaagtttggagcctacaccatcgccaagtatggcatgtccatgtatgtgctgggcatggccgaggagttcaagggggagattgctgtgaatgccctgtggcccaagacagccatccacacagctgccatggacatgctgggcggccctggcatcgagagccagtgcaggaaggtggacatcatcgcagatgctgcctacagcatcttccagaagcccaagagcttcaccggcaactttgtgattgatgagaacatcctgaaggaggagggcatcgagaactttgatgtgtatgccatcaagccaggccaccccctgcagcctgacttcttcctggatgagtacccagaggccgtgtccaagaaggtggagagcactggagctgtgcctgagttcaaggaggagaagctgcagctgcagcccaagcccaggtctggagctgtggaggagaccttcagaattgtgaaggacagcctgagtgatgatgtggtgaaggccacccaggccatctacctgtttgagctgtctggagaagatggcggcacctggttcctggacctgaagagcaaaggaggaaatgtgggctatggagagcccagcgaccaggctgatgtggtgatgtccatgaccacagatgactttgtgaagatgttcagcggcaagctgaagcccaccatggccttcatgtctgggaagctgaagatcaagggcaacatggccctggccatcaagctggagaagctgatgaaccagatgaatgcccggctgtag

SEQ ID NO: 20582 - DNA, 1257 bp, Artificial Sequence
  Description of Artificial Sequence: Synthetic coding sequence
atgctgcccaacacaggccgcctggccggctgcaccgtcttcatcaccggggccagccggggcatcggcaaggccatcgccctgaaggccgccaaggatggagccaacatcgtgattgctgccaagacagcccagccccaccccaagctgctgggcaccatctacacagctgctgaggagattgaagctgtgggcggcaaggccctgccctgcatcgtggatgtgagagatgagcagcagatctctgctgctgtggagaaggccatcaagaagtttggaggcatcgacatcctggtgaacaatgccagcgccatcagcctgaccaacaccctggacacccccaccaagaggctggacctgatgatgaatgtgaacacccggggcacctacctggccagcaaggcctgcatcccctacctgaagaagagcaaggtggcccacatcctgaacatcagcccccccctgaacctgaaccctgtgtggttcaagcagcactgtgcctacaccatcgccaagtatggcatgtccatgtatgtgctgggcatggccgaggagttcaagggggagattgctgtgaatgccctgtggcccaagacagccatccacacagctgccatggacatgctgggcggccctggcatcgagagccagtgcaggaaggtggacatcatcgcagatgctgcctacagcatcttccagaagcccaagagcttcaccggcaactttgtgattgatgagaacatcctgaaggaggagggcattgaaaattttgatgtgtatgccatcaagccaggccaccccctgcagcctgacttcttcctggatgagtacccagaggccgtgtccaagaaggtggagagcactggagctgtgcctgagttcaaggaggagaagctgcagctgcagcccaagcccaggtctggagctgtggaggagaccttccgcatcgtgaaggacagcctgagtgatgatgtggtgaaggccacccaggccatctacctgtttgagctgagcggggaggatggcggcacctggttcctggacctgaagagcaagggcggcaatgtgggctacggggagcccagcgaccaggctgatgtggtgatgtccatgaccacagatgactttgtgaagatgttttctgggaagctgaagcccaccatggccttcatgtctgggaagctgaagatcaagggcaacatggccctggccatcaagctggagaagctgatgaaccagatgaatgcccggctgtag

SEQ ID NO: 20583 - DNA, 1077 bp, Artificial Sequence
  Description of Artificial Sequence: Synthetic coding sequence
atgcctggctgtgagctgcctgtgggcacctgcccagacatgtgcccagctgctgagcgggcccagcgggagcgggagcaccggctgcaccggctggaggtggtgcccggctgccggcaggacccccccagggctgacccccagagagctgtgaaggagtacagcaggcctgctgctgggaagccccggcccccacccagccagctgcggcccccatctgtgctgctggccaccgtgcgctacctggccggggaggtggccgagagcgctgacatcgcccgggcagaggtggccagctttgtggccgaccggctgcgggctgtgctgctggacctggccctgcagggcgctggagatgctgaggccgctgtggtgctggaggccgccctggccaccctgctgactgtggtggcccggctgggcccagatgctgcccggggccctgctgaccctgtgctgctgcaggcccaggtgcaggagggcttcggcagcctgcggcgctgctacgcccggggagctggcccccacccccggcagcctgccttccagggcctcttcctgctgtacaacctgggctctgtggaggccctgcacgaggtgctgcagctgcctgctgccctgcgggcctgcccccccctgaggaaggccctggccgtggatgctgccttccgggagggcaatgctgcccggctcttccggctgctgcagaccctgccctacctgcccagctgtgctgtgcagtgccacgtgggccacgcccggcgggaggccctggccaggtttgcccgggccttcagcacccccaagggccagaccctgcccctgggcttcatggtgaacctgctggccctggatggcctgcgggaggcccgggacctgtgccaggcccacggcctgcccctggatggagaggagcgggtggtgttcctgcggggccgctacgtggaggagggcctgcccccagccagcacctgcaaggtgctggtggagagcaagctgcggggccgcaccctggaggaggtggtgatggccgaggaggaggatgagggcacagaccggcccggcagccctgcctag

SEQ ID NO: 20584 - DNA, 150 bp, Artificial Sequence
  Description of Artificial Sequence: Synthetic coding sequence
atgagcagctgtgtgagcagccagcccagcagcaacagagctgccccccaggatgagctgggcggccggggcagcagcagcagcgagagccagaagccctgtgaggccctgcggggcctgagcagcctgagcatccacctgggcatgtag

SEQ ID NO: 20585 - DNA, 2598 bp, Artificial Sequence
  Description of Artificial Sequence: Synthetic coding sequence
atgcctgctgtgtccctgccccccaaggaaaatgccctcttcaagaggatcctgcgctgctatgagcacaagcagtacagaaatggcctgaagttctgcaagcagatcctgagcaaccccaagtttgctgagcacggggagaccctggccatgaagggcctgaccctgaactgcctgggcaagaaggaggaggcctatgagctggtgcggcggggcctgagaaatgacctgaagagccacgtgtgctggcacgtgtatggcctgctgcagaggagtgacaagaagtatgatgaggccatcaagtgctacagaaatgccctgaagtgggacaaggacaacctgcagatcctgcgggacctgagcctgctgcagatccagatgagggacctggagggctaccgggagacccgctaccagctgctgcagctgcggcctgcccagagggcctcctggattggctacgccatcgcctaccacctgctggaggactatgagatggccgccaagatcctggaggagttcaggaagacccagcagaccagcccagacaaggtggactatgagtacagcgagctgctgctgtaccagaaccaggtgctgcgggaggccggcctgtaccgggaggccctggagcacctgtgcacctatgagaagcagatctgtgacaagctggccgtggaggagaccaagggggagctgctgctgcagctgtgccgcctggaggatgctgctgatgtgtaccggggcctgcaggagagaaatcctgagaactgggcctactacaagggcctggagaaggccctgaagccagccaacatgctggagcggctgaagatctatgaggaggcctggaccaagtacccccggggcctggtgccccggcggctgcccctgaacttcctgagcggggagaagttcaaggagtgcctggacaagttcctgaggatgaacttcagcaagggctgcccccctgtgttcaacaccctgcggagcctgtacaaggacaaggagaaggtggccatcatcgaggagctggtggtgggctatgagaccagcctgaagagctgccgcctcttcaaccccaatgatgatggcaaggaggagccccccaccaccctgctgtgggtgcagtactacctggcccagcactatgacaagattggccagcccagcatcgccctggagtacatcaacacagccatcgagagcacccccaccctcatcgagctgttcctggtgaaggccaagatctacaagcatgctggcaacatcaaggaggccgcccgctggatggatgaggcccaggccctggacacagctgaccgcttcatcaacagcaaatgtgccaagtacatgctgaaggccaacctgatcaaggaggccgaggagatgtgcagcaagttcacccgggagggcaccagcgctgtggagaacctgaatgagatgcagtgcatgtggttccagacagaatgtgcccaggcctacaaggccatgaacaagtttggagaggccctgaagaagtgccatgaaattgagcggcacttcatcgagatcacagatgaccagtttgacttccacacctactgcatgaggaagatcaccctgcggagctatgtggacctgctgaagctggaggatgtgctgcggcagcaccccttctacttcaaggccgcccgcatcgccatcgagatctacctgaagctgcatgacaaccccctgacagatgagaacaaggagcacgaggccgacacagccaacatgtctgacaaggagctgaagaagctgaggaacaagcagaggcgggcccagaagaaggcccagatcgaggaggagaagaagaatgctgagaaggagaagcagcagaggaaccagaagaagaagaaggatgatgatgatgaggagattggaggccccaaggaggagctgatccctgagaagctggccaaggtggagacccccctggaggaggccatcaagttcctgacccccctgaagaacctggtgaagaacaagattgagacccacctgtttgcctttgagatctacttcaggaaggagaagttcctgctgatgctgcagagcgtgaagagggcctttgccatcgacagcagccacccctggctgcacgagtgcatgatccgcctcttcaacacagtgtgtgagagcaaggacctgagtgacacagtgaggacagtgctgaagcaggagatgaaccggctgtttggagccaccaaccccaagaacttcaatgagaccttcctgaagaggaacagcgacagcctgccccaccggctgtctgctgccaagatggtgtactacctggaccccagcagccagaagagggccatcgagctggccaccaccctggatgagagcctgaccaacagaaacctgcagacctgcatggaggtgctggaggccctgtatgatggcagcctgggggactgcaaggaggccgctgagatctaccgggccaactgccacaagctgttcccctatgccctggccttcatgcctcctggctatgaggaggacatgaagatcaccgtgaatggagacagcagcgctgaggccgaggagctggccaatgagatctag

SEQ ID NO: 20586 - DNA, 1797 bp, Artificial Sequence; identical to SEQ ID NO: 19125
  Description of Artificial Sequence: Synthetic coding sequence

SEQ ID NO: 20587 - DNA, 1818 bp, Artificial Sequence
  Description of Artificial Sequence: Synthetic coding sequence
atgggcggctgcttcagcaagcccaagcctgtggagctgaagattgaggtggtgctgcctgagaaggagcggggcaaggaggagctgagcgccagcggcaagggcagcccccgggcctaccagggcaatggaacagcccggcacttccacacagaggagcggctgagcaccccccacccctaccccagcccccaggactgtgtggaggccgctgtgtgccacgtgaaggacctggagaatggccagatgagggaggtggagctgggctggggcaaggtgctgctggtgaaggacaatggagagttccacgccctgggccacaagtgcccccactacggggcccccctggtgaagggcgtgctgagccggggccgggtgcgctgcccctggcatggagcctgcttcaacatcagcactggagacctggaggacttccctggcctggacagcctgcacaagttccaggtgaagattgagaaggagaaggtgtatgtgcgggccagcaagcaggccctgcagctgcagaggaggaccaaggtgatggccaagtgcatcagccccagcgctggctacagcagcagcaccaacgtgctgattgtgggcgctggagctgctggcctggtgtgtgccgagaccctgcggcaggagggcttcagtgaccgcatcgtgctgtgcaccctggacagacacctgccctatgaccggcccaagctgagcaagagcctggacacccagcctgagcagctggccctgcggcccaaggagttcttccgggcctacggcatcgaggtgctgacagaggcccaggtggtgacagtggatgtgaggaccaagaaggtggtgttcaaggatggcttcaagctggagtacagcaagctgctgctggcccctggcagcagccccaagaccctgagctgcaagggcaaggaggtggagaatgtgttcaccatccgcaccccagaagatgccaacagagtggtgcggctggcccggggcagaaatgtggtggtggtgggcgccggcttcctgggcatggaggtggccgcctacctgacagagaaggcccacagcgtgtctgtggtggagctggaggagacccccttccgccgcttcctgggggagcgggtgggccgggccctgatgaagatgtttgagaacaacagagtgaagttctacatgcagacagaggtgtctgagctgcggggccaggagggcaagctgaaggaggtggtgctgaagagcagcaaggtggtgcgggcagatgtgtgtgtggtgggcattggagctgtgcctgccaccggcttcctgcggcagagcggcatcggcctggacagccggggcttcatccctgtgaacaagatgatgcagaccaacgtgcctggggtgtttgctgctggagatgctgtgaccttccccctggcctggaggaacaacaggaaggtgaacatcccccactggcagatggcccacgcccagggccgggtggccgcccagaacatgctggcccaggaggccgagatgagcacagtgccctacctgtggacagccatgtttgggaagagcctgcgctatgccggctatggagagggctttgatgatgtgatcatccagggcgacctggaggagctgaagtttgtggccttctacaccaagggagatgaggtgattgctgtggcctccatgaactatgaccccatcgtgtccaaggtggccgaggtgctggccagcggccgggccatcaggaagcgggaggtggagctgtttgtgctgcacagcaagacaggagacatgtcctggctgaccgggaagggcagctag

SEQ ID NO: 20588 - DNA, 1374 bp, Artificial Sequence
  Description of Artificial Sequence: Synthetic coding sequence
atgaaccagccctgcaacagcatggagccccgggtgatggatgatgacatgctgaagctggccgtgggggaccagggcccccaggaggaggccggccagctggccaagcaggagggcatcctcttcaaggatgtgctgagcctgcagctggacttcaggaacatcctgagaattgacaacctgtggcagtttgagaacctgaggaagctgcagctggacaacaacatcatcgagaagattgagggcctggagaacctggcccacctggtgtggctggacctgtccttcaacaacatcgagaccatcgagggcctggacaccctggtgaacctggaggacctgagcctcttcaacaaccgcatcagcaagattgacagcctggatgccctggtgaagctgcaggtgctgagcctgggcaacaacagaattgacaacatgatgaacatcatctacctgcggcgcttcaagtgcctgcggaccctgagcctgagcaggaaccccatcagcgaggccgaggactacaagatgttcatctgtgcctacctgcctgacctgatgtacctggactacagaagaattgatgaccacaccaagaagctggccgaggccaagcaccagtacagcattgatgagctgaagcaccaggagaacctgatgcaggcccagctggaggatgagcaggcccagcgggaggagctggagaagcacaagacagcctttgtggagcacctgaatggcagcttcctgtttgacagcatgtatgcagaggacagcgagggcaacaacctgagctacctgcccggggtgggggagctgctggagacctacaaggacaagtttgtgatcatctgtgtgaacatctttgaatatggcctgaagcagcaggagaagaggaagacagagctggacaccttctctgaatgtgtgcgggaggccatccaggagaaccaggagcagggcaagaggaagatcgccaagtttgaggagaagcacctgagcagcctgagcgccatccgggaggagctggagctgcccaacatcgagaagatgatcctggagtgcagcgctgacatcagcgagctgtttgatgccctgatgaccctggagatgcagctggtggagcagctggaggagaccatcaacatgtttgaaagaaatattgtggacatggtgggcctcttcattgaaaatgtgcagagcctgatggcccagtgccgggacctggagaaccaccaccacgagaagctgctggagatcagcatcagcaccctggagaagatcgtggagggggacctggatgaggacctgcccaatgacctgcgggccggccgcttccagaagttcaactacgtggaggccagcggcaccttctag

SEQ ID NO: 20589 - DNA, 1374 bp, Artificial Sequence; identical to SEQ ID NO: 20588
  Description of Artificial Sequence: Synthetic coding sequence

SEQ ID NO: 20590 - DNA, 1572 bp, Artificial Sequence; identical to SEQ ID NO: 18903
  Description of Artificial Sequence: Synthetic coding sequence

SEQ ID NO: 20591 - DNA, 1572 bp, Artificial Sequence; identical to SEQ ID NO: 18903
  Description of Artificial Sequence: Synthetic coding sequence

SEQ ID NO: 20592 - DNA, 1842 bp, Artificial Sequence; identical to SEQ ID NO: 18580
  Description of Artificial Sequence: Synthetic coding sequence

SEQ ID NO: 20593 - DNA, 390 bp, Artificial Sequence; identical to SEQ ID NO: 19988
  Description of Artificial Sequence: Synthetic coding sequence

SEQ ID NO: 20594 - DNA, 390 bp, Artificial Sequence; identical to SEQ ID NO: 19988
  Description of Artificial Sequence: Synthetic coding sequence

SEQ ID NO: 20595 - DNA, 4128 bp, Artificial Sequence
  Description of Artificial Sequence: Synthetic coding sequence
atggtgcctggagaggagaaccagctggtgcccaaggaggatgtgttctggcgctgccggcagaacatctttgatgagatgaagaagaagttcctgcagattgaaaatgctgctgaggagccccgggtgctgtgcatcatccaggacaccaccaacagcaagacagtgaatgaaagaatcaccctgaacctgcctgccagcacccctgtgaggaagctgtttgaagatgtggccaacaaggtgggctacatcaatggcacctttgacctggtgtggggcaatggcatcaacacagctgacatggcccccctggaccacaccagtgacaagagcctgctggatgccaactttgagcccgggaagaagaacttcctgcacctgacagacaaggatggagagcagccccagatcctgctggaggacagcagcgctggggaggacagcgtgcatgaccgcttcatcggccccctgccccgggagggcagcggcggcagcaccagtgactatgtgtcccagagctacagctacagcagcatcctgaacaagtcagaaacaggctacgtgggcctggtgaaccaggccatgacctgctacctgaacagcctgctgcagaccctcttcatgaccccagagttcagaaatgccctgtacaagtgggagtttgaggagagcgaggaggaccctgtgaccagcatcccctaccagctgcagaggctgtttgtgctgctgcagaccagcaagaagagggccatcgagaccacagatgtgaccaggagctttggctgggacagcagcgaggcctggcagcagcatgatgtgcaggagctgtgccgggtgatgtttgatgccctggagcagaagtggaagcagacagagcaggccgacctgatcaatgagctgtaccagggcaagctgaaggactatgtgcgctgcctggagtgtggctatgagggctggagaattgacacctacctggacatccccctggtgatccggccctacggcagcagccaggcctttgcctctgtggaggaggccctgcacgccttcatccagcctgagatcctggatggccccaaccagtacttctgtgagcgctgcaagaagaagtgtgatgccaggaagggcctgcgcttcctgcacttcccctacctgctgaccctgcagctgaagagatttgattttgactacaccaccatgcaccgcatcaagctgaatgacaggatgaccttccctgaggagctggacatgagcaccttcattgatgtggaggatgagaagagcccccagacagagagctgcacagattctggagcagaaaatgaaggcagctgccacagcgaccagatgagcaatgacttcagcaatgatgatggagtggatgagggcatctgcctggagaccaacagcggcacagagaagatcagcaagagcggcctggagaagaacagcctcatctatgagctgttctctgtgatggtgcacagcggcagcgctgctgggggccactactatgcctgcatcaagagcttcagtgatgagcagtggtacagcttcaatgaccagcacgtgagccgcatcacccaggaggacatcaagaagacccacggcggcagcagcggcagccggggctactacagcagcgcctttgccagcagcaccaatgcctacatgctgatctaccgcctgaaggaccctgccagaaatgccaagttcctggaggtggatgagtacccagagcacatcaagaacctggtgcagaaggagcgggagctggaggagcaggagaagaggcagcgggagattgaaagaaacacctgcaagatcaagctgttctgcctgcaccccaccaagcaggtgatgatggagaacaagctggaggtgcacaaggacaagaccctgaaggaggccgtggagatggcctacaagatgatggacctggaggaggtgatccccctggactgctgccgcctggtgaagtatgatgagttccatgactacctggagaggagctatgaaggagaggaggacacccccatgggcctgctgctgggcggcgtgaagagcacctacatgtttgacctgctgctggagaccaggaagccagaccaggtgttccagagctacaagccaggagaggtgatggtgaaggtgcacgtggtggacctgaaggccgagagcgtggccgcccccatcaccgtgcgggcctacctgaaccagacagtgacagagttcaagcagctgatcagcaaggccatccacctgcctgctgagaccatgagaattgtgctggagcgctgctacaatgacctgcggctgctgtctgtgagcagcaagaccctgaaggccgagggcttcttccgcagcaacaaggtgtttgtggagagcagcgagaccctggactaccagatggcctttgctgacagccacctgtggaagctgctggacagacatgccaacaccatccggctgtttgtgctgctgcctgagcagagccctgtgtcctacagcaagaggacagcctaccagaaggccggcggggacagcggaaatgtggatgatgactgtgagcgggtgaagggccctgtgggcagcctgaagtctgtggaggccatcctggaggagagcacagagaagctgaagagcctgagcctgcagcagcagcaggatggagacaatggagacagcagcaagagcacagagaccagtgactttgagaacatcgagagccccctgaatgaaagagacagcagcgcctctgtggacaaccgggagctggagcagcacatccagaccagtgaccctgagaacttccagagcgaggagaggagtgacagtgatgtgaacaatgacaggagcaccagctctgtggacagcgacatcctgagcagcagccacagcagtgacaccctgtgcaatgctgacaatgcccagatccccctggccaacggcctggacagccacagcatcaccagcagcaggaggaccaaggccaatgaaggcaagaaggagacctgggacacagcagaagaagattctggaacagattctgaatatgatgagagcggcaagagcagaggagagatgcagtacatgtacttcaaggccgagccctatgctgctgatgagggcagcggggagggccacaagtggctgatggtgcacgtggacaagaggatcaccctggccgccttcaagcagcacctggagccctttgtgggcgtgctgagcagccacttcaaggtgttccgggtgtatgccagcaaccaggagtttgagagcgtgcggctgaatgagaccctgagcagcttcagtgatgacaacaagatcaccatccggctgggccgggccctgaagaagggggagtacagagtgaaggtgtaccagctgctggtgaatgagcaggagccctgcaagttcctgctggatgctgtgtttgccaagggcatgacagtgcggcagagcaaggaggagctgatcccccagctgcgggagcagtgtggcctggagctgagcattgaccgcttccggctgaggaagaagacctggaagaaccctggcaccgtcttcctggactaccacatctatgaggaggacatcaacatcagcagcaactgggaggtgttcctggaggtgctggatggagtggagaagatgaagtccatgagccagctggccgtgctgagccgccgctggaagcccagcgagatgaagctggaccccttccaggaggtggtgctggagagcagctctgtggatgagctgcgggagaagctgtctgagatcagcggcatccccctggatgacatcgagtttgccaagggccggggcaccttcccctgtgacatctctgtgctggacatccaccaggacctggactggaaccccaaggtgtccaccctgaatgtgtggcccctgtacatctgtgatgatggagctgtgatcttctacagagacaagacagaggagctgatggagctgacagatgagcagagaaatgagctgatgaagaaggagagcagccggctgcagaagacaggccaccgggtgacctacagccccaggaaggagaaggccctgaagatctacctggatggagcccccaacaaggacctgacccaggactag

SEQ ID NO: 20596 - DNA, 600 bp, Artificial Sequence
  Description of Artificial Sequence: Synthetic coding sequence
atgaggacagctgaccgggaggcccggcccggcctgcccagcctgctgctgctgctgctggccggggccggcctgtctgctgccagccccccagctgccccccgcttcaacgtgtccctggacagcgtgcctgagctgcgctggctgcctgtgctgcggcactatgacctggacctggtgcgggccgccatggcccaggtgattggagacagagtgcccaagtgggtgcacgtgctgattggcaaggtggtgctggagctggagcgcttcctgccccagcccttcaccggggagatccggggcatgtgtgacttcatgaacctgagcctggccgactgcctgctggtgaacctggcctatgagagctctgtgttctgcaccagcatcgtggcccaggacagccggggccacatctaccacggcaggaacctggactacccctttggaaatgtgctgaggaagctgactgtggatgtgcagttcctgaagaatggccagatcgccttcaccggcaccaccttcatcggctacgtgggcctgtggacaggccagagcccccacaagttcaccgtgtctggagatgagcgggacccccactag

SEQ ID NO: 20597 - DNA, 972 bp, Artificial Sequence
  Description of Artificial Sequence: Synthetic coding sequence
atgaggacagctgaccgggaggcccggcccggcctgcccagcctgctgctgctgctgctggccggggccggcctgtctgctgccagccccccagctgccccccgcttcaacgtgtccctggacagcgtgcctgagctgcgctggctgcctgtgctgcggcactatgacctggacctggtgcgggccgccatggcccaggtgattggagacagagtgcccaagtgggtgcacgtgctgattggcaaggtggtgctggagctggagcgcttcctgccccagcccttcaccggggagatccggggcatgtgtgacttcatgaacctgagcctggccgactgcctgctggtgaacctggcctatgagagctctgtgttctgcaccagcatcgtggcccaggacagccggggccacatctaccacggcaggaacctggactacccctttggaaatgtgctgaggaagctgactgtggatgtgcagttcctgaagaatggccagatcgccttcaccggcaccaccttcatcggctacgtgggcctgtggacaggccagagcccccacaagttcaccgtgtctggagatgagcgggacaagggctggtggtgggagaatgccatcgccgccctcttcagaagacacatccctgtgtcctggctgatccgggccaccctgtctgagagcgagaactttgaggccgctgtgggcaagctggccaagacccccctgattgctgatgtgtactacatcgtgggcggcaccagcccccgggagggcgtggtgatcaccaggaacagagatggccctgctgacatctggcccctggaccccctgaatggagcctggttccgggtggagaccaactatgaccactggaagccagcccccaaggaggatgacaggaggaccagcgccatcaaggccctgaatgccaccggccaggccaacctgagcctggaggccctcttccagtag

SEQ ID NO: 20598 - DNA, 4539 bp, Artificial Sequence
  Description of Artificial Sequence: Synthetic coding sequence
atggctgctgctgctggcaacagagccagcagcagcggcttccctggggcccgggccaccagccctgaggccggcggcggcggcggggccctgaaggccagcagcgccccagctgctgctgctggcctgctgcgggaggccggcagcggcggccgggagagagctgactggaggcggcggcagctgaggaaggtgcgctctgtggagctggaccagctgcctgagcagcccctcttcctggccgccagccccccagccagcagcaccagccccagccctgagccagcagatgctgctggcagcggcaccggcttccagcctgtggccgtgcccccaccccacggggccgccagccggggcggggcccacctgacagaatctgtggccgccccagattctggggccagcagccctgctgctgctgagcctggagagaagagggccccagctgctgagcccagccctgctgctgccccagctggccgggagatggagaacaaggagaccctgaagggcctgcacaagatggatgacaggcctgaggagaggatgatccgggagaagctgaaggccacctgcatgcctgcctggaagcatgagtggctggagaggaggaacagaagaggccctgtggtggtgaagcccatccctgtgaagggagatggcagcgagatgaaccacctggccgctgagagccctggagaggtgcaggccagcgctgccagccctgccagcaagggccgccgcagccccagccctggcaacagccccagcggccgcacagtgaagtctgagagccctggggtgcggaggaagagggtgtcccctgtgcccttccagagcggccgcatcaccccaccccggcgggcccccagcccagatggcttcagcccctacagccctgaggagaccaacagaagagtgaacaaggtgatgagggcccggctgtacctgctgcagcagatcggccccaacagcttcctgattggaggagacagcccagacaacaagtacagagtcttcatcggcccccagaactgcagctgtgcccggggcaccttctgcatccacctgctgtttgtgatgctgcgggtcttccagctggagcccagcgaccccatgctgtggaggaagaccctgaagaactttgaggtggagagcctcttccagaagtaccacagcagaagaagcagccgcatcaaggcccccagcaggaacaccatccagaagtttgtgtccaggatgagcaacagccacaccctgagcagcagcagcaccagcaccagcagcagcgagaacagcatcaaggatgaggaggagcagatgtgccccatctgcctgctgggcatgctggatgaggagagcctgactgtgtgtgaagatggctgcaggaacaagctgcaccaccactgcatgagcatctgggccgaggagtgcagaagaaaccgggagcccctcatctgccccctgtgccgcagcaagtggaggagccatgacttctacagccatgagctgagcagccctgtggacagccccagcagcctgcgggccgcccagcagcagacagtgcagcagcagcccctggccggcagcagaagaaaccaggagagcaacttcaacctgacccactacggcacccagcagatccccccagcctacaaggacctggccgagccctggatccaggtgtttggcatggagctggtgggctgcctcttcagcaggaactggaatgtgcgggagatggccctgcggcggctgagccatgatgtgtctggggccctgctgctggccaatggagagagcactggaaacagcggcggcagcagcggcagcagccccagcggcggggccaccagcggcagcagccagaccagcatctctggagatgtggtggaggcctgctgcagcgtgctgtccatggtgtgtgccgaccctgtgtacaaggtgtatgtggccgccctgaagaccctgcgggccatgctggtgtacaccccctgccacagcctggccgagcgcatcaagctgcagaggctgctgcagcctgtggtggacaccatcctggtgaagtgtgctgatgccaacagcaggaccagccagctgagcatcagcaccctgctggagctgtgcaagggccaggccggggagctggccgtgggccgggagatcctgaaggccggcagcattggaattggaggagtggactatgtgctgaactgcatcctgggcaaccagacagagagcaacaactggcaggagctgctgggccgcctgtgcctgattgaccggctgctgctggagttccctgctgagttctacccccacatcgtgtccacagatgtgtcccaggccgagcctgtggagatccgctacaagaagctgctgagcctgctgacctttgccctgcagagcattgacaacagccacagcatggtgggcaagctgagccgccgcatctacctgagcagcgccaggatggtgaccaccgtgccccacgtgttcagcaagctgctggagatgctgtctgtgagcagcagcacccacttcaccaggatgagaagaaggctgatggccatcgcagatgaggtggagattgctgaggccatccagctgggcgtggaggacaccctggatggccagcaggacagcttcctgcaggcctctgtgcccaacaactacctggagaccacagagaacagcagcccagaatgtactgtgcacctggagaagacaggcaagggcctgtgtgccaccaagctgagcgccagcagcgaggacatcagcgagcggctggccagcatctctgtgggccccagcagcagcaccaccaccaccaccaccaccacagagcagcccaagcccatggtgcagaccaagggccggccccacagccagtgcctgaacagcagccccctgagccaccacagccagctgatgtttcctgccctgagcacccccagcagcagcacccccagcgtgcctgctggaacagccacagatgtgtccaagcaccggctgcagggcttcatcccctgccgcatccccagcgccagcccccagacccagaggaagttcagcctgcagttccacaggaactgcccagagaacaaggacagcgacaagctgagccctgtgttcacccagagccggcccctgcccagcagcaacatccaccggcccaagcccagccggcccaccccaggcaacaccagcaagcagggcgaccccagcaagaacagcatgaccctggacctgaacagcagcagcaaatgtgatgacagctttggctgcagcagcaacagcagcaatgctgtgatccccagtgatgaaacagtgttcacccctgtggaggagaagtgccgcctggatgtgaacacagagctgaacagcagcattgaggacctgctggaggcctccatgcccagcagtgacaccaccgtgaccttcaagtctgaggtggccgtgctgagccctgagaaggccgagaatgatgacacctacaaggatgatgtgaaccacaaccagaagtgcaaggagaagatggaggccgaggaggaggaggccctggccatcgccatggccatgtctgccagccaggatgccctgcccatcgtgccccagctgcaggtggagaatggagaggacatcatcatcatccagcaggacaccccagagaccctgcccggccacaccaaggccaagcagccctaccgggaggacacagagtggctgaagggccagcagatcggcctgggcgccttcagcagctgctaccaggcccaggatgtgggcaccggcaccctgatggctgtgaagcaggtgacctacgtgaggaacaccagcagcgagcaggaggaggtggtggaggccctgcgggaggagatccgcatgatgagccacctgaaccaccccaacatcatccgcatgctgggcgccacctgtgagaagagcaactacaacctcttcatcgagtggatggccggcggctctgtggcccacctgctgagcaagtacggggccttcaaggagagcgtggtgatcaactacacagagcagctgctgcggggcctgagctacctgcacgagaaccagatcatccacagagatgtgaagggggccaacctgctgattgacagcacaggccagaggctgagaattgctgactttggagctgctgcccggctggccagcaagggcaccggggccggggagttccagggccagctgctgggcaccatcgccttcatggcccctgaggtgctgcggggccagcagtatggccgcagctgtgatgtgtggagcgtgggctgtgccatcatcgagatggcctgtgccaagccaccctggaatgctgagaagcacagcaaccacctggccctgatcttcaagatcgccagcgccaccacagcccccagcatccccagccacctgagccctggcctgagagatgtggccctgcgctgcctggagctgcagccccaggacaggcctcccagccgggagctgctgaagcaccctgtgttccgcaccacctggtag

SEQ ID NO: 20599 - DNA, 2274 bp, Artificial Sequence
  Description of Artificial Sequence: Synthetic coding sequence
gctgatggaggagacagccaggccttccgctgcaccagctgtggccatgctggcaccaccccagccccccgggaggccctgagccctgcagatgcccacgtgggccggggctttgctgagcgggagcccatcccagcccagggcctgctggtgctggccgtgctgagtgatggagctggggaccacatccggcagaggctgctgccccccctgctgcagatcgtgtgcaagggcctggaggaccccagccaggtggtgagaaatgctgccctgtttgccctgggccagttcagcgagaacctgcagccccacatcagcagctacagccgggaggtgatgcccctgctgctggcctacctgaagtctgtgcccctgggccacacccaccacctggccaaggcctgctacgccctggagaactttgtggagaacctgggccccaaggtgcagccctacctgcctgagctgatggagtgcatgctgcagctgctgaggaaccccagcagcccccgggccaaggagctggccgtgtctgccctgggcgccatcgccacagctgcccaggccagcctgctgccctacttccctgccatcatggagcacctgcgggagttcctgctgaccggccgggaggacctgcagcctgtgcagatccagagcctggagaccctgggcgtgctggcccgggctgtgggggagcccatgaggcccctggccgaggagtgctgccagctgggcctgggcctgtgtgaccaggtggatgatcctgacctgcggcgctgcacctacagcctgtttgctgccctgagcggcctgatgggagagggcctggccccccacctggagcagatcaccaccctgatgctgctgagcctgcggagcacagagggcatcgtgccccagtatgatggcagcagcagcttcctgctgtttgatgatgaaagtgatggagaggaggaggaggagctgatggatgaagatgtggaggaggaggatgacagcgagatcagcggctacagcgtggagaatgccttctttgatgagaaggaggacacctgtgccgctgtgggggagatctctgtgaacacctctgtggccttcctgccctacatggagagcgtgtttgaggaggtgttcaagctgctggagtgcccccacctgaatgtgaggaaggccgcccacgaggccctgggccagttctgctgtgccctgcacaaggcctgccagagctgccccagcgagcccaacacagctgccctgcaggccgccctggcccgggtggtgcccagctacatgcaggccgtgaaccgggagcgggagcggcaggtggtgatggctgtgctggaggccctgactggagtgctgcggagctgtggcaccctgaccctgaagcccccaggccgcctggccgagctgtgtggggtgctgaaggctgtgctgcagaggaagacagcctgccaggacacagatgaggaggaggaggaggaggatgatgaccaggccgagtatgatgccatgctgctggagcacgccggggaggccatcccagccctggccgctgctgctggaggagacagctttgcccccttctttgctggcttcctgcccctgctggtgtgcaagaccaagcagggctgcaccgtggccgagaagagctttgctgtgggcaccctggccgagaccatccagggcctgggcgccgccagcgcccagtttgtgtcccggctgctgcctgtgctgctgagcacagcccaggaggccgaccctgaggtgcgcagcaatgccatcttcggcatgggcgtgctggccgagcacggcggccacccagcccaggagcacttccccaagctgctgggcctgctcttccccctgctggcccgggagagacatgacagagtgcgggacaacatctgtggggccctggcccggctgctgatggccagccccaccaggaagccagagccccaggtgctggccgccctgctgcacgccctgcccctgaaggaggacctggaggagtgggtgaccatcggccgcctcttctccttcctgtaccagagcagcccagaccaggtgattgatgtggcccctgagctgctgcgcatctgcagcctcatcctggccgacaacaagatccccccagacaccaaggccgccctgctgctgctgctgaccttcctggccaagcagcacacagacagcttccaggccgccctgggcagcctgcctgtggacaaggcccaggagctgcaggccgtgctgggcctgtcctag

SEQ ID NO: 20600 - DNA, 1812 bp, Artificial Sequence
  Description of Artificial Sequence: Synthetic coding sequence
atgggcgtcatccctgagggccccctgtgggtgtctggcagtgatgacaacctgagcggcaccagcggcatggaggtggatgacagagtgtctgccctggagcagaggctgcagctgcaggaggatgagctggccgtgctgaaggccgccctggctgatgccctgcggcggctgcgggcctgtgaggagcagggcgccgccctgcgggcccggggcacccccaagggccgggccccaccccggctgggcaccacagcctctgtgtgccagctgctgaagggcctgcccaccaggacccccctgaatggcagcggccccccccggcgggtgggcggctacgccaccagccccagcagccccaagaaggaggccaccagcggccgcagctctgtgcggcgctacctgagccctgagcggctggcctctgtgcggcgggaggaccccaggagcaggaccaccagcagcagcagcaactgcagcgccaagaaggagggcaagaccaaggaggtgatcttctctgtggaggatggctctgtgaagatgttcctgcggggccggcctgtgcccatgatgatcccagatgagctggcccccacctacagcctggacaccaggtctgagctgcccagctgccgcctgaagctggagtgggtgtatggctaccggggccgggactgccgggccaacctgtacctgctgcccactggagagatcgtgtactttgtggcctctgtggccgtgctgtacagcgtggaggagcagaggcagaggcactacctgggccacaatgatgacatcaagtgcctggccatccacccagacatggtgaccatcgccaccggccaggtggccggcaccaccaaggagggcaagcccctgcccccccacgtgcgcatctgggacagcgtgtccctgagcaccctgcacgtgctgggcctgggcgtgtttgacagagctgtgtgctgcgtgggcttcagcaagagcaatggaggcaacctgctgtgtgctgtggatgagagcaatgaccacatgctgtctgtgtgggactgggccaaggagaccaaggtggtggatgtgaagtgcagcaatgaagctgtgctggtggccaccttccaccccacagaccccaccgtgctgatcacctgtgggaagagccacatctacttctggaccctggagggcggcagcctgagcaagaggcagggcctgtttgagaagcatgagaagcccaagtatgtgctgtgtgtgaccttcctggagggcggagatgtggtgactggagacagcggcggcaacctgtatgtgtggggcaagggcggcaaccgcatcacccaggccgtgctgggcgcccatgatggcggcgtgtttggcctgtgtgccctgagagatggcaccctggtgtctgggggcggccgggaccggcgggtggtgctgtggggcagtgactacagcaagctgcaggaggtggaggtgcctgaagattttggacctgtgaggacagtggccgagggccatggagacaccctgtatgtgggcaccaccagaaattccatcctgcagggctctgtgcacacaggcttcagcctgctggtgcagggccacgtggaggagctgtggggcctggccacccaccccagccgggcccagtttgtgacctgtggccaggacaagctggtgcacctgtggagcagtgacagccaccagcccctgtggagccgcatcatcgaggtggagagccgctctgtgacccaggccggcggccagtggcatgacctgggcagcctgcagcccccacctcctggcttcaagtag

SEQ ID NO: 20601 - DNA, 996 bp, Artificial Sequence
  Description of Artificial Sequence: Synthetic coding sequence
atggccgagggcggcggccctgagcctggagagcaggagcggcgcagcagcggccccaggcctccttctgcccgggacctgcagctggccctggccgagctgtatgaagatgaggtgaagtgcaagagcagcaagagcaaccggcccaaggccaccgtcttcaagagccccaggaccccaccccagcgcttctacagcagcgagcacgagtacagcggcctgaacatcgtgcggcccagcacaggcaagatcgtgaatgagctgttcaaggaggcccgggagcacggggctgtgcccctgaatgaggccacccgggccagcggagatgacaagagcaagagcttcaccggcggcggctaccgcctgggcagcagcttctgcaagaggtctgagtacatctacggggagaaccagctgcaggatgtgcagatcctgctgaagctgtggagcaatggcttcagcctggatgatggagagctgcggccctacaatgagcccaccaatgcccagttcctggagagcgtgaagagaggagagatccccctggagctgcagaggctggtgcatggaggccaggtgaacctggacatggaggaccaccaggaccaggagtacatcaagccccggctgcgcttcaaggccttcagcggggagggccagaagctgggcagcctgaccccagaaattgtgtccacccccagcagccctgaggaggaggacaagagcatcctgaatgctgtggtgctgattgatgattctgtgcccaccaccaagatccagatccggctggctgatggcagccgcctcatccagcgcttcaacagcacccaccgcatcctggatgtgaggaacttcatcgtgcagagcaggcctgagtttgctgccctggacttcatcctggtgaccagcttccccaacaaggagctgacagatgagagcctgaccctgctggaggccgacatcctgaacacagtgctgctgcagcagctgaagtag

SEQ ID NO: 20602 - DNA, 2064 bp, Artificial Sequence
  Description of Artificial Sequence: Synthetic coding sequence
atggatggaggagccctgacagacaccagcctgacagacagctacttcagcaccagcttcatcggcgtgaatggcttcggcagccctgtggagaccaagtaccccctgatgcagaggatgaccaacagcagcagcagccccagcctgctgaatgattctgccaagccctacagcgcccatgaccccctgaccagccctgccagcagcctcttcaatgactttggagccctgaacatcagccagaggaggaagacccccaaccccacagccagcgagttcatccccaagggcggcagcaccagccggctgagcaatgtgtcccagagcaacatgtctgccttcagccaggtgttcagccaccccagcatgggcagccctgccacagctggcctggcccctggcatgagcctgtctgctggcagcagccccctgcacagccccaagatcaccccccacaccagccctgcccccaggagaagaagccacacccccaacccagccagctacatggtgcccagcagcgccagcacctctgtgaacaaccctgtgtcccagacccccagcagcggccaggtgatccagaaggagaccgtgggcggcaccacctacttctacacagacaccaccccagcccccctgaccggcatggtgttccccaactaccacatctacccacccacagccccccacgtggcctacatgcagcccaaggccaatgcccccagcttcttcatggctgatgagctgcggcaggagctgatcaacagacacctgatcaccatggcccagattgaccaggccgacatgcctgctgtgcccacagaggtggacagctaccacagcctcttccccctggagcccctgcccccacccaaccgcatccagaagagcagcaactttggctacatcaccagctgctacaaggctgtgaacagcaaggatgacctgccctactgcctgcggcgcatccacggcttccggctggtgaacaccaagtgcatggtgctggtggacatgtggaagaagatccagcacagcaacatcgtgaccctgcgggaggtgttcaccaccaaggcctttgctgagcccagcctggtgtttgcctatgacttccacgccggcggggagaccatgatgagccgccacttcaatgaccccaatgctgatgcctacttcaccaagaggaagtggggccagcacgagggccccctgccccggcagcacgccggcctgctgcctgagagcctcatctgggcctacatcgtgcagctgagcagcgccctgcggaccatccacacagctggcctggcctgccgggtgatggaccccaccaagatcctgatcaccgggaagacccggctgcgggtgaactgtgtgggcgtgtttgatgtgctgacctttgacaacagccagaacaacaaccccctggccctgatggcccagtaccagcaggccgacctgatcagcctgggcaaggtggtgctggccctggcctgcaacagcctggccggcatccagcgggagaacctgcagaaggccatggagctggtgaccatcaactacagcagtgacctgaagaacctgatcctgtacctgctgacagaccagaacaggatgaggtctgtgaatgacatcatgcccatgattggagcccgcttctacacccagctggatgctgcccagatgagaaatgatgtgattgaggaggacctggccaaggaggtgcagaatggccgcctcttccggctgctggccaagctgggcaccatcaatgaaagacctgagttccagaaggaccccacctggagcgagactggagaccgctacctgctgaagctgttccgggaccacctgttccaccaggtgacagaagctggggccccctggattgacctgagccacatcatcagctgcctgaacaagctggatgctggggtgcctgagaagatcagcctcatcagcagagatgagaagtctgtgctggtggtgacctacagcgacctgaagcgctgctttgagaacaccttccaggagctgattgctgctgccaacggccagctgtag

SEQ ID NO: 20603 - DNA, 6951 bp, Artificial Sequence
  Description of Artificial Sequence: Synthetic coding sequence
atggatggagtgagcagcgaggccaatgaagaaaatgacaacatcgagaggcctgtgagaagaagacacagcagcatcctgaagcccccaagaagccccctgcaggacctgcggggcggcaatgaaagagtgcaggagagcaatgccctgaggaacaagaagaacagcagaagagtgtcctttgctgacaccatcaaggtgttccagacagagagccacatgaagatcgtgaggaagtctgagatggaggagacagaaacaggagagaacctgctgctgatccagaacaagaagctggaggacaactactgtgagatcaccggcatgaacaccctgctgagcgcccccatccacacccagatgcagcagaaggagttcagcatcatcgagcacacccgggagaggaagcacgccaatgaccagaccgtcatcttcagtgatgagaaccagatggacctgaccagcagccacacagtgatgatcaccaagggcctgctggacaaccccatcagcgagaagagcaccaagattgacaccaccagcttcctggccaacctgaagctgcacacagaggacagcaggatgaagaaggaggtgaacttctctgtggaccagaacaccagcagcgagaacaagattgacttcaatgacttcatcaagaggctgaagacaggcaagtgcagcgccttcccagatgtgcctgacaaggaaaattttgagatccccatctacagcaaggagcccaacagcgccagcagcacccaccagatgcacgtgtccctgaaggaggatgagaacaacagcaacatcaccaggctcttccgggagaaggatgatggcatgaacttcacccagtgccacacagccaacatccagaccctcatccccaccagcagcgagaccaacagccgggagagcaaaggaaatgacatcaccatctatggaaatgacttcatggacctgaccttcaaccacaccctgcagatcctgcctgccactggaaacttcagcgagattgagaaccagacccagaatgccatggatgtgaccaccggctacggcaccaaggccagcggcaacaagacagtgttcaagagcaagcagaacacagccttccaggacctgagcatcaacagcgctgacaagatccacatcaccaggagccacatcatgggcgctgagacccacatcgtgtcccagacctgcaaccaggatgcccgcatcctggccatgaccccagagagcatctacagcaaccccagcatccagggctgcaagacagtgttctacagcagctgcaatgatgccatggagatgaccaagtgcctgagcaacatgagggaggagaagaacctgctgaagcatgacagcaactatgccaagatgtactgcaacccagatgccatgagcagcctgacagagaagaccatctacagcggggaggagaacatggacatcaccaagagccacacagtggccatcgacaaccagatcttcaagcaggaccagagcaatgtgcagattgctgctgcccccaccccagagaaggagatgatgctgcagaacctgatgaccaccagtgaagatggcaagatgaatgtgaactgcaacagcgtgccccacgtgtccaaggagcgcatccagcagagcctgagcaaccccctgagcatcagcctgacagacaggaagacagagctgctgagcggggagaacatggacctgacagagagccacaccagcaacctgggcagccaggtgcccctggccgcctacaacctggcccctgagagcaccagcgagagccacagccagagcaagagcagcagtgatgaatgtgaggagatcaccaagagcagaaatgagcccttccagaggagtgacatcatcgccaagaacagcctgacagacacctggaacaaggacaaggactgggtgctgaagatcctgccctacctggacaaggacagcccccagagcgctgactgcaaccaggagatcgccaccagccacaacatcgtgtactgcggcggcgtgctggacaagcagatcaccaacagaaacacagtgtcctgggagcagagcctcttcagcaccaccaagcccctcttcagcagcggccagttctccatgaagaaccacgacacagccatcagcagccacacagtgaagtctgtgctgggccagaacagcaagctggccgagcccctgaggaagagcctgagcaaccccaccccagactactgccacgacaagatgatcatctgcagcgaggaggagcagaacatggacctgaccaagagccacacagtggtgattggcttcggccccagcgagctgcaggagctgggcaagaccaacctggagcacaccaccggccagctgaccaccatgaaccggcagattgctgtgaaggtggagaagtgtgggaagagccccatcgagaagagcggcgtgctgaagagcaactgcatcatggatgtgctggaggatgagagcgtgcagaagcccaagttccccaaggagaagcagaatgtgaagatctggggcaggaagtctgtgggcggccccaagattgacaagaccatcgtgttttctgaagatgacaagaatgacatggacatcaccaagagctacaccatcgagatcaaccaccggcccctgctggagaagagggactgccacctggtgcccctggccggcaccagcgagaccatcctgtacacctgccggcaggatgacatggagatcaccaggagccacaccacagccctggagtgcaagacagtgtccccagatgagatcaccacccggcccatggacaagacagtggtgtttgtggacaaccacgtggagctggagatgacagagagccacacagtgttcatcgactaccaggagaaggagaggacagaccggcccaactttgagctgagccagaggaagagcctgggcacccccaccgtcatctgcacccccacagaggagagcgtcttcttccctggaaatggagagagtgaccggctggtggccaatgacagccagctgacccccctggaggagtggagcaacaacagaggccctgtggaggtggccgacaacatggagctgagcaagagcgccacctgcaagaacatcaaggatgtgcagagccctggcttcctgaatgagcccctgagcagcaagagccagaggaggaagagcctgaagctgaagaatgacaagaccatcgtgttttctgagaaccacaagaatgacatggacatcacccagagctgcatggtggagattgacaatgaaagtgccctggaggacaaggaggacttccacctggccggggccagcaagaccatcctgtacagctgtggccaggatgacatggagatcaccaggagccacaccacagccctggagtgcaagaccctgctgcccaatgagatcgccatccggcccatggacaagacagtgctcttcacagacaactacagcgacctggaggtgacagacagccacacagtgttcatcgactgccaggccacagagaagatcctggaggagaaccccaagtttggaattggcaagggcaagaacctgggcgtgtccttccccaaggacaacagctgtgtgcaggagattgctgagaagcaggccctggccgtgggcaacaagatcgtgctgcacacagagcagaagcagcagctgtttgctgccaccaacagaaccaccaatgagatcatcaagttccacagcgctgccatggatgagaaggtgattggcaaggtggtggaccaggcctgcaccctggagaaggcccaggtggagagctgccagctgaacaacagagacagaagaaatgtggacttcaccagcagccacgccacagctgtgtgtggcagcagtgacaactacagctgcctgcccaacgtcatcagctgcacagacaacctggagggcagcgccatgctgctgtgtgacaaggatgaggagaaggccaactactgccctgtgcagaatgacctggcctatgccaatgactttgccagcgagtactacctggagagcgagggccagcccctgagcgccccctgccccctgctggagaaggaggaggtgatccagaccagcaccaagggccagctggactgtgtgatcaccctgcacaaggaccaggacctgatcaaggaccccaggaacctgctggccaaccagaccctggtgtacagccaggacctgggggagatgaccaagctgaacagcaagagggtgtccttcaagctgcccaaggaccagatgaaggtgtatgtggatgacatctacgtgatcccccagccccacttcagcacagaccagccccccctgcccaagaagggccagagcagcatcaacaaggaggaggtgatcctgagcaaggccggcaacaagagcctgaacatcatcgagaacagcagcgcccccatctgtgagaacaagcccaagatcctgaacagcgaggagtggtttgctgctgcctgcaagaaggagctgaaggagaacatccagaccaccaactacaacacagccctggacttccacagcaacagtgatgtgaccaagcaggtgatccagacccacgtgaatgctggggaggccccagaccctgtgatcaccagcaatgtgccctgcttccacagcatcaagcccaacctgaacaacctgaatggcaagacaggagagttcctggccttccagacagtgcacctgccccccctgcctgagcagctgctggagctgggcaacaaggcccacaatgacatgcacatcgtgcaggccacagagatccacaacatcaacatcatcagcagcaatgccaaggacagcagagatgaggagaacaagaagagccacaacggggctgagaccaccagcctgccccccaagacagtgttcaaggacaaggtgcggcgctgcagcctgggcatcttcctgccccggctgcccaacaagaggaactgcagcgtgactggaattgatgacctggagcagatcccagctgacaccacagacatcaaccacctggagacccagcctgtgagcagcaaggacagcggcatcggctctgtggccggcaagctgaacctgagccccagccagtacatcaatgaggagaacctgcctgtgtacccagatgagatcaacagcagtgacagcatcaacattgaaacagaggagaaggccctgattgagacctaccagaaggagatcagcccctatgagaacaagatgggcaagacctgcaacagccagaagaggacctgggtgcaggaggaggaggacatccacaaggagaagaagatcaggaagaatgagatcaagttcagtgacaccacccaggaccgggagatctttgaccaccacacagaggaggacatcgacaagagcgccaacagcgtgctgatcaagaacctgagcaggacccccagcagctgcagcagcagcctggacagcatcaaggcagatggcaccagcctggacttcagcacctaccgcagcagccagatggagagccagttcctgcgggacaccatctgtgaggagagcctgcgggagaagctgcaggacggccgcatcaccatccgggagttcttcatcctgctgcaggtgcacatcctgatccagaagccccggcagagcaacctgcccggcaacttcaccgtgaacaccccacccaccccagaggacctgatgctgagccagtatgtgtaccggcccaagatccagatctaccgggaggactgtgaggcccggcggcagaagattgaggagctgaagctgagcgccagcaaccaggacaagctgctggtggacatcaacaagaacctgtgggagaagatgaggcactgcagcgacaaggagctgaaggccttcggcatctacctgaacaagatcaagagctgcttcaccaagatgaccaaggtgttcacccaccagggcaaggtggccctgtatggcaagctggtgcagagcgcccagaatgaaagagagaagctgcagatcaagattgatgagatggacaagatcctgaagaagattgacaactgcctgacagagatggagacagagaccaagaacctggaggatgaggagaagaacaaccctgtggaggagtgggacagcgagatgagagctgctgagaaggagctggagcagctgaagacagaggaggaggagctgcagaggaacctgctggagctggaggtgcagaaggagcagaccctggcccagattgacttcatgcagaagcagaggaacagaacagaggagctgctggaccagctgagcctgtctgagtgggatgtggtggagtggagcgatgaccaggccgtgttcacctttgtgtatgacaccatccagctgaccatcacctttgaggagagcgtggtgggcttccccttcctggacaagcgctacaggaagatcgtggatgtgaacttccagagcctgctggatgaggaccaggccccacccagcagcctgctggtgcacaagctgatcttccagtatgtggaggagaaggagagctggaagaagacctgcaccacccagcaccagctgcccaagatgctggaggagttcagcctggtggtgcaccactgccgcctgctgggggaggagattgagtacctgaagcgctggggccccaactacaacctgatgaacatcgacatcaacaacaatgagctgcggctgctcttcagcagcagcgctgcctttgccaagtttgagatcaccctcttcctgagcgcctactaccccagcgtgcccctgcccagcaccatccagaaccacgtgggcaacaccagccaggatgacatcgccaccatcctgagcaaggtgcccctggagaacaactacctgaagaatgtggtgaagcagatctaccaggacctcttccaggactgccacttctaccactag

SEQ ID NO: 20604 - DNA, 714 bp, Artificial Sequence
  Description of Artificial Sequence: Synthetic coding sequence
atgggctgctgcggctgcagcggcggctgcggcagcggctgcggcggccggggcagcggctgcggcggctgcggcagcggctgcggcggctgcggcagcggctgcggcggctgcggcagcggctgcggcggctgcggcggctgcggcagcggctgtgccggctgcggcggctgcggcagcggctgctgcgtgcctgtgtgctgctgcaagcccatgtgctgctgcgtgcctgcctgcagctgcagcagctgtgggaagggcggctgcggcagctgtggcggcagcaagaggggctgtgtgtcctgtggggtgtccaagggggcctgtggcagctgtggcggcagcaagggcggctgcggcagctgtggcggcagcaagggcggctgcggcagctgtggcggcagcaagggcggctgcggcagctgtggcggcagcaagggcggctgcggcagctatggctgcagccagagcagctgctgcaagccctgctgctgcagcagcggctgcggcagcagctgctgccagagcagctgctgcaagccctactgctgccagagcagctgctgcaagccctactgctgccagagcagctgctgcaagccctgcagctgcttcagcggctgcggcagcagctgctgccagagcagctgctacaagccctgctgctgccagagcagctgctgcgtgcctgtgtgctgccagtgcaagatctag

SEQ ID NO: 20605 - DNA, 717 bp, Artificial Sequence
  Description of Artificial Sequence: Synthetic coding sequence
atgggctgcagcggctgcagcggcggctgcggcagcagctgtggcggctgcggcagcagctgtggcggctgcggcagcggctacggcggctgcggcagcggctgctgcgtgcctgtgtgctgctgcaagcctgtgtgctgctgcgtgcctgcctgcagctgcagcagctgtggcagctgtggcggcagcaagggcgtgtgtggcagctgtggcggctgcaagggcggctgcggcagctgtggcggcagcaagggcggctgcggcagcagctgctgcgtgcctgtgtgctgcagcagcagctgtggcagctgtggcggcagcaagggcgtgtgtggcttccggggcggcagcaagggcggctgcggcagctgtggctgcagccagtgcagctgctacaagccctgctgctgcagcagcggctgcggcagcagctgctgccagagcagctgctgcaagcccagctgcagccagagcagctgctgcaagccctgctgcagccagagcagctgctgcaagccctgctgctgcagcagcggctgcggcagcagctgctgccagagcagctgctgcaagccctgctgcagccagagcagctgctgcaagccctgctgctgcagcagcggctgcggcagcagctgctgccagagcagctgctgcaagccctgcagcagccagagcagctgctgcgtgcccatctgctgccagtgcaagatctag

SEQ ID NO: 20606 - DNA, 1473 bp, Artificial Sequence; identical to SEQ ID NO: 18917
  Description of Artificial Sequence: Synthetic coding sequence

SEQ ID NO: 20607 - DNA, 5826 bp, Artificial Sequence
  Description of Artificial Sequence: Synthetic coding sequence
ctgctgacctctgtgctgatgcccagctttggctacttcatccgcagccctgagaagcgggagcccatcgccctgatcaggaagagtgatgtgtcccggggcaacctggagaaggagatggcccacctgaaccacgacctgtacagcggggacctgaatgagcagagccaggcccagctgtctgagggcagcatcaccctgcaggtggaggccgtggagagcaccagccaggtggatgaaaatgatgtgaccctgacagctgacaagggcaagacagaggacaccttcttcatgagcaacaagccccagcgctacaaggacaagctgcctgacagcggggacagcatgctgcgcatcagcaccatcgccagcgccatcgccgaggcctctgtgaacacagaccccagccagctggccgccatgatcaaggccctgagcaacaagacccgggacaagaccttccaggaggatgagaagcagaaggactacagccacgtgcgccacttcctgcccaatgacctggagaagagcaatggcagcaatgccctggacatggagaagtacctgaagaagacagaggtgagccgctatgaaagtgccctggagaacttcagccgggcctccatgtctgacacctgggacctgagcctgcccaaggagcagaccacccaggacatccaccctgtggacctgagcgccacctctgtgtctgtgcgggccccagaagaaaatacagctgccatcgtgtatgtggagaatggagagagcgagaaccaggagagcttccgcaccatcaacagcagcaacagcgtgaccaaccgggagaacaacagcgctgtggtggatgtgaagacctgcagcattgacaacaagctgcaggatgtgggcaatgatgagaaggccaccagcatcagcacccccagcgacagctacagctctgtgaggaacccccgcatcaccagcctgtgcctgctgaaggactgtgaggagatccgggacaaccgggagaaccagaggcagaatgaatgtgtgtctgagatcagcaacagcgagaagcacgtgacctttgagaaccacagaattgtgagccccaagaacagcgacctgaagaacaccagccctgagcacggcggccggggctctgaagatgagcaggagagcttccggcccagcaccagccccctgagccacagcagccccagcgagatcagcggcaccagcagcagcggctgtgccctggagagctttggcagcgctgcccagcagcagcagcccccctgtgagcaggagctgagccccctggtgtgcagccctgctggggtgtcccggctgacctacgtgtctgagcctgagagcagctaccccaccacagccacagatgatgccctggaggacaggaagagtgacatcaccagcgagctgagcaccaccatcatccagggcagccctgctgccctggaggagcgggccatggagaagctgcgggagaaggtgcccttccagaacagaggcaagggcaccctgagcagcatcatccagaacaacagcgacaccaggaaggccacagagaccaccagcctgagcagcaagccagaatatgtgaagccagacttccgctggagcaaggaccccagcagcaagagcggcaacctgctggagaccagcgaggtgggctggaccagcaaccctgaggagctggaccccatccggctggccctgctgggcaagagcggcctgagctgccaggtgggcagcgccaccagccaccctgtgtcctgccaggagcccattgatgaggaccagaggatcagccccaaggacaagagcacagctggccgggagttcagcggccaggtgagccaccagaccaccagcgagaaccagtgcacccccatccccagcagcacagtgcacagctctgtggccgacatgcagaacatgcctgctgctgtgcacgccctgctgacccagcccagcctgtctgctgccccctttgcccagcgctacctgggcaccctgcccagcacaggcagcaccaccctgccccagtgccacgccggaaatgccaccgtgtgtggcttcagcggcggcctgccctacccagctgtggccggggagcctgtgcagaacagcgtggccgtgggcatctgcctgggcagcaacatcggcagcggctggatgggcaccagcagcctgtgcaacccctacagcaacaccctgaaccagaacctgctgagcaccaccaagcccttccctgtgcccagcgtgggcaccaactgtggcatcgagccctgggacagcggcgtgaccagcggcctgggctctgtgcgggtgcctgaggagctgaagctgccccacgcctgctgcgtgggcatcgccagccagaccctgctgtctgtgctgaaccccacagaccgctggctgcaggtgtccattggagtgctgagcatctctgtgaatggagagaaggtggacctgagcacctaccgctgcctggtgttcaagaacaaggccatcatccggccccacgccacagaggagatcaaggtgctcttcatccccagcagccctggggtcttccgctgcaccttctctgtggcctcctggccctgcagcacagatgctgagaccatcgtgcaggccgaggccctggccagcacagtgaccctgacagccatcgccgagagccctgtgattgaggtggagacagagaagaaggatgtgctggactttggagacctgacctacggcggctggaaggccctgcccctgaagctgatcaacagaactcatgccaccgtgcccatccgcctcatcatcaatgccaatgctgtggcctggcgctgcttcaccttcagcaaggagagcgtgcgggcccctgtggaggtggccccctgtgctgatgtggtgacccggctggccggccccagcgtggtgaaccacatgatgcctgccagctatgatggccaggaccctgagttcctgatgatctgggtgctcttccacagccccaagaagcagatcagcagcagtgacatcctggacagcgctgaggagttcagcgccaaggtggacatcgaggtggacagccccaaccccacccctgtgctgcggtctgtgtccctgcgggcccgggccggcatcgcccgcatccacgccccccgggacctgcagaccatgcacttcctggccaaggtggccagcagcaggaagcagcacctgcccctgaagaatgccggcaacatcgaggtgtacctggacatcaaggtgcctgagcagggcagccacttctctgtggaccccaagaacctgctgctgaagccaggagaggagcacgaggtgattgtgtccttcacccccaaggaccctgaggcctgtgaggagcgcatcctgaagatctttgtgcagcccttcggcccccagtatgaggtggtgctgaagggggaggtgatcagcagcggcagcaagcccctgagccctggcccctgcctggacatccccagcatcctgagcaacaagcagttcctggcctggggcggcgtgcccctgggccgcacccagctgcagaagctggccctgaggaacaacagcgccagcaccacccagcacctgcggctgctgatccggggccaggaccaggactgcttccagctgcagaacaccttcggcagcgagcagaggctgaccagcaactgtgagatccgcatccaccccaaggaggacatcttcatctctgtgctgtttgcccccacccggctgagctgcatgctggcccggctggagatcaagcagctgggcaacagaagccagcccggcatcaagttcaccatccccctgagcggctacggcggcaccagcaacctgatcctggagggcgtgaagaagctgagtgacagctacatggtgacagtgaatggcctggtgcctgggaaggagagcaagatcgtgttttctgtgaggaacacaggcagccgggccgcctttgtgaaggctgtgggcttcaaggacagccagaagaaggtgctgctggaccccaaggtgctgcgcatcttcccagacaagtttgtgctgaaggagaggacccaggagaatgtgaccctcatctacaaccccagcgaccggggcatcaacaacaagacagccacagagctgagcacagtgtacctgtttggaggagatgagatcagccggcagcagtacagaagagccctgctgcacaagccagagatgatcaagcagatcctgcctgagcacagcgtgctgcagaacatcaactttgtggaggccttccaggatgagctgctggtgacagaggtgtatgacctgccccagaggcccaatgatgtgcagctgttctacggctccatgtgcaagatcatcctgagcgtcatcggggagttccgggactgcatcagcagccgggagttcctgcagcccagcagcaaggccagcctggagagcaccagtgacctgggcgccagcggcaagcatggaggaaatgtgtccctggatgtgctgcctgtgaagggcccccagggcagccccctgctgagccgggccgcccggccccccctggaccagctggccagcgaggagccctggacagtgctgcctgagcacctgatcctggtggcccccagcccctgtgacatggccaagacaggccgcttccagatcgtgaacaacagcgtgcggctgctgcgctttgagctgtgctggccagcccactgcctgactgtgaccccccagcacggctgtgtggcccctgagagcaagctgcagatcctggtgagccccaacagcagcctgagcaccaagcagagcatgttcccctggagcggcctcatctacatccactgtgatgatggccagaagaagatcgtgaaggtgcagatccgggaggacctgacccaggtggagctgctgacccggctgaccagcaagcccttcggcatcctgagccctgtgtctgagcccagcgtgagccacctggtgaagcccatgaccaagccacccagcaccaaggtggagatccggaacaagagcatcaccttccccaccacagagcccggggagaccagcgagagctgcctggagctggagaaccacggcaccacagatgtgaagtggcacctgagcagcctggccccaccctacgtgaagggcgtggatgagagcggagatgtgttccgggccacctatgctgccttccgctgcagccccatcagcggcctgctggagagccacggcatccagaaggtgtccatcaccttcctgccccggggccgcggggactatgcccagttctgggatgtggagtgccaccccctgaaggagccccacatgaagcacaccctgcgcttccagctgagcggccagagcattgaagcagaaaatgaaccagaaaatgcctgcctgagcacagacagcctcatcaagattgaccacctggtgaagccccggcggcaggccgtgtctgaggccagcgcccgcatccctgagcagctggatgtgacagcccggggcgtgtatgccccagaagatgtgtaccgcttccggcccacctctgtgggggagagcaggaccctgaaggtgaacctgaggaacaacagcttcatcacccacagcctgaagttcctgagcccccgggagcccttctacgtgaagcacagcaagtacagcctgcgggcccagcactacatcaacatgcctgtgcagttcaagcccaagtctgctgggaagtttgaggccctgctggtgatccagacagatgagggcaagagcatcgccatccgcctcatcggggaggccctgggcaagaactag

SEQ ID NO: 20608 - DNA, 111 bp, Artificial Sequence
  Description of Artificial Sequence: Synthetic coding sequence
atgtgctactacggcaactactacggcggctacggctatggaggcctgggctgcggctacggcagctgctgcggctgcggcttccggcggctgggctgcggctatggatag

SEQ ID NO: 20609 - DNA, 528 bp, Artificial Sequence
  Description of Artificial Sequence: Synthetic coding sequence
atgagctacaactgctgcagcggcaacttcagcagccgcagctgtggggactacctgcgctacccagccagcagccggggcttctcctaccccagcaacctggtgtacagcacagacctgtgcagccccagcacctgccagctgggcagcagcctgtaccggggctgccaggagatctgctgggagcccaccagctgccagaccagctatgtggagagcagcccctgccagaccagctgctaccggcccaggaccagcctgctgtgcagcccctgcaagaccacctacagcggcagcctgggcttcggcagcagcagctgccgcagcctgggctacggcagccgcagctgctacagcgtgggctgcggcagcagtggagtgcgcagcctgggctacggcagctgtggcttccccagcctgggctacggcagcggcttctgccggcccacctacctggccagccgcagctgccagagcccctgctacagacctgcctacggcagcaccttctgccgcagcacctgctag

SEQ ID NO: 20610 - DNA, 324 bp, Artificial Sequence
  Description of Artificial Sequence: Synthetic coding sequence
atgggcaagaagaggaccaagggcaagacagtgcccattgatgacagcagcgagaccctggagcctgtgtgccgccacatcaggaagggcctggagcagggcaacctgaagaaggccctggtgaatgtggagtggaacatctgccaggactgcaagacagacaacaaggtgaaggacaaggccgaggaggagacagaggagaagcccagcgtgtggctgtgcctgaagtgtggccaccagggctgcggcaggaacagccaggagcagcacgccctgaagcactacctgacccccaggtctgagccccactgcctggtgctgtag

SEQ ID NO: 20611 - DNA, 2469 bp, Artificial Sequence
  Description of Artificial Sequence: Synthetic coding sequence
atgggcaagaagaggaccaagggcaagacagtgcccattgatgacagcagcgagaccctggagcctgtgtgccgccacatcaggaagggcctggagcagggcaacctgaagaaggccctggtgaatgtggagtggaacatctgccaggactgcaagacagacaacaaggtgaaggacaaggccgaggaggagacagaggagaagcccagcgtgtggctgtgcctgaagtgtggccaccagggctgcggcaggaacagccaggagcagcacgccctgaagcactacctgacccccaggtctgagccccactgcctggtgctgagcctggacaactggagcgtgtggtgctacgtgtgtgacaatgaggtgcagtactgcagcagcaaccagctgggccaggtggtggactatgtgaggaagcaggccagcatcaccacccccaagccagagaaggacaatggaaacatcgagctggagaacaagaagctggagaaggagagcaagaatgagcaggagcgggagaagaaggagaacatggccaaggagaacccccccatgaacagcccctgccagatcaccgtgaagggcctgagcaacctgggcaacacctgcttcttcaatgctgtgatgcagaacctgagccagacccctgtgctgcgggagctgctgaaggaggtgaagatgagcggcaccatcgtgaagattgagcccccagacctggccctgacagagcccctggagatcaacctggagcccccaggccccctgaccctggccatgagccagttcctgaatgagatgcaggagaccaagaagggcgtggtgacccccaaggagctgttcagccaggtgtgcaagaaggctgtgcgcttcaagggctaccagcagcaggacagccaggagctgctgcgctacctgctggatggcatgagagctgaggagcaccagagggtgtccaagggcatcctgaaggccttcggcaacagcacagagaagctggatgaggagctgaagaacaaggtgaaggactatgagaagaagaagtccatgcccagctttgtggaccgcatctttggaggagagctgacctccatgatcatgtgtgaccagtgcaggacagtgtccctggtgcatgagagcttcctggacctgagcctgcctgtgctggatgaccagagcggcaagaagtctgtgaatgacaagaacctgaagaagacagtggaggatgaggaccaggacagcgaggaggagaaggacaatgacagctacatcaaggagaggagtgacatccccagcggcaccagcaagcacctgcagaagaaggccaagaagcaggccaagaagcaggccaagaaccagaggcggcagcagaagatccagggcaaggtgctgcacctgaatgacatctgcaccatcgaccaccctgaggacagtgaatatgaggccgagatgagcctgcagggcgaggtgaacatcaagagcaaccacatcagccaggagggcgtgatgcacaaggagtactgtgtgaaccagaaggacctgaatggccaggccaagatgattgaatctgtgacagacaaccagaagagcacagaggaggtggacatgaagaacatcaacatggacaatgacctggaggtgctgaccagcagccccaccaggaacctgaatggagcctacctgacagagggcagcaatggagaggtggacatcagcaatggcttcaagaacctgaacctgaatgctgccctgcacccagatgagatcaacatcgagatcctgaatgacagccacaccccaggcaccaaggtgtatgaggtggtgaatgaagatcctgagacagccttctgcaccctggccaaccgggaggtgttcaacacagatgaatgttccatccagcactgcctgtaccagttcaccagaaatgagaagctgagagatgccaacaagctgctgtgtgaggtgtgcacccggcggcagtgcaatggccccaaggccaacatcaagggggagaggaagcacgtgtacaccaatgccaagaagcagatgctgatcagcctggcccctcctgtgctgaccctgcacctgaagcgcttccagcaggccggcttcaacctgaggaaggtgaacaagcacatcaagtttcctgagatcctggacctggcccccttctgcaccctgaagtgcaagaatgtggccgaggagaacaccagggtgctgtacagcctgtatggagtggtggagcacagcggcaccatgaggagcggccactacacagcctatgccaaggccaggacagccaacagccacctgagcaacctggtgctgcatggagacatcccccaggactttgagatggagagcaagggccagtggttccacatcagtgacacccacgtgcaggccgtgcccaccaccaaggtgctgaacagccaggcctacctgctcttctatgaaagaatcctgtag

SEQ ID NO: 20612 - DNA, 2472 bp, Artificial Sequence; identical to SEQ ID NO: 19153
  Description of Artificial Sequence: Synthetic coding sequence

SEQ ID NO: 20613 - DNA, 1167 bp, Artificial Sequence
  Description of Artificial Sequence: Synthetic coding sequence
atggaccccatccgctccttctgtgggaagctgcggagcctggccagcaccctggactgtgaaacagcccggctgcagagggccctggatggagaggagagtgactttgaggactaccccatgaggatcctgtatgacctgcacagcgaggtgcagaccctgaaggatgatgtgaacatcctgctggacaaggcccggctggagaaccaggagggcatcgacttcatcaaggccaccaaggtgctgatggagaagaacagcatggacatcatgaagatccgggagtacttccagaagtatggctacagcccccgggtgaagaagaacagcgtgcatgagcaggaggccatcaacagcgaccctgagctgagcaactgtgagaacttccagaagacagatgtgaaggatgacctgagtgacccccctgtggccagcagctgcatcagcgagaagagccccaggagcccccagctgagtgactttggcctggagcgctacatcgtgtcccaggtgctgcccaaccccccccaggccgtgaacaactacaaggaggagcccgtcatcgtgaccccacccaccaagcagagcctggtgaaggtgctgaagacccccaagtgtgccctgaagatggatgactttgaatgtgtgacccccaagctggagcacttcggcatcagcgagtacaccatgtgcctgaatgaagactacaccatgggcctgaagaatgccaggaacaacaagtctgaggaggccatcgacacagagagccggctgaatgacaacgtgtttgccacccccagccccatcatccagcagctggagaagagtgatgctgagtacaccaacagccccctggtgcccaccttctgcaccccaggcctgaagatccccagcaccaagaacagcatcgccctggtgtccaccaactaccccctgagcaagaccaacagcagcagcaatgacctggaggtggaggacaggaccagcctggtgctgaacagcgacacctgctttgagaacctgacagaccccagcagccccaccatcagcagctatgagaacctgctgcggacccccaccccacctgaggtgaccaagatccctgaggacatcctgcagaagttccagtggatctaccccacccagaagctgaacaagatgaggtag

SEQ ID NO: 20614 - DNA, 1353 bp, Artificial Sequence; identical to SEQ ID NO: 18980
  Description of Artificial Sequence: Synthetic coding sequence

SEQ ID NO: 20615 - DNA, 3378 bp, Artificial Sequence
  Description of Artificial Sequence: Synthetic coding sequence
atgacagtggagcagaatgtgctgcagcagagcgctgcccagaagcaccagcagaccttcctgaaccagctgcgggagatcaccggcatcaatgacacccagatcctgcagcaggccctgaaggacagcaatggaaacctggagctggccgtggccttcctgacagccaagaatgccaagaccccccagcaggaggagaccacctactaccagacagccctgcctggaaatgaccgctacatctctgtgggcagccaggccgacaccaacgtcatcgacctgactggagatgacaaggatgacctgcagagggccatcgccctgagcctggccgagagcaacagagccttccgggagaccggcatcacagatgaggagcaggccatcagccgggtgctggaggccagcattgctgagaacaaggcctgcctgaagaggacccccacagaggtgtggagggacagcaggaacccctatgacaggaagaggcaggacaaggcccctgtgggcctgaagaatgtgggcaacacctgctggttctctgctgtgatccagagcctcttcaacctgctggagttccggcggctggtgctgaactacaagccacccagcaatgcccaggacctgcccaggaaccagaaggagcacaggaacctgcccttcatgagggagctgcgctacctgtttgccctgctggtgggcaccaagaggaaatatgtggaccccagcagagctgtggagatcctgaaggatgccttcaagagcaatgacagccagcagcaggatgtgtctgagttcacccacaagctgctggactggctggaggatgccttccagatgaaggccgaggaggagacagatgaggagaagcccaagaaccccatggtggagctgttctacggccgcttcctggccgtgggcgtgctggagggcaagaagtttgaaaatacagagatgtttggccagtaccccctgcaggtgaatggcttcaaggacctgcatgaatgtctggaggccgccatgattgaaggagaaattgagagcctgcacagcgagaacagcggcaagagcggccaggagcactggttcacagagctgccccctgtgctgacctttgagctgagcagatttgagttcaaccaggccctgggccggcctgagaagatccacaacaagctggagttcccccaggtgctgtacctggaccgctacatgcacaggaaccgggagatcacccgcatcaagcgggaggagatcaagaggctgaaggactacctgactgtgctgcagcagaggctggagcgctacctgtcctatggcagcggccccaagcgcttccccctggtggatgtgctgcagtatgccctggagtttgccagcagcaagcctgtgtgcaccagccctgtggatgacattgatgccagcagccccccatctggcagcatccccagccagaccctgcccagcaccacagagcagcagggcgccctgagcagcgagctgcccagcaccagccccagctctgtggccgccatcagcagccgcagcgtcatccacaagcccttcacccagagccgcatccccccagacctgcccatgcacccagcccccaggcacatcacagaggaggagctgtctgtgctggagagctgcctgcaccgctggaggacagaaattgaaaatgacacccgggacctgcaggagagcatcagccgcatccacaggaccatcgagctgatgtacagcgacaagtccatgatccaggtgccctaccgcctgcatgctgtgctggtgcatgagggccaggccaatgccggccactactgggcctacatctttgaccaccgggagagccgctggatgaagtacaatgacattgctgtgaccaagagctcctgggaggagctggtgcgggacagctttggaggctacagaaatgccagcgcctactgcctgatgtacatcaatgacaaggcccagttcctgatccaggaggagttcaacaaggagaccggccagcccctggtgggcatcgagaccctgcccccagacctgcgggactttgtggaggaggacaaccagagatttgagaaggagctggaggagtgggatgcccagctggcccagaaggccctgcaggagaagctgctggccagccagaagctgcgggagagcgagacctctgtgaccacagcccaggccgccggggaccctgagtacctggagcagcccagcagaagtgacttcagcaagcacctgaaggaggagaccatccagatcatcaccaaggccagccatgaacatgaggacaagagccctgagaccgtgctgcagagcaagccagagaacaccaccagccagcccctgagcaaccagagggtggtggaggtggccatcccccacgtgggcaagttcatgattgagagcaaggagggcggctatgatgatgagatcatgatgacccccaacatgcagggcatcatcatggccatcggcaagagccgctctgtgtatgacagatgtggccctgaggccggcttcttcaaggccatcaagctggagtatgcccggctggtgaagctggcccaggaggacaccccacctgagacagactaccgcctgcaccacgtggtggtgtacttcatccagaaccaggcccccaagaagatcatcgagaagaccctgctggagcagtttggagacaggaacctgagctttgatgagcgctgccacaacatcatgaaggtggcccaggccaagctggagatgatcaagccagaggaggtgaacctggaggagtatgaggagtggcaccaggactacaggaagttccgggagaccaccatgtacctgatcatcggcctggagaacttccagcgggagagctacatcgacagcctgctcttcctgatctgtgcctaccagaacaacaaggagctgctgagcaagggcctgtaccggggccatgatgaggagctgatcagccactaccgccgggagtgcctgctgaagctgaatgagcaggccgctgagctgtttgaaagtggagaagatcgggaggtgaacaacggcctcatcatcatgaatgagttcatcgtgcccttcctgcccctgctgctggtggatgagatggaggagaaggacatcctggccgtggaggacatgaggaaccgctggtgcagctacctgggccaggagatggagccccacctgcaggagaagctgacagacttcctgcccaagctgctggactgcagcatggagatcaagagcttccacgagccccccaagctgcccagctacagcacccatgagctgtgtgaaagatttgcccgcatcatgctgagcctgagcaggaccccagcagatggaagatag

SEQ ID NO: 20616 - DNA, 1608 bp, Artificial Sequence
  Description of Artificial Sequence: Synthetic coding sequence
atggacctgcggcaggcctgcaggacccccagcagagatgaagctggggtggagctgctgatgacctacttcatccagctgggctttgtggagagccgcttcttcccccccacccggcagatgggcctgctcttcacctggtatgacagcctgactggagtgcctgtgtcccagcagaacctgctgctggagaaggcctctgtgctcttcaacacaggagccctgtacacccagatcggcacccgctgtgaccggcagacccaggccggcctggagagcgccattgatgccttccagagagctgctggggtgctgaactacctgaaggacaccttcacccacacccccagctatgacatgagccctgccatgctgtctgtgctggtgaagatgatgctggcccaggcccaggagagcgtgtttgagaagatcagcctgcccggcatcagaaatgagttcttcatgctggtgaaggtggcccaggaggccgccaaggtgggggaggtgtaccagcagctgcatgctgccatgagccaggcccctgtgaaggagaacatcccctacagctgggccagcctggcctgtgtgaaggcccaccactacgccgccctggcccactacttcaccgccatcctgctgattgaccaccaggtgaagccaggcacagacctggaccaccaggagaagtgcctgagccagctgtatgaccacatgcctgagggcctgacccccctggccaccctgaagaatgaccagcagaggcggcagctgggcaagagccacctgcggcgggccatggcccaccacgaggagagcgtgcgggaggccagcctgtgcaagaagctgcggagcattgaggtgctgcagaaggtgctgtgtgccgcccaggagaggagccggctgacctacgcccagcaccaggaggaggatgacctgctgaacctgattgatgcccccagcgtggtggccaagacagagcaggaggtggacatcatcctgccccagttcagcaagctgactgtgacagacttcttccagaagctgggccccctgagcgtcttcagcgccaacaagcgctggaccccacccaggagcatccgcttcaccgctgaggagggggacctgggcttcaccctgcggggaaatgcccctgtgcaggtgcacttcctggacccctactgcagcgcctctgtggccggggcccgggagggggactacatcgtgtccatccagctggtggactgcaagtggctgaccctgtctgaggtgatgaagctgctgaagagctttggagaagatgaaattgagatgaaggtggtgtccctgctggacagcaccagctccatgcacaacaagagcgccacctacagcgtgggcatgcagaagacctacagcatgatctgcctggccattgatgatgatgacaagacagacaagaccaagaagatcagcaagaagctgtccttcctgtcctggggcaccaacaagaaccggcagaagagcgccagcaccctgtgcctgcccagcgtgggcgccgcccggccccaggtgaagaagaagctgcccagccccttcagcctgctgaacagcgacagctcctggtactag

SEQ ID NO: 20617 - DNA, 2952 bp, Artificial Sequence
  Description of Artificial Sequence: Synthetic coding sequence
atggccccccggctgcagctggagaaggccgcctggcgctgggccgagaccgtgcggcctgaggaggtgtcccaggagcacatcgagacagcctaccgcatctggctggagccctgcatccggggcgtgtgcagaagaaactgcaagggcaaccccaactgcctggtgggcatcggggagcacatctggctgggggagattgatgaaaattccttccacaacattgatgaccccaactgtgagaggaggaagaagaacagctttgtgggcctgaccaacctgggcgccacctgctacgtgaacaccttcctgcaggtgtggttcctgaacctggagctgcggcaggccctgtacctgtgccccagcacctgcagcgactacatgctgggagatggcatccaggaggagaaggactatgagccccagaccatctgtgagcacctgcagtacctgtttgccctgctgcagaacagcaacagacgctacatcgaccccagcggctttgtgaaggccctgggcctggacaccggccagcagcaggatgcccaggagttcagcaagctgttcatgagcctgctggaggacaccctgagcaagcagaagaacccagatgtgaggaacatcgtgcagcagcagttctgtggggagtatgcctacgtgacagtgtgcaaccagtgtggccgggagagcaagctgctgagcaagttctatgagctggagctgaacatccagggccacaagcagctgacagactgcatcagcgagttcctgaaggaggagaagctggagggggacaaccgctacttctgtgagaactgccagagcaagcagaatgccaccaggaagatccggctgctgagcctgccctgcaccctgaacctgcagctgatgagatttgtgtttgaccggcagacaggccacaagaagaagctgaacacctacatcggcttcagcgagatcctggacatggagccctacgtggagcacaagggcggcagctatgtgtatgagctgtctgctgtgctgatccaccggggcgtgtctgcctacagcggccactacatcgcccacgtgaaggacccccagagcggggagtggtacaagttcaatgatgaggacatcgagaagatggagggcaagaagctgcagctgggcatcgaggaggacctggccgagcccagcaagagccagaccaggaagcccaagtgtgggaagggcacccactgcagcagaaatgcctacatgctggtgtaccgcctgcagacccaggagaagcccaacaccaccgtgcaggtgcctgccttcctgcaggagctggtggaccgggacaacagcaagtttgaggagtggtgcatcgagatggccgagatgaggaagcagagcgtggacaagggcaaggccaagcatgaggaggtgaaggagctgtaccagaggctgcctgctggagctgagccctatgaatttgtgtccctggagtggctgcagaagtggctggatgagagcacccccaccaagcccatcgacaaccacgcctgcctgtgcagccatgacaagctgcacccagacaagatcagcatcatgaagaggatcagtgaatatgctgctgacatcttctacagccgctatggaggcggcccccggctgactgtgaaggccctgtgcaaggaatgtgtggtggagcgctgccgcatcctgcggctgaagaaccagctgaatgaagactacaagacagtgaacaacctgctgaaggctgctgtgaagggcagtgatggcttctgggtgggcaagagcagcctgcgctcctggaggcagctggccctggagcagctggatgagcaggatggagatgctgagcagagcaatggcaagatgaatggcagcaccctgaacaaggatgagagcaaggaggagaggaaggaggaggaggagctgaacttcaatgaagacatcctgtgcccccacggggagctgtgcatcagtgaaaatgaaagaaggctggtgtccaaggaggcctggagcaagctgcagcagtacttccccaaggcccctgagttccccagctacaaggagtgctgcagccagtgcaagatcctggagcgggagggggaggagaatgaggccctgcacaagatgattgccaatgagcagaagaccagcctgcccaacctcttccaggacaagaaccggccctgcctgagcaactggccagaggacacagatgtgctgtacatcgtgtcccagttctttgtggaggagtggaggaagtttgtgaggaagcccacccgctgcagccctgtgtcctctgtgggcaacagcgccctgctgtgcccccacggcggcctgatgttcacctttgcctccatgaccaaggaggacagcaagctgattgccctgatctggcccagcgagtggcagatgatccagaagctgtttgtggtggaccacgtgatcaagatcacccgcatcgaggtgggagatgtgaaccccagcgagacccagtacatcagcgagcccaagctgtgcccagaatgtcgggagggcctgctgtgccagcagcagagggacctgcgggagtacacccaggccaccatctacgtgcacaaggtggtggacaacaagaaggtgatgaaggacagcgcccctgagctgaatgtgagcagcagcgagacagaggaggacaaggaggaggccaagccagatggagagaaggaccctgacttcaaccagatcatgcacgccttctctgtggccccctttgaccagaacctgagcattgatggcaagatcctgagtgatgactgtgccaccctgggcaccctgggcgtcatccctgagagcgtcatcctgctgaaggcagatgagcccatcgctgactatgctgccatggatgatgtgatgcaggtgtgcatgcctgaggagggcttcaagggcaccggcctgctgggccactag

SEQ ID NO: 20618 - DNA, 738 bp, Artificial Sequence
  Description of Artificial Sequence: Synthetic coding sequence
atgtctgtgtgcagcagtgacctgtcctatggcagccgggtgtgcctgcccggcagctgtgacagctgcagcgacagctggcaggtggatgactgcccagagagctgctgtgagcccccctgctgtgccccagccccctgcctgagcctggtgtgcacccctgtgtcccgggtgagcagcccctgctgccgggtgacctgtgagcccagcccctgccagagcggctgcaccagcagctgcacccccagctgctgccagcagagcagctgccagcctgcctgctgcaccagcagcccctgccagcaggcctgctgcgtgcctgtgtgctgcaagacagtgtgctgcaagcctgtgtgctgcatgcctgtgtgctgcggccccagcagcagctgctgccagcagagcagctgccagcctgcctgctgcatcagcagcccctgccagcagagctgctgcgtgcctgtgtgctgcaagcccatctgctgcgtgcctgtgtgcagcggggccagcagcctgtgctgccagcagagcagctgccagcctgcctgctgcaccaccagctgctgccggcccagcagctctgtgtccctgctgtgcaggcctgtgtgcaggcctgccaggagagtgcctgtgcccagctgctgcgtgcccaccagcagctgccagcccagctgtggccgcctggccagctgtggcagcctgctgtgccggcccacctgcagccggctggcctgctag

SEQ ID NO: 20619 - DNA, 1098 bp, Artificial Sequence
  Description of Artificial Sequence: Synthetic coding sequence
atggccgccagcaccatgtctgtgtgcagcagtgacctgtcctatggcagccgggtgtgcctgcccggcagctgtgacagctgcagcgacagctggcaggtggatgactgcccagagagctgctgtgagcccccctgctgtgccccagccccctgcctgagcctggtgtgcacccctgtgtcccgggtgagcagcccctgctgccctgtgacctgtgagcccagcccctgccagagcggctgcaccagcagctgcacccccagctgctgccagcagagcagctgccagctggcctgctgtgccagcagcccctgccagcaggcctgctgcgtgcctgtgtgctgcaagacagtgtgctgcaagcctgtgtgctgcgtgtctgtgtgctgcggggacagcagctgctgccagcagagcagctgccagagcgcctgctgcaccagcagcccctgccagcaggcctgctgcgtgcctgtgtgctgcaagcctgtgtgcagcggcatcagcagcagctgctgccagcagagcagctgtgtgtcctgtgtgagcagcccctgctgccaggccgtgtgtgagcccagcccctgccagagcggctgcaccagcagctgcacccccagctgctgccagcagagcagctgccagcccacctgctgcaccagcagcccctgccagcaggcctgctgcgtgcctgtgtgctgcgtgcctgtgtgctgcgtgcccacctgcagcgaggacagcagcagctgctgccagcagagcagctgccagcctgcctgctgcaccagcagcccctgccagcacgcctgctgcgtgcctgtgtgcagcggggccagcaccagctgctgccagcagagcagctgccagcctgcctgctgcacagccagctgctgccggcccagcagctctgtgtccctgctgtgccaccctgtgtgcaagagcacctgctgcgtgcctgtgcccagctgtggggccagcgccagcagctgccagcccagctgctgcaggacagccagctgtgtgtccctgctgtgccggcccatgtgcagcaggcctgcctgctacagcctgtgcagcggccagaagagcagctgctag

SEQ ID NO: 20620 - DNA, 816 bp, Artificial Sequence
  Description of Artificial Sequence: Synthetic coding sequence
atggccgcctgcaccatgtctgtgtgcagcagcgcctgcagcgacagctggagggtggatgactgcccagagagctgctgtgagcccccctgtggcacagccccctgcctgaccctggtgtgcacccctgtgtcctgtgtgagcagcccctgctgccaggccgcctgtgagcccagcccctgccagagcggctgcaccagcagctgcacccccagctgctgccagcctgcctgctgtgccagcagcccctgccagcaggcctgctgcgtgcctgtgtgctgcaagcctgtgtgctgcctgcccacctgcagcaaggacagcagcagctgctgccagcagagcagctgccagcccacctgctgtgccagcagcagctgccagcagagctgctgcgtgcctgtgtgctgcaagcctgtgtgctgcgtgcccacctgcagcgaggacagcagcagctgctgccagcacagcagctgccagcccacctgctgcaccagcagcccctgccagcagagctgctacgtgcctgtgtgctgcaagcctgtgtgcttcaagcccatctgctgcgtgcctgtgtgcagcggggccagcaccagctgctgccagcagagcagctgccagcctgcctgctgcaccaccagctgctgccggcccagcagctctgtgtccctgctgtgccggcccatctgcaggcctgcctgctgcgtgcccatcagcagctgctgtgccccagccagcagctaccaggccagctgctgcaggcctgccagctgtgtgtccctgctgtgcaggcctgcctgcagccggctggcctgctag

SEQ ID NO: 20621 - DNA, 1206 bp, Artificial Sequence
  Description of Artificial Sequence: Synthetic coding sequence
atgtctgtgtgcagcagtgacctgagctacagcagccgggtgtgcctgcccggcagctgtgacagctgcagcgacagctggcaggtggatgactgcccagagagctgctgtgagcccccctgctgtgcccccagctgctgtgccccagccccctgcctgagcctggtgtgcacccctgtgtcccgggtgagcagcccctgctgccctgtgacctgtgagcccagcccctgccagagcggctgcaccagcagctgcacccccagctgctgccagcagagcagctgccagctggcctgctgtgccagcagcccctgccagcaggcctgctgcgtgcctgtgtgctgcaagacagtgtgctgcaagcctgtgtgctgcgtgcctgtgtgctgcggggacagcagctgctgccagcagagcagctgccagagcgcctgctgcaccagcagcccctgccagcaggcctgctgcgtgcccatctgctgcaagcctgtgtgcagcggcatcagcagcagctgctgccagcagagcagctgtgtgtcctgtgtgagcagcccctgctgccaggccgtgtgtgagcccagcccctgccagagcggctgcatcagcagctgcacccccagctgctgccagcagagcagctgccagcctgcctgctgcaccagcagcagctgccagcaggcctgctgcgtgcctgtgtgctgcaagacagtgtgctgcaagcctgtgtgcagcgaggacagcagcagctgctgccagcagagcagctgccagcctgcctgctgcaccagcagcccctgccagcaggcctgctgcgtgcctgtgtgctgcaagcctgtgtgctgcaagcctgtgggctctgtgcccatctgcagcggggccagcagcctgtgctgccagcagagcagctgccagcctgcctgctgcaccagcagccagagccagcagggctgctgcgtgcctgtgtgctgcaagcctgtgtcctgtgtgcctgtgtgcagcggggccagcagcagctgctgccagcagagcagctgccagcctgcctgctgcaccaccagctgctgccggcccagcagctctgtgtccctgctgtgcaggcctgtgtgcaggcctgcctgctgcgtgcctgtgcccagctgctgtgcccccaccagcagctgccagcccagctgctgcaggcctgccagctgtgtgtccctgctgtag

SEQ ID NO: 20622 - DNA, 849 bp, Artificial Sequence
  Description of Artificial Sequence: Synthetic coding sequence
atggccgccagcaccatgtctgtgtgcagcagcgcctgcagcgacagctggcaggtggatgcctgcccagagagctgctgtgagccccactgctgtgccctgagctgctgtgccccagccccctgcctgaccctggtgtgcacccctgtgtcccgggtgagcagcccctgctgccaggccgcctgtgagcccagcccctgccagagcggctgcaccagcagctgcacccccagctgctgccagcagagcagctgccagcctgcctgctgcaccagcagcccctgccagcaggcctgctgcgtgcctgtgtgctgcaagcctgtgtgctgcctgcccacctgcagcaaggacagcagcagctgctgccagcagagcagctgccagcccacctgctgtgccagcagcagcagccagcagagctgctgcgtgcctgtgtgctgcaagcctgtgtgctacgtgcccacctgcagcgaggacagcagcagctgctgccagcagagcagctgccacccagcctgctgcaccagcagcccctgccagcaggcctgctgcgtgcctgtgcgctgcaagcctgtgtgctgcaagcccatctgctgcgtgcctgtgtgcagcggggccagcaccagctgctgccagcagagcagctgccagcctgcctgctgcaccaccagctgctgccggcccagcagctctgtgtccctgctgtgcaggcctgtgtgcaggcctgcctgctgcatgcctgtgagcagctgctgtgccccagccagcagctgccaggccagctgctgcaggcctgccagctgtgtgtccctgctgtgcaggcctgcctgcagcaggcctgcctgctag

SEQ ID NO: 20623 - DNA, 891 bp, Artificial Sequence
  Description of Artificial Sequence: Synthetic coding sequence
atggccagcagccccctgcccggccccaatgacatcctgctggccagccccagcagcgccttccagcctgacaccctgagccagcccaggcctggccacgccaacctgaagcccaaccaggtgggccaggtgatcctgtatggcatccccatcgtgtccctggtgattgatggccaggagcggctgtgcctggcccagatcagcaacaccctgctgaagaacttctcctacaatgagatccacaacagaagagtggccctgggcatcacctgtgtgcagtgcacccctgtgcagctggagatcctgcggcgggccggggccatgcccatcagcagcagaagatgtggcatgatcaccaagcgggaggccgagcggctgtgcaagagcttcctgggagaaaatcggccccccaagctgcctgacaactttgcctttgatgtgtcccatgaatgtgcctggggctgccggggcagcttcatcccagcccgctacaacagcagccgggccaagtgcatcaagtgcagctactgcaacatgtacttcagccccaacaagttcatcttccacagccacaggaccccagatgccaagtacacccagccagatgctgccaacttcaacagctggaggaggcacctgaagctgacagacaagagcccccaggatgagctggtgtttgcctgggaggatgtgaaggccatgttcaacggcggcagcaggaagagggccctgccccagcccggggcccacccagcctgccaccccctgagcagcatccgcaccaggagcatcgccttcagcagccagaccctgatgctgctggaggagatctttggagagaaggaccaggaggactacatgaggatcaatgaagacaacatctggctgtag

SEQ ID NO: 20624 - DNA, 5346 bp, Artificial Sequence
  Description of Artificial Sequence: Synthetic coding sequence
gtgaagaagatccaccgccaccggctgagccctgccacagagaagggagctgccagcagcggggagggggacaaggaccccccacctccagcccatgaagatattgctgtgaagggcacagccacagctgctggcaccggccctggcaccggggctgctgctgctgctgctgctgctgtgcccccaccccaccctgctgctgctgctgctgctgctgctgctgctgctgctgctgctgctgctgctgtgcccccaccccaccccaacatccgggccctgcagacccaggccccccagcagatcccccggggccctgtgcagcagcccctggaggaccgcatcttcaccccagctgtgtctgctgtgtacagcacagtgacccaggtggcccggcagcccggcacccccacccccagcccctacagcgcccacgagatcaacaagggccaccccaacctggccgccaccccacctggccacgccagcagccctggcctgagccagaccccctaccccagcggccagaatgccggccccaccaccctggtgtacccccagaccccccagaccatgaacagccagccccagaccaggagccctgtgatcttcagccccagccagttcttccagaggccccagatccagcccccccgggccaccatccccaacagcagccccagcatccggcctggggcccagacccccacagctgtgtaccaggccaaccagcacatcatgatggtgaaccacctgcccatgccctaccctgtgccccagggcccccagtactgcatcccccagtaccgccacagcggccccccctacgtgggccccccccagcagtaccctgtgcagcccccaggccctggccccttctacccaggccctggccctggggacttccccaatgcctacggcacccccttctaccccagccagcctgtgtaccagagcgcccccatcatcgtgcccacccagcagcagcccccaccagccaagcgggagaagaagaccatccgcatccgggaccccaaccagggcggcaaggacatcacagaggagatcatgtctgggggcggcagcaggaaccccaccccacccatcggccggcccaccagcacccccaccccaccccagctgcccagccaggtgcctgagcacagccctgtggtgtatggcaccgtggagagcgcccacctggccgccagcacccctgtgacagctgccagtgaccagaagcaggaggagaagcccaagccagaccctgtgctgaagagccccagccctgtgctgcggctggtgctgagcggggagaagaaggagcaggagggccagaccagcgagaccacagccatcgtgtccattgctgagctgcccctgccccccagccccaccaccgtgtcctctgtggcccggagcaccatcgccgcccccaccagcagcgccctgagcagccagcccatcttcaccacagccattgatgacagatgtgagctgagcagcccccgggaggacaccatccccatccccagcctgaccagctgcacagagaccagtgaccccctgcccaccaatgaaaatgatgatgacatctgcaagaagccctgcagcgtggccccaaatgacatccccctggtgagcagcaccaacctgatcaatgagatcaacggggtgtctgagaagctgagcgccacagagagcatcgtggagatcgtgaagcaggaggtgctgcccctgaccctggagctggagatcctggagaaccccccagaggagatgaagctggagtgcatcccagcccccatcacccccagcacagtgcccagcttcccccccaccccacccaccccaccagccagccccccccacacccctgtgattgtgcctgctgctgccaccaccgtgagcagccccagcgctgccatcaccgtgcagagggtgctggaggaggatgagagcatccgcacctgcctgtctgaagatgccaaggagatccagaacaagattgaggtggaggctgatggccagacagaggagatcctggacagccagaacctgaacagcagaagaagccctgtgcctgcccagatcgccatcaccgtgcccaagacctggaagaagcccaaggacaggaccaggaccacagaggagatgctggaggccgagctggagctgaaggccgaggaggagctgagcattgacaaggtgctggagagcgagcaggacaagatgagccagggcttccaccctgagcgggaccccagcgacctgaagaaggtgaaggctgtggaggagaatggagaggaggccgagcctgtgagaaatggagctgagagcgtgtctgagggggagggcattgatgccaacagcggcagcacagacagcagtggagatggagtgaccttccccttcaagccagagagctggaagcccacagacacagagggcaagaagcagtatgaccgggagttcctgctggacttccagttcatgcctgcctgcatccagaagccagagggcctgccccccatcagtgatgtggtgctggacaagatcaaccagcccaagctgcccatgaggaccctggacccccgcatcctgccccggggccctgacttcaccccagcctttgctgactttggccggcagaccccaggcggccggggcgtgcccctgctgaatgtgggcagccgccgcagccagcccggccagaggcgggagcccaggaagatcatcaccgtgtctgtgaaggaggatgtgcacctgaagaaggccgagaatgcctggaagcccagccagaagagggacagccaggctgatgatcctgagaacatcaagacccaggagctgttcaggaaggtgcgcagcatcctgaacaagctgaccccccagatgttcaaccagctgatgaagcaggtgtctggcctgactgtggacacagaggagcggctgaagggcgtcatcgacctggtgtttgagaaggccattgatgagcccagcttctctgtggcctatgccaacatgtgccgctgcctggtgaccctgaaggtgcccatggctgacaagccaggcaacacagtgaacttcaggaagctgctgctgaaccgctgccagaaggagtttgagaaggacaaggcagatgatgatgtgtttgagaagaagcagaaggagctggaggccgccagcgcccctgaggagaggacccggctgcatgatgagctggaggaggccaaggacaaggccaggagaagaagcatcggcaacatcaagttcatcggggagctgttcaagctgaagatgctgacagaggccatcatgcatgactgtgtggtgaagctgctgaagaaccatgatgaggagagcctggagtgcctgtgccgcctgctgaccaccatcggcaaggacctggactttgagaaggccaagcccaggatggaccagtacttcaaccagatggagaagatcgtgaaggagaggaagaccagcagccgcatccgcttcatgctgcaggatgtgattgacctgcggctgtgcaactgggtgtccagaagagctgaccagggccccaagaccatcgagcagatccacaaggaggccaagattgaggagcaggaggagcagaggaaggtgcagcagctgatgaccaaggagaagagaagacctggggtgcagagggtggatgaaggaggctggaacacagtgcagggcgccaagaacagccgggtgctggaccccagcaagttcctgaagatcaccaagcccaccattgatgagaagatccagctggtgcccaaggcccagctgggctcctggggcaagggcagcagcggcggggccaaggccagcgagacagatgccctgcggagcagcgccagcagcctgaaccgcttcagcgccctgcagcccccagcccccagcggcagcacccccagcacccctgtggagtttgacagcaggaggaccctgaccagccggggctccatgggccgggagaagaatgacaagcccctgcccagcgccacagcccggcccaacaccttcatgaggggcggcagcagcaaggacctgctggacaaccagagccaggaggagcagaggcgggagatgctggagaccgtgaagcagctgactggaggagtggatgtggagaggaacagcacagaagctgagaggaacaagacccgggagagcgccaagccagagatcagcgccatgtctgcccatgacaaggccgccctgtctgaggaggagctggagaggaagagcaagagcatcattgatgagttcctgcacatcaatgacttcaaggaggccatgcagtgtgtggaggagctgaatgcccagggcctgctgcacgtgtttgtgcgggtgggcgtggagagcaccctggagaggagccagatcacccgggaccacatgggccagctgctgtaccagctggtgcagagcgagaagctgagcaagcaggacttcttcaagggcttcagcgagaccctggagctggctgatgacatggccatcgacatcccccacatctggctgtacctggccgagctggtgacccccatgctgaaggagggcggcatctccatgagggagctgaccatcgagttcagcaagcccctgctgcctgtgggccgggccggcgtgctgctgtctgagatcctgcacctgctgtgcaagcagatgagccacaagaaggtgggcgccctgtggagggaggccgacctgtcctggaaggacttcctgcctgaaggagaagatgtgcacaacttcctgctggagcagaagctggacttcattgaaagtgacagcccctgcagcagcgaggccctgagcaagaaggagctgtctgctgaggagctgtacaagaggctggagaagctgatcatcgaggacaaggccaatgatgagcagatctttgactgggtggaggccaacctggatgagatccagatgagcagccccaccttcctgcgggccctgatgacagctgtgtgcaaggccgccatcatcgctgacagcagcaccttccgggtggacacagctgtgatcaagcagagggtgcccatcctgctgaagtacctggacagcgacacagagaaggagctgcaggccctgtatgccctgcaggccagcatcgtgaagctggaccagcctgccaacctgctgaggatgttctttgactgcctgtatgatgaggaggtgatcagtgaagatgccttctacaagtgggagagcagcaaggaccctgctgagcagaatggaaaaggagtggccctgaagtctgtgacagccttcttcacctggctgcgggaggccgaggaggagagcgaggacaactag

SEQ ID NO: 20625 - DNA, 4758 bp, Artificial Sequence; identical to SEQ ID NO: 18496
  Description of Artificial Sequence: Synthetic coding sequence

SEQ ID NO: 20626 - DNA, 3087 bp, Artificial Sequence
  Description of Artificial Sequence: Synthetic coding sequence
atggccagcgaggccgtgaaggtggtggtgcgctgccggcccatgaaccagcgggagcgggagctgcgctgccagcctgtggtgacagtggactgtgcccgggcccagtgctgcatccagaaccctggagctgctgatgagccccccaagcagttcacctttgatggagcctaccacgtggaccacgtgacagagcagatctacaatgaaattgcctaccccctggtggagggcgtgacagagggctacaacggcaccatctttgcctacggccagacaggcagcggcaagagcttcaccatgcagggcctgcctgacccccccagccagaggggcatcatcccccgggcctttgagcacgtgtttgagagcgtgcagtgtgccgagaacaccaagttcctggtgcgggccagctacctggagatctacaatgaagatgtgcgggacctgctgggcgctgacaccaagcagaagctggagctgaaggagcaccctgagaagggcgtgtatgtgaagggcctgtccatgcacacagtgcacagcgtggcccagtgtgagcacatcatggagaccggctggaagaacagatctgtgggctacaccctgatgaacaaggacagcagccgcagccacagcatcttcaccatcagcattgagatgtctgctgtggatgagcggggcaaggaccacctgcgggccggcaagctgaacctggtggacctggccggcagcgagcggcagagcaagacaggagccactggagagcggctgaaggaggccaccaagatcaacctgagcctgagcgccctgggcaatgtcatcagcgccctggtggatggccgctgcaagcacgtgccctacagagacagcaagctgacccggctgctgcaggacagcctgggcggcaacaccaagaccctgatggtggcctgcctgagccctgctgacaacaactatgatgagaccctgagcaccctgcgctatgccaacagagccaagaacatccggaacaagccccgcatcaatgaagaccccaaggatgccctgctgcgggagtaccaggaggagatcaagaagctgaaggccatcctgacccagcagatgagccccagcagcctgagcgccctgctgagccggcaggtgcccccagaccctgtgcaggtggaggagaagctgctgccccagcccgtcatccagcatgatgtggaggccgagaagcagctgatccgggaggagtatgaggagcggctggcccggctgaaggctgactacaaggccgagcaggagagccgggcccggctggaggaggacatcacagccatgaggaacagctatgatgtgcggctgagcaccctggaggagaacctgaggaaggagacagaggccgtgctgcaggtgggcgtgctgtacaaggccgaggtgatgagcagagctgagtttgccagcagcgctgagtaccccccagccttccagtatgagaccgtggtgaagcccaaggtgttcagcaccacagacaccctgcccagtgatgatgtgtccaagacccaggtgagcagcagatttgctgagctgcccaaggtggagcccagcaagtctgagatcagcctgggcagcagcgagagcagcagcctggaggagacctctgtgtctgaggccttccctggccctgaggagcccagcaatgtggaggtgtccatgcccacagaggagagccgcagccgctacttcctggatgaatgtctgggccaggaggccgccggccacctgctgggggagcagaactacctgccccaggaggagccccaggaggtgcccctgcagggcctgctgggcctgcaggacccctttgctgaggtggaggccaagctggcccggctgagcagcacagtggccaggacagatgccccccaggctgatgtgcccaaggtgcctgtgcaggtgcctgcccccacagacctgctggagcccagtgatgcccggcctgaggccgaggccgcagatgacttcccccccaggcctgaggtggacctggccagcgaggtggccctggaggtggtgaggacagctgagcccggggtgtggctggaggcccaggcccctgtggccctggtggcccagcctgagcccctgcctgccacagctggggtgaagcgggagagcgtgggcatggaggtggccgtgctgacagatgaccccctgcctgtggtggaccagcagcaggtgctggcccggctgcagctgctggagcagcaggtggtgggcggggagcaggccaagaacaaggacctgaaggagaagcacaagaggaggaagagatatgcagatgaaagaaggaagcagctggtggccgccctgcagaacagtgatgaggacagcggggactgggtgctgctgaatgtgtatgacagcatccaggaggaggtgcgggccaagagcaagctgctggagaagatgcagaggaagctgcgggctgctgaggtggagatcaaggacctgcagagcgagttccagctggagaagattgactacctggccaccatccggcggcaggagcgggacagcatgctgctgcagcagctgctggagcaggtgcagcccctcatcagaagagactgcaactacagcaacctggagaagatcctgcgggagagctgctgggatgaggacaatggcttctggaagatcccccaccctgtgatcaccaagaccagcctgcctgtggtgtccacaggcccccagaacaagccagccaggaagaccagcgctgctgacaatggagagcccaacatggaggatgaccgctaccgcctgatgctgagccgcagcaacagtgaaaatattgccagcaactacttccgcagcaagagggccagccagatcctgagcacagatgccaggaagagcctgacccaccacaacagccccccaggcctgagctgccccctgagcaacaacagcgccatcccccccacccaggcccctgagatgccccagccccggcccttccggctggagagcctggacatccccttcaccaaggccaagaggaagaagagcaagagcaactttggaagtgagcccctgtag

SEQ ID NO: 20627 - DNA, 921 bp, Artificial Sequence
  Description of Artificial Sequence: Synthetic coding sequence
atgaggcagcacgacaccagaaatggaagaattgtgctgatctctggaagaagaagcttctgcagcatcttctctgtgctgccctacagagacagcacccaggtgggggacctgaagctggatggcggccggcagagcactggagctgtgtccctgaaggagatcatcggcctggagggcgtggagctgggcgcagatggcaagacagtgtcctacacccagttcctgctgcccaccaatgccttcggggcccggaggaacaccatcgacagcaccagcagcttcagccagttcaggaacctgagccacaggagcctgagcatcggccgggccagcggcacccagggcagcctggacaccggcagtgacctgggggacttcatggactatgaccccaacctgctggatgacccccagtggccctgtgggaagcacaagagggtgctgatcttccccagctacatgaccaccgtgattgattatgtgaagcccagcgacctgaagaaggacatgaatgagaccttcaaggagaagttcccccacatcaagctgaccctgagcaagatccgcagcctgaagcgggagatgaggaagctggcccaggaggactgtggcctggaggagcccaccgtggccatggcctttgtgtactttgagaagctggccctgaagggcaagctgaacaagcagaacaggaagctgtgtgccggggcctgtgtgctgctggccgccaagattggaagtgacctgaagaagcatgaggtgaagcacctgattgacaagctggaggagaagttccggctgaacagaagagagctgattgcctttgagttccctgtgctggtggccctggagtttgccctgcacctgcctgagcacgaggtgatgccccactaccgccgcctggtgcagagcagctag

SEQ ID NO: 20628 - DNA, 2820 bp, Artificial Sequence
  Description of Artificial Sequence: Synthetic coding sequence
atggccgcccagcccccccggggcatccggctgagcgccctgtgccccaagttcctgcacaccaacagcaccagccacacctggcccttctctgctgtggccgagctgattgacaatgcctatgaccctgatgtgaatgccaagcagatctggattgacaagacagtcatcaatgaccacatctgcctgaccttcacagacaatggaaatggcatgaccagtgacaagctgcacaagatgctgagctttggcttcagtgacaaggtgaccatgaatggccacgtgcctgtgggcctgtatggaaatggcttcaagagcggctccatgaggctgggcaaggatgccatcgtgttcaccaagaatggagagagcatgtctgtgggcctgctgagccagacctacctggaggtgatcaaggccgagcacgtggtggtgcccatcgtggccttcaacaagcaccggcagatgatcaacctggccgagagcaaggccagcctggccgccatcctggagcacagcctcttcagcacagagcagaagctgctggccgagctggatgccatcatcggcaagaagggcacccgcatcatcatctggaacctgcggagctacaagaatgccacagaatttgattttgagaaggacaagtatgacatccgcatccctgaggacctggatgagatcaccgggaagaagggctacaagaagcaggagaggatggaccagatcgcccctgagagtgactacagcctgcgggcctactgcagcatcctgtacctgaagcccaggatgcagatcatcctgcggggccagaaggtgaagacccagctggtgtccaagagcctggcctacatcgagagagatgtgtaccggcccaagttcctgagcaagacagtgcgcatcaccttcggcttcaactgcaggaacaaggaccactacggcatcatgatgtaccacaggaacagactcatcaaggcctatgagaaggtgggctgccagctgcgggccaacaacatgggcgtgggcgtggtgggcatcatcgagtgcaacttcctgaagcccacccacaacaagcaggactttgactacaccaatgagtaccgcctgaccatcacagccctgggggagaagctgaatgactactggaatgagatgaaggtgaagaagaacacagagtaccccctgaacctgcctgtggaggacatccagaagaggccagaccagacctgggtgcagtgtgatgcctgcctgaagtggaggaagctgcctgatggcatggaccagctgcctgagaagtggtactgcagcaacaacccagacccccagttcaggaactgtgaggtgcctgaggagccagaagatgaggacctggtgcaccccacctatgagaagacctacaagaagaccaacaaggagaagttccgcatccggcagcctgagatgatcccccgcatcaatgctgagctgctcttccggcccacagccctgagcacccccagcttcagcagccccaaggagagcgtgccccggcggcacctgtctgagggcaccaacagctatgccacccggctgctgaacaaccaccaggtgcccccccagagcgagcctgagagcaacagcctgaagaggcggctgagcaccaggagcagcatcctgaatgccaagaacagaaggctgagcagccagtttgagaacagcgtgtacaagggagatgatgatgatgaagatgtgatcatcctggaggagaacagcacccccaagccagctgtggaccatgacatcgacatgaagtctgagcagagccacgtggagcagggcggcgtgcaggtggagtttgtgggggacagcgagccctgtggccagacaggcagcaccagcaccagcagcagccgctgtgaccagggcaacacagctgccacccagacagaggtgcccagcctggtggtgaagaaggaggagaccgtggaggatgaaattgatgtgagaaatgatgctgtgatcctgcccagctgtgtggaggccgaggccaagatccacgagacccaggagaccacagacaagtctgcagatgatgctggctgccagctgcaggagctgaggaaccagctgctgctggtgacagaggagaaggagaactacaagaggcagtgccacatgttcacagaccagatcaaggtgctgcagcagaggatcctggagatgaatgacaagtatgtgaagaaggagacctgccaccagagcacagaaacagatgctgtgttcctgctggagagcatcaacgggaagtctgagagcccagaccacatggtgtcccagtaccagcaggccctggaggagattgaaaggctgaagaagcagtgcagcgccctgcagcacgtgaaggccgagtgcagccagtgcagcaacaatgaaagcaagtctgagatggatgagatggctgtgcagctggatgatgtgttccggcagctggacaagtgcagcattgaaagagaccagtacaagtctgaggtggagctgctggagatggagaagagccagatccgcagccagtgtgaggagctgaagacagaggtggagcagctgaagagcaccaaccagcagacagccacagatgtgtccaccagcagcaacatcgaggagagcgtgaaccacatggatggagagagcctgaagctgcggagcctgcgggtgaatgtgggccagctgctggccatgattgtgcctgacctggacctgcagcaggtgaactatgatgtggatgtggtggatgagatcctgggccaggtggtggagcagatgtctgagatcagcagcacctag

SEQ ID NO: 20629 - DNA, 1149 bp, Artificial Sequence; identical to SEQ ID NO: 20229
  Description of Artificial Sequence: Synthetic coding sequence

SEQ ID NO: 20630 - DNA, 5058 bp, Artificial Sequence
  Description of Artificial Sequence: Synthetic coding sequence
atgagcctgcccttctaccagcgctgccaccagcactatgacctgagctacagaaacaaggatgtgcgcagcacagtgagccactaccagcgggagaagaagaggtctgctgtgtacacccagggcagcacagcctacagcagccgcagcagcgctgcccacagaagagagagcgaggccttccggcgggccagcgccagcagcagccagcagcaggccagccagcacgccctgagcagcgaggtgtccaggaaggccgccagcgcctatgactatggcagcagccacggcctgacagacagcagcctgctgctggatgactacagcagcaagctgagccccaagcccaagagggccaagcacagcctgctgtctggagaggagaaggagaacctgcccagcgactacatggtgcccatcttcagcggccggcagaagcacgtgtctggcatcacagacacagaggaggagcgcatcaaggaggccgccgcctacatcgcccagaggaacctgctggccagcgaggagggcatcaccaccagcaagcagagcacagccagcaagcagaccacagccagcaagcagagcacagccagcaagcagagcacagccagcaagcagagcacagccagccggcagagcacagccagccggcagagcgtggtgtccaagcaggccaccagcgccctgcagcaggaggagaccagcgagaagaagagcaggaaggtggtgatccgggagaaggccgagcggctgagcctgaggaagaccctggaggagacagagacctaccacgccaagctgaatgaagaccacctgctgcacgcccctgagttcatcatcaagcccaggagccacacagtgtgggagaaggaaaatgtgaagctgcactgcagcattgctggctggccagagccccgggtgacctggtacaagaaccaggtgcccatcaacgtgcacgccaaccctgggaagtacatcatcgagagccgctatggcatgcacaccctggagatcaatggctgtgactttgaggacacagcccagtaccgggccagcgccatgaatgtgaagggggagctgagcgcctatgcctctgtggtggtgaagcgctacaagggggagtttgatgagacccgcttccacgccggggccagcaccatgcccctgagctttggagtgaccccctacggctacgccagcagatttgagatccactttgatgacaagtttgatgtgtcctttggccgggagggggagaccatgagcctgggctgccgggtggtgatcaccccagagatcaagcacttccagcctgagatccagtggtacagaaatggagtgcccctgagccccagcaagtgggtgcagaccctgtggagcggggagcgggccaccctgaccttcagccacctgaacaaggaggatgagggcctgtacaccatccgggtgaggatgggagagtactatgagcagtacagcgcctacgtgtttgtgagagatgctgatgctgagattgagggcgccccagctgcccccctggatgtgaagtgcctggaggccaacaaggactacatcatcatctcctggaagcagcctgctgtggatggcggcagccccatcctgggctacttcatcgacaagtgtgaggtgggcacagacagctggagccagtgcaatgacacccctgtgaagtttgcccgcttccctgtgacaggcctgattgagggccgcagctacatcttccgggtgcgggctgtgaacaagatgggcatcggcttccccagccgggtgtctgagcctgtggccgccctggaccctgctgagaaggcccggctgaagagccggcccagcgccccctggacaggccagatcatcgtgacagaggaggagcccagcgagggcatcgtgcccggccccccaacagacctgtctgtgacagaggccaccaggagctatgtggtgctgtcctggaagcccccaggccagaggggccacgagggcatcatgtactttgtggagaagtgtgaggccggcacagagaactggcagagggtgaacacagagctgcctgtgaagagccccaggtttgccctgtttgacctggccgagggcaagagctactgcttccgggtgcgctgcagcaacagcgctggggtgggggagcccagcgaggccacagaggtgacagtggtgggggacaagctggacatccccaaggcccctgggaagatcatccccagcaggaacacagacacctctgtggtggtgtcctgggaggagagcaaggatgccaaggagctggtgggctactacatcgaggcctctgtggccggcagcggcaagtgggagccctgcaacaacaaccctgtgaagggcagccgcttcacctgccacggcctggtgacaggccagagctacatcttccgggtgcgggctgtgaatgctgctggcctgtctgagtacagccaggacagcgaggccatcgaggtgaaggccgccatcggcggcggcgtgtccccagatgtgtgcccagccctgagtgatgagcccggcggcctgacagccagccggggccgggtgcatgaggccagcccccccaccttccagaaggatgccctgctgggcagcaagcccaacaagcccagcctgcccagcagcagccagaacctgggccagacagaggtgtccaaggtgtctgagaccgtgcaggaggagctgaccccaccaccccagaaggccgccccccagggcaagagcaagagtgaccccctgaagaagaagacagaccgggccccacccagccccccctgtgacatcacctgcctggagagcttccgggacagcatggtgctgggctggaagcagcctgacaagattggaggagctgagatcaccggctactacgtgaactaccgggaggtgattgatggagtgcctgggaagtggagggaggccaacgtgaaggctgtgtctgaggaggcctacaagatcagcaacctgaaggagaacatggtgtaccagttccaggtggccgccatgaacatggccggcctgggcgcccccagcgctgtgtctgagtgcttcaagtgtgaggagtggaccatcgctgtgcccggccccccccacagcctgaagtgcagcgaggtgaggaaggacagcctggtgctgcagtggaagccccctgtgcacagcggccgcacccctgtgacaggctactttgtggacctgaaggaggccaaggccaaggaggaccagtggaggggcctgaatgaagctgccatcaagaatgtgtacctgaaggtgcggggcctgaaggagggcgtgtcctatgtgttccgggtgcgggccatcaaccaggccggcgtgggcaagcccagcgacctggccggccctgtggtggccgagaccaggcctggcaccaaggaggtggtggtgaatgtggatgatgatggagtcatcagcctgaactttgaatgtgacaagatgacccccaagtctgagttctcctggagcaaggactatgtgtccacagaggacagcccccggctggaggtggagagcaaaggaaacaagaccaagatgaccttcaaggacctgggcatggatgacctgggcatctacagctgtgatgtgacagacacagatggcatcgccagcagctacctgattgatgaggaggagctgaagaggctgctggccctgagccatgagcacaagttccccaccgtgcctgtgaagtctgagctggccgtggagatcctggagaagggccaggtgcgcttctggatgcaggccgagaagctgtctggaaatgccaaggtgaactacatcttcaatgagaaggagatctttgagggccccaagtacaagatgcacatcgacaggaacacaggcatcatcgagatgttcatggagaagctgcaggatgaagatgagggcacctacaccttccagctgcaggacggcaaggccaccaaccacagcacagtggtgctggtgggagatgtgttcaagaagctgcagaaggaggccgagttccagaggcaggagtggatcaggaagcagggcccccactttgtggagtacctgtcctgggaggtgactggagaatgtaatgtgctgctgaagtgcaaggtggccaacatcaagaaggagacccacatcgtgtggtacaaggatgagcgggagatctctgtggatgagaagcatgacttcaaggatggcatctgcaccctgctgatcacagagttcagcaagaaggatgctggcatctatgaggtgatcctgaaggatgaccggggcaaggacaagagccggctgaagctggtggatgaggccttcaaggagctgatgatggaggtgtgcaagaagatcgccctgagcgccacagacctgaagatccagagcacagctgagggcatccagctgtacagctttgtgacctactacgtggaggacctgaaggtgaactggagccacaatggaagtgccatccgctacagcgacagagtgaagacaggagtgactggagagcagatctggctgcagatcaatgagcccaccccaaatgacaagggcaagtatgtgatggagctgtttgatggcaagacaggccaccagaagacagtggacctgagcggccaggcctatgatgaggcctatgcagagttccagaggctgaagaagagcctgctcttccagaaggaccgggcccgggtgctgggcggcctgcctgatgtggtgaccatccaggagggcaaggccctgaacctgacctgcaatgtgtggggagaccccccacctgaggtgtcctggctgaagaatgagaaggccctggccagtgatgaccactgcaacctgaagtttgaagctggccgcacagcctacttcaccatcaacggggtgtccacagctgacagcggcaagtatggcctggtggtgaagaacaagtatggcagcgagaccagtgacttcaccgtgtctgtgttcatccctgaggaggaggccaggatggccgccctggagagcctgaagggcggcaagaaggccaagtag

SEQ ID NO: 20631 - DNA, 3456 bp, Artificial Sequence
  Description of Artificial Sequence: Synthetic coding sequence
atgatggccgccgccctgggccccccagaggtgattgcccagctggagaatgctgccaaggtgctgatggcccctccttccatggtgaacaatgagcagaggcagcacgccgagcacatcttcctgtccttcaggaagagcaagagcccctttgctgtgtgcaagcacatcctggagaccagcaaggtggactatgtgctcttccaggccgccacagccatcatggaggccgtggtgcgggagtggatcctgctggagaagggcagcattgagagcctgcggaccttcctgctgacctacgtgctgcagaggcccaacctgcagaagtatgtgcgggagcagatcctgctggccgtggccgtcatcgtgaagaggggcagcctggacaagagcattgactgcaagagcatcttccacgaggtgtcccagctgatcagcagcggcaaccccaccgtgcagaccctggcctgcagcatcctgacagccctgctgtctgagttcagcagcagcagcaagaccagcaacatcggcctgtccatggagttccacggcaactgcaagagggtcttccaggaggaggacctgcggcagatcttcatgctgactgtggaggtgctgcaggagttcagcagaagagagaacctgaatgcccagatgagctctgtgttccagcgctacctggccctggccaaccaggtgctgtcctggaacttcctgccccccaagctgggccgccactacatcgccatgtttgagagcagccagaatgtgctgctgaagcccacagagagctggagggagaccctgctggacagccgggtgatggagctgttcttcaccgtgcacaggaagatcagagaagattctgacatggcccaggacagcctgcagtgcctggcccagctggccagcctgcacggccccatcttcccagatgagggcagccaggtggactacctggcccacttcatcgagggcctgctgaacaccatcaatggcatcgagattgaagattctgaggccgtgggcatcagcagcatcatcagcaacctgatcaccgtcttccccagaaatgtgctgacagccatccccagcgagctgttcagcagctttgtgaactgcctgacccacctgacctgcagctttggccgctctgctgccctggaggaggtgctggacaaggatgacatggtgtacatggaggcctatgacaagctgctggagagctggctgaccctggtgcaggatgacaagcacttccacaagggcttcttcacccagcacgctgtgcaggtgttcaacagctacatccagtgccacctggccgccccagatggcaccaggaacctgacagccaatggagtggccagccgggaggaggaggagatcagcgagctgcaggaggatgaccgggaccagttcagtgaccagctggcctctgtgggcatgctgggcagaattgctgctgagcactgcatccccctgctgaccagcctgctggaggagcgggtgacccggctgcacggccagctgcagaggcaccagcagcagctgctggccagccctggcagcagcacagtggacaacaagatgctggatgacctgtatgaggacatccactggctgatcctggtgacaggctacctgctggctgatgacacccagggcgagacccccctcatccccccagagatcatggagtacagcatcaagcacagcagcgaggtggacatcaacaccaccctgcagatcctgggcagccctggagagaaggccagcagcatccctggctacaacagaacagattctgtcatccggctgctgagcgccatcctgcgggtgtctgaggtggagagccgggccatccgggctgacctgacccacctgctgagcccccagatgggcaaggacatcgtgtggttcctgaagcgctgggccaagacctacctgctggtggatgagaagctgtatgaccagatcagcctgcccttcagcacagccttcggggctgacacagagggcagccagtggatcatcggctacctgctgcagaaggtgatcagcaacctgtctgtgtggagcagcgagcaggacctggccaatgacacagtgcagctgctggtgaccctggtggagcggcgggagcgggccaacctggtgatccagtgtgagaactggtggaacctggccaagcagtttgccagccgcagcccccccctgaacttcctgagcagccctgtgcagaggaccctgatgaaggccctggtgctgggcggctttgcccacatggacacagagaccaagcagcagtactggacagaggtgctgcagcccctgcagcagcgcttcctgcgggtcatcaaccaggagaacttccagcagatgtgccagcaggaggaggtgaagcaggagatcacagccaccctggaggccctgtgtggcattgctgaggccacccagattgacaacgtggccatcctcttcaacttcctgatggacttcctgaccaactgcatcggcctgatggaggtgtacaagaacaccccagagaccgtgaacctgatcatcgaggtgtttgtggaggtggcccacaagcagatctgctacctgggggagagcaaggccatgaacctgtatgaggcctgcctgaccctgctgcaggtgtacagcaagaacaacctgggccggcagagaattgatgtgacagctgaggaggagcagtaccaggacctgctgctgatcatggagctgctgaccaacctgctgagcaaggagttcatcgacttcagtgacacagatgaggtgttccggggccacgagcccggccaggccgccaacagatctgtgtctgctgctgatgtggtgctgtatggagtgaacctgatcctgcccctgatgagccaggacctgctgaagttccccaccctgtgcaaccagtactacaagctgatcaccttcatctgtgagatcttccctgagaagatcccccagctgcctgaggacctcttcaagagcctgatgtacagcctggagctgggcatgacctccatgagcagcgaggtgtgccagctgtgcctggaggccctgacccccctggccgagcagtgtgccaaggcccaggagacagacagccccctcttcctggccaccaggcacttcctgaagctggtgtttgacatgctggtgctgcagaagcacaacacagagatgaccacagctgctggggaggccttctacaccctggtgtgcctgcaccaggccgagtacagcgagctggtggagaccctgctgagcagccagcaggaccctgtgatctaccagaggctggctgatgccttcaacaagctgacagccagcagcaccccacccaccctggacaggaagcagaagatggccttcctgaagagcctggaggagttcatggccaacgtgggcggcctgctgtgtgtgaagtag

SEQ ID NO: 20632 - DNA, 420 bp, Artificial Sequence
  Description of Artificial Sequence: Synthetic coding sequence
atgggcggcggggagcgctacaacatcccagccccccagagcagaaatgtgtccaagaaccagcagcagctgaaccggcagaagaccaaggagcagaacagccagatgaagatcgtgcacaagaagaaggagcggggccacggctacaacagcagcgctgctgcctggcaggccatgcagaatggaggcaagaacaagaacttccccaacaaccagagctggaacagcagcctgagcggcccccggctgctcttcaagagccaggccaaccagaactatgctggggccaagttcagcgagccccccagccccagcgtgctgcccaagccacccagccactgggtgcctgtgtccttcaaccccagcgacaaggagatcatgaccttccagctgaagaccctgctgaaggtgcaggtgtag

SEQ ID NO: 20633 - DNA, 984 bp, Artificial Sequence
  Description of Artificial Sequence: Synthetic coding sequence
atgaaggagatgctggccaaggacctggaggagagccagggcggcaagagcagcgaggtgctgagcgccacagagctgcgggtgcagctggcccagaaggagcaggagctggcccgggccaaggaggccctgcaggccatgaaggctgacaggaagaggctgaagggggagaagacagacctggtgtcccagatgcagcagctgtatgccaccctggagagccgggaggagcagctgcgggacttcatccggaactatgagcagcacaggaaggagagtgaagatgctgtgaaggccctggccaaggagaaggacctgctggagcgggagaagtgggagctgcggcggcaggccaaggaggccacagaccacgccacagccctgcggagccagctggacctgaaggacaacaggatgaaggagctggaggccgagctggccatggccaagcagagcctggccaccctgaccaaggatgtgcccaagaggcacagcctggccatgcctggagagaccgtgctgaatggaaaccaggagtgggtggtgcaggccgacctgcccctgacagctgccatccggcagagccagcagaccctgtaccacagccaccccccccaccctgctgaccggcaggccgtgcgggtgagcccctgccacagccggcagcccagcgtcatcagtgatgccagcgctgctgagggggacaggagcagcacccccagcgacatcaacagccccaggcacaggacccacagcctgtgcaatggagacagccctggccctgtgcagaagaacctgcacaaccccatcgtgcagagcctggaggacctggaggaccagaagaggaagaagaagaaggagaagatgggcttcggcagcatcagccgggtgtttgcccggggcaagcagaggaagagcctggaccccggcctgtttgatggaacagccccagactactacattgaagaagatgctgactggtag

SEQ ID NO: 20634 - DNA, 984 bp, Artificial Sequence; identical to SEQ ID NO: 20633
  Description of Artificial Sequence: Synthetic coding sequence

SEQ ID NO: 20635 - DNA, 609 bp, Artificial Sequence
  Description of Artificial Sequence: Synthetic coding sequence
atggatgagcaggccctgctgggcctgaaccccaatgctgacagcgacttccggcagagggccctggcctactttgagcagctgaagatcagcccagatgcctggcaggtgtgtgccgaggccctggcccagaggacctacagtgatgaccacgtgaagttcttctgcttccaggtgctggagcaccaggtgaagtacaagtacagcgagctgaccaccgtgcagcagcagctgatccgggagaccctcatctcctggctgcaggcccagatgctgaacccccagcctgagaagaccttcatccggaacaaggccgcccaggtgtttgccctgctgtttgtgacagagtacctgaccaagtggcccaagttcttctttgacatcctgtctgtggtggacctgaacccccggggcgtggacctgtacctgcgcatcctgatggccattgattctgagctggtggacagagatgtggtgcacaccagcgaggaggcccggaggaacaccctcatcaaggacaccatgagggagcagtgcatccccaacctggtggagagctggtaccagatcctgcagaactaccagttcaccaacagcgaggtgacctag

SEQ ID NO: 20636 - DNA, 1803 bp, Artificial Sequence
  Description of Artificial Sequence: Synthetic coding sequence
atgagccgggtggccaagtaccgccggcaggtgtctgaagatcctgacatcgacagcctgctggagaccctgagccctgaggagatggaggagctggagaaggagctggatgtggtggaccctgatggctctgtgcctgtgggcctgcggcagaggaaccagacagagaagcagagcactggagtgtacaaccgggaggccatgctgaacttctgtgagaaggagaccaagaagctgatgcagcgggagatgtccatggatgagagcaagcaggtggagaccaagacagatgccaagaatggagaggagcggggcagagatgccagcaagaaggccctgggcccccggcgggacagcgacctgggcaaggagcccaagaggggcggcctgaagaagagcttcagccgggacagagatgaagctgggggcaagtctggagagaagcccaaggaggagaagatcatccggggcatcgacaagggccgggtgcgggctgctgtggacaagaaggaggccggcaaggatggccgcggggaggagagagctgtggccaccaagaaggaggaggagaagaagggcagtgacaggaacacaggcctgagccgggacaaggacaagaagcgggaggagatgaaggaggtggccaagaaggaggatgatgagaaggtgaagggggagaggaggaacacagacaccaggaaggagggggagaagatgaagagagctgggggcaacacagacatgaagaaggaggatgagaaggtgaagaggggcactggaaacacagacaccaagaaggatgatgagaaggtgaagaagaatgagcccctgcacgagaaggaggccaaggatgacagcaagaccaagaccccagagaagcagaccccatctggccccaccaagcccagcgagggccctgccaaggtggaggaggaggccgcccccagcatctttgatgagcccctggagcgggtgaagaacaatgaccctgagatgacagaggtgaatgtgaacaacagcgactgcatcaccaatgagatcctggtgcgcttcacagaggccctggagttcaacacagtggtgaagctgtttgccctggccaacaccagggcagatgaccacgtggcctttgccatcgccatcatgctgaaggccaacaagaccatcaccagcctgaacctggacagcaaccacatcaccgggaagggcatcctggccatcttccgggccctgctgcagaacaacaccctgacagagctgcgcttccacaaccagaggcacatctgtggcggcaagacagagatggagatcgccaagctgctgaaggagaacaccaccctgctgaagctgggctaccactttgagctggccggccccaggatgacagtgaccaacctgctgagcaggaacatggacaagcagaggcagaagaggctgcaggagcagaggcaggcccaggaggccaagggggagaagaaggacctgctggaggtgcccaaggccggggctgtggccaagggcagccccaagcccagcccccagcccagccccaagcccagccccaagaacagccccaagaagggcggggccccagctgcccctcctcctcctcctccacccctggcccctcctctcatcatggagaacctgaagaacagcctgagccctgccacccagaggaagatgggagacaaggtgctgcctgcccaggagaagaacagccgggaccagctgctggccgccatccgcagcagcaacctgaagcagctgaagaagctggagctgcccctgctgctgcagtag

SEQ ID NO: 20637 - DNA, 201 bp, Artificial Sequence
  Description of Artificial Sequence: Synthetic coding sequence
atgattggcaccacagaggtgccctgctgcggccccagcgccacctgggccctgcgctggagcgaccagatcaccctgcccagcctgccctggaccatgagcagcctgtggtgcatccccctgaagggcatgctggccacctgccctgtgtccctgctggagcacgcctacagcaatgccctgcggggctggaagccctag

SEQ ID NO: 20638 - DNA, 2121 bp, Artificial Sequence
  Description of Artificial Sequence: Synthetic coding sequence
atggccacagccaactttgggaagatccagatcggcatctacgtggagatcaagagaagtgatggccgcatccaccaggccatggtgaccagcctgaatgaagataatgaatctgtgacagtggagtggattgaaaatggagacaccaagggcaaggagattgacctggagagcatcttcagcctgaacccagacctggtgcctgatgaggagattgagcccagccctgagaccccacctcctccagccagcagcgccaaggtgaacaagatcgtgaagaacagaagaacagtggccagcatcaagaatgacccccccagccgggacaacagagtggtgggcagcgcccgggcccggcccagccagtttcctgagcagagcagcagcgcccagcagaatggatctgtgtctgacatcagccctgtgcaggccgccaagaaggagtttggaccacccagcaggaggaagagcaactgtgtgaaggaggtggagaagctgcaggagaagcgggagaagaggcggctgcagcagcaggagctgcgggagaagagggcccaggatgtggatgccaccaaccccaactatgagatcatgtgcatgatccgggacttccggggcagcctggactaccggcccctgaccacagctgaccccattgatgagcaccgcatctgtgtgtgtgtgaggaagaggcccctgaacaagaaggagacccagatgaaggacctggatgtgatcaccatccccagcaaggatgtggtgatggtgcatgagcccaagcagaaggtggacctgacccgctacctggagaaccagaccttccgctttgattatgcctttgatgattctgccccaaatgagatggtgtaccgcttcaccgcccggcccctggtggagaccatctttgagcggggcatggccacctgctttgcctacggccagacaggcagcggcaagacccacaccatgggcggggacttcagcggcaagaaccaggactgcagcaagggcatctatgccctggccgccagagatgtgttcctgatgctgaagaagcccaactacaagaagctggagctgcaggtgtatgccaccttctttgagatctacagcggcaaggtgtttgacctgctgaacaggaagaccaagctgcgggtgctggaggatggcaagcagcaggtgcaggtggtgggcctgcaggagcgggaggtgaagtgtgtggaggatgtgctgaagctgattgacatcggcaacagctgcaggaccagcggccagaccagcgccaatgcccacagcagccgcagccatgctgtgttccagatcatcctgcggaggaagggcaagctgcacggcaagttcagcctgattgacctggccggaaatgaaagaggagctgacaccagcagcgctgaccggcagacccggctggagggcgctgagatcaacaagagcctgctggccctgaaggagtgcatccgggccctgggcaggaacaagccccacacccccttccgggccagcaagctgacccaggtgctgcgggacagcttcatcggggagaacagcaggacctgcatgattgccaccatcagccctggcatggccagctgtgagaacaccctgaacaccctgcgctatgccaacagagtgaaggagctgactgtggaccccacagctgctggagatgtgcggcccatcatgcaccacccccccaaccagattgatgacctggagacccagtggggcgtgggcagcagcccccagagagatgacctgaagctgctgtgtgagcagaatgaggaggaggtgagcccccagctgttcaccttccatgaagctgtgtcccagatggtggagatggaggagcaggtggtggaggaccacagagctgtgttccaggagagcatccgctggctggaggatgagaaggccctgctggagatgacagaggaggtggactatgatgtggacagctatgccacccagctggaggccatcctggagcagaagattgacatcctgacagagctgcgggacaaggtgaagagcttccgggccgccctgcaggaggaggagcaggccagcaagcagatcaaccccaagaggccccgggccctgtag

SEQ ID NO: 20639 - DNA, 1281 bp, Artificial Sequence; identical to SEQ ID NO: 18929
  Description of Artificial Sequence: Synthetic coding sequence

SEQ ID NO: 20640 - DNA, 996 bp, Artificial Sequence
  Description of Artificial Sequence: Synthetic coding sequence
atgctgcgctgtggccagatgatctttgcccaggccctggtgtgccgccacctgggccgggactggcgctggacccagaggaagaggcagcctgacagctacttctctgtgctgaatgccttcatcgacaggaaggacagctactacagcatccaccagatcgcccagatgggcgtgggggagggcaagagcatcggccagtggtacggccccaacacagtggcccaggtgctgaagaagctggccgtgtttgacacctggagcagcctggccgtgcacatcgccatggacaacacagtggtgatggaggagatccggcggctgtgcaggacctctgtgccctgtgccggggccacagccttccctgctgacagcgacagacactgcaatggcttccctgctggagctgaggtgaccaaccggcccagcccctggaggcccctggtgctgctgatccccctgcggctgggcctgacagacatcaatgaggcctacgtggagaccctgaagcactgcttcatgatgccccagagcctgggcgtcatcggcggcaagcccaacagcgcccactacttcatcggctacgtgggggaggagctgatctacctggacccccacaccacccagcctgctgtggagcccacagatggctgcttcatcccagatgagagcttccactgccagcaccccccctgcaggatgagcattgctgagctggaccccagcattgctgtgggcttcttctgcaagacagaagatgacttcaatgactggtgccagcaggtgaagaagctgagcctgctgggcggggccctgcccatgtttgagctggtggagctgcagcccagccacctggcctgcccagatgtgctgaacctgagcctgggggagagctgccaggtgcaggtgggcagcctgggggacagcagtgatgtggagcggctggagcgcttctttgattctgaagatgaggactttgagatcctgagcctgtag

SEQ ID NO: 20641 - DNA, 1461 bp, Artificial Sequence; identical to SEQ ID NO: 18479
  Description of Artificial Sequence: Synthetic coding sequence

SEQ ID NO: 20642 - DNA, 3075 bp, Artificial Sequence; identical to SEQ ID NO: 19574
  Description of Artificial Sequence: Synthetic coding sequence

SEQ ID NO: 20643 - DNA, 339 bp, Artificial Sequence
  Description of Artificial Sequence: Synthetic coding sequence
atggatgacaaggcctctgtgggcaagatctctgtgtccagtgacagcgtgtccaccctgaacagtgaagattttgtgctggtgtcccggcagggagatgagacccccagcaccaacaacggcagtgatgatgagaagacaggcctgaagatcgtgggcaatggcagcgagcagcagctgcagaaggagctggctgatgtgctgatggacccccccatggatgaccagcctggagagaaggagctggtgaagaggagccagctggatggagaaggagatggccccctgagcaaccagctgagcgccagcagcaccatcaaccctgtgcccctggtgtag

SEQ ID NO: 20644 - DNA, 441 bp, Artificial Sequence
  Description of Artificial Sequence: Synthetic coding sequence
atgctgaaggaggactgtgccagcgagctgaaggtgcacctggccaagagcctgcccctgcccagctctgtgaaccggcccagaattgacctgattgtgtttgtggtgaacctgcacagcaagtacagcctgcagaacacagaggagagcctgcggcacgtggatgccagcttcttcctgggcaaggtgtgcttcctggccaccggggccggccgggagagccactgcagcatccaccgccacacagtggtgaagctggcccacacctaccagagccccctgctgtactgtgacctggaggtggagggcttccgggccaccatggcccagaggctggtgcgggtgctgcagatctgtgccggccacgtgcctggggtgtctgccctgaacctgctgagcctgctgcggagcagcgagggccccagcctggaggacctgtag

SEQ ID NO: 20645 - DNA, 1203 bp, Artificial Sequence
  Description of Artificial Sequence: Synthetic coding sequence
atggccagtgacacccaggccgtgcctgatgtgtctggccgcagccgggcccggcgctatgcagagtggagcagcggcctgcggagcggccgggccggcggcggggagacctctgtggagaggaggaggacctgtgcctttgacaccctggaggccttcctgatcatggatggagaggacatcccagacttcagcagcctgaaggaggagacagcctactggaaggagctgagcctgaagtacaagcagagcttccaggaggccagagatgagctggtggagttccaggagggcagccgggagctggaggccgagctggaggcccagctggtgcaggccgagcagaggaacagagacctgcaggccgacaaccagaggctgaagtatgaggtggaggccctgaaggagaagctggagcaccagtatgcccagagctacaagcaggtgtctgtgctggaggatgacctgagccagacccgggccatcaaggagcagctgcacaagtatgtgcgggagctggagcaggccaatgatgacctggagcgggccaagagggccaccatcgtgtccctggaggactttgagcagaggctgaaccaggccatcgagagaaatgccttcctggagagcgagctggatgagaaggagagcctgctggtgtctgtgcagaggctgaaggatgaggcccgggacctgcggcaggagctggccgtgcgggagcggcagcaggaggtgaccaggaagagcgcccccagcagccccaccctggactgtgagaagatggattctgctgtgcaggccagcctgagcctgcctgccacccctgtgggcaagggcacagagaacaccttccccagccccaaggccatccccaacggcttcggcaccagccccctgacccccagcgcccgcatcagcgccctgaacatcgtgggggacctgctgaggaaggtgggcgccctggagagcaagctggccgcctgcaggaactttgccaaggaccaggccagcaggaagagctacatctctggaaatgtgaactgtggggtgctgaatggaaatggcaccaagttcagccgcagcggccacaccagcttctttgataaaggagctgtgaatggatttgatcctgcccctcctcctcctggcctgggcagcagccggcccagcagcgcccctggcatgctgcccctgtctgtgtag

SEQ ID NO: 20646 - DNA, 699 bp, Artificial Sequence
  Description of Artificial Sequence: Synthetic coding sequence
atgaccccaccccagcagcccccacccctgcggtctgagcccggcaccctgggcagcgctgccagcagctacagccccctgggcctgaatggagtgcccggcagcatctgggactttgtgtctggcagcttcagccccagccccagccccatcctgtctgctggcccccccagcagcagcagcgccagccccaatggagctgagctggcccgggtgcggcggcagctggatgaggccaagaggaagatccggcagtgggaggagagctggcagcaggtgaagcaggtgtgtgatgcctggcagcgggaggcccaggaggccaaggagcgggcccgggtggccgacagcgaccggcagctggccctgcagaagaaggaggaggtggaggcccaggtgaagcagctgcaggaggagctggagggcctgggcgtggccagcaccctgcccggcctgcggggctgtggggacatcggcaccatccccctgcccaagctgcacagcctgcagagccagctgcggctggacctggaggccgtggatggagtcatcttccagctgcgggccaagcagtgtgtggcctgccgggagcgggcccatggagctgtgctgcggccctgccagcaccacatcctgtgtgagccctgtgccgccacagccccagaatgtccctactgcaagggccagcccctgcagtggtag

SEQ ID NO: 20647 - DNA, 1500 bp, Artificial Sequence
  Description of Artificial Sequence: Synthetic coding sequence
atgctgccctggcccccagccctggccatgcccatgcccacagagggcaccccaccacccctgagcggcacccccatccctgtgcctgcctacttcagacatgctgagcccggcttcagcctgaagaggccccggggcctgagccgcagcctgcccccacctcctccagccaagggcagcatccccatcagccgcctcttcccccccaggaccccaggctggcaccagctgcagccccggcgggtgtccttccggggggaggccagcgagaccctgcagagccctggctatgaccccagcaggcctgagagcttcttccagcagagcttccagaggctgagccggctgggccacggcagctatggagaggtgttcaaggtgcgcagcaaagaagatggccgcctgtatgctgtgaagaggtccatgagccccttccggggccccaaggaccgggccaggaagctggccgaggtgggcagccatgagaaggtgggccagcacccctgctgcgtgcggctggagcaggcctgggaggagggcggcatcctgtacctgcagacagagctgtgtggccccagcctgcagcagcactgtgaggcctggggcgccagcctgcctgaggcccaggtgtggggctacctgcgggacaccctgctggccctggcccacctgcacagccagggcctggtgcacctggatgtgaagccagccaacatcttcctgggcccccggggccgctgcaagctgggggactttggcctgctggtggagctgggcacagctggagctggggaggtgcaggagggggacccccgctacatggcccctgagctgctgcagggcagctatggaacagctgctgatgtgttcagcctgggcctgaccatcctggaggtggcctgcaacatggagctgccccatggaggagagggctggcagcagctgcggcagggctacctgcccccagagttcaccgctggcctgagcagcgagctgcggtctgtgctggtgatgatgctggagccagaccccaagctgcgggccacagctgaggccctgctggccctgcctgtgctgcggcagccccgggcctggggcgtgctgtggtgcatggctgctgaggccctgagccggggctgggccctgtggcaggccctgctggccctgctgtgctggctgtggcacggcctggcccacccagcctcctggctgcagcccctgggccccccagccaccccacctggcagccccccctgcagcctgctgctggacagcagcctgagcagcaactgggatgatgacagcctgggccccagcctgagccctgaggccgtgctggccaggacagtgggcagcaccagcacccccaggagccgctgcaccccaagagatgccctggacctgagtgacatcaacagcgagcccccccggggcagcttccccagctttgagcccaggaacctgctgagcctgtttgaggacaccctggaccccacctag

SEQ ID NO: 20648 - DNA, 3153 bp, Artificial Sequence; identical to SEQ ID NO: 18501
  Description of Artificial Sequence: Synthetic coding sequence

SEQ ID NO: 20649 - DNA, 363 bp, Artificial Sequence
  Description of Artificial Sequence: Synthetic coding sequence
atgagcattggagtgcccatcaaggtgctgcatgaagctgagggccacatcgtgacctgtgagaccaacacaggagaggtgtaccggggcaagctgattgaagctgaggacaacatgaactgccagatgagcaacatcaccgtgacctacagagatggccgggtggcccagctggagcaggtgtacatccggggcagcaagatccgcttcctgatcctgcctgacatgctgaagaatgcccccatgctgaagtccatgaagaacaagaaccagggcagcggggccggccggggcaaggccgccatcctgaaggcccagggctacctgagcagcctggagtgggtgctggtgcacatctgctag

SEQ ID NO: 20650 - DNA, 1182 bp, Artificial Sequence; identical to SEQ ID NO: 19786
  Description of Artificial Sequence: Synthetic coding sequence

SEQ ID NO: 20651 - DNA, 228 bp, Artificial Sequence
  Description of Artificial Sequence: Synthetic coding sequence
atgagcccccagaagagggtgaagaatgtgcaggcccagaacagaaccagccagggcagcagcagcttccagaccaccctgagcgcctggaaggtgaagcaggaccccagcaacagcaagaacatcagcaagcacggccagaacaaccctgtgggggactatgagcacgcagatgaccaggccgaggaggatgccctgcagatggctgtgggctactttgagaagtag

SEQ ID NO: 20652 - DNA, 996 bp, Artificial Sequence
  Description of Artificial Sequence: Synthetic coding sequence
atggcctttgtgacccggcagttcatgaggtctgtgagcagcagcagcacagccagcgccagcgccaagaagatcatcgtgaagcacgtgacagtgattggaggcggcctgatgggcgccggcatcgcccaggtggccgccgccaccggccacacagtggtgctggtggaccagacagaggacatcctggccaagagcaagaagggcatcgaggagagcctgaggaaggtggccaagaagaagtttgctgagaacctgaaggctggagatgaatttgtggagaagaccctgagcaccatcgccaccagcacagatgctgcctctgtggtgcacagcacagacctggtggtggaggccatcgtggagaacctgaaggtgaagaatgagctgttcaagaggctggacaagtttgctgctgagcacaccatctttgccagcaacaccagcagcctgcagatcaccagcatcgccaatgccaccacccggcaggacagatttgctggcctgcacttcttcaaccctgtgcctgtgatgaagctggtggaggtgatcaagacccccatgaccagccagaagacctttgagagcctggtggacttcagcaaggccctgggcaagcaccctgtgtcctgcaaggacaccccaggcttcatcgtgaaccggctgctggtgccctacctgatggaggccatccggctgtatgaaagagacttccagacctgtggggacagcaacagcggcctgggcttcagcctgaagggagatgccagcaaagaagatattgacacagccatgaagctgggcgccggctaccccatgggcccctttgagctgctggactatgtgggcctggacaccaccaagttcatcgtggatggctggcatgagatggatgctgagaaccccctgcaccagcccagccccagcctgaacaagctggtggccgagaacaagtttgggaagaagacaggagagggcttctacaagtacaagtag

SEQ ID NO: 20653 - DNA, 1281 bp, Artificial Sequence; identical to SEQ ID NO: 18929
  Description of Artificial Sequence: Synthetic coding sequence

SEQ ID NO: 20654 - DNA, 1290 bp, Artificial Sequence
  Description of Artificial Sequence: Synthetic coding sequence
atgcccaacgtgctgctgccccccaaggagagcaacctcttcaagaggatcctgaagtgctatgagcagaagcagtacaagaatggcctgaagttctgcaagatgatcctgagcaaccccaagtttgctgagcacggggagaccctggccatgaagggcctgaccctgaactgcctgggcaagaaggaggaggcctatgaatttgtgaggaagggcctgagaaatgatgtgaagagccacgtgtgctggcacgtgtatggcctgctgcagaggagtgacaagaagtatgatgaggccatcaagtgctacagaaatgccctgaagctggacaaggacaacctgcagatcctgcgggacctgagcctgctgcagatccagatgagggacctggagggctaccgggagacccgctaccagctgctgcagctgcggcccacccagagggcctcctggattggctacgccatcgcctaccacctgctgaaggactatgacatggccctgaagctgctggaggagttccggcagacccagcaggtgccccccaacaagattgattatgagtacagcgagctgatcctgtaccagaaccaggtgatgagggaggccgacctgctgcaggagagcctggagcacatcgagatgtatgagaagcagatctgtgacaagctgctggtggaggagatcaagggggagatcctgctgaagctgggccgcctgaaggaggccagcgaggtgttcaagaacctgattgacagaaatgctgagaactggtgctactatgagggcctggagaaggccctgcagatcagcaccctggaggagcggctgcagatctatgaggagatcagcaagcagcaccccaaggccatcaccccccggcggctgcccctgaccctggtgcctggagagcgcttccgggagctgatggacaagttcctgcgggtgaacttcagcaagggctgccccccactcttcaccaccctgaagagcctgtactacaacacagagaaggtgtccatcatccaggagctggtgaccaactatgaggccagcctgaagacctgtgacttcttcagcccctatgaaaatggagagaaggagccccccaccaccctgctgtgggtgcagtacttcctggcccagcactttgacaagctgggccagtacagcctggccctggactacatcaatgctgccatcgccagcacccccaccctcatcgagctgttctacatgaaggccaagatctacaaggtgaagtctgagagctgcttcctgagcagctag

SEQ ID NO: 20655 - DNA, 360 bp, Artificial Sequence
  Description of Artificial Sequence: Synthetic coding sequence
atggacaagaacattggagagcagctgaacaaggcctatgaggccttccggcaggcctgcatggaccgggacagcgctgtgaaggagctgcagcagaagacagaaaattatgagcagaggatccgggagcagcaggagcagctgagcctgcagcagaccatcatcgacaagctgaagagccagctgctgctggtgaacagcacccaggacaacaactacggctgtgtgcccctgctggaggacagcgagaccaggaagaacaacctgaccctggaccagccccaggacaaggtgatcagcggcatcgcccgggagaagctgcccaaggtggacatcgccagcgctgagagcagcatctag

SEQ ID NO: 20656 - DNA, 699 bp, Artificial Sequence; identical to SEQ ID NO: 20646
  Description of Artificial Sequence: Synthetic coding sequence

SEQ ID NO: 20657 - DNA, 1461 bp, Artificial Sequence; identical to SEQ ID NO: 18479
  Description of Artificial Sequence: Synthetic coding sequence

SEQ ID NO: 20658 - DNA, 3075 bp, Artificial Sequence; identical to SEQ ID NO: 19574
  Description of Artificial Sequence: Synthetic coding sequence

SEQ ID NO: 20659 - DNA, 1767 bp, Artificial Sequence; identical to SEQ ID NO: 19028
  Description of Artificial Sequence: Synthetic coding sequence

SEQ ID NO: 20660 - DNA, 666 bp, Artificial Sequence
  Description of Artificial Sequence: Synthetic coding sequence
atgctgaagaacaagggccacagcagcaagaaggacaacctggccgtgaatgctgtggccctgcaggaccacatcctgcatgacctgcagctgaggaacctgtctgtggccgaccacagcaagacccaggtgcagaagaaggagaacaagagcctgaagagggacaccaaggccatcatcgacaccggcctgaagaagaccacccagtgccccaagctggaggacagcgagaaggagtatgtgctggaccccaagcccccacccctgaccctggcccagaagctgggcctcatcggccccccacctccacccctgagcagtgatgagtgggagaaggtgaagcagaggagcctgctgcagggcgacagcgtgcagccctgccccatctgcaaggaggagtttgagctgcggccccaggtgctgctgagctgcagccacgtgttccacaaggcctgcctgcaggcctttgagaagttcaccaacaagaagacctgccccctgtgcaggaagaaccagtaccagaccagggtcatccatgatggagcccggctcttccgcatcaagtgtgtgacccgcatccaggcctactggaggggctgtgtggtgaggaagtggtacagaaacctgaggaagacagtgcccccaacagatgccaagctgaggtag

SEQ ID NO: 20661 - DNA, 900 bp, Artificial Sequence; identical to SEQ ID NO: 18623
  Description of Artificial Sequence: Synthetic coding sequence

SEQ ID NO: 20662 - DNA, 2193 bp, Artificial Sequence
  Description of Artificial Sequence: Synthetic coding sequence
atggaggacctgtttgagaccttccaggatgagatgggcttcagcaacatggaggatgatggccctgaggaggaggagcgggtggccgagccccaggccaacttcaacaccccccaggccctgcgctttgaggagctgctggccaacctgctgaatgagcagcaccagatcgccaaggagctgtttgagcagctgaagatgaagaagcccagcgccaagcagcagaaggaggtggagaaggtgaagccccagtgcaaggaggtgcaccagaccctcatcctggaccctgcccagaggaagaggctgcagcagcagatgcagcagcacgtgcagctgctgacccagatccacctgctggccacctgcaaccccaacctgaaccctgaggccagcagcacccgcatctgcctgaaggagctgggcacctttgcccagagcagcatcgccctgcaccaccagtacaaccccaagttccagaccctcttccagccctgcaacctgatgggcgccatgcagctgattgaggacttcagcacccacgtgtccattgactgcagcccccacaagacagtgaagaagacagccaatgagttcccctgcctgcccaagcaggtggcctggatcctggccaccagcaaggtgttcatgtacccagagctgctgcctgtgtgcagcctgaaggccaagaacccccaggacaagatcctcttcaccaaggccgaggacaacaagtacctgctgacctgcaagacagcccggcagctgactgtgcgcatcaagaacctgaacatgaacagagccccagacaacatcatcaagttctacaagaagaccaagcagctgcctgtgctgggcaagtgctgtgaggagatccagccccaccagtggaagccacccatcgagcgggaggagcaccggctgcccttctggctgaaggccagcctgcccagcatccaggaggagctgcggcacatggctgatggagcccgggaggtgggcaacatgacaggcaccacagagatcaacagcgaccagggcctggagaaggacaacagcgagctgggcagcgagacccgctaccccctgctgctgcccaagggcgtggtgctgaagctgaagcctgtggccgaccgcttccccaagaaggcctggaggcagaagaggagctctgtgctgaagcccctgctgatccagcccagccccagcctgcagcccagcttcaaccctgggaagaccccagcccagagcacccacagcgaggccccacccagcaagatggtgctgcgcatcccccaccccatccagcctgccaccgtgctgcagacagtgcctggggtgccccccctgggcgtgtctggaggagagagctttgagagccctgctgccctgcctgccatgcctcctgaggcccggaccagcttccccctgtctgagagccagaccctgctgagcagcgcccctgtgcccaaggtgatgatgcccagccctgccagctccatgttcaggaagccctacgtgagaagaagacccagcaagagaagaggagcccgggccttccgctgcatcaagccagcccctgtgatccacccagccagcgtcatcttcaccgtgcctgccaccaccgtgaagatcgtgtccctgggcggcggctgcaacatgatccagcctgtgaatgctgctgtggcccagagcccccagaccatccccatcgccaccctgctggtgaaccccaccagcttcccctgccccctgaaccagcccctggtggccagctctgtgagccccctgattgtgtctggcaacagcgtgaacctgcccatccccagcaccccagaggacaaggcccacatgaatgtggacatcgcctgtgctgtggctgatggagaaaatgccttccagggcctggagcccaagctggagccccaggagctgagccccctgagcgccaccgtcttccccaaggtggagcacagccctggccccccacctgtggacaagcagtgccaggagggcctgtctgagaacagcgcctaccgctggacagtggtgaagacagaggagggccggcaggccctggagcccctgccccagggcatccaggagagcctgaacaacagcagccctggggacctggaggaggtggtgaagatggagccagaagatgccacagaggagatcagcggcttcctgtag

SEQ ID NO: 20663 - DNA, 1563 bp, Artificial Sequence
  Description of Artificial Sequence: Synthetic coding sequence
atgtttgtgtctgacttcaggaaggagttctatgaggtggtgcagagccagagggtgctgctgtttgtggccagtgatgtggatgccctgtgtgcctgcaagatcctgcaggccctcttccagtgtgaccacgtgcagtacaccctggtgcctgtgtctggctggcaggagctggagacagccttcctggagcacaaggagcagatcaagctgctgatcaagcaggatgatgacctggaggtgcctgcctatgaggacatcttcagagatgaggaggaggatgaggagcacagcggaaatgacagtgatggcagcgagcccagcgagaagaggacccggctggaggaggagatcgtggagcagaccatgagaagacggcagaggcgggagtgggaggccaggagaagagacatcctgtttgattatgagcagtatgagtaccacggcaccagcagcgccatggtgatgtttgagctggcctggatgctgagcaaggacctgaatgacatgctgtggtgggccatcgtgggcctgacagaccagtgggtgcaggacaagatcacccagatgaagtatgtgacagatgtgggcgtgctgcagagacatgtgagccgccacaaccacagaaatgaagatgaggagaacaccctgtctgtggactgcacccgcatcagctttgaatatgacctgcggctggtgctgtaccagcactggagcctgcatgacagcctgtgcaacaccagctacacagctgcccgcttcaagctgtggagcgtgcacggccagaagaggctgcaggagttcctggccgacatgggcctgcccctgaagcaggtgaagcagaagttccaggccatggacatcagcctgaaggagaacctgcgggagatgattgaggagagcgccaacaagtttggcatgaaggacatgagggtgcagaccttcagcatccacttcggcttcaagcacaagttcctggccagtgatgtggtgtttgccaccatgagcctgatggagagccctgagaaggatggcagcggcacagaccacttcatccaggccctggacagcctgagccgcagcaacctggacaagctgtaccacggcctggagctggccaagaagcagctgcgggccacccagcagaccatcgccagctgcctgtgcaccaacctggtgatcagccagggccccttcctgtactgcagcctgatggagggcaccccagatgtgatgctgttcagcaggcctgccagcctgagcctgctgagcaagcacctgctgaagagctttgtgtgcagcaccaagaacagacgctgcaagctgctgcccctggtgatggccgcccccctgtccatggagcacggcaccgtgacagtggtgggcatccccccagagacagacagcagtgacaggaagaacttcttcggccgggcctttgagaaggctgctgagagcaccagcagcaggatgctgcacaaccactttgacctgtctgtgattgagctgaaggccgaggacaggagcaagttcctggatgccctgatcagcctgctgtcctag

SEQ ID NO: 20664 - DNA, 567 bp, Artificial Sequence; identical to SEQ ID NO: 19160
  Description of Artificial Sequence: Synthetic coding sequence

SEQ ID NO: 20665 - DNA, 1182 bp, Artificial Sequence
  Description of Artificial Sequence: Synthetic coding sequence
atggatgctgccaccctgacctatgacaccctgcgctttgctgagtttgaggacttccctgagaccagcgagcctgtgtggatcctgggcaggaagtacagcatcttcacagagaaggatgagatcctgagtgatgtggccagccggctgtggttcacctacaggaagaacttccctgccatcggcggcaccggccccaccagtgacaccggctggggctgcatgctgcgctgtggccagatgatctttgcccaggccctggtgtgccgccacctgggccgggactggcgctggacccagaggaagaggcagcctgacagctacttctctgtgctgaatgccttcatcgacaggaaggacagctactacagcatccaccagatcgcccagatgggcgtgggggagggcaagagcatcggccagtggtacggccccaacacagtggcccaggtgctgaagaagctggccgtgtttgacacctggagcagcctggccgtgcacatcgccatggacaacacagtggtgatggaggagatccggcggctgtgcaggacctctgtgccctgtgccggggccacagccttccctgctgacagcgacagacactgcaatggcttccctgctggagctgaggtgaccaaccggcccagcccctggaggcccctggtgctgctgatccccctgcggctgggcctgacagacatcaatgaggcctacgtggagaccctgaagcactgcttcatgatgccccagagcctgggcgtcatcggcggcaagcccaacagcgcccactacttcatcggctacgtgggggaggagctgatctacctggacccccacaccacccagcctgctgtggagcccacagatggctgcttcatcccagatgagagcttccactgccagcaccccccctgcaggatgagcattgctgagctggaccccagcattgctgtgggcttcttctgcaagacagaagatgacttcaatgactggtgccagcaggtgaagaagctgagcctgctgggcggggccctgcccatgtttgagctggtggagctgcagcccagccacctggcctgcccagatgtgctgaacctgagcctggacagcagtgatgtggagcggctggagcgcttctttgattctgaagatgaggactttgagatcctgagcctgtag

SEQ ID NO: 20666 - DNA, 780 bp, Artificial Sequence; identical to SEQ ID NO: 18843
  Description of Artificial Sequence: Synthetic coding sequence

SEQ ID NO: 20667 - DNA, 852 bp, Artificial Sequence
  Description of Artificial Sequence: Synthetic coding sequence
atgatccccccccaggaggccagcgccaggagaagagaaattgaggacaagctgaagcaggaggaggagaccctgtccttcatccgggacagcctggagaagagtgaccagctgaccaagaacatggtgtccatcctgagcagctttgagagccggctgatgaagctggagaacagcatcatccctgtgcacaagcagacagagaacctgcagaggctgcaggagaatgtggagaagaccctgagctgcctggaccacgtgatctcctactaccacgtggccagtgacacagagaagatcatccgggagggccccaccggccgcctggaggagtacctgggctccatggccaagatccagaaggctgtggagtacttccaggacaacagcccagacagccctgagctgaacaaggtgaagctgctgtttgagcggggcaaggaggccctggagagcgagttccgcagcctgatgaccaggcacagcaaggtggtgtcccctgtgctgatcctggacctgatctctggagatgatgacctggaggcccaggaggatgtgaccctggagcacctgcctgagagcgtgctgcaggacgtcatccgcatcagccgctggctggtggagtatggaagaaaccaggacttcatgaatgtgtactaccagatccgcagcagccagctggacaggagcatcaagggcctgaaggagcacttccacaagagcagcagcagcagtggagtgccctacagccctgccatccccaacaagaggaaggacacccccaccaagaagcctgtgaagaggcctggagagccccccagctggcccatcagcgccacagcccggggctag

SEQ ID NO: 20668 - DNA, 2121 bp, Artificial Sequence
  Description of Artificial Sequence: Synthetic coding sequence
atgaatgaggccatggccacagacagcccccggcggcccagccgctgcacaggaggagtggtggtgcggccccaggccgtgacagagcagagctacatggagagcgtggtgaccttcctgcaggatgtggtgccccaggcctacagcggcacccccctgacagaggagaaggagaagatcgtgtgggtgcgctttgaaaatgctgacctgaatgacaccagcaggaacctggagttccacgagatccacagcactggaaatgaaccacccctgctgatcatgattggctacagtgatggcatgcaggtgtggagcatccccatctctggagaggcccaggagctgttctctgtgcgccacggccccatccgggccgcccgcatcctgcctgccccccagtttggagcccagaagtgtgacaactttgctgagaagaggcccctgctgggcgtgtgcaagagcatcggcagcagcggcaccagccccccctactgctgcgtggacctgtacagcctgaggactggagagatggtgaagagcatccagttcaagacccccatctatgacctgcactgcaacaagaggatcctggtggtggtgctgcaggagaagattgctgcctttgacagctgcaccttcaccaagaagttctttgtgaccagctgctacccctgccccggccccaacatgaaccccatcgccctgggcagccgctggctggcctatgcagagaacaagctgatccgctgccaccagagcagaggaggagcctgtggggacaacatccagagctacacagccaccgtcatctctgctgccaagaccctgaagagcggcctgaccatggtgggcaaggtggtgacccagctgaccggcaccctgcccagcggcgtgacagaagatgatgtggccatccacagcaacagccgccgcagccccctggtgcccggcatcatcaccgtcatcgacacagagaccgtgggggagggccaggtgctggtgtctgaggacagcgacagtgatggcatcgtggcccacttccctgcccacgagaagcctgtgtgctgcatggccttcaacaccagcggcatgctgctggtgaccacagacaccctgggccatgacttccacgtgttccagatcctgacccacccctggagcagcagccagtgtgctgtgcaccacctgtacaccctgcacagaggagaaacagaggccaaggtgcaggacatctgcttcagccatgactgccgctgggtggtggtgtccaccctgcggggcaccagccacgtgttccccatcaacccctatggaggccagccctgtgtgaggacccacatgagcccccgggtggtgaacaggatgagccgcttccagaagtctgctggcctggaggagattgagcaggagctgaccagcaagcagggcggccgctgcagccctgtgcccggcctgagcagcagccccagcggcagccccctgcacggcaagctgaacagccaggacagctacaacaacttcaccaacaacaaccctggcaacccccggctgagccccctgcccagcctgatggtggtgatgcccctggcccagatcaagcagcccatgaccctgggcaccatcaccaagaggacaggcccctacctgtttggagctggctgcttcagcatcaaggccccctggagctacatcatgaccaagtacatcttctacatcaagccacccaacaaggtgaagcccccaccccagatcagccccagcaagtccatgggcggggagttctgtgtggccgccatcttcggcaccagccgctcctggtttgccaacaatgccggcctgaagcgggagaaggaccagagcaagcaggtggtggtggagagcctgtacatcatcagctgctacggcaccctggtggagcacatgatggagccccggcccctgagcacagcccccaagatcagtgatgacacccccctggagatgatgaccagcccccgggcctcctggaccctggtgaggaccccccagtggaatgagctgcagccccccttcaatgccaaccaccccctgctgctggccgcagatgctgtgcagtactaccagttcctgctggccggctag

SEQ ID NO: 20669 - DNA, 1815 bp, Artificial Sequence
  Description of Artificial Sequence: Synthetic coding sequence
atgggcggctgcttcagcaagcccaagccaggggccgccctgcccaccgtggagctgaagattgaggtggtgctgcctgagaaggagcggggcaaggaggagctgagcgccagcggcaagggcagcccccgggcctaccagggcaatggaacagcccggcacttccacacagaggagcggctgagcaccccccacccctaccccagcccccaggactgtgtggaggccgctgtgtgccacgtgaaggacctggagaatggccagatgagggaggtggagctgggctggggcaaggtgctgctggtgaaggacaatggagagttccacgccctgggccacaagtgcccccactacggggcccccctggtgaagggcgtgctgagccggggccgggtgcgctgcccctggcatggagcctgcttcaacatcagcactggagacctggaggacttccctggcctggacagcctgcacaagttccaggtgaagattgagaaggagaaggtgtatgtgcgggccagcaagcaggccctgcagctgcagaggaggaccaaggtgatggccaagtgcatcagccccagcgctggctacagcagcagcaccaacgtgctgattgtgggcgctggagctgctggcctggtgtgtgccgagaccctgcggcaggagggcttcagtgaccgcatcgtgctgtgcaccctggacagacacctgccctatgaccggcccaagctgagcaagagcctggacacccagcctgagcagctggccctgcggcccaaggagttcttccgggcctacggcatcgaggtgctgacagaggcccaggtggtgacagtggatgtgaggaccaagaaggtggtgttcaaggatggcttcaagctggagtacagcaagctgctgctggcccctggcagcagccccaagaccctgagctgcaagggcaaggaggtggagaatgtgttcaccatccgcaccccagaagatgccaacagagtggtgcggctggcccggggcagaaatgtggtggtggtgggcgccggcttcctgggcatggaggtggccgcctacctgacagagaaggcccacagcgtgtctgtggtggagctggaggagacccccttccgccgcttcctgggggagcgggtgggccgggccctgatgaagatgtttgagaacaacagagtgaagttctacatgcagacagaggtgtctgagctgcggggccaggagggcaagctgaaggaggtggtgctgaagagcagcaaggtggtgcgggcagatgtgtgtgtggtgggcattggagctgtgcctgccaccggcttcctgcggcagagcggcatcggcctggacagccggggcttcatccctgtgaacaagatgatgcagaccaacgtgcctggggtgtttgctgctggagatgctgtgaccttccccctggcctggaggaacaacaggaaggtgaacatcccccactggcagatggcccacgcccagggccgggtggccgcccagaacatgctggcccaggaggccgagatgagcacagtgccctacctgtggacagccatgtttgggaagagcctgcgctatgccggctatggagagggctttgatgatgtgatcatccagggcgacctggaggagctgaagtttgtggccttctacaccaagggagatgaggtgattgctgtggcctccatgaactatgaccccatcgtgtccaaggtggccgaggtgctggccagcggccgggccatcaggaagcgggaggtggagactggagacatgtcctggctgaccgggaagggcagctag

SEQ ID NO: 20670 - DNA, 744 bp, Artificial Sequence
  Description of Artificial Sequence: Synthetic coding sequence
atgagcacagctgctgtgcctgagctgaagcagatcagccgggtggaggccatgaggctgggccctggctggagccacagctgccacgccatgctgtatgctgccaaccctggccagctgtttggccgcatccccatgaggttctctgtgctgatgcagatgagatttgatggcctgctgggcttccctgggggctttgtggaccggcgcttctggagcctggaggatggcctgaacagagtgctgggcctgggcctgggctgcctgcggctgacagaggccgactacctgagcagccacctgacagagggcccccaccgggtggtggcccacctgtatgcccggcagctgaccctggagcagctgcatgctgtggagatctctgctgtgcacagccgggaccacggcctggaggtgggccccccacctggcccccggcccccaccccggggcctggccctggccccctggaaggcccccatgggcaacaccagccctgagggccccctggccggcctgggccgggtgtccctgagccctgccatgggctggggcgagggcagcggggccggccggcctgggaaggagggccggggctggggccctgccctgggcctgccccagggctgtgtgaccagcgccctgctgcctgccatcgccaaccctggcagcggcggcgtgggctctgtgggcaggaagggctggggccgcagcggggactgcctgggctcctgggagacctag

SEQ ID NO: 20671 - DNA, 1338 bp, Artificial Sequence; identical to SEQ ID NO: 18645
  Description of Artificial Sequence: Synthetic coding sequence

SEQ ID NO: 20672 - DNA, 1335 bp, Artificial Sequence
  Description of Artificial Sequence: Synthetic coding sequence
ttccgggtgcctgctgctggccgccgctgccccctggcccggggggcccggcggcccccagacagcgcctgtggccgcttccccccagaccccggcagccccccagaggaggaggatgctgacctgtctgagcgggaggagagctggctgctggccgagcgggaggagaaccaggaggccgagttccctggcctgcggcgggctgtgcagctgaacctgagccggcccatcgaggagcagggccccctggatgtgatcatccacaagctgacagatgtgatcctggaggccgaccagaatgacagccagagcctggagctggtgcaccgcttccaggagtacattgatgcccaccctgagaccatcgtgctggaccccctgcctgccatccgcaccctgctggacaggagcaagagctatgagctgatcaggaagattgaggcctacatggaggatgaccgcatctgcagcccccccttcatggagctgaccagcctgtgtggagatgacaccatgaggctgctggagaagaatggcctgaccttccccttcatctgcaagaccagggtggcccacggcaccaacagccatgagatggccatcgtgttcaaccaggagggcctgaatgccatccagcccccctgtgtggtgcagaacttcatcaaccacaatgctgtgctgtacaaggtgtttgtggtgggggagagctacacagtggtgcagaggcccagcctgaagaacttctctgctggcaccagtgaccgggagagcatcttcttcaacagccacaacgtgtccaagccagagagcagctctgtgctgacagagctggacaagattgagggcgtgtttgagcggcccagtgatgaagtcatccgggagctgagccgggccctgcggcaggccctgggcgtgtccctgtttggcatcgacatcatcatcaacaaccagacaggccagcacgccgtcatcgacatcaatgccttccctggctatgagggcgtgtctgagttcttcacagacctgctgaaccacatcgccaccgtgctgcagggccagagcacagccatggccgccactggagatgtggccctgctgcggcacagcaagctgctggccgagcctgctgggggcctggtgggggagaggacctgcagcgccagccctggctgctgcggctccatgatgggccaggatgccccctggaaggccgaggctgatgctgggggcacagccaagctgccccaccagaggctgggctgcaatgccggcgtgagccccagcttccagcagcactgtgtggccagcctggccaccaaggccagcagccagtag

SEQ ID NO: 20673 - DNA, 864 bp, Artificial Sequence
  Description of Artificial Sequence: Synthetic coding sequence
atgtgtggcagaagaagacggcagagagctgccctgctgagccactgggaccccaccctgagcagtgactgggatggagagaggacagccccccagtgcctgctgcgcatcaagagggacatcatgagcatctacaaggagcccccacctggcatgtttgtggtgcctgacacagtggacatgaccaagatccacgccctgatcaccggcccctttgacaccccctatgagggcggcttcttcctgtttgtgttccgctgccccccagactaccccatccaccccccccgggtgaagctgatgaccactggaaacaacacagtgcgcttcaaccccaacttctacagaaatggcaaggtgtgcctgagcatcctgggcacctggacaggccctgcctggagccctgcccagagcatcagctctgtgctgatcagcatccagagcctgatgacagagaacccctaccacaatgaacctggctttgagcaggagcggcaccctggggacagcaagaactacaatgaatgcatcagacatgagaccatccgggtggccgtgtgtgacatgatggagggcaaatgtccctgcccagagcccctgcggggcgtgatggagaagagcttcctggagtactatgacttctatgaggtggcctgcaaggaccggctgcacctgcagggccagaccatgcaggacccctttggagagaagaggggccactttgactaccagagcctgctgatgaggctgggcctcatccggcagaaggtgctggagcggctgcacaatgaaaatgctgagatggacagcgacagcagcagcagcggcacagaaacagacctgcacggcagcctgcgggtgtag

SEQ ID NO: 20674 - DNA, 852 bp, Artificial Sequence
  Description of Artificial Sequence: Synthetic coding sequence
cctccctgcagcctcatcagtgactgctgtgccggcaaccagagggacagcgtgggcgtgggccccagcgagcccggctgctacccctgccccggccccaacatgaaccccatcgccctgggcagccgctggctggcctatgcagagaacaagctgatccgctgccaccagagccggggcggggcctgtggggacaacatccagagctacacagccaccgtcatctctgctgccaagaccctgaagagcggcctgaccatggtgggcaaggtggtgacccagctgaccggcaccctgcccagcggcgtgacagaagatgatgtggccatccacagcaacagcagaagaagccccctggtgcccggcatcatcaccgtgattgacacagaaacagtgggggagggccaggtgctggtgtctgaagattctgacagtgatggcatcgtggcccacttccctgcccacgagaagcctgtgtgctgcatggccttcaacaccagcggcatgctgctggtgaccacagacaccctgggccatgacttccacgtgttccagatcctgacccacccctggagcagcagccagtgtgctgtgcaccacctgtacaccctgcacagaggagaaacagaggccaaggtgcaggacatctgcttcagccatgactgccgctgggtggtggtgtccaccctgcggggcaccagccacgtgttccccatcaacccctacggcggccagccctgtgtgaggacccacatgagcccccgggtggtgaacaggatgagccgcttccagaagtctgctggcctggaggagattgagcaggagctgaccagcaagcagggcggccgctag

SEQ ID NO: 20675 - DNA, 2235 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcagagcgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagaaattggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcagagcgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccagcccttccctgcctaccccagcagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccagcagccccttccaggtgaccaccggctaccagctgcctgtgtacaactaccaggccttccctgcctaccccaacagcgctgtgcaggtgaccaccggctaccagttccacgtgtacaactaccagatgccaccccagtgccctgtgggggagcagaggaggaacctgtggacagaggcctacaagtggtggtacctggtgtgcctgatccagaggcgggactag

SEQ ID NO: 20676 - DNA, 1089 bp, Artificial Sequence; identical to SEQ ID NO: 18944
  Description of Artificial Sequence: Synthetic coding sequence

SEQ ID NO: 20677 - DNA, 2130 bp, Artificial Sequence
  Description of Artificial Sequence: Synthetic coding sequence
atggctgatgctggcatcagaagagtggtgcccagcgacctgtaccccctggtgctgggcttcctgcgggacaaccagctgtctgaggtggccaacaagtttgccaaggccaccggggccacccagcaggatgccaatgccagcagcctgctggacatctacagcttctggctgaagagcgccaaggtgcctgagaggaagctgcaggccaatggacctgtggccaagaaggccaagaagaaggccagcagcagtgacagcgaggacagcagcgaggaggaggaggaggtgcagggccccccagccaagaaggctgctgtgcctgccaagagggtgggcctgcccccaggcaaggccgccgccaaggccagcgagagcagcagcagcgaggagagcagtgatgatgatgatgaggaggaccagaagaagcagcctgtgcagaagggcgtgaagccccaggccaaggccgccaaggccccacccaagaaggccaagagcagtgacagcgacagcgacagcagcagtgaagatgagccccccaagaaccagaagcccaagatcacccctgtgacagtgaaggcccagaccaaggccccacccaagccagcccgggccgcccccaagatcgccaacgggaaggccgccagcagcagcagcagcagcagcagcagcagcagcagtgatgacagcgaggaggagaaggccgccgccacccccaagaaggtgtggaccatcacctctgtgcgggcagagaccgtgcccaagaagcaggtggtggccaaggcccctgtgaaggccgccaccacccccaccaggaagagcagcagcagcgaggacagcagcagtgatgaggaggaggagcagaagaagcccatgaagaacaagccaggcccctacagctctgtgcccccacccagcgcccccccacccaagaagagcctgggcacccagccccccaagaaggctgtggagaagcagcagcctgtggagagcagcgaggacagcagtgatgaaagtgacagcagcagcgaggaggagaagaagccacccaccaaggctgtggtgtccaaggccaccaccaagcccccaccagccaagaaggctgctgagagcagcagtgacagcagtgacagcgacagcagtgaagatgatgaggcccccagcaagccagctggcaccaccaagaacagcagcaacaagccagctgtgaccaccaagagccctgctgtgaagccagctgctgcccccaagcagcctgtgggcggcggccagaagctgctgaccaggaaggctgacagcagcagcagcgaggaggagagcagcagcagcgaggaggagaagaccaagaagatggtggccaccaccaagcccaaggccacagccaaggccgccctgagcctgcctgccaagcaggccccccagggcagccgggacagcagcagtgacagcgacagcagcagcagcgaggaggaggaggagaagaccagcaagtctgctgtgaagaagaagccccagaaggtggccggcggggccgcccccagcaagccagccagcgccaagaagggcaaggccgagagcagcaacagcagcagcagtgatgacagcagcgaggaggaggaggagaagctgaagggcaagggcagcccccggccccaggcccccaaggccaacggcaccagcgccctgacagcccagaatggcaaggccgccaagaacagcgaggaggaggaggaggagaagaagaaggctgctgtggtggtgtccaagagcggcagcctgaagaagaggaagcagaatgaagctgccaaggaggccgagaccccccaggccaagaagatcaagctgcagacccccaacaccttccccaagaggaagaagggggagaagagggccagcagccccttccggcgggtgcgggaggaggagattgaggtggacagccgggtggccgacaacagctttgatgccaagagaggagctgctggggactggggcgagcgggccaaccaggtgctgaagttcaccaagggcaagagcttcagacatgagaagaccaagaagaagaggggcagctaccggggcggcagcatctctgtgcaggtgaacagcatcaagtttgacagcgagtag

SEQ ID NO: 20678 - DNA, 558 bp, Artificial Sequence; identical to SEQ ID NO: 19671
  Description of Artificial Sequence: Synthetic coding sequence

SEQ ID NO: 20679 - DNA, 1764 bp, Artificial Sequence; identical to SEQ ID NO: 19443
  Description of Artificial Sequence: Synthetic coding sequence

SEQ ID NO: 20680 - DNA, 1098 bp, Artificial Sequence
  Description of Artificial Sequence: Synthetic coding sequence
atgaaggagctgtggtgtgtgatggactgggccgtgcccggcctgctgggcagcggcacctacttcaagaagcagttcagtgaccctgtggagcacggccagaggcacacagccaccaagcgggagctggccactggaaggaaggccatgcagaggctggccaagaagatgagcggctggttcctgcggaggaccaagaccctcatcaaggaccagctgcccaagaaggaggacaggatggtgtactgcagcctgacagacttccagaaggctgtgtaccagacagtgctggagacagaagatgtgaccctcatcctgcagagcagcgagccctgcacctgccgcagcggccagaagagaagaaactgctgctacaagaccaacagccacggggagaccgtgaagaccctgtacctgagctacctgactgtgctgcagaaggtggccaaccacgtggccctgctgcaggccgccagcaccagcaagcagcaggagaccctcatcaagaggatctgtgaccaggtgttcagccgcttcccagactttgtgcagaagagcaaggatgctgcctttgagaccctgagtgaccccaagtacagcggcaagatgaaggtgctgcagcagctgctgaaccactgcaggaagaacagagacaaggtgctgctcttctccttcagcaccaagctgctggatgtgctgcagcagtactgcatggccagcggcctggactacagaaggctggatggcagcaccaagtctgaggagcggctgaagatcgtgaaggagttcaacagcacccaggatgtgaacatctgcctggtgtccaccatggccggcggcctgggcctgaactttgtgggcgccaacgtggtggtgctgtttgaccccacctggaacccagccaatgacctgcaggccatcgacaggacccagacccactgcagaagagaaagagatgctgagcccctgagcagcgcccctggcctgcagaatggaagtgaaaatgctgtgccctacccctggtggtgctgcgtgactggagccagcatcagctgctggaggtgtgagatctgccgcatccaggatgtgctggagtag

SEQ ID NO: 20681 - DNA, 1104 bp, Artificial Sequence
  Description of Artificial Sequence: Synthetic coding sequence
atggagaagaagaagatggtgacccagggcaaccaggagcccaccaccaccccagatgccatggtgcagcccttcaccaccatccccttccccccaccaccccagaatggcatccccacagaatatggagtgccccacacccaggactatgccggccagacaggagagcacaacctgaccctgtatggcagcacccaggcccacggggagcagagcagcaacagccccagcacccagaatggcagcctgacccagacagagggcggggcccagacagatggccagcagagccagacccagagcagtgaaaattctgagagcaagagcacccccaagaggctgcacgtgagcaacatccccttccgcttccgggaccctgacctgcggcagatgtttggccagtttgggaagatcctggatgtggagatcatcttcaatgaaagaggcagcaaaggatttggatttgtgacctttgaaaattctgcagatgctgaccgggcccgggagaagctgcacggcaccgtggtggagggcaggaagattgaggtgaacaatgccacagcccgggtgatgaccaacaagaagatggtgaccccctatgccaacggctggaagctgagccctgtggtgggcgctgtgtatggccctgagctgtatgctgccagcagcttccaggctgatgtgtccctgggcaatgatgctgctgtgcccctgagcggccggggcggcatcaacacctacatccccctcatcatccctggcttcccctaccccacagctgccaccacagctgctgccttccggggggcccacctgcggggccggggccgcacagtgtatggagctgtgcgggctgtgcccccaacagccatcccagcctacccaggagtggacatgcagcccacagacatgcacagcctgctgctgcagccccagccccccctgctgcagcccctgcagcccctgactgtgacagtgatggccggctgcacccagcccacccccaccatgcccctgcccctgcccctggccatggagctggccctgtggagggtgtacacagaggtggccacagctgacctgcccccaacagaggtgacctag

SEQ ID NO: 20682 - DNA, 1764 bp, Artificial Sequence; identical to SEQ ID NO: 19443
  Description of Artificial Sequence: Synthetic coding sequence

SEQ ID NO: 20683 - DNA, 1143 bp, Artificial Sequence
  Description of Artificial Sequence: Synthetic coding sequence
atggatgctgccaccctgacctatgacaccctgcgctttgctgagtttgaggacttccctgagaccagcgagcctgtgtggatcctgggcaggaagtacagcatcttcacagagaaggatgagatcctgagtgatgtggccagccggctgtggttcacctacaggaagaacttccctgccatcggcggcaccggccccaccagtgacaccggctggggctgcatgctgcgctgtggccagatgatctttgcccaggccctggtgtgccgccacctgggccgggactggcgctggacccagaggaagaggcagcctgacagctacttctctgtgctgaatgccttcatcgacaggaaggacagctactacagcatccaccagatcgcccagatgggcgtgggggagggcaagagcatcggccagtggtacggccccaacacagtggcccaggtgctgaagaagctggccgtgtttgacacctggagcagcctggccgtgcacatcgccatggacaacacagtggtgatggaggagatccggcggctgtgcaggacctctgtgccctgtgccggggccacagccttccctgctgacagcgacagacactgcaatggcttccctgctggagctgaggtgaccaaccggcccagcccctggaggcccctggtgctgctgatccccctgcggctgggcctgacagacatcaatgaggcctacgtggagaccctgaagcactgcttcatgatgccccagagcctgggcgtcatcggcggcaagcccaacagcgcccactacttcatcggctacgtgggggaggagctgatctacctggacccccacaccacccagcctgctgtggagcccacagatggctgcttcatcccagatgagagcttccactgccagcaccccccctgcaggatgagcattgctgagctggaccccagcattgctgtgggcttcttctgcaagacagaagatgacttcaatgactggtgccagcaggtgaagaagctgagcctgctgggcggggccctgcccatgtttgagctggtggagctgcagcccagccacctggcctgcccagatgtgctgaacctgagcctgggggagagctgccaggtgcagatcctgctgatgtag

SEQ ID NO: 20684 - DNA, 2124 bp, Artificial Sequence
  Description of Artificial Sequence: Synthetic coding sequence
atgatccccccccaggaggccagcgccaggagaagagaaattgaggacaagctgaagcaggaggaggagaccctgtccttcatccgggacagcctggagaagagtgaccagctgaccaagaacatggtgtccatcctgagcagctttgagagccggctgatgaagctggagaacagcatcatccctgtgcacaagcagacagagaacctgcagaggctgcaggagaatgtggagaagaccctgagctgcctggaccacgtgatctcctactaccacgtggccagtgacacagagaagatcatccgggagggccccaccggccgcctggaggagtacctgggctccatggccaagatccagaaggctgtggagtacttccaggacaacagcccagacagccctgagctgaacaaggtgaagctgctgtttgagcggggcaaggaggccctggagagcgagttccgcagcctgatgaccaggcacagcaaggtggtgtcccctgtgctgatcctggacctgatctctggagatgatgacctggaggcccaggaggatgtgaccctggagcacctgcctgagagcgtgctgcaggacgtcatccgcatcagccgctggctggtggagtatggaagaaaccaggacttcatgaatgtgtactaccagatccgcagcagccagctggacaggagcatcaagggcctgaaggagcacttccacaagagcagcagcagcagtggagtgccctacagccctgccatccccaacaagaggaaggacacccccaccaagaagcctgtgaagaggcctggcaccatcaggaaggcccagaacctgctgaagcagtacagccagcacggcctggatggcaagaagggcggcagcaacctgatccccctggagggccacgagcatgacttccgggtgaagcacctgtctgaggccctgaatgacaagcacggccccctggccggcagagatgacatgctggatgtggagacagatgcctacatccactgtgtgtctgcctttgtgaagctggcccagagcgagtaccagctgctggccgacatcatccctgagcaccaccagaagaagacctttgacagcctcatccaggatgccctggatggcctgatgctggagggagaaaatattgtgtctgctgccaggaaggccatcgtgagacatgacttcagcacagtgctgactgtgttccccatcctgcggcacctgaagcagaccaagccagagtttgaccaggtgctgcagggcacagctgccagcaccaagaacaagctgcccggcctcatcacctccatggagaccatcggggccaaggccctggaggactttgctgacaacatcaagaatgaccctgacaaggagtacaacatgcccaaggatggcaccgtgcatgagctgaccagcaatgccatcctcttcctgcagcagctgctggacttccaggagacagctggggccatgctggccagccaggagaccagcagcagcgccaccagctacagcagcgagttcagcaagaggctgctgagcacctacatctgcaaggtgctgggcaacctgcagctgaacctgctgagcaagagcaaggtgtatgaggaccctgccctgagcgccatcttcctgcacaacaactacaactacatcctgaagagcctggagaagtctgagctgatccagctggtggccgtgacccagaagacagctgagaggagctaccgggagcacatcgagcagcagatccagacctaccagaggtcctggctgaaggtgacagactacatcgccgagaagaacctgcccgtcttccagcccggggtgaagctgcgggacaaggagcggcagatcatcaaggagcgcttcaagggcttcaatgatggcctggaggagctgtgcaagatccagaaggcctgggccatcccagacacagagcagagggaccgcatccggcaggcccagaagaccatcgtgaaggagacctacggggccttcctgcagaagtttggatctgtgcccttcaccaagaaccctgagaagtacatcaagtatggagtggagcaggtgggggacatgattgaccggctgtttgacaccagcgcctag

SEQ ID NO: 20685 - DNA, 1026 bp, Artificial Sequence; identical to SEQ ID NO: 19437
  Description of Artificial Sequence: Synthetic coding sequence

SEQ ID NO: 20686 - DNA, 1488 bp, Artificial Sequence
  Description of Artificial Sequence: Synthetic coding sequence
atggccggcgtgggccgcagcggcggcccctggggccgcacccggggcggccgcagcggccgcctgggcgtgtccctgggcgccctgagcagcctgcccctggaggagctgccccggcccctgtgctgccgccgctgcagaagacacttcggctttgccctgcggggggagaccatccctgtgtctgtggccggcagcgccagcagccagtttgcccccctggccctgcacctgagcctgctgctgagccgcatcagcgccagccggctgacccgctggcccccaccagacaagcgggagggcagcgctgtggaccccgggaagagaagaagcctggccgccacccccagcagcagcctgccctgcaccctgattgccctgggcctgcggcatgagaaggaggccaatgagctgatggaggacctgtttgagaccttccaggatgagatgggcttcagcaacatggaggatgatggccctgaggaggaggagcgggtggccgagccccaggccaacttcaacaccccccaggccctgcgctttgaggagctgctggccaacctgctgaatgagcagcaccagatcgccaaggagctgtttgagcagctgaagatgaagaagcccagcgccaagcagcagaaggaggtggagaaggtgaagccccagtgcaaggaggtgcaccagaccctcatcctggaccctgcccagaggaagaggctgcagcagcagatgcagcagcacgtgcagctgctgacccagatccacctgctggccacctgcaaccccaacctgaaccctgaggccagcagcacccgcatctgcctgaaggagctgggcacctttgcccagagcagcatcgccctgcaccaccagtacaaccccaagttccagaccctcttccagccctgcaacctgatgggcgccatgcagctgattgaggacttcagcacccacgtgtccattgactgcagcccccacaagacagtgaagaagacagccaatgagttcccctgcctgcccaagcaggtggcctggatcctggccaccagcaaggtgttcatgtacccagagctgctgcctgtgtgcagcctgaaggccaagaacccccaggacaagatcctcttcaccaaggccgaggacaacctgctggccctgggcctgaagcactttgagggcacagagttcctgaaccccctcatcagcaagtacctgctgacctgcaagacagcccggcagctgactgtgcgcatcaagaacctgaacatgaacagagccccagacaacatcatcaagttctacaagaagaccaagcagctgcctgtgctgggcaagtgctgtgaggagatccagccccaccagtggaagccacccatcgagcgggaggagcaccggctgcccttctggctgaaggtgcagcccagcagcagcaagtctgtgggcggccgccgcagcctgaaggtgctgcgggagtaccagggcctgccctag

SEQ ID NO: 20687 - DNA, 180 bp, Artificial Sequence
  Description of Artificial Sequence: Synthetic coding sequence
atggccgcccctggggccctgctggtgatgggcgtgtctggcagcggcaactgggatggcaacagcatgatgctgatgatcatcaccaggaggaagattgagggccgctgggagaaggcctaccgctccatgaccaggacaggcttccacggctctgtgacctgcatgaccttctactag

SEQ ID NO: 20688 - DNA, 207 bp, Artificial Sequence
  Description of Artificial Sequence: Synthetic coding sequence
atgggagaaacagagggcaagaaggatgaagctgactacaagaggctgcagaccttccccctggtgcgccacagcgacatgcctgaggagatgagggtggagaccatggagctgtgtgtgacagcctgtgagaagttcagcaacaacaatgaggtgctgcctgctgtgcaggccgccccccgggcctttgatggcccctgtggctag

SEQ ID NO: 20689 - DNA, 2451 bp, Artificial Sequence; identical to SEQ ID NO: 19768
  Description of Artificial Sequence: Synthetic coding sequence

SEQ ID NO: 20690 - DNA, 1119 bp, Artificial Sequence; identical to SEQ ID NO: 18969
  Description of Artificial Sequence: Synthetic coding sequence

SEQ ID NO: 20691 - DNA, 480 bp, Artificial Sequence
  Description of Artificial Sequence: Synthetic coding sequence
atgatccccccccaggaggccagcgccaggagaagagaaattgaggacaagctgaagcaggaggaggagaccctgtccttcatccgggacagcctggagaagagtgaccagctgaccaagaacatggtgtccatcctgagcagctttgagagccggctgatgaagctggagaacagcatcatccctgtgcacaagcagacagagaacctgcagaggctgcaggagaatgtggagaagaccctgagctgcctggaccacgtgatctcctactaccacgtggccagtgacacagagaagatcatccgggagggccccaccggccgcctggaggagtacctgggctccatggccaagatccagaaggctgtggagtacttccaggacaacagcccagacagccctgagctgaacaaggtggtgcggggcccccagaacaacgtgcgcagcctgggcatctctgtgtctgccctggtgtcctag

SEQ ID NO: 20692 - DNA, 243 bp, Artificial Sequence
  Description of Artificial Sequence: Synthetic coding sequence
atggccagcgaggagctgcagaaggacctggaggaggtgaaggtgctgctggagaaggccaccaggaagagggtgagagatgccctgacagctgagaagagcaagattgaaacagagatcaagaacaagatgcagcagaagagccagaagaaggccgagctgctggacaatgagaagccagctgctgtggtggcccccatcaccaccggctacacagatggcatcagccagatcagcctgtag

SEQ ID NO: 20693 - DNA, 606 bp, Artificial Sequence
  Description of Artificial Sequence: Synthetic coding sequence
atgcccagcgagaccctgtgggagatcgccaaggccgaggtggagaagaggggcatcaatggaagtgaaggagatggagctgagattgctgagaagtttgtgttcttcatcggcagcaagaatggaggcaagaccaccatcatcctgcgctgcctggacagagatgagccccccaagcccaccctggccctggagtacacctacggccggcgggccaagggccacaacacccccaaggacatcgcccacttctgggagctgggcggcggcaccagcctgctggacctgatcagcatccccatcaccggggacaccctgcggaccttcagcctggtgctggtgctggacctgagcaagcccaatgacctgtggcccaccatggagaacctgctgcaggccaccaagagccacgtggacaaggtgatcatgaagctgggcaagaccaatgccaaggctgtgtctgagatgaggcagaagatctggaacaacatgcccaaggaccaccctgtgtcctgctgcctgggcctgctgctggagagcctggtgcccttcatcgtgaatgacaacatcaccaacaacttcttccgcttcctgtgcatgacctag

SEQ ID NO: 20694 - DNA, 1401 bp, Artificial Sequence
  Description of Artificial Sequence: Synthetic coding sequence
atgagctacagacctgtggtgtcccctgtgatgagcctgacccggcgctgcatgaggagcaggacctccatgaggacagatgctgtgttcctgatcctgtacaaggagctgtactaccgccacatctatgccaaggtgtctgggggccccagcctggagcagagatttgagagctactacaactactgcaacctcttcaactacatcctgaatgctgatggccctgcccccctggagctgcccaaccagtggctgtgggacatcattgatgagttcatctaccagttccagagcttcagccagtaccgctgcaagacagccaagaagtctgaggaggagattgacttcctgcggagcaaccccaagatctggaatgtgcacagcgtgctgaatgtgctgcacagcctggtggacaagagcaacatcaaccggcagctggaggtgtacaccagcggcggggaccctgagagcgtggccggggagtatggccgccacagcctgtacaagatgctgggctacttcagcctggtgggcctgctgcggctgcacagcctgctgggggactactaccaggccatcaaggtgctggagaacatcgagctgaacaagaagtccatgtacagccgggtgcctgagtgccaggtgaccacctactactacgtgggctttgcctacctgatgatgaggcgctaccaggatgccatccgggtgtttgccaacatcctgctgtacatccagaggaccaagtccatgttccagaggaccacctacaagtatgagatgatcaacaagcagaatgagcagatgcacgccctgctggccatcgccctgaccatgtaccccatgagaattgatgagagcatccacctgcagctgcgggagaagtacggggacaagatgctgaggatgcagaagggggacccccaggtgtatgaggagctgttctcctacagctgccccaagttcctgagccctgtggtgcccaactatgacaacgtgcaccccaactaccacaaggagcccttcctgcagcagctgaaggtgttcagtgatgaggtgcagcagcaggcccagctgagcaccatccgctccttcctgaagctgtacaccaccatgcctgtggccaagctggccggcttcctggacctgacagagcaggagttccgcatccagctgctggtgttcaagcacaagatgaagaacctggtgtggaccagcggcatcagcgccctggatggagagttccagagcgccagcgaggtggacttctacatcgacaaggacatgatccacatcgctgacaccaaggtggccaggagatatggagacttcttcatccggcagatccacaagtttgaggagctgaacagaaccctgaagaagatgggccagaggccctag

SEQ ID NO: 20695 - DNA, 597 bp, Artificial Sequence
  Description of Artificial Sequence: Synthetic coding sequence
atgagcagagctgtgaccatcgccgaggccttctgccacatcctcttccgcatcatcagcgagatcctgatgaggatgctggaggagcagtgcctcttccccctgcctgagccccaggacctcttccaggccagccagatgaagtttgaggacttccagaaggacctgaggaagctgaagaaggacctgaaggcctgtgaggtggaggccggcaaggtgtaccaggtgagcagcaaggagcacatgcagcccttcaaggagaacatggagcagttcatcatccaggccaagattgaccaggaggccgaggagaacagcctgacagagacccacaagtgcttcctggagaccacagcctacttcttcatgaagcccaagctgggggagaaggaggtgagccccaatgccttcttcagcatctggcatgagttcagcagtgacttcaaggacttctggaagaaggagaacaagctgctgctgcaggagcgggtgaaggaggccgaggaggtgtgccggcagaagaagggcaagagcctgtacaagatcaagcccaggcatgacagcggcatcaaggccaagatctccatgaagacctag

SEQ ID NO: 20696 - DNA, 441 bp, Artificial Sequence
  Description of Artificial Sequence: Synthetic coding sequence
atggagcccacccgggactgccccctgtttggaggagccttcagcgccatcctgcccatgggcgccattgatgtgtctgacctgcggcctgtgcctgacaaccaggaggtgttctgccaccctgtgacagaccagagcctcatcgtggagctgctggagctgcaggcccacgtgcggggggaggccgccgcccgctaccactttgaagatgtgggcggcgtgcagggcgcccgggctgtgcacgtggagagcgtgcagcccctgagcctggagaacctggccctgcggggccgctgccaggaggcctgggtgctgagcggcaagcagcagatcgccaaggagaaccagcaggtggccaaggatgtgaccctgcaccaggccctgctgcggctgccccagtaccagacagacctgctgctgaccttcaaccagcccccatag

SEQ ID NO: 20697 - DNA, 1584 bp, Artificial Sequence
  Description of Artificial Sequence: Synthetic coding sequence
atgagcctgtgtggggcccgggccaatgccaagatgatggccgcctacaatggaggcaccagcgctgctgctgctggccaccaccaccaccaccaccaccacctgccccacctgcccccaccccacctgcaccaccaccaccacccccagcaccacctgcaccctggcagcgctgctgctgtgcaccctgtgcagcagcacaccagcagcgctgctgctgctgctgctgctgctgctgctgctgctgccatgctgaaccctggccagcagcagccctacttccccagccctgcccctggccaggcccctggccctgctgctgctgccccagcccaggtgcaggccgctgctgctgccaccgtgaaggcccaccaccaccagcacagccaccacccccagcagcagctggacatcgagccagaccggcccatcggctacggggcctttggagtggtgtggagcgtgacagaccccagagatggcaagagggtggccctgaagaagatgcccaacgtgttccagaacctggtgtcctgcaagagggtcttccgggagctgaagatgctgtgcttcttcaagcatgacaacgtgctgagcgccctggacatcctgcagcccccccacatcgactactttgaggagatctacgtggtgacagagctgatgcagagcgacctgcacaagatcatcgtgagcccccagcccctgagcagtgaccacgtgaaggtgttcctgtaccagatcctgcggggcctgaagtacctgcacagcgctggcatcctgcaccgggacatcaagccaggcaacctgctggtgaacagcaactgtgtgctgaagatctgtgactttggcctggcccgggtggaggagctggatgagagccgccacatgacccaggaggtggtgacccagtactaccgggcccctgagatcctgatgggcagccgccactacagcaatgccatcgacatctggagcgtgggctgcatctttgctgagctgctgggccgccgcatcctcttccaggcccagagccccatccagcagctggacctgatcacagacctgctgggcacccccagcctggaggccatgaggacagcctgtgagggcgccaaggcccacatcctgcggggcccccacaagcagcccagcctgcctgtgctgtacaccctgagcagccaggccacccatgaggccgtgcacctgctgtgcaggatgctggtgtttgaccccagcaagaggatcagcgccaaggatgccctggcccacccctacctggatgagggccgcctgcgctaccacacctgcatgtgcaagtgctgcttcagcaccagcacaggccgggtgtacaccagtgactttgagcctgtgaccaaccccaagtttgatgacacctttgagaagaacctgagctctgtgcggcaggtgaaggagatcatccaccagttcatcctggagcagcagaagggcaacagagtgcccctgtgcatcaacccccagagcgctgccttcaagagcttcatcagcagcacagtggcccagcccagcgagatgccacccagccccctggtgtgggagtag

SEQ ID NO: 20698 - DNA, 2742 bp, Artificial Sequence
  Description of Artificial Sequence: Synthetic coding sequence
atgaatgaggccatggccacagacagcccccggcggcccagccgctgcacaggaggagtggtggtgcggccccaggccgtgacagagcagagctacatggagagcgtggtgaccttcctgcaggatgtggtgccccaggcctacagcggcacccccctgacagaggagaaggagaagatcgtgtgggtgcgctttgaaaatgctgacctgaatgacaccagcaggaacctggagttccacgagatccacagcactggaaatgaaccacccctgctgatcatgattggctacagtgatggcatgcaggtgtggagcatccccatctctggagaggcccaggagctgttctctgtgcgccacggccccatccgggccgcccgcatcctgcctgccccccagtttggagcccagaagtgtgacaactttgctgagaagaggcccctgctgggcgtgtgcaagagcatcggcagcagcggcaccagccccccctactgctgcgtggacctgtacagcctgaggactggagagatggtgaagagcatccagttcaagacccccatctatgacctgcactgcaacaagaggatcctggtggtggtgctgcaggagaagattgctgcctttgacagctgcaccttcaccaagaagttctttgtgaccagctgctacccctgccccggccccaacatgaaccccatcgccctgggcagccgctggctggcctatgcagagaacaagctgatccgctgccaccagagcagaggaggagcctgtggggacaacatccagagctacacagccaccgtcatctctgctgccaagaccctgaagagcggcctgaccatggtgggcaaggtggtgacccagctgaccggcaccctgcccagcggcgtgacagaagatgatgtggccatccacagcaacagccgccgcagccccctggtgcccggcatcatcaccgtcatcgacacagagaccgtgggggagggccaggtgctggtgtctgaggacagcgacagtgatggcatcgtggcccacttccctgcccacgagaagcctgtgtgctgcatggccttcaacaccagcggcatgctgctggtgaccacagacaccctgggccatgacttccacgtgttccagatcctgacccacccctggagcagcagccagtgtgctgtgcaccacctgtacaccctgcacagaggagaaacagaggccaaggtgcaggacatctgcttcagccatgactgccgctgggtggtggtgtccaccctgcggggcaccagccacgtgttccccatcaacccctatggaggccagccctgtgtgaggacccacatgagcccccgggtggtgaacaggatgagccgcttccagaagtctgctggcctggaggagattgagcaggagctgaccagcaagcagggcggccgctgcagccctgtgcccggcctgagcagcagccccagcggcagccccctgcacggcaagctgaacagccaggacagctacaacaacttcaccaacaacaaccctggcaacccccggctgagccccctgcccagcctgatggtggtgatgcccctggcccagatcaagcagcccatgaccctgggcaccatcaccaagaggacaggcaaggtgaagcccccaccccagatcagccccagcaagtccatgggcggggagttctgtgtggccgccatcttcggcaccagccgctcctggtttgccaacaatgccggcctgaagcgggagaaggaccagagcaagcaggtggtggtggagagcctgtacatcatcagctgctacggcaccctggtggagcacatgatggagccccggcccctgagcacagcccccaagatcagtgatgacacccccctggagatgatgaccagcccccgggcctcctggaccctggtgaggaccccccagtggaatgagctgcagccccccttcaatgccaaccaccccctgctgctggccgcagatgctgtgcagtactaccagttcctgctggccggcctggtgcccccaggcagccctggccccatcaccaggcatggcagctatgacagcctggccagtgaccacagcggccaggaggatgaggagtggctgagccaggtggagatcgtgacccacacaggcccccaccggcggctgtggatgggcccccagttccagttcaagaccatccaccccagcggccagaccaccgtcatcagcagcagcagctctgtgctgcagagccacggccccagcgacaccccccagcccctgctggactttgacacagatgacctggacctgaacagcctgcgcatccagcctgtgcggagtgaccctgtgtccatgcctggcagcagcaggcctgtgtctgacagaagaggagtgtccacagtgattgatgctgccagcggcacctttgacagatctgtgaccctgctggaggtgtgtggctcctggccagagggcttcggcctgcggcacatgagctccatggagcacacagaggagggcctgcgggagcggctggctgatgccatggccgagagccccagcagagatgtggtgggcagcggcacagagctgcagcgggagggcagcattgagaccctgagcaacagcagcggcagcaccagcggcagcatccccaggaactttgatggctaccgcagccccctgcccaccaatgaaagccagcccctgagcctcttccccaccggcttcccctag

SEQ ID NO: 20699 - DNA, 2160 bp, Artificial Sequence; identical to SEQ ID NO: 18876
  Description of Artificial Sequence: Synthetic coding sequence

SEQ ID NO: 20700 - DNA, 324 bp, Artificial Sequence
  Description of Artificial Sequence: Synthetic coding sequence
atgtctgtgctgcggcccctggacaagctgcccggcctgaacacagccaccatcctgctggtgggcacagaagatgccctgctgcagcagctggccgacagcatgctgaaggaggactgtgccagcgagctgaaggtgcacctggccaagagcctgcccctgcccagctctgtgaaccggcccagaattgacctgattgtgtttgtggtgaacctgcacagcaagtacagcctgcagaacacagaggagagcctgcggcacgtggatgccagcttcttcctgggcaaggtgtgcttcctggccaccggcggcggccgcctgtag

SEQ ID NO: 20701 - DNA, 1599 bp, Artificial Sequence
  Description of Artificial Sequence: Synthetic coding sequence
atgtttgtgctgggcatccccctgtgcccagccctgtccttctctggaggagatgacagccagacccagctgtttgtgagcagcaaggatgtgatcaaggagattgaggactttgacagcctggaggccctgcggctggagggcaacacagtgggcgtggaggccgcccgggtgattgccaaggccctggagaagaagtctgagctgaagcgctgccactggagcgacatgttcaccggccgcctgaggacagagatccccccagccctgatcagcctgggggagggcctcatcacagctggggcccagctggtggagctggacctgagtgacaatgccttcggcccagatggagtgcagggctttgaggccctgctgaagagcagcgcctgcttcaccctgcaggagctgaagctgaacaactgtggcatgggcatcggcggcggcaaggtgattggcaccctggaggaggtgcacatgccccagaatggcatcaaccaccctggcatcacagccctggcccaggcctttgctgtgaaccccctgctgcgggtcatcaacctgaatgacaacaccttcacagagaagggagctgtggccatggccgagaccctgaagaccctgcggcaggtggaggtgatcaactttggagactgcctggtgcgcagcaaaggagctgtggccatcgcagatgccatccggggcggcctgcccaagctgaaggagctgaacctgtccttctgtgagatcaagagagatgctgccctggccgtggccgaggccatggctgacaaggccgagctggagaagctggacctgaatggaaacaccctgggggaggagggctgtgagcagctgcaggaggtgctggagggcttcaacatggccaaggtgctggccagcctgagtgatgatgaagatgaggaggaggaggaggagggggaggaggaggaggaggaggccgaggaggaggaggaggaggatgaggaggaggaggaggaggaggaggaggaggaggaggaggagccccagcagaggggccagggcgagaagagcgccacccccagcaggaagatcctggaccccaacacaggagagcccgcccctgtgctgagcagccccccaccagcagatgtgtccaccttcctggccttccccagccctgagaagctgctgcggctgggccccaagagctctgtgctgattgcccagcagacagacaccagtgaccctgagaaggtggtgtctgccttcctgaaggtgtcctctgtgttcaaggatgaggccaccgtgaggatggctgtgcaggatgctgtggatgccctgatgcagaaggccttcaacagcagcagcttcaacagcaacaccttcctgacccggctgctggtgcacatgggcctgctgaagtctgaggacaaggtgaaggccatcgccaacctgtatggccccctgatggccctgaaccacatggtgcagcaggactacttccccaaggccctggcccccctgctgctggcctttgtgaccaagcccaacagcgccctggagagctgcagctttgcccggcacagcctgctgcagaccctgtacaaggtgtag

SEQ ID NO: 20702 - DNA, 1383 bp, Artificial Sequence; identical to SEQ ID NO: 19538
  Description of Artificial Sequence: Synthetic coding sequence

SEQ ID NO: 20703 - DNA, 567 bp, Artificial Sequence; identical to SEQ ID NO: 19160
  Description of Artificial Sequence: Synthetic coding sequence

SEQ ID NO: 20704 - DNA, 1596 bp, Artificial Sequence
  Description of Artificial Sequence: Synthetic coding sequence
atgaacaagaccaaccaggtgtatgctgccaatgaagaccacaacagccagttcattgatgactacagcagcagtgatgagagcctgtctgtgagccacttctccttcagcaagcagagccaccggcccaggaccatccgggacaggaccagcttcagcagcaagctgcccagccacaacaagaagaacagcaccttcatccccaggaagcccatgaagtgcagcaatgagaaggtggtgaaccaggagcagagctatgagagcatggacaagttcctggatggagtgcaggaggtggcctacatccacagcaaccagaatgtgattggcagcagcaaggccgagaaccacatgagccgctgggccgcccatgatgtgtttgagctgaagcagttcagccagctgcctgccaacattgctgtgtgcagcagcaagacctacaaggagaaggtggatgctgacaccctgccccacaccaagaagggccagcagcccagcgagggcagcatcagcctgcccctgtacatcagcaaccctgtgaaccagaagaagaagaaggtgtaccacaccaaccagaccaccttcatcattggagagacccccaagggcatccggaggaagcagtttgaggagatggccagctacttcaacagcagctctgtgaatgaatttgccaagcacatcaccaatgccaccagcgaggagcggcagaagatgctgcgggacttctacgccagccagtacccagaggtgaaggagttctttgtggacagcgtgtcccagttcaacaacagcagctttgagaagggggagcagaggaccaggaagaagagtgacaagcgggagagcctcatcaagccccggctgagtgacagcgagaccctgtccttcaaggacagcaccaacaagatcagccaggtgtgcagcctgaagacctacaagaggaagtctgtgaagttccagaaccacatctcctaccgggaggaggtgttcttcaatgatgctgagaccaagaagagccctgtgagcagcacccaggagattgacagcggcaagaacagccaggccagcgaggacacagtgaccagccgcagcctgaacagcgagagcgagacccgggagcggcggctggagaacaccatgaaggaccagcaggacctgaccaggacaggcatcagcaggaaggagcccctgctgaagctggagaacaagaagattgaaaatcctgtgctggagaacaccagcgtcatcagcctgctgggggacaccagcatcctggatgacctcttcaagagccacggcaacagccccacccagctgcccaagaaggtgctgagcggccccatggagaaggccaagcagaggcccaaggacttctgggacatcctgaatgagcagaatgatgagagcctgagcaagctgacagacctggccgtcatcgagaccctgtgtgagaaggcccccctggccgcccccttcaagagaagagaggagcccgccaccagcctgtggaagagcaatgagaagttcctgtggaagaagttcagccccagcgacacagatgaaaatgccaccaacacccagagcaccacctag

SEQ ID NO: 20705 - DNA, 1089 bp, Artificial Sequence
  Description of Artificial Sequence: Synthetic coding sequence
atgacaggccacaccaggagcagcctgccccgctgcacaggaattgtgctgctgatcaagctgcgcttcagcgagcggctgaccggccacctgcacgcccagggcaccccaccctacgtgatcaacctggaccctgctgtgcatgaggtgcccttccctgccaacatcgacatccgggacacagtgaagtacaaggaggtgatgaagcagtatggcctgggccccaacggcggcatcgtgaccagcctgaacctgtttgccaccaggtttgaccaggtgatgaagttcatcgagaaggcccagaacatgagcaaatatgtgctgattgacaccccaggccagatcgaggtgttcacctggagcgccagcggcaccatcatcacagaggccctggccagcagcttccccaccgtggtgatctacgtgatggacaccagccgcagcaccaaccctgtgaccttcatgagcaacatgctgtatgcctgcagcatcctgtacaagaccaagctgcccttcatcgtggtgatgaacaagacagacatcatcgaccacagctttgctgtggagtggatgcaggactttgaggccttccaggatgccctgaaccaggagaccacctacgtgagcaacctgaccaggtccatgagcctggtgctggatgagttctacagcagcctgcgggtggtgggcgtgtctgctgtgctgggcaccggcctggatgagctgtttgtgcaggtgaccagcgctgctgaggagtatgagcgggagtacagaccagaatatgagcggctgaagaagagcctggccaatgctgagagccagcagcagcgggagcagctggagcggctgaggaaggacatgggctctgtggccctggatgctggaacagccaaggacagcctgagccctgtgctgcaccccagcgacctgatcctgacccggggcaccctggatgaggaggatgaggaggccgacagcgacacagatgacatcgaccaccgggtgacagaggagagccatgaggagcccgccttccagaacttcatgcaggagagcatggcccagtactggaagaggaacaacaagtag

SEQ ID NO: 20706 - DNA, 1338 bp, Artificial Sequence; identical to SEQ ID NO: 19215
  Description of Artificial Sequence: Synthetic coding sequence

SEQ ID NO: 20707 - DNA, 405 bp, Artificial Sequence
  Description of Artificial Sequence: Synthetic coding sequence
atgtctgaaaatgctgcccctggcctcatcagcgagctgctgctgcagaggggcaccaccaaggtggccaccggcctggtgctgaacagagaccagaggctggcctgggccgagaacagcattgacttcatcagccgggagctgtgtgcccacagcatcaggaagctgcaggcccacgtgctgctgatcaaggctgtgcacggctactttgacagccggcagaactacagcgagaaggagagcctgtccttcatgattgacaccatgaagagcaccctgaaggagcagttccagtttgtggaggtgcccggcaaccactgtgtgcacatgtctgagccccagcacgtggccagcatcatcagcagcttcctgcagtgcacccacatgctgcctgcccagctgtag

SEQ ID NO: 20708 - DNA, 321 bp, Artificial Sequence
  Description of Artificial Sequence: Synthetic coding sequence
atgagcagcaagggcagcagcacagatggccgcacagacctggccaacggcagcctgagcagcagccctgaggagatgtctggagctgaggagggccgggagaccagcagcggcatcgaggtggaggccagtgacctgagcctgagcctgactggagatgatggcggccccaacagaaccagcacagagagccggggcacagacacagagagcagcggggaggacaaggacagcgacagcatggaggacaccggccactacagcatcaatgatgagaacagagtgcatgacagaagtgaggaggaggaggaggaggagtag

SEQ ID NO: 20709 - DNA, 990 bp, Artificial Sequence; identical to SEQ ID NO: 18844
  Description of Artificial Sequence: Synthetic coding sequence

SEQ ID NO: 20710 - DNA, 2235 bp, Artificial Sequence
  Description of Artificial Sequence: Synthetic coding sequence
atggccacagccaactttgggaagatccagatcggcatctacgtggagatcaagagaagtgatggccgcatccaccaggccatggtgaccagcctgaatgaagataatgaatctgtgacagtggagtggattgaaaatggagacaccaagggcaaggagattgacctggagagcatcttcagcctgaacccagacctggtgcctgatgaggagattgagcccagccctgagaccccacctcctccagccagcagcgccaaggtgaacaagatcgtgaagaacagaagaacagtggccagcatcaagaatgacccccccagccgggacaacagagtggtgggcagcgcccgggcccggcccagccagtttcctgagcagagcagcagcgcccagcagaatggatctgtgtctgacatcagccctgtgcaggccgccaagaaggagtttggaccacccagcaggaggaagagcaactgtgtgaaggaggtggagaagctgcaggagaagcgggagaagaggcggctgcagcagcaggagctgcgggagaagagggcccaggatgtggatgccaccaaccccaactatgagatcatgtgcatgatccgggacttccggggcagcctggactaccggcccctgaccacagctgaccccattgatgagcaccgcatctgtgtgtgtgtgaggaagaggcccctgaacaagaaggagacccagatgaaggacctggatgtgatcaccatccccagcaaggatgtggtgatggtgcatgagcccaagcagaaggtggacctgacccgctacctggagaaccagaccttccgctttgattatgcctttgatgattctgccccaaatgagatggtgtaccgcttcaccgcccggcccctggtggagaccatctttgagcggggcatggccacctgctttgcctacggccagacaggcagcggcaagacccacaccatgggcggggacttcagcggcaagaaccaggactgcagcaagggcatctatgccctggccgccagagatgtgttcctgatgctgaagaagcccaactacaagaagctggagctgcaggtgtatgccaccttctttgagatctacagcggcaaggtgtttgacctgctgaacaggaagaccaagctgcgggtgctggaggatggcaagcagcaggtgcaggtggtgggcctgcaggagcgggaggtgaagtgtgtggaggatgtgctgaagctgattgacatcggcaacagctgcaggaccagcggccagaccagcgccaatgcccacagcagccgcagccatgctgtgttccagatcatcctgcggaggaagggcaagctgcacggcaagttcagcctgattgacctggccggaaatgaaagaggagctgacaccagcagcgctgaccggcagacccggctggagggcgctgagatcaacaagagcctgctggccctgaaggagtgcatccgggccctgggcaggaacaagccccacacccccttccgggccagcaagctgacccaggtgctgcgggacagcttcatcggggagaacagcaggacctgcatgattgccaccatcagccctggcatggccagctgtgagaacaccctgaacaccctgcgctatgccaacagagtgaaggagtttggcatcagccccagcgacatccccttcagccagggcagcggcagcaggccagacctgagccccagctatgaatatgatgacttcagccccagcgtgaccagggtgaaggagctgactgtggaccccacagctgctggagatgtgcggcccatcatgcaccacccccccaaccagattgatgacctggagacccagtggggcgtgggcagcagcccccagagagatgacctgaagctgctgtgtgagcagaatgaggaggaggtgagcccccagctgttcaccttccatgaagctgtgtcccagatggtggagatggaggagcaggtggtggaggaccacagagctgtgttccaggagagcatccgctggctggaggatgagaaggccctgctggagatgacagaggaggtggactatgatgtggacagctatgccacccagctggaggccatcctggagcagaagattgacatcctgacagagctgcgggacaaggtgaagagcttccgggccgccctgcaggaggaggagcaggccagcaagcagatcaaccccaagaggccccgggccctgtag

SEQ ID NO: 20711 - DNA, 1701 bp, Artificial Sequence; identical to SEQ ID NO: 18478
  Description of Artificial Sequence: Synthetic coding sequence

SEQ ID NO: 20712 - DNA, 798 bp, Artificial Sequence; identical to SEQ ID NO: 18432
  Description of Artificial Sequence: Synthetic coding sequence

SEQ ID NO: 20713 - DNA, 2808 bp, Artificial Sequence
  Description of Artificial Sequence: Synthetic coding sequence
atgaatgaggccatggccacagacagcccccggcggcccagccgctgcacaggaggagtggtggtgcggccccaggccgtgacagagcagagctacatggagagcgtggtgaccttcctgcaggatgtggtgccccaggcctacagcggcacccccctgacagaggagaaggagaagatcgtgtgggtgcgctttgaaaatgctgacctgaatgacaccagcaggaacctggagttccacgagatccacagcactggaaatgaaccacccctgctgatcatgattggctacagtgatggcatgcaggtgtggagcatccccatctctggagaggcccaggagctgttctctgtgcgccacggccccatccgggccgcccgcatcctgcctgccccccagtttggagcccagaagtgtgacaactttgctgagaagaggcccctgctgggcgtgtgcaagagcatcggcagcagcggcaccagccccccctactgctgcgtggacctgtacagcctgaggactggagagatggtgaagagcatccagttcaagacccccatctatgacctgcactgcaacaagaggatcctggtggtggtgctgcaggagaagattgctgcctttgacagctgcaccttcaccaagaagttctttgtgaccagctgctacccctgccccggccccaacatgaaccccatcgccctgggcagccgctggctggcctatgcagagaacaagctgatccgctgccaccagagcagaggaggagcctgtggggacaacatccagagctacacagccaccgtcatctctgctgccaagaccctgaagagcggcctgaccatggtgggcaaggtggtgacccagctgaccggcaccctgcccagcggcgtgacagaagatgatgtggccatccacagcaacagccgccgcagccccctggtgcccggcatcatcaccgtcatcgacacagagaccgtgggggagggccaggtgctggtgtctgaggacagcgacagtgatggcatcgtggcccacttccctgcccacgagaagcctgtgtgctgcatggccttcaacaccagcggcatgctgctggtgaccacagacaccctgggccatgacttccacgtgttccagatcctgacccacccctggagcagcagccagtgtgctgtgcaccacctgtacaccctgcacagaggagaaacagaggccaaggtgcaggacatctgcttcagccatgactgccgctgggtggtggtgtccaccctgcggggcaccagccacgtgttccccatcaacccctatggaggccagccctgtgtgaggacccacatgagcccccgggtggtgaacaggatgagccgcttccagaagtctgctggcctggaggagattgagcaggagctgaccagcaagcagggcggccgctgcagccctgtgcccggcctgagcagcagccccagcggcagccccctgcacggcaagctgaacagccaggacagctacaacaacttcaccaacaacaaccctggcaacccccggctgagccccctgcccagcctgatggtggtgatgcccctggcccagatcaagcagcccatgaccctgggcaccatcaccaagaggacaggcaaggtgaagcccccaccccagatcagccccagcaagtccatgggcggggagttctgtgtggccgccatcttcggcaccagccgctcctggtttgccaacaatgccggcctgaagcgggagaaggaccagagcaagcaggtggtggtggagagcctgtacatcatcagctgctacggcaccctggtggagcacatgatggagccccggcccctgagcacagcccccaagatcagtgatgacacccccctggagatgatgaccagcccccgggcctcctggaccctggtgaggaccccccagtggaatgagctgcagccccccttcaatgccaaccaccccctgctgctggccgcagatgctgtgcagtactaccagttcctgctggccggcctggtgcccccaggcagccctggccccatcaccaggcatggcagctatgacagcctggccagtgaccacagcggccaggaggatgaggagtggctgagccaggtggagatcgtgacccacacaggcccccaccggcggctgtggatgggcccccagttccagttcaagaccatccaccccagcggccagaccaccgtcatcagcagcagcagctctgtgctgcagagccacggccccagcgacaccccccagcccctgctggactttgacacagatgacctggacctgaacagcctgcgcatccagcctgtgcggagtgaccctgtgtccatgcctggcagcagcaggcctgtgtctgacagaagaggagtgtccacagtgattgatgctgccagcggcacctttgacagatctgtgaccctgctggaggtgtgtggctcctggccagagggcttcggcctgcggcacatgagctccatggagcacacagaggagggcctgcgggagcggctggctgatgccatggccgagagccccagcagagatgtggtgggcagcggcacagacacagccctggatgtggccgtgaagaccttccccccagagcggcacgtggccgtgaagtgctttgagctgcagcgggagggcagcattgagaccctgagcaacagcagcggcagcaccagcggcagcatccccaggaactttgatggctaccgcagccccctgcccaccaatgaaagccagcccctgagcctcttccccaccggcttcccctag

SEQ ID NO: 20714 - DNA, 615 bp, Artificial Sequence
  Description of Artificial Sequence: Synthetic coding sequence
atggaggccgccggcagccctgctgccacagagaccgggaagtacatcgccagcacccagaggccagatggcacctggaggaagcagaggagagtgaaggagggctacgtgccccaggaggaggtgcctgtgtatgagaacaagtatgtgaagttcttcaagagcaagccagagctgcccccaggcctgagccctgaggccacagcccctgtgacccccagcaggcctgagggcggggagcccggcctgagcaagacagccaagaggaacctgaagaggaaggagaagaggcggcagcagcaggagaagggggaggccgaggccctgagcaggaccctggacaaggtgtccctggaggagacagcccagctgcccagcgccccccagggcagcagagctgcccccacagctgccagtgaccagcctgacagcgctgccaccacagagaaggccaagaagatcaagaacctgaagaagaagctgcggcaggtggaggagctgcagcagaggatccaggccggggaggtgtcccagcccagcaaggagcagctggagaagctggcccggcggcgggccctggaggaggagctggaggacctggagctgggcctgtag

SEQ ID NO: 20715 - DNA, 663 bp, Artificial Sequence
  Description of Artificial Sequence: Synthetic coding sequence
atgagcagcggcaactaccagcagagcgaggccctgagcaagcccaccttcagcgaggagcaggccagcgccctggtggagagcgtgtttggcctgaaggtgtccaaggtgcggcccctgcccagctatgatgaccagaacttccacgtgtatgtgtccaagaccaaggatggccccacagaatatgtgctgaagatcagcaacaccaaggccagcaagaacccagacctgattgaggtgcagaaccacatcatcatgttcctgaaggctgctggcttccccacagcctctgtgtgccacaccaagggggacaacacagccagcctggtgtctgtggacagcggcagcgagatcaagagctacctggtgcggctgctgacctacctgcccggccggcccatcgccgagctgcctgtgagcccccagctgctgtatgaaattggcaagctggccgccaagctggacaagaccctgcagcgcttccaccaccccaagctgagcagcctgcaccgggagaacttcatctggaacctgaagaatgtgcccctgctggagaagtacctgtatgccctgggccagaacagaaaccgggagatcgtggagcacgtgatccacctgttcaaggaggaggtgatgaccaagctgagccacttccgggagtag

SEQ ID NO: 20716 - DNA, 603 bp, Artificial Sequence
  Description of Artificial Sequence: Synthetic coding sequence
atgagcagtgacagcatggaccagcccaggaacccctgtgaaaatgagcccctgaccccaggctaccacggcttccctgcccgggacagccagggcaaccaggagcccaccaccaccccagatgccatggtgcagcccttcaccaccatccccttccccccaccaccccagaatggcatccccacagaatatggagtgccccacacccaggactatgccggccagacaggagagcacaacctgaccctgtatggcagcacccaggcccacggggagcagagcagcaacagccccagcacccagaatggcagcctgacccagacagagggcggggcccagacagatggccagcagagccagacccagagcagtgaaaattctgagagcaagagcacccccaagaggctgcacgtgagcaacatccccttccgcttccgggaccctgacctgcggcagatgtttggccagtttgggaagatcctggatgtggagatcatcttcaatgaaagaggcagcaaaggatttggatttgtgacctttgaaaattctgcagatgctgaccgggcccgggagaagctgcacggcaccgtggtggagggctag

SEQ ID NO: 20717 - DNA, 387 bp, Artificial Sequence
  Description of Artificial Sequence: Synthetic coding sequence
atggccccagccaagaagggcggggagaagaagaagggccgcagcgccatcaatgaggtggtgacccgggagtacaccatcaacatccacaagaggatccacggcgtgggcttcaagaagagggccccccgggccctgaaggagatcaggaagtttgccatgaaggagatgggcaccccagatgtgagaattgacacccggctgaacaaggctgtgtgggccaagggcatcagaaatgtgccctaccgcatccgggtgcggctgagcaggaagagaaatgaagatgaggacagccccaacaagctgtacaccctggtgacctacgtgcctgtgaccaccttcaagatctctgtgctgaacagcgtgacagtggccaagagcccctag

SEQ ID NO: 20718 - DNA, 393 bp, Artificial Sequence
  Description of Artificial Sequence: Synthetic coding sequence
atggccccagccaagaagggcggggagaagaagaagggccgcagcgccatcaatgaggtggtgacccgggagtacaccatcaacatccacaagaggatccacggcgtgggcttcaagaagagggccccccgggccctgaaggagatcaggaagtttgccatgaaggagatgggcaccccagatgtgagaattgacacccggctgaacaaggctgtgtgggccaagggcatcagaaatgtgccctaccgcatccgggtgcggctgagcaggaagagaaatgaagatgaggacagccccaacaagctgtacaccctggtgacctacgtgcctgtgaccaccttcaagagcctgcagaatgatgacctcttcaagacagactgccaccaccagtag

SEQ ID NO: 20719 - DNA, 1524 bp, Artificial Sequence
  Description of Artificial Sequence: Synthetic coding sequence
atgtggctgaccagctaccccagccccaacttccctgtgtctgtgctgcagaatggagtgaagatgaccaatgaggcccccaagggcctgcgggccaacatcatccgcagctacctgatggaccccatcagtgaccctgagttcttcggcagctgcaagaagccagaggagttcaagaagctgctgtatggcctgtgcttcttccacgccctggtgcaggagaggaggaagtttggccccctgggctggaacatcccctatgagttcaatgaaacagacctgcgcatctctgtgcagcagctgcacatgttcctgaaccagtatgaggagctgccctatgaggccctgcgctacatgaccggggagtgcaactatggaggccgggtgacagatgactgggacaggaggaccctgcggagcatcctgaacaagttcttcaaccctgagctggtggagaacagcgactacaagtttgacagcagcggcatctactttgtgcccccatctggggaccacaagagctacatcgagtacaccaagaccctgcccctgaccccagcccctgagatcttcggcatgaatgccaatgctgacatcaccaaggaccagagcgagacccagctgctgtttgacaacatcctgctgacccagagccgctctgctggagctggggccaagagcagtgatgaggtggtgaatgaggtggccagtgacatcctgggcaagctgcccaacaactttgatattgaagctgccatgaggcgctaccccaccacctacacccagagcatgaacacagtgctggtgcaggagatgggccgcttcaacaagctgctgaagaccatccgggacagctgtgtgaacatccagaaggccatcaagggcctggccgtgatgagcacagacctggaggaggtggtgagcagcatcctgaatgtgaagatccctgagatgtggatgggcaagagctaccccagcctgaagcccctgggcagctatgtgaatgacttcctggcccggctgaagttcctgcagcagtggtatgaggtgggccccccacctgtgttctggctgagcggcttcttcttcacccaggccttcctgactggagcccagcagaactatgccaggaagtacaccatccccatcgacctgctgggctttgattatgaggtgatggaggacaaggagtacaagcaccccccagaagatggagtcttcatccacggcctcttcctggatggagcctcctggaacaggaagatcaagaagctggccgagagccaccccaagatcctgtatgacacagtgcctgtgatgtggctgaagccctgcaagagagctgacatccccaagaggcccagctatgtggcccccctgtacaagaccagcgagcggcggggcgtgctgagcaccaccggccacagcaccaactttgtgattgccatgaccctgcccagcgaccagcccaaggagcactggattggccggggcgtggccctgctgtgccagctgaacagctag

SEQ ID NO: 20720 - DNA, 1683 bp, Artificial Sequence
  Description of Artificial Sequence: Synthetic coding sequence
atggccgccagcgccaagaggaagcaggaggagaagcacctgaagatgctgcgggacatgacaggcctgccccacaacaggaagtgctttgactgtgaccagaggggccccacctacgtgaacatgacagtgggcagctttgtgtgcaccagctgcagcggcagcctgcggggcctgaaccccccccaccgggtgaagagcatctccatgaccaccttcacccagcaggagattgagttcctgcagaagcacggcaatgaggtgtgcaagcagatctggctgggcctgtttgatgacaggagcagcgccatcccagacttccgggacccccagaaggtgaaggagttcctgcaggagaagtatgagaagaagcgctggtacgtgcccccagagcaggccaaggtggtggcctctgtgcacgccagcatcagcggcagcagcgccagcagcaccagcagcaccccagaggtgaagcccctgaagagcctgctgggggacagcgcccccaccctgcacctgaacaagggcacccccagccagagccctgtggtgggccgcagccagggccagcagcaggagaagaagcagtttgacctgctgagtgacctgggcagtgacatctttgctgccccagccccccagagcacagccacagccaactttgccaactttgcccacttcaacagccatgctgcccagaacagcgccaatgctgactttgccaactttgatgccttcggccagagcagcggcagcagcaactttggaggcttccccacagccagccacagccccttccagccccagaccactggaggcagcgctgcctctgtgaatgccaactttgcccactttgacaacttccccaagagcagcagcgctgactttggcaccttcaacaccagccagagccaccagacagccagcgctgtgtccaaggtgtccaccaacaaggccggcctgcagacagctgacaagtatgctgccctggccaacctggacaacatcttctctgctggccagggcggggaccagggcagcggcttcggcaccaccgggaaggcccctgtgggctctgtggtgtctgtgcccagccagagcagcgccagcagtgacaagtatgctgccctggccgagctggacagcgtcttcagcagcgctgccaccagcagcaatgcctacaccagcaccagcaatgccagcagcaatgtgtttggaacagtgcctgtggtggccagcgcccagacccagcctgccagcagctctgtgcctgccccctttggagccacccccagcaccaacccctttgtggccgccgccggccccagcgtggccagcagcaccaaccccttccagaccaatgcccggggggccacagctgccacctttggaacagcctccatgtccatgcccaccggcttcggcaccccagccccctacagcctgcccaccagcttcagcggcagcttccagcagcctgccttccctgcccaggccgccttcccccagcagacagccttcagccagcagcccaacggctttgctgccttcggccagaccaagcctgtggtgaccccatttggccaggtggccgctgctggggtgagcagcaaccccttcatgaccggggcccccaccggccagttccccaccggcagcagcagcaccaaccccttcctgtag

SEQ ID NO: 20721 - DNA, 2403 bp, Artificial Sequence; identical to SEQ ID NO: 20015
  Description of Artificial Sequence: Synthetic coding sequence

SEQ ID NO: 20722 - DNA, 144 bp, Artificial Sequence
  Description of Artificial Sequence: Synthetic coding sequence
atggatgaccagcaggccctgaacagcatcatgcaggacctggccgtgctgcacaaggccagcaggcctgccctgagcctgcaggagaccaggaaggccaagagcagcagccccaagaagcagaatgatgtgcgggtgaagtag

SEQ ID NO: 20723 - DNA, 1272 bp, Artificial Sequence
  Description of Artificial Sequence: Synthetic coding sequence
atggtgtccttcatgaacaaccagaagcagcagaagcccaccctgagcggccagcgcttcaagaccaggaagagagatgagaaggagagatttgaccccacccagttccaggactgcatcatccagggcctgacagaaacaggaacagacctggaggccgtggccaagttcctggatgccagcggggccaagctggactaccgccgctatgcagagaccctgtttgacatcctggtggccggcggcatgctggcccctgggggcaccctggctgatgacatgatgaggacagatgtgtgtgtgtttgctgcccaggaggacctggagaccatgcaggcctttgcccaggtgttcaacaagctgatccgccgctacaagtacctggagaagggctttgaagatgaggtgaagaagctgctgctcttcctgaagggcttcagcgagagcgagaggaacaagctggccatgctgactggagtgctgctggccaacggcaccctgaatgccagcatcctgaacagcctgtacaatgaaaacctggtgaaggagggcgtgtctgctgcctttgctgtgaagctgttcaagtcctggatcaatgagaaggacatcaatgctgtggccgccagcctgaggaaggtgtccatggacaaccggctgatggagctgtttcctgccaacaagcagagcgtggagcacttcaccaagtacttcacagaggccggcctgaaggagctgtctgaatatgtgaggaaccagcagaccatcggggccaggaaggagctgcagaaggagctgcaggagcagatgagcagaggagaccccttcaaggacatcatcctgtatgtgaaggaggagatgaagaagaacaacatccctgagcctgtggtgattggaattgtgtggagctctgtgatgagcacagtggagtggaacaagaaggaggagctggtggccgagcaggccatcaagcacctgaagcagtacagccccctgctggccgccttcaccacccagggccagagcgagctgaccctgctgctgaagatccaggagtactgctatgacaacatccacttcatgaaggccttccagaagatcgtggtgctcttctacaaggccgaggtgctgtctgaggagcccatcctgaagtggtacaaggatgcccacgtggccaagggcaagtctgtgttcctggagcagatgaagaagtttgtggagtggctgaagaatgctgaggaggagagcgagagcgaggccgaggagggggactag

SEQ ID NO: 20724 - DNA, 1119 bp, Artificial Sequence; identical to SEQ ID NO: 18490
  Description of Artificial Sequence: Synthetic coding sequence

SEQ ID NO: 20725 - DNA, 912 bp, Artificial Sequence
  Description of Artificial Sequence: Synthetic coding sequence
atgatggatgtgtctggagtgggcttccccagcaaggtgccctggaagaagatgtctgctgaggagctggagaaccagtactgccccagccgctgggtggtgcggctgggcgctgaggaggccctgcggacctacagccagatcggcatcgaggccaccacccgggcccgggccaccaggaagagcctgctgcacgtgccctatggagatggagagggggagaaggtggacatctacttcccagatgagagcagcgaggccctgcccttcttcctgttcttccatggaggctactggcagagcggcagcaaggatgaaagtgccttcatggtgcaccccctgacagcccagggcgtggccgtggtgattgtggcctacggcatcgcccccaagggcaccctggaccacatggtggaccaggtgaccaggtctgtggcctttgtgcagaagcgctaccccagcaacaagggcatctacctgtgtggccacagcgctggggcccacctggccgccatgatgctgctggccgactggaccaagcatggagtgacccccaacctgcggggcttcttcctggtgtctggagtgtttgacctggagcccatcgtgtacaccagccagaatgtggccctgcagctgaccctggaggatgcccagaggaacagcccccagctgaaggtggcccaggcccagcctgtggaccccacctgccgggtgctggtggtggtgggccagtttgacagccctgagttccaccggcagagctgggagttctaccagaccctgtgccagggcgagtggaaggccagctttgaggagctgcatgatgtggaccactttgagatcgtggagaacctgacccagaaggacaacgtgctgacccagatcatcctgaagaccatcttccagtag

SEQ ID NO: 20726 - DNA, 684 bp, Artificial Sequence
  Description of Artificial Sequence: Synthetic coding sequence
atggccctgcatgacatggaggacttcacctttgatggcaccaagaggctgtctgtgaactacgtgaagggcatcctgcagcccacagacacctgtgacatctgggacaagatctggaacttccaggccaagccagatgacctgctgatcagcacctaccccaaggccggcaccacctggacccaggagatcgtggagctgatccagaatgaaggagatgtggagaagagcaagagggcccccacccaccagcgcttccccttcctggagatgaagatccccagcctgggctctgtgtgctggggctcctggcatgaacatgtgaagggctggtgggaggccaaggacaagcaccgcatcctgtacctgttctatgaggacatgaagaagaaccccaagcatgagatccagaagctggccgagttcatcggcaagaagctggatgacaaggtgctggacaagatcgtgcactacaccagctttgatgtgatgaagcagaaccccatggccaactacagcagcatcccagctgagatcatggaccacagcatcagccccttcatgaggaaaggagctgtgggggactggaagaagcacttcaccgtggcccagaatgaaagatttgatgaggactacaagaagaagatgacagacacccggctgaccttccacttccagttctag

SEQ ID NO: 20727 - DNA, 366 bp, Artificial Sequence
  Description of Artificial Sequence: Synthetic coding sequence
atggccccagccaagaagggcggggagaagaagaagggccgcagcgccatcaatgaggtggtgacccgggagtacaccatcaacatccacaagaggatccacggcgtgggcttcaagaagagggccccccgggccctgaaggagatcaggaagtttgccatgaaggagatgggcaccccagatgtgagaattgacacccggctgaacaaggctgtgtgggccaagggcatcagaaatgtgccctaccgcatccgggtgcggctgagcaggaagagaaatgaagatgaggacagccccaacaagctgtacaccctggtgacctacgtgcctgtgaccaccttcaagagcaagttcagcatcccctag

SEQ ID NO: 20728 - DNA, 267 bp, Artificial Sequence
  Description of Artificial Sequence: Synthetic coding sequence
ctgtccttccgggctgacagcgcccacgcctccatggtgaatgtgcccaagaccaggaggaccttctgcaagaagtgtgggaagcaccagccccacaaggtgacccagtacaagaagggcaaggacagcctgtatgcccagggcaagagaagatatgacaggaagcagagcggctatggaggccagaccaagcccatcttcaggaagaagctgcaccagaactgcatcgagcccaacctgcccccccgggcccagcagagcccctag

SEQ ID NO: 20729 - DNA, 582 bp, Artificial Sequence
  Description of Artificial Sequence: Synthetic coding sequence
atggacagcaccctggccgtgcagcagtacatccagcagaacatccgggctgactgcagcaacatcgacaagatcctggagcccccagagggccaggatgaaggagtgtggaagtatgagcacctgcggcagttctgcctggagctgaatggcctggccgtgaagctgcagagcgagtgccacccagacacctgcacccagatgacagccacagagcagtggatcttcctgtgtgccgcccacaagacccccaaggagtgcccagccatcgactacaccaggcacaccctggatggagctgcctgcctgctgaacagcaacaagtacttccccagccgggtgtccatcaaggagagctctgtggccaagctgggctctgtgtgccgccgcatctaccgcatcttcagccacgcctacttccaccaccggcagatctttgatgaatatgaaaatgagaccttcctgtgccaccgcttcaccaagtttgtgatgaagtacaacctgatgagcaaggacaacctgattgtgcccatcctggaggaggaggtgcagaacagcgtgtctggagagagcgaggcctag

SEQ ID NO: 20730 - DNA, 4137 bp, Artificial Sequence
  Description of Artificial Sequence: Synthetic coding sequence
atgagcctggagcgggagctgcggcagctgagcaaggccaaggccaaggcccagagagctggccagaggcgggaggaggccgccctgtgccaccagctgggggagctgctggccggccacggccgctatgcagaggccctggagcagcactggcaggagctgcagctgcgggagcgggcagatgaccccctgggctgtgctgtggcccacaggaagattggagagcggctggccgagatggaggactacccagctgccctgcagcaccagcaccagtacctggagctggcccacagcctgaggaaccacacagagctgcagagggcctgggccaccatcggccgcacccacctggacatctatgaccactgccagagcagagatgccctgctgcaggcccaggccgcctttgagaagagcctggccatcgtggatgaggagctggagggcaccctggcccagggcgagctgaatgagatgaggacccggctgtacctgaacctgggcctgacctttgagagcctgcagcagacagccctgtgcaatgactacttcaggaagagcatcttcctggccgagcagaaccacctgtatgaagatctcttccgggcccgctacaacctgggcaccatccactggagggctggccagcacagccaggccatgcgctgcctggagggcgcccgggagtgtgcccacaccatgaggaagcgcttcatggagagcgagtgctgcgtggtgattgcccaggtgctgcaggacctgggggacttcctggccgccaagagggccctgaagaaggcctaccgcctgggcagccagaagcctgtgcagagagctgccatctgccagaacctgcagcacgtgctggccgtggtgcggctgcagcagcagctggaggaggccgagggccgggacccccagggcgccatggtgatctgtgagcagctgggggacctcttcagcaaggccggggacttccccagggctgctgaggcctaccagaagcagctgcgctttgctgagctgctggacaggcctggagctgagcgggccatcatccacgtgtccctggccaccaccctgggggacatgaaggaccaccacggggctgtgcgccactatgaggaggagctgcggctgcggtctggaaatgtgctggaggaggccaagacctggctgaacatcgccctgagccgggaggaggccggagatgcctatgagctgctggccccctgcttccagaaggccctgagctgtgcccagcaggcccagaggccccagctgcagaggcaggtgctgcagcacctgcacacagtgcagctgcggctgcagccccaggaggcccctgagacagagacccggctgcgggagctgtctgtggctgaagatgaagatgaggaggaggaggccgaggaggccgccgccacagctgagagcgaggccctggaggccggggaggtggagctgtctgagggggaggatgacacagatggcctgaccccccagctggaggaggatgaggagctgcagggccacctgggccgcaggaagggcagcaagtggaacagaagaaatgacatgggagagaccctgctgcaccgggcctgcatcgagggccagctgcggcgggtgcaggacctggtgcggcagggccaccccctgaacccccgggactactgcggctggacccccctgcacgaggcctgcaactacggccacctggagatcgtgcgcttcctgctggaccacggggctgctgtggatgatcctgggggccagggctgtgagggcatcacccccctgcatgatgccctgaactgtggccactttgaggtggccgagctgctgctggagcggggggcctctgtgaccctgcggaccaggaagggcctgagccccctggagaccctgcagcagtgggtgaagctgtaccgccgggacctggacctggagacccggcagaaggcccgggccatggagatgctgctgcaggccgccgccagcggccaggacccccacagcagccaggccttccacacccccagcagcctgctgtttgatcctgagaccagcccccccctgagcccctgcccagagccccccagcaacagcacccggctgcctgaggccagccaggcccacgtgcgggtgtccccaggccaggccgccccagccatggcccggcccaggaggagcagacatggccctgccagcagcagcagcagcagtgaaggagaagattctgctggccctgcccggcccagccagaagaggccccgctgcagcgccacagcccagagggtggccgcctggaccccaggccctgccagcaaccgggaggccgccacagccagcaccagccgggccgcctaccaggccgccatccggggcgtgggcagcgcccagagccggctgggccctggccccccccggggccacagcaaggccctggccccccaggccgccctgatccctgaggaggagtgcctggccggggactggctggagctggacatgcccctgaccaggagccggcggccccggccccggggcactggagacaacagaagacccagcagcaccagcggcagtgacagcgaggagagccggccccgggcccgggccaagcaggtgcggctgacctgcatgcagagctgcagcgcccctgtgaatgccggccccagcagcctggccagcgagcccccaggcagccccagcaccccccgggtgtctgagcccagcggggacagcagcgctgctggccagcccctgggccctgcccctcctccacccatccgggtgcgggtgcaggtgcaggaccacctgttcctgatccctgtgccccacagcagtgacacccacagcgtggcctggctggccgagcaggccgcccagcgctactaccagacctgtggcctgctgccccggctgaccctgaggaaggagggcgccctgctggccccccaggacctgatcccagatgtgctgcagagcaatgatgaggtgctggccgaggtgacctcctgggacctgccccccctgacagaccgctaccgccgggcctgccagagcctgggccagggcgagcaccagcaggtgctgcaggccgtggagctgcagggcctgggcctgtccttcagcgcctgcagcctggccctggaccaggcccagctgacccccctgctgcgggccctgaagctgcacacagccctgcgggagctgcggctggccggcaaccggctgggggacaagtgtgtggccgagctggtggccgccctgggcaccatgcccagcctggccctgctggacctgagcagcaaccacctgggccctgagggcctgcggcagctggccatgggcctgcccggccaggccaccctgcagagcctggaggagctggacctgtccatgaaccccctgggagatggctgcggccagagcctggccagcctgctgcacgcctgccccctgctgagcaccctgcggctgcaggcctgtggcttcggccccagcttcttcctgagccaccagacagccctgggcagcgccttccaggatgctgagcacctgaagaccctgagcctgagctacaatgccctgggcgccccagccctggcccggaccctgcagagcctgcctgctggcaccctgctgcacctggagctgagctctgtggccgccggcaagggggacagcgacctgatggagcccgtcttccgctacctggccaaggagggctgtgccctggcccacctgaccctgagcgccaaccacctgggggacaaggctgtgcgggacctgtgccgctgcctgagcctgtgccccagcctcatcagcctggacctgagcgccaaccctgagatcagctgtgccagcctggaggagctgctgagcaccctgcagaagaggccccagggcctgtccttcctgggcctgagcggctgtgctgtgcagggccccctgggcctgggcctgtgggacaagattgctgcccagctgcgggagctgcagctgtgcagccggcggctgtgtgctgaagatagagatgccctgcggcagctgcagcccagccggcccggccctggagagtgcaccctggaccacggcagcaagctgttcttccggcggctgtag

SEQ ID NO: 20731 - DNA, 1218 bp, Artificial Sequence
  Description of Artificial Sequence: Synthetic coding sequence
atgaactaccagcagcagctggccaacagcgctgccatccgggcagagatccagagatttgagagcgtgcaccccaacatctacagcatctatgagctgctggagcgggtggaggagcctgtgctgcagaaccagatccgggagcacgtgattgccattgaagatgcctttgtgaacagccaggagtggaccctgagccgctctgtgcctgagctgaaggtgggcatcgtgggcaacctggccagcggcaagagcgccctggtgcaccgctacctgaccggcacctacgtgcaggaggagagccctgagggcggccgcttcaagaaggagatcgtggtggatggccagagctacctgctgctgatcagagatgagggcggccccccagaggcccagtttgccatgtgggtggatgctgtgatctttgtgttcagcctggaggatgagatctccttccagacagtgtaccactactacagcaggatggccaactacagaaacaccagcgagatccccctggtgctggtgggcacccaggatgccatcagcagcgccaacccccgggtgattgatgatgcccgggccaggaagctgagcaatgacctgaagcgctgcacctactatgagacctgtgccacctacggcctgaatgtggagagggtcttccaggatgtggcccagaagatcgtggccaccaggaagaagcagcagctgagcatcggcccctgcaagagcctgcccaacagccccagccacagctctgtgtgcagcgcccaggtgtctgctgtgcacatcagccagaccagcaatggaggcggcagcctgagtgactacagcagctctgtgcccagcacccccagcaccagccagaaggagctgagaattgatgtgcccccaacagccaacacccccacccctgtgaggaagcagagcaagagaagaagcaacctcttcaccagcaggaagggcagtgaccctgacaaggagaagaagggcctggagagcagagctgacagcatcggcagcggccgggccatccccatcaagcagggcctgcccttctttgtgctggccctgacagccagcacctacctgcggcctgctggggcccgggcccggcagagcagcccctggccaggcccccggggcggccagaccagcccccactgtgccgagggcccccagagcgcccagctgagcggggccatgatgaactag

SEQ ID NO: 20732 - DNA, 1245 bp, Artificial Sequence; identical to SEQ ID NO: 18327
  Description of Artificial Sequence: Synthetic coding sequence

SEQ ID NO: 20733 - DNA, 645 bp, Artificial Sequence
  Description of Artificial Sequence: Synthetic coding sequence
atgggccccctgcccaggacagtggagctgttctatgatgtgctgagcccctacagctggctgggctttgagatcctgtgccgctaccagaacatctggaacatcaacctgcagctgcggcccagcctcatcaccggcatcatgaaggacagcggcaacaagcccccaggcctgctgcccaggaagggcctgtacatggccaatgacctgaagctgctgcggcaccacctgcagatccccatccacttccccaaggacttcctgtctgtgatgctggagaagggcagcctgagcgccatgaggttcctgacagctgtgaacctggagcaccctgagatgctggagaaggccagccgggagctgtggatgagggtgtggagcagagctgctgagaaggccggcatgtctgctgagcaggcccagggcctgctggagaagatcgccacccccaaggtgaagaaccagctgaaggagaccacagaggccgcctgccgctacggggccttcggcctgcccatcaccgtggcccacgtggatggccagacccacatgctgtttggaagtgacaggatggagctgctggcccacctgctgggggagaagtggatgggccccatccccccagctgtgaatgcccggctgtag

SEQ ID NO: 20734 - DNA, 4206 bp, Artificial Sequence
  Description of Artificial Sequence: Synthetic coding sequence
atggctgacacagacctcttcatggagtgtgaggaggaggagctggagccctggcagaagatcagtgatgtgattgaggacagcgtggtggaggactacaacagcgtggacaagaccaccaccgtgtctgtgtcccagcagcctgtgtctgcccctgtgcccatcgccgcccacgcctctgtggccggccacctgagcaccagcaccaccgtgagcagcagcggggcccagaacagcgacagcaccaagaagaccctggtgaccctcatcgccaacaacaatgccggcaaccccctggtgcagcagggcggccagcccctcatcctgacccagaacccagcccctggcctgggcaccatggtgacccagcctgtgctgcggcctgtgcaggtgatgcagaatgccaaccacgtgaccagcagccctgtggccagccagcccatcttcatcaccacccagggcttccctgtgagaaatgtgcggcctgtgcagaatgccatgaaccaggtgggcatcgtgctgaatgtgcagcagggccagacagtgcggcccatcaccctggtgcctgcccctggcacccagtttgtgaagcccaccgtgggcgtgccccaggtgttcagccagatgacccctgtgcggcccggcagcaccatgcctgtgcggcccaccaccaacaccttcaccaccgtcatcccagccaccctgaccatccgcagcacagtgccccagagccagagccagcagaccaagagcacccccagcaccagcaccacccccacagccacccagcccaccagcctgggccagctggccgtgcagagccctggccagagcaaccagaccaccaaccccaagctggtgtccatcgccagctttgtgacagtgaagaggcctggggtgactggagagaacagcaatgaggtggccaagctggtgaacaccctgaacaccatccccagcctgggccagagccctggccctgtggtggtgagcaacaacagcagcgcccacggcagccagaggaccagcggccctgagagctccatgaaggtgaccagcagcatccctgtgtttgacctgcaggacggcggcaggaagatctgcccccgctgcaatgcccagttccgggtgacagaggccctgcggggccacatgtgctactgctgcccagagatggtggagtaccagaagaagggcaagagcctggacagcgagcccagcgtgcccagcgctgccaagccacccagccctgagaagacagcccctgtggccagcacccccagcagcacccccatcccagccctgagcccccccaccaaggtgcctgagcccaatgaaaatgtgggagatgctgtgcagaccaagctgatcatgctggtggatgacttctactacggcagagatggcggcaaggtggcccagctgaccaacttccccaaggtggccaccagcttccgctgcccccactgcaccaagaggctgaagaacaacatccgcttcatgaaccacatgaagcaccacgtggagctggaccagcagaatggagaggtggatggccacaccatctgccagcactgctaccggcagttcagcacccccttccagctgcagtgccacctggagaatgtgcacagcccctatgagagcaccaccaagtgcaagatctgtgagtgggcctttgagagcgagcccctcttcctgcagcacatgaaggacacccacaagccaggagagatgccctacgtgtgccaggtgtgccagtaccgcagcagcctgtacagcgaggtggatgtgcacttcaggatgattcatgaggacaccaggcacctgctgtgcccctactgcctgaaggtgttcaagaatggaaatgccttccagcagcactacatgaggcaccagaagagaaatgtgtaccactgcaacaagtgccgcctgcagttcctgtttgccaaggacaagattgagcacaagctgcagcaccacaagaccttcaggaagcccaagcagctggagggcctgaagccaggcaccaaggtgaccatccgggccagccggggccagcccaggacagtgcctgtgagcagcaatgacaccccaccttctgccctgcaggaggccgcccccctgaccagctccatggaccccctgcctgtgttcctgtacccacctgtgcagaggagcatccagaagagagctgtgaggaagatgtctgtgatgggccggcagacctgcctggagtgcagctttgagatcccagacttccccaaccacttccccacctacgtgcactgcagcctgtgccgctacagcacctgctgcagccgggcctatgccaaccacatgatcaacaaccacgtgcccaggaagagccccaagtacctggccctcttcaagaacagcgtgtctggcatcaagctggcctgcaccagctgcacctttgtgacctctgtgggagatgccatggccaagcacctggtgttcaaccccagccacaggagcagcagcatcctgccccggggcctgacctggatcgcccacagcagacatggccagacccgggacagagtgcatgacagaaatgtgaagaacatgtacccacctccttccttccccaccaacaaggccgccaccgtgaagtctgctggggccaccccagctgagcctgaggagctgctgacccccctggccccagccctgcccagccctgccagcacagccaccccaccacccacccccacccacccccaggccctggccctgccccccctggccacagaaggagcagaatgtctgaatgtggatgaccaggatgagggcagccctgtgacccaggagcctgagctggccagcggcggcggcggcagcggaggagtgggcaagaaggagcagctgtctgtgaagaagctgcgggtggtgctgtttgccctgtgctgcaacacagagcaggccgctgagcacttcaggaacccccagaggcgcatccgccgctggctgcggcgcttccaggccagccagggcgagaacctggagggcaagtacctgagctttgaggccgaggagaagctggccgagtgggtgctgacccagcgggagcagcagctgcctgtgaatgaggagaccctcttccagaaggccaccaagattggccgcagcctggagggcggcttcaagatctcctatgagtgggccgtgcgcttcatgctgcggcaccacctgacccctcatgccaggagagctgtggcccacaccctgcccaaggatgtggccgagaatgccggcctcttcatcgactttgtgcagaggcagatccacaaccaggacctgcccctgtccatgattgtggccattgatgagatcagcctcttcctggacacagaggtgctgagcagtgatgacagaaaagaaaatgccctgcagacagtgggcactggagagccctggtgtgatgtggtgctggccatcctggctgatggcaccgtgctgcccaccctggtgttctaccggggccagatggaccagcctgccaacatgccagacagcatcctgctggaggccaaggagagcggctacagtgatgatgagatcatggagctgtggagcaccagggtgtggcagaagcacacagcctgccagaggagcaagggcatgctggtgatggactgccacaggacccacctgtctgaggaggtgctggccatgctgagcgccagcagcaccctgcctgctgtggtgcctgctggctgcagcagcaagatccagcccctggatgtgtgcatcaagaggacagtgaagaacttcctgcacaagaagtggaaggagcaggcccgggagatggctgacacagcctgtgacagtgatgtgctgctgcagctggtgctggtgtggctgggggaggtgctgggcgtgattggagactgcccagagctggtgcagaggagcttcctggtggcctctgtgctgcccggcccagatggcaacatcaacagccccaccagaaatgctgacatgcaggaggagctgattgccagcctggaggagcagctgaagctgtctggagagcacagcgagagcagcaccccccggcccaggagcagccctgaggagaccatcgagcctgagagcctgcaccagctgtttgaaggagagagcgagacagagagcttctacggctttgaggaggccgacctggacctgatggagatctag

SEQ ID NO: 20735 - DNA, 1398 bp, Artificial Sequence; identical to SEQ ID NO: 18495
  Description of Artificial Sequence: Synthetic coding sequence

SEQ ID NO: 20736 - DNA, 3210 bp, Artificial Sequence
  Description of Artificial Sequence: Synthetic coding sequence
atgtacctgctggatggcagcggggagcccgccagccccccagcagatgccatgccccggggcaccccacccaggaagacagtgtaccgcatctctgtgaccatggtgaggaaggagcagctggccgcccctggcagcggcggccctgaccccaggcctgtgagaagacccaggcctgcccggagcccagatgcccctggccgcctggaggaggaggccgaggaggccgagggcgctgaggagcctgagggcccccggccccgggcctgggacttccgcaccttccgcaccaggagcacaggccagctggagctgggccgcctgcggccctgtgcccggggcctggagcctgctgacctggccggcagcgccccagctgaggaggagggccggggcagccctgccagcggcagcccagatgtggagggcgcccgggccgcccccctgcggcgcagcctgtccttccgccactggagcggccctgaggccccccagggccgcaccctgggcggcggcagaagacacagcagcagcggcagcctggcctgggccccctgtgatgaagctgctgctggcaccaccctggagcccgccacagccacccagcctgccagcgagaagaggaacaccctggatgtgggggaggtgctgagcaagaatgatgccctgagtgacctggagcgctgggagaggagcaagagcaagaacagaaccctggacaacagcgacctgcagaggctggagcgggcccgggctgctgctggggccggggccgccagcgagcaccggctgctgcgcttcttcagcggcatctttgccaggagagatggcggccctgggggcggccccagccccaggtctggggccagccggccccggggctacttcagcctgcggcgggccccagctgaggcccacagcagcagcgctgagagcattgatggcagccccaggagagatgcctttgtgaacagccaggagtggaccctgagccgctctgtgcctgagctgaaggtgggcatcgtgggcaacctggccagcggcaagagcgccctggtgcaccgctacctgaccggcacctacgtgcaggaggagagccctgagggcggccgcttcaagaaggagatcgtggtggatggccagagctacctgctgctgatcagagatgaaggaggccccccagaggcccagtttgccatgtgggtggatgctgtgatctttgtgttcagcctggaggatgagatctccttccagacagtgtaccactactacagcaggatggccaactacagaaacaccagcgagatccccctggtgctggtgggcacccaggatgccatcagcagcgccaacccccgggtgattgatgatgcccgggccaggaagctgagcaatgacctgaagcgctgcacctactatgagacctgtgccacctacggcctgaatgtggagagggtcttccaggatgtggcccagaagatcgtggccaccaggaagaagcagcagctgagcatcggcccctgcaagagcctgcccaacagccccagccacagctctgtgtgcagcgcccaggtgtctgctgtgcacatcagccagaccagcaatggaggcggcagcctgagtgactacagcagctctgtgcccagcacccccagcaccagccagaaggagctgagaattgatgtgcccccaacagccaacacccccacccctgtgaggaagcagagcaagaggaggagcaacctcttcaccagcaggaaaggaagtgaccctgacaaggagaagaagggcctggagagcagagctgacagcatcggcagcggccgggccatccccatcaagcagggcatgctgctgaagaggtctgggaagagcctgaacaaggagtggaagaagaagtatgtgaccctgtgtgacaacggggtgctgacctaccaccccagcctgcatgactacatgcagaatgtgcacggcaaggagattgacctgctgcggaccaccgtgaaggtgcctgggaagaggcctccccgggccaccagcgcctgtgcccccatcagcagccccaagaccaacggcctgagcaaggacatgagcagcctgcacatcagccccaacagcgacaccggcctgggggacagcgtgtgcagcagccccagcatcagcagcaccaccagccccaagctggaccccccacccagcccccacgccaacaggaagaagcacaggaggaagaagagcaccagcaacttcaaggcagatggcctgagcggcacagctgaggagcaggaggagaactttgagttcatcatcgtgtccctgaccggccagacctggcactttgaggccaccacctatgaggagagagatgcctgggtgcaggccatcgagagccagatcctggccagcctgcagagctgtgagagcagcaagaacaagagccggctgaccagccagagcgaggccatggccctgcagagcatccggaacatgaggggcaacagccactgtgtggactgtgagacccagaaccccaactgggccagcctgaacctgggcgccctgatgtgcatcgagtgcagcggcatccacaggaacctgggcacccacctgagccgggtgcgcagcctggacctggatgactggcctgtggagctgatcaaggtgatgagcagcattggaaatgagctggccaacagcgtgtgggaggagagcagccagggccgcaccaagcccagcgtggacagcacccgggaggagaaggagcgctggatccgggccaagtatgagcagaagctgttcctggcccccctgccctgcacagagctgagcctgggccagcacctgctgcgggccacagcagatgaggacctgaggacagccatcctgctgctggcccacggcagcagagatgaggtgaatgagacctgtggggagggagatggccgcacagccctgcacctggcctgcaggaaaggaaatgtggtgctggcccagctgctgatctggtatggagtggatgtgacagccagagatgcccacggcaacacagccctggcctatgcccggcaggccagcagccaggagtgcattgatgtgctgctgcagtatggctgcccagatgaaagatttgtgctgatggccacccccaacctgagcagaagaaacaacaacagaaacaacagcagcggccgggtgcccaccatcatctag

SEQ ID NO: 20737 - DNA, 1260 bp, Artificial Sequence
  Description of Artificial Sequence: Synthetic coding sequence
atgaacaaccagaagcagcagaagcccaccctgagcggccagcgcttcaagaccaggaagagagatgagaaggagagatttgaccccacccagttccaggactgcatcatccagggcctgacagaaacaggaacagacctggaggccgtggccaagttcctggatgccagcggggccaagctggactaccgccgctatgcagagaccctgtttgacatcctggtggccggcggcatgctggcccctgggggcaccctggctgatgacatgatgaggacagatgtgtgtgtgtttgctgcccaggaggacctggagaccatgcaggcctttgcccaggtgttcaacaagctgatccgccgctacaagtacctggagaagggctttgaagatgaggtgaagaagctgctgctcttcctgaagggcttcagcgagagcgagaggaacaagctggccatgctgactggagtgctgctggccaacggcaccctgaatgccagcatcctgaacagcctgtacaatgaaaacctggtgaaggagggcgtgtctgctgcctttgctgtgaagctgttcaagtcctggatcaatgagaaggacatcaatgctgtggccgccagcctgaggaaggtgtccatggacaaccggctgatggagctgtttcctgccaacaagcagagcgtggagcacttcaccaagtacttcacagaggccggcctgaaggagctgtctgaatatgtgaggaaccagcagaccatcggggccaggaaggagctgcagaaggagctgcaggagcagatgagcagaggagaccccttcaaggacatcatcctgtatgtgaaggaggagatgaagaagaacaacatccctgagcctgtggtgattggaattgtgtggagctctgtgatgagcacagtggagtggaacaagaaggaggagctggtggccgagcaggccatcaagcacctgaagcagtacagccccctgctggccgccttcaccacccagggccagagcgagctgaccctgctgctgaagatccaggagtactgctatgacaacatccacttcatgaaggccttccagaagatcgtggtgctcttctacaaggccgaggtgctgtctgaggagcccatcctgaagtggtacaaggatgcccacgtggccaagggcaagtctgtgttcctggagcagatgaagaagtttgtggagtggctgaagaatgctgaggaggagagcgagagcgaggccgaggagggggactag

SEQ ID NO: 20738 - DNA, 2769 bp, Artificial Sequence; identical to SEQ ID NO: 19914
  Description of Artificial Sequence: Synthetic coding sequence

SEQ ID NO: 20739 - DNA, 363 bp, Artificial Sequence
  Description of Artificial Sequence: Synthetic coding sequence
atggccccagccaagaagggcggggagaagaagaagggccgcagcgccatcaatgaggtggtgacccgggagtacaccatcaacatccacaagaggatccacggcgtgggcttcaagaagagggccccccgggccctgaaggagatcaggaagtttgccatgaaggagatgggcaccccagatgtgagaattgacacccggctgaacaaggctgtgtgggccaagggcatcagaaatgtgccctaccgcatccgggtgcggctgagcaggaagagaaatgaagatgaggacagccccaacaagctgtacaccctggtgacctacgtgcctgtgaccaccttcaagaactgccaccaccagtag

SEQ ID NO: 20740 - DNA, 378 bp, Artificial Sequence; identical to SEQ ID NO: 18771
  Description of Artificial Sequence: Synthetic coding sequence

SEQ ID NO: 20741 - DNA, 1500 bp, Artificial Sequence
  Description of Artificial Sequence: Synthetic coding sequence
atgagcaccccatctggcatcagcacctggctgagcctgcctgtgtccaccccagccagcatcaccagcatccgggtgacccagaagagcagcggcccctgggccttcagcagctgcacctacgtgtctggccctggggtgtgcatcagcagcctgagctgcagccgggtgggcagcagcagcttccggggcggcctgggcggcggctacggcggggccagcggcatgggcggcatcatcgccatcatggtgaaccagagcctgctgagccccctgaacctggaggtggaccccaacatccaggccgtgtgcacccaggagaaggagcagatcaagaccctgaacaacaagtttgccagcttcatcgacaaggtgtggttcctggagcagcagaacaaggtgctggagaccaagtggagcctgctgcagcagcagaagatggcccggagcaacatggacaacatgctggagagctacatcaacaacctgcggcggcagctggagaccctgggccaggagaagctgaagctggaggccgagctgggcaacatgcagggcctgggggaggacttcaagaacaagtatgaagatgagatcaacaagcacacagaggtggagaatgaatttgtgctgatcaagaaggatgtggatgaggcctacatgaacaaggccgagctggagagcctgctggagggcctgacagatgagatcaacttcctgcggcagctgtatgaggaggagatccgggagctgcagagccagatcagtgacatgtccatggtgctgtccatggactacagctgcagccgggacatggacagcatcatccctgaggtgaaggtgcagtatgaggagatcgccaactgcagcagagctgaggccgagagcatgtaccagatcaagtatgaggagctgcagaccctggccggcaagtatggagatgacctgagcaggaccaagacagagatcagcgagatgaacagaaacatctcctggctgcaggccgagacagagggcctgaagggccagagggccagcctggaggccgccatcacagatgctgagcagagaggagagctggccgtgaaggatgccaatgccaagctgtctgagctggaggccgccctgcagagggccaagcaggacatgatgggccagctgcgggagtaccaggagctgatgaatgtgggcctgaccctggacatcgagatcgccacctacaggaagctgctggagggggaggagagccggctggagagcggcatgcagaatgtgtccatccacaccaagaccaccagcagctatgctgggggcctgagcagcgcctatggaggcctgaccagccctggcatcatctaccgcctgggcagcagctttggatctgctgctggcagcagcagcttcagcaggaccagcagcaccagggctgtggtggtgaggaagattgagacccatgatggcaagctggagagcgagagcagtgatgtgctgagcaagtag

SEQ ID NO: 20742 - DNA, 504 bp, Artificial Sequence
  Description of Artificial Sequence: Synthetic coding sequence
atgtacatgggcatgatgtgcacagccaagaagtgtggcatccgcttccagcccccagccatcatcctgatctatgaaagtgagatcaagggcaagatccggcagaggatcatgcctgtgaggaacttcagcaagttcagtgactgcaccagggctgctgagcagctgaagaacaaccccaggcacaagagctacctggagcaggtgtccctgcggcagctggagaagctgttctccttcctgcggggctacctgagcggccagagcctggccgagaccatggagcagatccagcgggagaccaccattgatcctgaggaggacctgaacaagctggatgacaaggagctggccaagaggaagagcatcatggatgagctgtttgagaagaaccagaagaagaaggatgaccccaactttgtgtatgacatcgaggtggagttcccccaggatgaccagctgcagagctgtggctgggacacagaatctgcagatgagttctag

SEQ ID NO: 20743 - DNA, 378 bp, Artificial Sequence; identical to SEQ ID NO: 18497
  Description of Artificial Sequence: Synthetic coding sequence

SEQ ID NO: 20744 - DNA, 1005 bp, Artificial Sequence
  Description of Artificial Sequence: Synthetic coding sequence
atgaccaggagcctcttcaagggcaacttctggagcgctgacatcctgagcaccatcggctatgacaacatcatccagcacctgaacaacggcaggaagaactgcaaggagtttgaggacttcctgaaggagcgggccgccatcgaggagagatatggcaaggacctgctgaacctgagcaggaagaagccctgtggccagagcgagatcaacaccctgaagagggccctggaggtgttcaagcagcaggtggacaacgtggcccagtgccacatccagctggcccagagcctgcgggaggaggccaggaagatggaggagttccgggagaagcagaagctgcagaggaagaagacagagctgatcatggatgccatccacaagcagaagagcctgcagttcaagaagaccatggatgccaagaagaactatgagcagaagtgccgggacaaggatgaggccgagcaggccgtgagccgcagcgccaacctggtgaaccccaagcagcaggagaagctgtttgtgaagctggccaccagcaagacagctgtggaggacagcgacaaggcctacatgctgcacatcggcaccctggacaaggtgcgggaggagtggcagagcgagcacatcaaggcctgtgaggcctttgaggcccaggagtgtgagcgcatcaacttcttcagaaatgccctgtggctgcacgtgaaccagctgagccagcagtgtgtgaccagtgatgagatgtatgagcaggtgaggaagagcctggagatgtgcagcatccagagggacatcgagtactttgtgaaccagaggaagacaggccagatccccccagcccccatcatgtatgagaacttctacagcagccagaagaatgctgtgcctgctgggaaggccaccggccccaacctggcccggcggggccccctgcccatccccaagagcagcccagatgaccccaactacagcctggtggatgactacagcctgctgtaccagtag

SEQ ID NO: 20745 - DNA, 597 bp, Artificial Sequence
  Description of Artificial Sequence: Synthetic coding sequence
atgaagaaggtgcggctgaaggagctggagagccggctgcagcaggtggatggctttgagaagcccaagctgctgctggagcagtaccccacccggccccacatcgccgcctgcatgctgtacaccatccacaacacctatgatgacatcgagaacaaggtggtggccgacctgggctgcggctgcggcgtgctgagcattggaacagccatgctgggcgccggcctgtgtgtgggctttgatattgatgaagatgccctggagatcttcaacagaaatgctgaggagtttgagctgaccaacatcgacatggtgcagtgtgatgtgtgcctgctgagcaacaggatgagcaagagctttgacaccgtcatcatgaaccccccatttggcaccaagaacaacaagggcacagacatggccttcctgaagacagccctggagatggccaggacagctgtgtacagcctgcacaagagcagcacccgggagcacgtgcagaagaaggctgctgagtggaagatcaagattgacatcatcgccgagctgcgctatgacctgcctgccagctacaagttccacaagaagaagtctgtgtag

SEQ ID NO: 20746 - DNA, 1125 bp, Artificial Sequence
  Description of Artificial Sequence: Synthetic coding sequence
atgctggcccctggctgtgagctggaccctgaccaggaggtggtgaggaccaggccagaagatgtgcctgccagccccagcaccagcaccatgattgtgtctgtgctgcggccccccagccacgccagctgcacagcctgtggcaccgtgaccttccacatcgtggagaggatggccagcgtcatcccagccagcaacagatccatgagaagtgacaggaacacctacgtgggcaagagatttgtgcacgtgaagaacccctacctggacctgatggatgaggacatcctgtaccacctggacctgggcaccaagacccacaacctgcctgccatgtttggagatgtgaagtttgtgtgtgtgggcggcagccccaacaggatgaaggcctttgccctcttcatgcacaaggagctgggctttgaggaggccgaggaggacatcaaggacatctgtgccggcacagaccgctactgcatgtacaagacaggccctgtgctggccatcagccacggcatgggcatccccagcatcagcatcatgctgcacgagctgatcaagctgctgcaccacgcccgctgctgtgatgtgaccatcatccgcatcggcaccagcggcggcatcggcatcgcccctggcaccgtggtgatcacagacattgctgtggacagcttcttcaagcccaggtttgagcaggtgatcctggacaacatcgtgaccaggagcacagagctggacaaggagctgtctgaggagctgttcaactgcagcaaggagatccccaacttccccaccctggtgggccacaccatgtgcacctatgacttctatgagggccagggccgcctggatggagccctgtgcagcttcagccgggagaagaagctggactacctgaagagggccttcaaggccggcgtgaggaacatcgagatggagagcacagtgtttgctgccatgtgtggcctgtgtggcctgaaggctgctgtggtgtgtgtgaccctgctggaccggctggactgtgaccagatcaacctgccccatgatgtgctggtggagtaccagcagaggccccagctgctgatcagcaacttcatcagaagaaggctgggcctgtgtgactag

SEQ ID NO: 20747 - DNA, 4149 bp, Artificial Sequence
  Description of Artificial Sequence: Synthetic coding sequence
atgctgaggaagctgaccatcgagcagatcaatgactggttcaccatcggcaagacagtgaccaacgtggagctgctgggcgcccccccagccttccctgctggggccgcccgggaggaggtgcagaggcaggatgtggcccctggggccggccctgctgcccaggccccagccctggcccaggccccagcccggcctgctgctgcctttgagaggagcctgagccagaggagcagcgaggtggagtacatcaacaagtaccggcagctggaggcccaggagctggatgtgtgccgctctgtgcagcccaccagcggccctggcccccggcccagcctggccaagctgagctctgtgacctgcatccctggcaccacctacaagtacccagacctgcccatcagccgctacaaggaggaggtggtgtccctgattgagagcaacagcgtggtgatcatccacggggccactggaagtggcaagagcacccagctgccccagtacatcctggaccactacgtgcagaggtctgcctactgcagcatcgtggtgacccagcccaggaagatcggggccagcagcatcgcccgctggatcagcaaggagcgggcctggaccctgggcggcgtggtgggctaccaggtgggcctggagaagatcgccacagaggacaccaggctcatctacatgaccaccggggtgctgctgcagaagatcgtgtctgccaagagcctgatggagttcacccacatcatcattgatgaggtgcatgagaggacagaggagatggacttcctgctgctggtggtgaggaagctgctgcggaccaacagcagatttgtgaaggtggtgctgatgtctgccaccatcagctgcaaggagtttgctgactactttgctgtgcctgtgcagaacaagatgaacccagcctacatctttgaggtggagggcaagccccacagcgtggaggagtactacctgaatgacctggagcacatccaccacagcaagctgagcccccacctgctggaggagcccgtcatcaccaaggacatctatgaggtggccgtgtccctcatccagatgtttgatgacctggacatgaaggagagcggcaacaaggcctggagcggggcccagtttgtgctggagaggagctctgtgctggtgttcctgcccggcctgggggagatcaactacatgcatgagctgctgaccagcctggtgcacaagaggctgcaggtgtaccccctgcacagctctgtggccctggaggagcagaacaacgtgttcctgagccctgtgcccggctacaggaagatcatcctgagcaccaacattgctgagagctctgtgacagtgcctgatgtgaagtatgtgattgacttctgcctgaccaggaccctggtgtgtgatgaggacaccaactaccagagcctgcggctgtcctgggccagcaagaccagctgcaaccagaggaagggccgggccggccgggtgtcccggggctactgctaccgcctggtgcacaaggacttctgggacaacagcatcccagaccacgtggtgcctgagatgctgcgctgccccctgggcagcaccatcctgaaggtgaagctgctggacatgggagagccccgggccctgctggccacagccctgagccccccaggcctgagtgacatcgagaggaccatcctgctgctgaaggaggtgggcgccctggccgtgtctggccagcgggaggatgagaacccccatgatggagagctgaccttcctgggccgggtgctggcccagctgcctgtgaaccagcagctgggcaagctgattgtgctgggccacgtgtttggctgcctggatgagtgcctgatcatcgccgccgccctgagcctgaagaacttctttgccatgcccttccggcagcacctggatggctacagaaacaaggtgaacttcagcggcagcagcaagagtgactgcatcgccctggtggaggccttcaagacctggaaggcctgccggcagacaggagagctgcgctaccccaaggatgagctgaactggggccgcctgaactacatccagatcaagaggatccgggaggtggccgagctgtatgaggagctgaagacccgcatcagccagttcaacatgcacgtggacagccggcggcctgtgatggaccaggagtacatctacaagcagcgcttcatcctgcaggtggtgctggccggggccttctaccccaactacttcaccttcggccagccagatgaggagatggctgtgcgggagctggccggcaaggaccccaagaccaccgtggtgctgaagcacatccccccctacggcttcctgtactacaagcagctgcagagcctcttccggcagtgtggccaggtgaagagcatcgtgtttgatggagccaaggcctttgtggagttcagcaggaaccccacagagcgcttcaagaccctgcctgctgtgtacatggccatcaagatgagccagctgaaggtgtccctggagctgtctgtgcacagcgctgaggagattgagggcaaggtgcagggcatgaatgtgtccaagctgaggaacaccagggtgaatgtggacttccagaagcagacagtggaccccatgcaggtgtccttcaacaccagtgacaggagccagacagtgacagacctgctgctgaccattgatgtgacagaggtggtggaggtgggccacttctggggctacagaattgatgagaacaacagcgagatcctgaagaagctgacagctgagatcaaccagctgaccctggtgcccctgcccacccacccccacccagacctggtgtgcctggccccctttgctgactttgacaagcagcgctacttccgggcccaggtgctgtatgtgtctggcaacagcgctgaggtgttctttgtggactatggcaacaagagccacgtggacctgcacctgctgatggagatcccctgccagttcctggagctgcccttccaggccctggagttcaagatctgcaagatgaggccttctgccaagagcctggtgtgtgggaagcactggagcgatggagccagccagtggtttgccagcctggtgtctggctgcaccctgctggtgaaggtgttttctgtggtgcacagcgtgctgcacgtggatgtgtaccagtacagcggcgtgcaggatgccatcaacatcagagatgtgctgatccagcagggctacgccgagctgacagaggagagctatgagagcaagcagagccatgaggtgctgaagggcctcttcagcaagtctgtggagaacatgacagatggctctgtgcccttccccatgaaggatgatgagaagtacctgatccgcatcctgctggagagcttcagcaccaacaagctgggcacccccaactgcaaggccgagctgcacggccccttcaacccctatgagctgaagtgccacagcctgacccgcatcagcaagttccgctgtgtgtggattgagaaggagagcatcaacagcgtcatcatcagtgatgcccctgaggacctgcaccagaggatgctggtggccgccagcctgagcatcaatgccaccggcagcaccatgctgctgcgggagaccagcctgatgccccacatccctggcctgcctgccctgctgtccatgctgtttgcccctgtgattgagctgagaattgaccagaatggcaagtactacacaggagtgctgtgtggcctgggctggaacccagccaccggggccagcatcctgcctgagcatgacatggagctggcctttgatgtgcagttctctgtggaggatgtggtggaggtgaacatcctgcgggccgccatcaacaagctggtgtgtgatggccccaacggctgcaagtgcctgggccctgagcgggtggcccagctgcaggacatcgcccggcagaagctgctgggcctcttctgccagagcaagccccgggagaagatcgtgcccaagtggcatgagaagccctatgagtggaaccaggtggaccccaagctggtgatggagcaggccgaccgggagagcagccggggcaagaacaccttcctgtaccagctgcacaagctggtggtgctgggcacctag

SEQ ID NO: 20748 - DNA, 357 bp, Artificial Sequence
  Description of Artificial Sequence: Synthetic coding sequence
atggatgtgttcctgatgatccgccgccacaagaccaccatcttcacagatgccaaggagagcagcacagtgtttgagctgaagagaattgtggagggcatcctgaagaggcccccagatgagcagaggctgtacaaggatgaccagctgctggatgatggcaagaccctgggagaatgtggcttcaccagccagacagcccggccccaggccccagccaccgtgggcctggccttccgggcagatgacacctttgaggccctgtgcatcgagcccttcagcagccccccagagctgcctgatgtgatgaagccccaggacagcggcagcagcgccaatgagcaggccgtgcagtag

SEQ ID NO: 20749 - DNA, 3228 bp, Artificial Sequence; identical to SEQ ID NO: 19483
  Description of Artificial Sequence: Synthetic coding sequence

SEQ ID NO: 20750 - DNA, 381 bp, Artificial Sequence
  Description of Artificial Sequence: Synthetic coding sequence
atgacagccacagagcagtggatcttcctgtgtgccgcccacaagacccccaaggaatgtcctgccatcgactacaccaggcacaccctggatggagctgcctgcctgctgaacagcaacaagtacttccccagccgggtgtccatcaaggagagctctgtggccaagctgggctctgtgtgccgccgcatctaccgcatcttcagccacgcctacttccaccaccggcagatctttgatgaatatgaaaatgagaccttcctgtgccaccgcttcaccaagtttgtgatgaagtacaacctgatgagcaaggacaacctgattgtgcccatcctggaggaggaggtgcagaacagcgtgtctggagagagcgaggcctag

SEQ ID NO: 20751 - DNA, 2811 bp, Artificial Sequence; identical to SEQ ID NO: 18319
  Description of Artificial Sequence: Synthetic coding sequence

SEQ ID NO: 20752 - DNA, 1860 bp, Artificial Sequence; identical to SEQ ID NO: 19332
  Description of Artificial Sequence: Synthetic coding sequence

SEQ ID NO: 20753 - DNA, 513 bp, Artificial Sequence
  Description of Artificial Sequence: Synthetic coding sequence
atgacccggggcaaccagcgggagctggcccggcagaagaacatgaagaagcagagcgacagcgtgaagggcaagagaagagatgatggcctgtctgctgctgccaggaagcagagggtgggcgtgcagcagcccaatgctgagctgagccccatccacttccacctgatcctgtgtgccctgcaccccccagccagctgccccttctgccccctggtgccccccagcgcccccagcagcctgcccccaggcacccggcgcagctgcagccgcagcaggaagaggcagaccaggagaagaagaaaccccagcagctttgtggccagctgccccaccctgctgccctttgcctgtgtgcctggggccagccccaccaccctggccttcccccctgtggtgctgaccggccccagcacagatggcatcccctttgccctgagcctgcagagggtgccctttgtgctgcccagcccccaggtggccagcctgcccctgggccacagccggggctag

SEQ ID NO: 20754 - DNA, 630 bp, Artificial Sequence; identical to SEQ ID NO: 18435
  Description of Artificial Sequence: Synthetic coding sequence

SEQ ID NO: 20755 - DNA, 1755 bp, Artificial Sequence
  Description of Artificial Sequence: Synthetic coding sequence
atggccgccagcgccaagaggaagcaggaggagaagcacctgaagatgctgcgggacatgacaggcctgccccacaacaggaagtgctttgactgtgaccagaggggccccacctacgtgaacatgacagtgggcagctttgtgtgcaccagctgcagcggcagcctgcggggcctgaaccccccccaccgggtgaagagcatctccatgaccaccttcacccagcaggagattgagttcctgcagaagcacggcaatgaggtgtgcaagcagatctggctgggcctgtttgatgacaggagcagcgccatcccagacttccgggacccccagaaggtgaaggagttcctgcaggagaagtatgagaagaagcgctggtacgtgcccccagagcaggccaaggtggtggcctctgtgcacgccagcatcagcggcagcagcgccagcagcaccagcagcaccccagaggtgaagcccctgaagagcctgctgggggacagcgcccccaccctgcacctgaacaagggcacccccagccagagccctgtggtgggccgcagccagggccagcagcaggagaagaagcagtttgacctgctgagtgacctgggcagtgacatctttgctgccccagccccccagagcacagccacagccaactttgccaactttgcccacttcaacagccatgctgcccagaacagcgccaatgctgactttgccaactttgatgccttcggccagagcagcggcagcagcaactttggaggcttccccacagccagccacagccccttccagccccagaccacagccttcaggatgctgagcagcagctgcagctttggagagttcaccagcgccttccccctgcaggccacccacagcggcagcgctgcctctgtgaatgccaactttgcccactttgacaacttccccaagagcagcagcgctgactttggcaccttcaacaccagccagagccaccagacagccagcgctgtgtccaaggtgtccaccaacaaggccggcctgcagacagctgacaagtatgctgccctggccaacctggacaacatcttctctgctggccagggcggggaccagggcagcggcttcggcaccaccgggaaggcccctgtgggctctgtggtgtctgtgcccagccagagcagcgccagcagtgacaagtatgctgccctggccgagctggacagcgtcttcagcagcgctgccaccagcagcaatgcctacaccagcaccagcaatgccagcagcaatgtgtttggaacagtgcctgtggtggccagcgcccagacccagcctgccagcagctctgtgcctgccccctttggagccacccccagcaccaacccctttgtggccgccgccggccccagcgtggccagcagcaccaaccccttccagaccaatgcccggggggccacagctgccacctttggaacagcctccatgtccatgcccaccggcttcggcaccccagccccctacagcctgcccaccagcttcagcggcagcttccagcagcctgccttccctgcccaggccgccttcccccagcagacagccttcagccagcagcccaacggctttgctgccttcggccagaccaagcctgtggtgaccccatttggccaggtggccgctgctggggtgagcagcaaccccttcatgaccggggcccccaccggccagttccccaccggcagcagcagcaccaaccccttcctgtag

SEQ ID NO: 20756 - DNA, 795 bp, Artificial Sequence; identical to SEQ ID NO: 19367
  Description of Artificial Sequence: Synthetic coding sequence

SEQ ID NO: 20757 - DNA, 1506 bp, Artificial Sequence
  Description of Artificial Sequence: Synthetic coding sequence
atgagcagcgagcaggacaagagcgccagcaaggagaagagcaagaagcctgtgcgcttcctgccccagctgtccatggagaagctggccagcaaggagaagttcaaggccccagcccgggccctgccccagctgtccatggtgtccaccaagccccactggcagcaggccgcccccagcttccacctgtctgtgaagcaggatgatgagagccctgagcccttctctgtgaagaatgagcagagccacgccgagtacatggagagatttgggaagaagggcaagctgccccaccaggtggatgacagctatgtgggccccagcaccagcaagagcaagggcaagagcccccacaaggagcgggagaacttccgcagcaccctggtgaatgtcatcatgcagcaggatgctgacctggacagcgctgtgcctgatggcagcaccatccccaagcccacagccagcgccatcgagaaggacatcctgcgctactactactacatccaccacggcatcgacacagaccacgtggcccccatggaggacagctggctggagcacgtgctggacctggtgccccagcacctgaaggtgttcacagacagcatcgtgaccctgagtgatgagatgagggaggactacctgctgtctgtgaggaagagcatcgtggactttgtgctgaaggacccccgggagaagggagatgacaagaagacagatgagctgcctgcccacagagctgagatggagatcctgcccaagccctggaggaagagcttcctggccgccagcagctacatccgggaccacctgaatgccatgaaccccaccatgctggccgtgctggacctgtggcacaccaacttcaagaagctgcggctggtggacatcaaggagttccacaactgccaggatgccctggagctgagcagcttccagaacatcatcatgaggcacatggacagcgccaaggagaccctgctgaagatgtggttccctgaggtgcagaacatctactaccagggcaacaagaagaagcagctgcccaccggggacagcagcgccaagctggagagcttcttcaactgtgccgccgccctgatgaccctgcagctgcaggacctgaccctggtgtccatgcaggacttcacagacctgattgcccagcccccagattctgtgcgggcctttgagcaccctggcttcatcatgaggctcatcctggacaatgacaccatcaagtttgagcctgagctgagtgactacatcgacatcttcctgaatgtgtatgatgtgatgatcaaggctgtgtcctttgtgccccgggtggagaccaagctgtacagcaagtggaggaacaaggccaagccaggccacttctacttcagccacatccagaggtctgtgaccttccagcacagcgaggtgagcagcccccagaacagccacttcaagatcgtgagccccttctctgtgctgggcttcacctggcgctgccagctgtag

SEQ ID NO: 20758 - DNA, 855 bp, Artificial Sequence
  Description of Artificial Sequence: Synthetic coding sequence
atgacagatgtgcctgccaccttcacccaggccgagtgcaatggagacaagcccccagaaaatggccagcagaccatcaccaagatcagcgaggagctgacagatgtggacagccccctgccccactacagagtggagcccagcctggagggcgccctgaccaagggcagccaggaggagaggaggaagctgcagggcaacatgctgctgaacagctccatggaggacaagatgctgaaggaaaatcctgaggagaagctgttcatcgtgcacaaggccatcacagacctgagcctgcaggagaccagcgcagatgagatgaccttccgggagggccaccagtgggagaagatccccctgagcggcagcaaccaggagatccggcggcagaaggagcgcatcacagagcagcccctgaaggaggaggaggatgaggacaggaagaacaagggccaccaggccgctgagattgagtggctgggcttcaggaagcccagccaggccgacatgctgcacagcaagcatgatgaggagcagaaggtgtgggatgaggagattgatgatgatgatgatgacaactgcaacaatgatgaagatgaggtgcgggtcatcgagttcaagaagaagcatgaggaggtgtcccagttcaaggaggagggagatgccagcgaggacagccccctgagcagcgccagcagccaggccgtgaccccagatgagcagcccaccctgggcaagaagagtgacatcagcagaaatgcctacagccgctacaacaccatctcctacaggaagatcaggaagggcaacaccaagcagagaattgatgaatttgagagcatgatgcacctgtag

SEQ ID NO: 20759 - DNA, 735 bp, Artificial Sequence
  Description of Artificial Sequence: Synthetic coding sequence
atgaagaaggtgcggctgaaggagctggagagccggctgcagcaggtggatggctttgagaagcccaagctgctgctggagcagtaccccacccggccccacatcgccgcctgcatgctgtacaccatccacaacacctatgatgacatcgagaacaaggtggtggccgacctgggctgcggctgcggcgtgctgagcattggaacagccatgctgggcgccggcctgtgtgtgggctttgatattgatgaagatgccctggagatcttcaacagaaatgctgaggagtttgagctgaccaacatcgacatggtgcagtgtgatgtgtgcctgctgagcaacaggatgagcaagagctttgacaccgtcatcatgaaccccccatttggcaccaagaacaacaagggcacagacatggccttcctgaagacagccctggagatggccaggacagctgtgtacagcctgcacaagagcagcacccgggagcacgtgcagaagaaggctgctgagtggaagatcaagattgacatcatcgccgagctgcgctatgacctgcctgccagctacaagttccacaagaagaagtctgtgtccctgctgatcctggccggcctgcacagcgtgctgaagagcttcctgggccgcatgtggtggttcatgcctgtgatcccagccacccgggaggccgaggcccgggagagcctggagctgcggcggcagaggctgcagtag

SEQ ID NO: 20760 - DNA, 885 bp, Artificial Sequence
  Description of Artificial Sequence: Synthetic coding sequence
atgaacaaccagaagcagcagaagcccaccctgagcggccagcgcttcaagaccaggaagagagatgagaaggagagatttgaccccacccagttccaggactgcatcatccagggcctgacagaaacaggaacagacctggaggccgtggccaagttcctggatgccagcggggccaagctggactaccgccgctatgcagagaccctgtttgacatcctggtggccggcggcatgctggcccctgggggcaccctggctgatgacatgatgaggacagatgtgtgtgtgtttgctgcccaggaggacctggagaccatgcaggcctttgcccaggtgttcaacaagctgatccgccgctacaagtacctggagaagggctttgaagatgaggtgaagaagctgctgctcttcctgaagggcttcagcgagagcgagaggaacaagctggccatgctgactggagtgctgctggccaacggcaccctgaatgccagcatcctgaacagcctgtacaatgaaaacctggtgaaggagggcgtgtctgctgcctttgctgtgaagctgttcaagtcctggatcaatgagaaggacatcaatgctgtggccgccagcctgaggaaggtgtccatggacaaccggctgatggagctgtttcctgccaacaagcagagcgtggagcacttcaccaagtacttcacagaggccggcctgaaggagctgtctgaatatgtgaggaaccagcagaccatcggggccaggaaggagctgcagaaggagctgcaggagcagatgagcagaggagaccccttcaaggacatcatcctgtatgtgaaggaggagatgaagaagaacaacatccctgagcctgtggtgattggatag

SEQ ID NO: 20761 - DNA, 1374 bp, Artificial Sequence; identical to SEQ ID NO: 20588
  Description of Artificial Sequence: Synthetic coding sequence

SEQ ID NO: 20762 - DNA, 1638 bp, Artificial Sequence
  Description of Artificial Sequence: Synthetic coding sequence
atgagcagcagcggctacccacccaaccagggcgccttcagcacagagcagagccgctacccaccccacagcgtgcagtacaccttccccaacaccaggcaccagcaggagtttgctgtgcctgactaccgcagcagccacctggaggtgtcccaggccagccagctgctgcagcagcagcagcagcagcagctgcggcggcggcccagcctgctgtctgagttccaccctggcagtgaccggccccaggagaggaggaccagctatgagcccttccaccctggccccagccctgtggaccatgacagcctggagagcaagaggccccggctggagcaggtgtctgacagccacttccagagggtgtctgctgctgtgctgcccctggtgcaccccctgcctgagggcctgcgggccagcgcagatgccaagaaggaccctgcctttggaggcaagcatgaggcccccagcagccccatcagcggccagccctgtggagatgaccagaatgccagccccagcaagctgagcaaggaggagctgatccagagcatggacagagtggaccgggagatcgccaaggtggagcagcagatcctgaagctgaagaagaagcagcagcagctggaggaggaggccgccaagcccccagagcctgagaagcctgtgtccccacctcctgtggagcagaagcacaggagcatcgtgcagatcatctatgatgagaacaggaagaaggccgaggaggcccacaagatctttgagggcctgggccccaaggtggagctgcccctgtacaaccagcccagcgacaccaaggtgtaccacgagaacatcaagaccaaccaggtgatgaggaagaagctgatcctcttcttcaagagaagaaaccacgccaggaagcagcgggagcagaagatctgccagagatatgaccagctgatggaggcctgggagaagaaggtggacagaattgagaacaaccccaggaggaaggccaaggagagcaagacccgggagtactatgagaagcagtttcctgagatcaggaagcagcgggagcagcaggagcgcttccagagggtgggccagagaggagctggcctgagcgccaccatcgcccggtctgagcacgagatcagcgagatcattgatggcctgtctgagcaggagaacaatgagaagcagatgaggcagctgagcgtcatcccccccatgatgtttgatgctgagcagaggagagtgaagttcatcaacatgaatggcctgatggaggaccccatgaaggtgtacaaggaccggcagttcatgaatgtgtggacagaccacgagaaggagatcttcaaggacaagttcatccagcaccccaagaactttggcctcatcgccagctacctggagaggaagtctgtgcctgactgtgtgctgtactactacctgaccaagaagaatgaaaactacaaggccctggtgagaagaaattatggcaagaggcggggcaggaaccagcagcagatcgcccggcccagccaggaggagaaggtggaggagaaggaggaggacaaggccgagaagacagagaagaaggaggaggagaagaaggatgaggaggagaaggatgagaaggaggacagctag

SEQ ID NO: 20763 - DNA, 480 bp, Artificial Sequence
  Description of Artificial Sequence: Synthetic coding sequence
atgacccactgctgcagcccctgctgccagcccacctgctgcaggaccacctgctggcagcccaccaccgtgaccacctgcagcagcaccccctgctgccagcccagctgctgcgtgagcagctgctgccagccctgctgccaccccacctgctgccagaacacctgctgcaggaccacctgctgccagcccatctgtgtgaccagctgctgccagcccagctgctgcagcaccccctgctgccagcccacctgctgcggcagcagctgtggccagagcagcagctgtgcccctgtgtactgcaggaggacctgctaccaccccacctctgtgtgcctgcccggctgcctgaaccagagctgtggcagcaactgctgccagccctgctgcaggcctgcctgctgtgagaccacctgctgcaggaccacctgcttccagcccacctgtgtgtacagctgctgccagcccagctgctgctag

SEQ ID NO: 20764 - DNA, 1071 bp, Artificial Sequence
  Description of Artificial Sequence: Synthetic coding sequence
atggagggccatgaccccaaggagcctgagcagctgaggaagctgttcatcggcggcctgagctttgagaccacagatgacagcctgcgggagcactttgagaagtggggcaccctgacagactgtgtggtgatgagggacccccagaccaagaggagccggggcttcggctttgtgacctacagctgtgtggaggaggtggatgctgccatgtgtgcccggccccacaaggtggatggccgggtggtggagcccaagagagctgtgtcccgggaggacagcgtgaagccaggggcccacctgactgtgaagaagatctttgtgggcggcatcaaggaggacacagaggagtacaacctgcgggactactttgagaagtatggcaagattgagaccatcgaggtgatggaggaccggcagagcggcaagaagaggggctttgcctttgtgacctttgatgaccatgacacagtggacaagatcgtggtgcagaagtaccacaccatcaatggccacaactgtgaggtgaagaaggccctgagcaagcaggagatgcagagcgctggcagccagaggggccggggcggcggcagcggcaacttcatgggccggggcggcaactttggaggcggcggcggcaactttggccggggcggcaactttggaggccggggcggctatggaggcggcggcggcggcagccggggcagctatggaggaggagatggcggctacaacggctttggaggagatggcggcaactatggaggcggccctggctacagcagcagaggaggctatggaggcggcggccctggctacggcaaccagggcggcggctatggaggcggcggcggctatgatggctacaatgaaggaggcaactttggaggcggcaactatggaggcggcggcaactacaatgactttggaaactacagcggccagcagcagagcaactacggccccatgaagggcggcagctttggaggccgcagcagcggcagcccctacggcggcggctacggcagcggcggcggcagcggcggctacggcagccgccgcttctag

SEQ ID NO: 20765 - DNA, 186 bp, Artificial Sequence
  Description of Artificial Sequence: Synthetic coding sequence
atgcccttcttcggcaacaccttcagccccaagaagaccccacccaggaagagcgccagcctgagcaacctgcacagcctggacaggagcacccgggaggtggagctgggcctggagtatggcagccccaccatgaacctggccggccagagcctgaagtttgaaaatggccagtggatcgcctag

SEQ ID NO: 20766 - DNA, 981 bp, Artificial Sequence
  Description of Artificial Sequence: Synthetic coding sequence
atgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctggtgggtgcgggagggcttcttcaagccagagtaccaggcccggctgccccaggccactggagagaccttctccatgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggatag

SEQ ID NO: 20767 - DNA, 2031 bp, Artificial Sequence
  Description of Artificial Sequence: Synthetic coding sequence
atgatccccccccaggaggccagcgccaggagaagagaaattgaggacaagctgaagcaggaggaggagaccctgtccttcatccgggacagcctggagaagagtgaccagctgaccaagaacatggtgtccatcctgagcagctttgagagccggctgatgaagctggagaacagcatcatccctgtgcacaagcagacagagaacctgcagaggctgcaggagaatgtggagaagaccctgagctgcctggaccacgtgatctcctactaccacgtggccagtgacacagagaagatcatccgggagggccccaccggccgcctggaggagtacctgggctccatggccaagatccagaaggctgtggagtacttccaggacaacagcccagacagccctgagctgaacaaggtgaagctgctgtttgagcggggcaaggaggccctggagagcgagttccgcagcctgatgaccaggcacagcaaggtggtgtcccctgtgctgatcctggacctgatctctggagatgatgacctggaggcccaggaggatgtgaccctggagcacctgcctgagagcgtgctgcaggacgtcatccgcatcagccgctggctggtggagtatggaagaaaccaggacttcatgaatgtgtactaccagatccgcagcagccagctggacaggagcatcaagggcctgaaggagcacttccacaagagcagcagcagcagtggagtgccctacagccctgccatccccaacaagaggaaggacacccccaccaagaagcctgtgaagaggcctggccatgaacatgacttccgggtgaagcacctgtctgaggccctgaatgacaagcacggccccctggccggcagagatgacatgctggatgtggagacagatgcctacatccactgtgtgtctgcctttgtgaagctggcccagagcgagtaccagctgctggccgacatcatccctgagcaccaccagaagaagacctttgacagcctcatccaggatgccctggatggcctgatgctggagggggagaacatcgtgtctgctgccaggaaggccatcgtgagacatgacttcagcacagtgctgaccgtcttccccatcctgcggcacctgaagcagaccaagccagagtttgaccaggtgctgcagggcacagctgccagcaccaagaacaagctgcccggcctcatcacctccatggagaccatcggggccaaggccctggaggactttgctgacaacatcaagaatgaccctgacaaggagtacaacatgcccaaggatggcaccgtgcatgagctgaccagcaatgccatcctcttcctgcagcagctgctggacttccaggagacagctggggccatgctggccagccaggagaccagcagcagcgccaccagctacagcagcgagttcagcaagaggctgctgagcacctacatctgcaaggtgctgggcaacctgcagctgaacctgctgagcaagagcaaggtgtatgaagatcctgccctgagcgccatcttcctgcacaacaactacaactacatcctgaagagcctggagaagtctgagctgatccagctggtggccgtgacccagaagacagctgagaggagctaccgggagcacatcgagcagcagatccagacctaccagaggtcctggctgaaggtgacagactacatcgccgagaagaacctgcctgtgttccagcccggggtgaagctgcgggacaaggagcggcagatcatcaaggagcgcttcaagggcttcaatgatggcctggaggagctgtgcaagatccagaaggcctgggccatcccagacacagagcagagggaccgcatccggcaggcccagaagaccatcgtgaaggagacctatggagccttcctgcagaagtttggatctgtgcccttcaccaagaaccctgagaagtacatcaagtatggagtggagcaggtgggggacatgattgaccggctgtttgacaccagcgcctag

SEQ ID NO: 20768 - DNA, 459 bp, Artificial Sequence
  Description of Artificial Sequence: Synthetic coding sequence
atgacagatgtgcctgccaccttcacccaggccgagtgcaatggagacaagcccccagaaaatggccagcagaccatcaccaagatcagcgaggagctgacagatgtggacagccccctgccccactacagagtggagcccagcctggagggcgccctgaccaagggcagccaggaggagaggaggaagctgcagggcaacatgctgctgaacagctccatggaggacaagatgctgaaggaaaatcctgaggagaagctgttcatcgtgcacaaggccatcacagacctgagcctgcaggagaccagcgcagatgagatgaccttccgggagggccaccagtgggagaagatccccctgagcggcagcaaccaggagatccggcggcagaaggagcgcatcacagagcagcccctgaaggaggaggaggatgaggacaggaagaacaagggccactag

SEQ ID NO: 20769 - DNA, 768 bp, Artificial Sequence
  Description of Artificial Sequence: Synthetic coding sequence
atgtggcccttccccagccgcagcctcttccccccacccacccaggcctggctgcagacagtgtccagtgaccctgaggcccagggctggggcgcctggaatgagaccaaggagatcctgggccctgagggcggggagggcaaggaggagaaggaggaggaggaggatgctgaggaggaccaggatggagatgctggcttcctgctgagcctgctggagcaggagaacctggctgaatgtcccctgcctgaccaggagctggaggccatcaagatgaaggtgtgtgccatggagcaggccgagggcaccccccggcccccaggagtgcagcagcaggccgaggaggaggagggcacagctgctggccagctgctgagccctgagaccgtgggctgccccctgagcggcaccccagaggagaaggtggaggccgaccacaggtctgtgtatgtgggcaatgtggactatggaggcagcgctgaggagctggaggcccacttcagccgctgtggggaggtgcaccgggtgaccatcctgtgtgacaagttcagcggccaccccaagggctgctgcaggaaggagcccaccagcctgggcagcgccccccagacagctggggcctttgaggacacccaggcccctgggggccaccccagccccacagctgccagccgggccggccctggcagtgaccacaagggccgcacaggccctgtggagaacagccaccacggcttccaccgcatcaagggcaagacccgcttctag

SEQ ID NO: 20770 - DNA, 3561 bp, Artificial Sequence
  Description of Artificial Sequence: Synthetic coding sequence
atggagaaggccaccgtgcctgtggccgccgccacagctgctgagggggagggcagccccccagctgtggccgctgtggccggccccccagctgctgctgaggtgggcggcggcgtgggcggcagcagccgggcccggagcgccagcagcccccggggcatggtgcgggtgtgtgacctgctgctgaagaagaagccaccccagcagcagcaccacaaggccaagaggaacagaacctgccggccccccagcagcagcgagagcagcagtgacagcgacaacagcggcggcggcggcggcggcggcggcggcggcggcggcggcggcggcaccagcagcaacaacagcgaggaggaggaggatgatgatgatgaggaggaggaggtgtctgaggtggagagcttcatcctggaccaggatgacctggagaaccccatgctggagacagccagcaagctgctgctgagcggcacagcagatggagctgacctgaggacagtggaccctgagacccaggcccggctggaggccctgctggaggccgccggcatcggcaagctgagcacagcagatggcaaggcctttgctgaccctgaggtgctgcggcggctgaccagctctgtgtcctgtgccctggatgaagctgctgctgccctgaccaggatgagagctgagagcacagccaatgccggccagagcgacaacagaagcctggccgaggcctgcagtgaaggagatgtgaatgctgtgaggaagctgctgattgagggccgctctgtgaatgagcacacagaggagggggagagcctgctgtgcctggcctgcagcgctggctactatgagctggcccaggtgctgctggccatgcacgccaacgtggaggaccggggcatcaagggggacatcacccccctgatggccgccgccaacggcggccacgtgaagatcgtgaagctgctgctggcccacaaggcagatgtgaatgcccagagcagcactggaaacacagccctgacctacgcctgtgccggcggctacgtggatgtggtgaaggtgctgctggagagcggggccagcattgaggaccacaatgaaaatggccacacccccctgatggaggccggcagcgctggccacgtggaggtggcccggctgctgctggagaatggagctggcatcaacacccacagcaatgagttcaaggagagcgccctgaccctggcctgctacaagggccacctggagatggtgcgcttcctgctggaggccggggctgaccaggagcacaagacagatgagatgcacacagccctgatggaggcctgcatggatggccacgtggaggtggcccggctgctgctggacagcggggcccaggtgaacatgcctgctgacagctttgagagccccctgaccctggccgcctgtggcggccacgtggagctggccgccctgctgattgagcggggggccagcctggaggaggtgaatgatgagggctacacccccctgatggaggccgcccgggagggccacgaggagatggtggccctgctgctgggccagggcgccaacatcaatgcccagacagaggagacccaggagacagccctgaccctggcctgctgcggcggcttcctggaggtggccgacttcctgatcaaggccggggctgacatcgagctgggctgcagcacccccctgatggaggccgcccaggagggccacctggagctggtgaagtacctgctggccgccggggccaacgtgcacgccaccacagccaccggggacacagccctgacctacgcctgtgaaaatggccacacagatgtggctgatgtgctgctgcaggccggggctgacctggagcatgaaagtgaaggaggccgcacccccctgatgaaggccgcccgggccggccacgtgtgcaccgtgcagttcctgatcagcaagggggccaacgtgaacagaaccacagccaacaatgaccacacagtgctgagcctggcctgtgccggcggccacctggccgtggtggagctgctgctggcccacggggctgaccccacccaccggctgaaggatggcagcaccatgctgattgaggccgccaagggcggccacacctctgtggtgtgctacctgctggactaccccaacaacctgctgagcgcccctcctccagatgtgacccagctgaccccacccagccatgacctgaacagagccccccgggtgcctgtgcaggccctgcccatggtggtgcccccccaggagccagacaagcccccagccaacgtggccaccaccctgcccatccggaacaaggccgccagcaagcagaagagcagcagccacctgcctgccaacagccaggatgtgcagggctacatcaccaaccagagccctgagagcatcgtggaggaggcccagggcaagctgacagagctggagcagaggatcaaggaggccatcgagaagaatgcccagctgcagagcctggagctggcccacgccgaccagctgaccaaggagaagattgaggagctgaacaagacccgggaggagcagatccagaagaagcagaagatcctggaggagctgcagaaggtggagcgggagctgcagctgaagacccagcagcagctgaagaagcagtacctggaggtgaaggcccagaggatccagctgcagcagcagcagcagcagagctgccagcacctgggcctgctgacccctgtgggcgtgggggagcagctgtctgagggggactatgcccggctgcagcaggtggaccctgtgctgctgaaggatgagccccagcagacagctgcccagatgggctttgcccccatccagcccctggccatgccccaggccctgcccctggccgccggccccctgcccccaggcagcatcgccaacctgacagagctgcagggcgtcatcgtgggccagcctgtgctgggccaggcccagctggccggcctgggccagggcatcctgacagagacccagcagggcctgatggtggccagccctgcccagaccctgaatgacaccctggatgacatcatggctgctgtgtctggccgggccagcgccatgagcaacacccccacccacagcattgctgccagcatcagccagccccagacccccacccccagccccatcatcagccccagcgccatgctgcccatctacccagccattgatattgatgcccagacagagagcaaccacgacacagccctgaccctggcctgtgccggcggccacgaggagctggtgcagaccctgctggagcggggggccagcattgagcaccgggacaagaagggcttcacccccctcatcctggccgccacagctggccacgtgggcgtggtggagatcctgctggacaacggggctgacatcgaggcccagagcgagaggaccaaggacacccccctgagcctggcctgcagcggcggccggcaggaggtggtggagctgctgctggcccggggggccaacaagagcacaggcatgttcctgatcacccacctgtag

SEQ ID NO: 20771 - DNA, 2682 bp, Artificial Sequence
  Description of Artificial Sequence: Synthetic coding sequence
atggccgccaccgtggagggccctgagctggaggccgctgctgctgctggagatgcctctgaagattctgatgctggcagccgggccctgcccttcctgggcggcaaccggctgagcctggacctgtacccaggcggctgccagcagctgctgcacctgtgtgtgcagcagcccctgcagctgctgcaggtggagttcctgcggctgagcacccatgaggacccccagctgctggaggccaccctggcccagctgccccagagcctgagctgcctgcggagcctggtgctgaagggcggccagaggcgggacaccctgggcgcctgcctgcggggggccctgaccaacctgcctgctggcctgagcggcctggcccacctggcccacctggacctgtccttcaacagcctggagaccctgcctgcctgtgtgctgcagatgaggggcctgggcgccctgctgctgagccacaactgcctgtctgagctgcctgaggccctgggcgccctgcctgccctgaccttcctgactgtgacccacaaccggctgcagaccctgcccccagccctgggcgccctgagcaccctgcagaggctggacctgagccagaacctgctggacaccctgcccccagaaattggaggcctgggcagcctgctggagctgaacctggccagcaaccggctgcagagcctgcctgccagcctggccggcctgcggagcctgcggctgctggtgctgcacagcaacctgctggcctctgtgcctgctgacctggcccggctgcccctgctgacccggctggacctgcgggacaaccagctgcgggacctgcccccagagctgctggatgccccctttgtgcggctgcagggcaaccccctgggggaggccagcccagatgcccccagcagccctgtggccgccctgatccctgagatgcccaggctcttcctgaccagtgacctggacagcttccctgtgaccccccagggctgcagcgtgaccctggcctgtggggtgcggctgcagtttcctgctggggccacagccacccccatcaccatccgctaccgcctgctgctgcctgagcccggcctggtgcccctgggcccccatgatgccctgctgagccacgtgctggagctgcagccccacggcgtggccttccagcaggatgtgggcctgtggctgctcttcaccccaccccaggcccggcgctgccgggaggtggtggtgaggaccagaaatgacaacagctggggagacctggagacctacctggaggaggaggccccccagaggctgtgggcccactgccaggtgccccacttctcctggttcctggtggtgtccaggcctgtgtccaatgcctgcctggtgcccccagagggcaccctgctgtgcagcagcggccaccctggggtgaaggtgatcttccccccaggggccacagaggagcccaggagagtgtccatgcaggtggtgaggatggccggccgggagctgcaggccctgctgggggagcctgaggccgctgtgagccccctgctgtgcctgagccagagcggccccccatccttcctgcagcctgtgacagtgcagctgcccctgcccagcggcatcaccggcctgagcctggacaggagccggctgcacctgctgtactgggcccctcctgctgccacctgggatgacatcacagcccaggtggtgctggagctgacccacctgtatgcccgcttccaggtgacccacttctcctggtactggctgtggtacaccaccaagaactgtgtgggcggcctggccaggaaggcctgggagcggctgcggctgcaccgggtgaacctgattgccctgcagaggcggcgggaccctgagcaggtgctgctgcagtgcctgcccaggaacaaggtggatgccaccctgcggcggctgctggagcgctaccggggccctgagcccagcgacacagtggagatgtttgaaggagaggagttctttgctgcctttgagcggggcattgatgtggatgctgacagaccagactgtgtggagggccgcatctgctttgtgttctacagccacctgaagaatgtgaaggaggtgtccttctacagaggagctgtgcctgtgcgggtgcctgaggaggccgaggccgcccggcagaggaaaggagcagatgccctgtggatggccaccctgcccatcaagctgccccggctgcggggcagcgagggccccaggagaggagctggcctgagcctggcccccctgaacctgggagatgctgagaccggcttcctgacccagagcaacctgctgtctgtggccggccgcctgggcctggactggccagctgtggccctgcacctgggcgtgtcctaccgggaggtgcagaggatcagacatgagttcagagatgacctggatgagcagatccgccacatgctgttctcctgggccgagcggcaggccggccagcccggggctgtgggcctgctggtgcaggccctggagcagagcgaccggcaggatgtggccgaggaggtgcgggctgtgctggagctgggccgcaggaagtaccaggacagcatccggaggatgggcctggcccccaaggaccctgccctgcccggcagcagcgccccccagcccccagagcccgcccaggcctag

SEQ ID NO: 20772 - DNA, 1482 bp, Artificial Sequence
  Description of Artificial Sequence: Synthetic coding sequence
atggacttcctgctgggcaaccccttcagcagccctgtgggccagagaattgagaaggccacagatggcagcctgcagagcgaggactgggccctgaacatggagatctgtgacatcatcaatgaaacagaggagggccccaaggatgccctgcgggctgtgaagaagagaattgtgggcaacaagaacttccacgaggtgatgctggccctgactgtgctggagacctgtgtgaagaactgtggccaccgcttccacgtgctggtggccagccaggactttgtggagagcgtgctggtgaggaccatcctgcccaagaacaacccccccaccatcgtgcatgacaaggtgctgaacctgatccagagctgggcagatgccttccgcagcagcccagacctgactggagtggtgaccatctatgaggacctgcggaggaagggcctggagttccccatgacagacctggacatgctgagccccatccacaccccccagaggacagtgttcaacagcgagacccagagcggccaggacagcgtgggcacagacagcagccagcaggaggacagcggccagcacgccgcccccctgcctgccccacccatcctgagcggggacacccccatcgcccccaccccagagcagatcggcaagctgcggtctgagctggagatggtgtctggaaatgtgcgggtgatgtctgagatgctgacagagctggtgcccacccaggccgagcctgctgacctggagctgctgcaggagctgaacagaacctgccgggccatgcagcagagggtgctggagctgatcccccagatcgccaatgagcagctgacagaggagctgctgattgtgaatgacaacctgaacaacgtgttcctgcggcatgaaagatttgagcgcttcagaacaggccagaccaccaaggcccccagcgaggccgagcctgctgctgacctgattgacatgggccctgaccctgctgccaccggcaacctgagcagccagctggccggcatgaacctgggcagcagctctgtgcgggccggcctgcagagcctggaggccagcggccgcctggaggatgaatttgacatgtttgccctgacccggggcagcagcctggccgaccagaggaaggaggtgaagtatgaggccccccaggccacagatggcctggccggggccctggatgcccggcagcagagcactggagccatccctgtgacccaggcctgcctgatggaggacatcgagcagtggctgagcacagatgtgggcaatgatgctgaggagcccaagggcgtgaccagcgagggcaagtttgacaagttcctggaggagcgggccaaggctgctgaccggctgcccaacctgagcagccccagcgctgagggccccccaggcccccccagcggccctgcccccaggaagaagacccaggagaaggatgatgacatgctgtttgccctgtag

SEQ ID NO: 20773 - DNA, 663 bp, Artificial Sequence
  Description of Artificial Sequence: Synthetic coding sequence
atgaacagccagccccagaccaggagcccccccagcaggacagtgcccatccactgcacagacaactggaagaggaggaaggtgctggagcagacccctgtgtaccgcagcctggccggccggggctggatcaagtactgcatcttcttccagaggccccagatccagcccccccgggccaccatccccaacagcagccccagcatccggcctggggcccagacccccacagctgtgtaccaggccaaccagcacatcatgatggtgaaccacctgcccatgccctaccctgtgccccagggcccccagtactgcatcccccagtaccgccacagcggccccccctacgtgggccccccccagcagtaccctgtgcagcccccaggccctggccccttctacccaggccctggccctggggacttccccaatgcctacggcacccccttctaccccagccagcctgtgtaccagagcgcccccatcatcgtgcccacccagcagcagcccccaccagccaagcgggagaagaagaccatccgcatccgggaccccaaccagggcggcaaggacatcacagaggagatcatgtctgggggcggcagcaggaaccccaccccacccatcggccggcccaccagcacccccaccccaccccagtag

SEQ ID NO: 20774 - DNA, 414 bp, Artificial Sequence
  Description of Artificial Sequence: Synthetic coding sequence
atgagcctgtttggcaccaccagcggcttcggcaccagcggcacctccatgtttggcagcgccaccacagacaaccacaaccccatgaaggacatcgaggtgaccagcagcccagatgacagcatcggctgcctgtccttcagcccccccaccctgcccggcaacttcctgattgctggctcctgggccaatgatgtgcgctgctgggaggtgcaggacagcggccagaccatccccaaggcccagcagatgcacacaggccctgtgctggatgtgtgctggagcgatgatggcagcaaggtgttcaccgccagctgtgacaagacagccaagatgtgggacctgagcagcaaccaggccatccagatcgcccagcatgatgcccctgtgaagaccatccactggatcaagtag

SEQ ID NO: 20775 - DNA, 7809 bp, Artificial Sequence
  Description of Artificial Sequence: Synthetic coding sequence
atgaagaggaaggtggtgaacacccacaagctgcggctgagccccaatgaggaggccttcatcctgaaggaggactatgaaagaagaaggaagctgcggctgctgcaggtgcgggagcaggagcgggacatcgccctgcagatccgggaggacatcaagcagaggaggaaccagcagttcacccggctggccgaggagctgcgggcagagtgggaggagagccagacccagaagatccagaacctggagaagctgtacctggccagcctgcgctccatgggagagggccaccggcaggccaaggaaaatgaaccagacctggatgccctggcccagagagctgctgagaggaagaggaaggctgacctgcggcacaaggaggccctgaaggtgcagaagaaccagaaggagatcctgctgaagcagaagacctggcacatcaaggccaggaaggaggccctgctggtggagaaggagaggtctgccaagatcaccagcctgcccccacctccacccaccctgtttgagaacatcgaggtgaagaggatctctgctgtgaagaccaacagcagcacctaccaccacctgcacacctttgtgaaccgggagacagacaccaagaggccagatgcccggctggccgctgaggaggaggccaagaggctggaggagctgcagaagcaggccgcccaggagaggatggagagatttgagaaggcccacgtgcggggcttccaggccatgaagaagatccacctggcccagaaccaggagaagctgatgaaggagctgaagcagctgcagcaggaggacctggcccggcggcggcagacagtggcccagatgccaccccagctggtggagctgccctacaagaggtctgagatgaaggaggactggcagcgggagctggagtttgcctttgaggacatgtacaatgctgacaggaaggtgaagggcaacctgatcctgcacctggagcctgagcccctgcccaccgtgaccaaccagatccaggatgaggagctggacctgtccatggagcaggagaacctgggcgctgctgaggacctgcctgtgacagaagctgagatctgcagcagcgagacagatgtgcccctggtgatgaagacccagcagatccccagcaaggtgctcttcaagaagctgctgaacaagatccgcagccagaagagcctgtggaccatcaagtccatgtctgaagatgaaagtgagatgatcaccaccgtgtctgaaattgagagcaaggcccccaccgtggagagcggcaccatcgccagcaaggagaggaccctgagcagcggccaggagcaggtggtggagagtgacaccctgaccatcgagagcggccccctggccagcgaggacaagcccctgagctgtggcaccaacagcggcaaggagcaggagatcaatgagaccctgcccatcaccaccgtggcccagagctctgtgctgctgcacccccaggaggccgccgcccgcatccgcatgtctgcccggcagaagcagatcatggagattgaggagcagaagcagaagcagctggagctgctggagcagatcgagcagcagaagctgcggctggagacagactgcttccgggcccagctggaggaggagaagaggaagaagacccagcccaccggggtgggcatcgccccagccagctgccctgtgatcagtgatgaggacagccaccggcagatgatccggaactaccagcaccagctgctgcagcagaaccggctgcaccggcagagcgtggagacagccaggaagcagctgctggagtaccagaccatgctgaagggccgctgccccagcgtgtctgcccccagcctcatcacagacagcgtcatctctgtgcccagctggaagtctgagcggcccacagccatcagcgagcactgggaccagggccagaggctgaagctgagccccaacaagtaccagcccatccagcccatccagaccagcaagctggagcaggaccacttccaggtggcccggcagaaccacttcccccagaggcaggtggagaccacagagaccctgcgggccagtgacatcctgaccaaccaggccctggagagccaggagcacctgcggcagttcagccagacagagacccagcagagggactacaagctggtgcccaaggacagcgagaccctgagccgggccctgagccatgaccggcagctgatcagccaggatgccaggaagatcagcgagacctttggagccaccaccttccagagcctggagagccagcagctgttctctgaaaattctgagaacatctcctaccacctgacagagcccagcagctttgtgcccctggtgccccagcacagcttcagcagcctgcctgtgaaggtggagagcggcaagatccaggagcccttcagcgccatgagcaagagcacagtgtccaccagccacagcatcatcagccagatgcatgaccggcccctgctgcccagcgagaacatcacagcccagcagggcaacatgaaggccctgcaggagcagctggacctgcagaagaaggtgctgcaggccacccaggaggcccaggagcagctgctgctgtgcaagcagaaggaggtggagcagcagacaggcctgagcgtcttcctgcccctggtgaccccagacagcagcgccctgctgcccagcgccaaggctgacctgggccgcatccaggagagcagccccaccaagaacaacattgctgtgtccagtgaccaccacgtgatcagccagctgcaggacaagaggctgagcctgagccagcccatcctgagccagcagaacaacttcaagttcctgcaggagcagctgaacatccagaaggacagcctgcaggcccggcgggaggcccaggaggtgctgtatgtgcacaagcagagcgagctggaccggcgggtgtgcagcgagcaggccgagcccagcttccccttccaggtggcccagcacaccttcaccagcctgcccagcgctgacaccaagagcggcaagatccaggagcagcacagcagcaagtctgagaagggcctggtgtcctgccagagcgacatccccatcagccaggacggcagcctgtccttcctgcagcagttcctgcccctgcatgacagcctgaagctgctgcaggagcagctgaccaagcagagggacaccctgcaggcccggcatgaggcccaggtggagctgctgctgcaccggcagagggacctgggggacagcaagagcggcctggtgagcagcagcagcagccctgtggtggtgcagcacagcgtggccagccaggccagcgccaaggccgagccccggcgcatccaggagctgtacctgtctgagaaggaaaatgtgggccccagctgccacctgatcatccccaccttccaggacaagagcctgtccttcccccagcacagcctggcccagcaggagaacctgaccatcctgcaggagcagagccagatccagagggtcatcctgggcgccaaggagggcacccaggagtttgtgcacacagaaagtgagctggagaagaggatcagcagcgagcagacaggcaccagcagcagcctgagccaggtggatgagagcgagcgcttccaggagtgcatcagcatcaagagtgacagcaccatccccctgagccaccccaagatcccccgctgccaggagcggctgctgcgggtgtcccagcacatgctgcccctgcaggacaacctggaggagcaccaggcctggctggacacagagaaggaggccttccacttcagccagaagacccaggagaacaccagcagcgagcagacaggcagcagcagcttcatcccccagctggtgcagctgtccttcaccagcctggccagcgctgagagcggcaccatcctggagcccctcttcacagaaagtgagagcaagatcttcagcagccacctgcagatcccccagctgcaggaccggctgctgcgcatcagccagctgatccagccccagcaggacaacctgaaggccctgcaggagcagctggccacccagcgggaggccatcatcctggcccggcaggaggcccgggaggagctgctgctgcaccagagcgagtgggagggccgcatcagccctgagcaggtggacaccagcagcctgcccctggtgccccagcacagctttgccagcctgcccctgaatgaaagtgaaagaaaccaggagccctgcagcatcaacagcgacaacatcgtgagcagcggccacagcgagatccccaccctgcctgatggcctgctgggcctgagccacctggtgctgccccagcaggacaacctgattgccctggaggagcacctgcacgcccagacagacttcctgcccagcattgagaagacccagaaggagctggtgctgagcaagccctgcaagtttgaggagaaggtgagcagcgagcacttcatccagagccaccacggggacctgcaggccctgcagcagcagctggacacccagaagaaggccatccgcagcatccaggaggtgcaggaggagctgctgctgcagaggctgtctgagctggagaagagggtgtcctctgagcaggtgtgcagcagcagctttgtgtcccaggtgcctgtggccgacagcgagaggacccagaagagcttccccaccaagagcaatgacaccctgcccagcagccaccgggagatcccccggctgcaggaccggctgctgagcctgagcaagcccatcctgccccagcaggacaacatgacagcccagctggatgcccagcgggaggtgatgtacagctatgagaagccccaggaggagctgagcctgaacaagcagaggaagctgaacaagtctgagagcgctgagcacaccatccccagcctcttcctgcccaaggagacagagcacagcttcatccccctgccctttgctgaggccaagcccaagagcacctgtgagctgtacagcagccagaatgagcacgccgccccacccagcaaccctgtgattcctggcttccaggaccggctgctgtccttcagccagagcgtgctgacccagcaggacaacctgggcctgcagaagcagctggacctgcagcgggaggtgctgcactacagccagaaggcccaggagaagctgctggtgcagaggcagacagccctgcagcagcagatccagaagcatgaggagaccctgaaggacttcttcaaggacagccagatcagcaagcccaccgtggagaatgacctgaagacccagaagatgggccagctgcgggactggttccccaacacccaggacctggccggaaatgaccaggagaacatcagacatgctgacaggaacaacagtgatgacaaccacctggccagcgaggacaccagcgccaagcagagcggggagcacctggagaaggacctgggcagaagaagcagcaagccccctgtggccaaggtgaagtgtggcctggacctgaaccagcacgagctgagcgccatccaggaggtggagagccctgccatcggccgcaccagcatcctgggcaagccaggcatctatgaggaccgggaccccctgcgggtgtccatcagccgggagcagagcttcttcggcagccccctggcccatgaccccttcagctgcctgcagctggtgggccaggagaatgtgtgtggagatgattatgatgaggccgtgaagctgaaggagagcgtggtggagaaccacgctgtgctgtcctatgctgtggaggaggagcacgcctacctgggccccaccgtgaagccagatgacaaggccaagaccctgtcctatgagcccctgagcagcgccaccgtgtccacaggcagcctgctgtcctatgaaaatacagacctgagcctgacagatcctgagagcttcagcgagcacatggatgacagcaagcaggagagcaccaccagcaaggaggaggagaccaacatcatcagcagcatcgtgcccagcacccaggacatctaccagaggcagaacagcagtgatgtgcacaagagcctgctgcctgctgtggatgagaccacctgtggccacacccacttccagcagatgattgacaagtacatcaatgaggccaacctgatccctgagaagacagacctgcaggagctggagcacatcttccccaacctgcaccaccagctgttcaagcccctggagccccacccagactttgacctgagcagcagcagcagcggcatcagcccagacaacagagacttctaccagaggagtgacagcagcagcgagagccactgtgccaccggcctgagcaagagcacagtgtacttcaccgccctgcggaggacctccatgcacagcagcctgaacaccagccccaaccagcagcctgacaccaacctggcccacgtgggcgcccacagctttgccacagagaacatcattggaggcagcgagcagtgctttgagcagctgcagcctgagtacagcagccaggaggagagccagcacgccgacctgcccagcatcttcagcattgaggcccgggacagcagccagggcatgaagaaccagaactaccccagcgaggagcacacagagatcctgcagaacaagaagaagatcgtgcacttccagctgagcatcggcaacctgagctctgtgtacagcagcagtgatgaggccaacgtgtttgaccagctgaatgtgcagcacagcaccccctgtggcagcaacagcagtgaatgttccaccaagcaccagctggagagcaggaaggagagcatgggctttgaggagctgagcaagaggggcgtggtgaccatgctgcagagccagggcctgattgaggacaacaagaatgagacctgccgggtgctggacatcaacccccaggtggaggagacagacagccggctgtgtgtgaggacagtggagatgggcaccagcatccaggccccctacagcctgaccacccagaatgagaagtactttgaaaattctgctgagacagacatccccaagatcaccaagaagctgagccagctgggggagagcgagctgtttgccagcagcggcagcttcagcctgcagagcagcatccctgtgtgggagacagaaacaggccacggcatcatggaggagcctgagctgaccctcatcagcaccacagacaccagcattgctgagatggactttgccaacctgaccctggaggagaagtcagaaaatgaggccaagtgcttcttccaggtgtctgagttcctgcccctggtgtctgccacagaggccagtgactacccagctgtgtctgagctgagcattgagaagcccaggacagccagcacagctgagaccccccggcggctgacccctgtgcccggcagcctgcaggaggccttcatcaagaggaagaagagcttcatggagaggagccaccagaggcagaaggagatccggaacaagatccacgtgtctgagaacagccagatcaagacagtgaaggagaagcccagcatcagcagctctgtgtcccggctgaagggcgtgaacaaggtgcgggccagcttccctgaggacaggaagaccacccaggccctgcggcaccagaggggcctgcggctgtacaaccagctggccgaggtgaagcagcagaaggaggagaagaccaagcaggaggcctatgcccagaacagagcccgggccaaggagttccacaagaagaccctggagaagctgcgggccaagaacacctgctag

SEQ ID NO: 20776 - DNA, 1602 bp, Artificial Sequence
  Description of Artificial Sequence: Synthetic coding sequence
tctgcccccagcgtgggcaatgacatgggaaatgatgatgccatcggcggcaatgtgtccaagtacatcgtgctgcccaccggctactgcggccagcccaagaagggccacctgatctttgatgcctgctttgagagcggcaacctgggccgggtggaccaggtgtctgaatttgaatatgacctcttcatccggccagacacctgcaacccccgcttccgggtgtggttcaacttcaccgtggagaatgtgaaggagagccagagggtcatcttcaacatcgtgaacttcagcaagaccaagagcctgtacagagatggcatggcccccatggtgaagagcaccagccggcccaagtggcagaggctgccccccaagaatgtgtactactaccgctgcccagaccacaggaagaactacgtgatgagctttgccttctgctttgaccgggaggaggacatctaccagtttgcctactgctacccctacacctacacccgcttccagcactacctggacagcctgcagaagaggaacatggactacttcttccgggagcagctgggccagagcgtgcagcagaggaagctggacctgctgaccatcaccagcccagacaacctgcgggagggcgctgagcagaaggtggtgttcatcaccggccgggtgcaccctggagagacccccagcagctttgtgtgccagggcatcatcgacttcctggtgtcccagcaccccatcgcctgtgtgctgcgggagtacctggtgttcaagatcgcccccatgctgaacccagatggagtgtacctgggcaactaccgctgcagcctgatgggctttgacctgaacagacactggctggaccccagcccctgggtgcaccccaccctgcacggcgtgaagcagctgattgtgcagatgtacaatgaccccaagaccagcctggagttctacatcgacatccacgcccacagcaccatgatgaatggcttcatgtatggcaacatctttgaagatgaggagcgcttccagaggcaggccatcttccccaagctgctgtgccagaatgctgaggacttctcctacagcagcaccagcttcaacagagatgctgtgaaggccggcaccggccgccgcttcctgggcggcctgctggaccacaccagctactgctacaccctggaggtgtccttctacagctacatcatcagcggcaccacagctgctgtgccctacacagaggaggcctacatgaagctgggcagaaatgtggcccggaccttcctggactactaccgcctgaaccctgtggtggagaaggtggccatccccatgccccggctgaggaacaaggagattgaggtgcagaggaggaaggagaagagccccccctacaagcaccccctgctgcggggccctgccagcaactaccccaacagcaaaggagacaagaagagctctgtgaaccacaaggaccccagcacccccttcaagaccaggagccctggccgctcctatggagaccgctccatgcacttcctgctgggcaatgagatcaaccacagcagcctggccagcaaggacctgtggatcaatgcctag

SEQ ID NO: 20777 - DNA, 1509 bp, Artificial Sequence
  Description of Artificial Sequence: Synthetic coding sequence
atgcctgagatccgggtgacccccctgggcgcctgccctgtgctgtcctggaacctggtgctgcccccaggccggggcagccgggcccccagcagcacagacaccaggacaggcttccacgtgctgccccacggcgtggatgatgagctggagatcaaggcctactatgccggccacgtgctgggcgccgccatgttccagatcaaggtgggcagcgagagcgtggtgtacaccggggactacaacatgaccccagacagacacctgggcgccgcctggattgacaagtgccggcccaacctgctgatcacagagagcacctacgccaccaccatccgggacagcaagcgctgccgggagcgggacttcctgaagaaggtgcatgagaccgtggagcggggcggcaaggtgctgatccctgtgtttgccctgggccgggcccaggagctgtgcatcctgctggagaccttctgggagaggatgaacctgaaggtgcccatctacttcagcacaggcctgacagagaaggccaaccactactacaagctgttcatcccctggaccaaccagaagatcaggaagacctttgtgcagaggaacatgtttgagttcaagcacatcaaggcctttgaccgggcctttgctgacaaccctggccccatggtggtgtttgccaccccaggcatgctgcacgccggccagagcctgcagatcttcaggaagtgggccggaaatgagaagaacatggtgatcatgcctggctactgtgtgcagggcaccgtgggccacaagatcctgagcggccagaggaagctggagatggagggccggcaggtgctggaggtgaagatgcaggtggagtacatgtccttcagcgcccatgctgatgccaagggcatcatgcagctggtgggccaggccgagcctgagagcgtgctgctggtgcacggggaggccaagaagatggagttcctgaagcagaagattgagcaggagctgcgggtgaactgctacatgcctgccaacggggagaccgtgaccctgcccaccagccccagcatccctgtgggcatcagcctgggcctgctgaagcgggagatggcccagggcctgctgcctgaggccaagaagccccggctgctgcacggcaccctcatcatgaaggacagcaacttccggctggtgtcctctgagcaggccctgaaggagctgggcctggccgagcaccagctgcgcttcacctgccgggtgcacctgcatgacaccaggaaggagcaggagacagccctgcgggtgtacagccacctgaagtctgtgctgaaggaccactgtgtgcagcacctgcctgatggctctgtgacagtggagagcgtgctgctgcaggccgccgcccccagtgaagatcctggcaccaaggtgctgctggtgtcctggacctaccaggatgaggagctgggcagcttcctgaccagcctgctgaagaagggcctgccccaggcccccagctag

SEQ ID NO: 20778 - DNA, 1371 bp, Artificial Sequence
  Description of Artificial Sequence: Synthetic coding sequence
atggctgacagcctggagagcacccccctgcccagccctgaggaccggctggccaagctgcaccccagcaaggagctgctggagtactaccagaagaagatggccgagtgtgaggccgagaatgaagacctgctgaagaagctggagctgtacaaggaggcctgtgagggccagcacaagctggagtgtgacctgcagcagcgggaggaggagattgctgagctgcagaaggccctgagtgacatgcaggtgtgcctcttccaggagcgggagcacgtgctgcggctgtacagtgaaaatgaccggctgcgcatccgggagctggaggacaagaagaagatccagaacctgctggccctggtgggcacagatgctggggaggtgacctacttctgcaaggagcccccccacaaggtgaccatcctgcagaagaccatccaggccgtgggagaatgtgagcagagcgagagcagcgccttcaaggctgaccccaagatcagcaagagaagacccagccgggagaggaaggagagcagcgagcactaccagagggacatccagaccctcatcctgcaggtggaggccctgcaggcccagctgggggagcagaccaagctgagccgggagcagatcgagggcctgattgaggaccggcgcatccacctggaggagatccaggtgcagcaccagaggaaccagaacaagatcaaggagctgaccaagaacctgcaccacacccaggagctgctgtatgagagcaccaaggacttcctgcagctgcggtctgagaaccagaacaaggagaagtcctggatgctggagaaggacaacctgatgagcaagatcaagcagtacagagtgcagtgcaagaagaaggaggacaagattggcaaggtgctgcctgtgatgcatgagagccaccacgcccagagcgagtacatcaagagcctgaaggacaagctggtgcaggagaagaagctgagcaacatgtaccaggagcagtgcatcagcctggaggaggagctggcccgcatccgggaggaggagggcatgaggcgggagatcttcaaggacaggaccaacaagatgggcaagaggctgcagatcatgaccaagagatatgaggccctggagcggcggcgcatcctggaggtggagggcttcaagacagacatcaaggtgctgcggcagaagctgaaggacctggagcagatgctgtacaaggccaccgtgaatgcccgggccaaccaggacctggccctgctgtgtgaggtgcgggacagcaacagaagagcccacaagatccagggcgagctgaagaacctgaagagcaaggtgtttggcctggagaatgagctgcggctgtgctag

SEQ ID NO: 20779 - DNA, 270 bp, Artificial Sequence; identical to SEQ ID NO: 20498
  Description of Artificial Sequence: Synthetic coding sequence

SEQ ID NO: 20780 - DNA, 453 bp, Artificial Sequence
  Description of Artificial Sequence: Synthetic coding sequence
atgcaccctgaggacagcgtggtgagcagcaaggtgctgggctgcagccacttccctgtggccagcaggcctgctggcagccatgacccccagcccggccaccggggccgggtgctgggccctgcccgggcccctggctgggtgcgctatgcagagcgggtgctgggccggcccatcacagcccacctgtgcacagccaagagcccccagcaggtgatgggcagcctggtgaaggactactttgcccggcagcagaacctgagccctgagaagatcttccacgtgattgtggccccctgctatgacaagaagctggaggccctgcaggagagcctgcccccagccctgcacggcagcagaggagctgactgtgtgctgaccagcggggagatcgcccagatcatggagcagggcgacctgtctgtgagagatgctgctgtggacaccctgtag

SEQ ID NO: 20781 - DNA, 534 bp, Artificial Sequence
  Description of Artificial Sequence: Synthetic coding sequence
atgggctgctgcggctgcagccggggctgcggcagcggctgcggcggctgcggcagcagctgtggcggctgcggcagcggctgcggcggctgcggcagcggccggggcggctgcggcagcggctgcggcggctgcagcagcagctgtggcggctgcggcagccgctgctacgtgcctgtgtgctgctgcaagcctgtgtgctcctgggtgcctgcctgcagctgcaccagctgtggcagctgtggcggcagcaaaggaggctgcggcagctgtggcggcagcaaaggaggctgcggcagctgtggcggcagcaaaggaggctgcggcagctgtggctgcagccagagcagctgctgcaagccctgctgctgcagcagcggctgcggcagcagctgctgccagagcagctgctgcaagccctgctgctgccagagcagctgctgcgtgcctgtgtgctgccagagcagctgctgcaagccctgctgctgccagagcaactgctgcgtgcctgtgtgctgccagtgcaagatctag

SEQ ID NO: 20782 - DNA, 294 bp, Artificial Sequence
  Description of Artificial Sequence: Synthetic coding sequence
atgcctgctgagctgtggctgaccagctatggagtgcgggaggtggaccaggtgaagaggctgaccggccctggcctgtctgagggccctgagcccagcatctctgtgatggtgactggaggcccctggcccacccggctgagcaggacctgcctgcactacctgggggagtttggagaggaccagatctatgaggcccaccagcagggccgcggggccctggaggccctgctgtgtggcggcccccagggcgcctgcagcgagaaggtgtctgccacccgggaggagctgtag

SEQ ID NO: 20783 - DNA, 264 bp, Artificial Sequence
  Description of Artificial Sequence: Synthetic coding sequence
atggagaaccagctggccaagagcacagaggagaggaccttccagtaccaggacagcctgcccagcctgcctgtgcccagcctggaggagagcctgaagaagtacctggagagcgtgaagccctttgccaaccaggaggagtacaagaagacagaggagatcgtgcagaagttccagagcggcatcggggagaagctgcaccagaagctgctggagcgggccaagggcaagaggaactgggtgtttgtggtgatcatcgagtag

SEQ ID NO: 20784 - DNA, 1881 bp, Artificial Sequence; identical to SEQ ID NO: 19875
  Description of Artificial Sequence: Synthetic coding sequence

SEQ ID NO: 20785 - DNA, 2940 bp, Artificial Sequence
  Description of Artificial Sequence: Synthetic coding sequence
atgctgtgctggggcaatgccagctttggccagctgggcctgggcggcattgatgaggagatcgtgctggagcccaggaagagtgacttcttcatcaacaagagggtgagagatgtgggctgcggcctgcggcacacagtgtttgtgctggatgatggcaccgtgtacacctgtggctgcaatgacctgggccagctgggccacgagaagagcaggaagaagccagagcaggtggtggccctggatgcccagaacatcgtggccgtgtcctgtggggaggcccacaccctggccctgaatgacaagggccaggtgtatgcctggggcctggacagtgatggccagctgggcctggtgggcagcgaggagtgcatccgggtgcccaggaacatcaagagcctgagtgacatccagatcgtgcaggtggcctgtggctactaccacagcctggccctgagcaaggccagcgaggtgttctgctggggccagaacaagtatggccagctgggcctgggcacagactgcaagaagcagaccagcccccagctgctgaagagcctgctgggcatccccttcatgcaggtggccgccggcggggcccacagctttgtgctgaccctgagcggggccatcttcggctggggcaggaacaagtttggccagctgggcctgaatgatgaaaatgacagatatgtgcccaacctgctgaagagcctgcggagccagaagatcgtgtacatctgctgcggggaggaccacacagctgccctgaccaaggagggcggcgtcttcaccttcggggccggcggctacggccagctgggccacaacagcaccagccatgagatcaaccccaggaaggtgtttgagctgatgggcagcatcgtgacagaaattgcctgtggccggcagcacaccagcgcctttgtgcccagcagcggccgcatctacagctttggcctgggcggcaatggccagctgggcaccggcagcaccagcaacaggaagagccccttcaccgtgaagggcaactggtacccctacaacggccagtgcctgcctgacatcgacagcgaggagtacttctgtgtgaagaggatcttctctggaggagaccagagcttcagccactacagcagcccccagaactgtggccccccagatgacttccgctgccccaaccccaccaagcagatctggacagtgaatgaggccctgatccagaagtggctgagctaccccagcggccgcttccctgtggagatcgccaatgaaattgatggcaccttcagcagcagcggctgcctgaatggcagcttcctggccgtgtccaatgatgaccactacagaacaggcacccgcttcagcggcgtggacatgaatgctgcccggctgctcttccacaagctgatccagcctgaccacccccagatcagccagcaggtggccgccagcctggagaagaacctgatccccaagctgaccagcagcctgcctgatgtggaggccctgcgcttctacctgaccctgcctgagtgccccctgatgtctgacagcaacaacttcaccaccatcgccatcccctttggaacagccctggtgaacctggagaaggcccccctgaaggtgctggagaactggtggagcgtgctggagcccccactcttcctgaagatcgtggagctgttcaaggaggtggtggtgcacctgctgaagctgtacaagattggcatccccccatctgaaagacgcatcttcaacagcttcctgcacacagccctgaaggtgctggagatcctgcaccgggtgaatgagaagatgggccagatcatccagtatgacaagttctacatccacgaggtgcaggagctgattgacatcagaaatgactacatcaactgggtgcagcagcaggcctacggcatggatgtgaaccacggcctgacagagctggccgacatccctgtgaccatctgcacctacccctttgtgtttgatgcccaggccaagaccaccctgctgcagacagatgctgtgctgcagatgcagatggccatcgaccaggcccaccggcagaatgtgagcagcctcttcctgcccgtcatcgagagcgtgaacccctgcctgatcctggtggtgcggcgggagaacatcgtgggagatgccatggaggtgctgaggaagaccaagaacatcgactacaagaagcccctgaaggtgatctttgtgggagaagatgctgtggatgctgggggcgtgaggaaggagttcttcctgctgatcatgagggagctgctggaccccaagtatggcatgttccgctactatgaggacagccgcctcatctggttcagtgacaagatcaccgtggagaactttggagccacagaggtgaaggagctggtgctgaatggagctgacacagctgtgaacaagcagaaccggcaggagtttgtggatgcctacgtggactacatcttcaacaagtctgtggccagcctgtttgatgccttccacgccggcttccacaaggtgtgtggcggcaaggtgctgctgctcttccagcccaatgagctgcaggccatggtgattggcaacaccaactatgactggaaggagctggagaagaacacagagtacaagggggagtactgggccgagcaccccaccatcaagatcttctgggaggtgttccacgagctgcccctggagaagaagaagcagttcctgctcttcctgaccggcagtgaccgcatccccatcctgggcatgaagagcctgaagctggtgatccagagcactggaggaggagaggagtacctgcctgtgagccacacctgcttcaacctgctggacctgcccaagtacacagagaaggagaccctgcggagcaagctgatccaggccatcgaccacaatgaaggcttcagcctcatctag

SEQ ID NO: 20786 - DNA, 1020 bp, Artificial Sequence
  Description of Artificial Sequence: Synthetic coding sequence
atgaagatctttgtgggcaatgtggatggagctgacaccaccccagaggagctggccgccctgtttgccccctatggaacagtgatgagctgtgctgtgatgaagcagtttgcctttgtgcacatgagagaaaatgctggggccctgcgggccatcgaggccctgcacggccacgagctgcggcccggccgggccctggtggtggagatgagccggccccggcccctgaacacctggaagatctttgtgggcaatgtgtctgctgcctgcaccagccaggagctgcggagcctgtttgaaagaagaggccgggtgattgaatgtgatgtggtgaagggcaagaggatgcacgtgcagctgagcaccagccggctgaggacagcccctggcatgggagaccagagcggctgctaccgctgtgggaaggagggccactggagcaaagaatgtcccatcgacagaagtggccgggtggccgacctgacagagcagtacaatgagcagtatggagctgtgaggaccccctacaccatgtcctatggagacagcctgtactacaacaatgcctacggggccctggatgcctactacaagcgctgccgggccgcccggagctatgaggccgtggccgctgctgctgcctctgtgtacaactatgcagagcagaccctgagccagctgccccaggtgcagaacacagccatggccagccacctgaccagcaccagcctggacccctatgacagacacctgctgcccaccagcggggccgccgccacagctgctgctgctgctgctgctgctgctgctgtgacagctgccagcaccagctactacggccgggacaggagccccctgcggcgggccacagcccctgtgcccaccgtgggggagggctacggctacggccacgagagcgagctgagccaggccagcgctgctgccaggaacagcctgtatgacatggcccgctatgagcgggagcagtatgctgaccgggcccgctacagcgccttctag

SEQ ID NO: 20787 - DNA, 390 bp, Artificial Sequence; identical to SEQ ID NO: 19988
  Description of Artificial Sequence: Synthetic coding sequence

SEQ ID NO: 20788 - DNA, 1695 bp, Artificial Sequence
  Description of Artificial Sequence: Synthetic coding sequence
atgagctacccagcagatgattatgagagcgaggccgcctatgacccctatgcctaccccagcgactatgacatgcacactggagaccccaagcaggacctggcctatgaaaggcagtatgagcagcagacctaccaggtgattcctgaggtgatcaagaacttcatccagtacttccacaagacagtgtctgacctgattgaccagaaggtgtatgagctgcaggccagccgggtgtccagtgatgtgattgaccagaaggtgtatgagatccaggacatctatgagaacagctggaccaagctgacagagcgcttcttcaagaacaccccctggccagaggccgaggccatcgccccccaggtgggcaatgatgctgtgttcctgatcctgtacaaggagctgtactaccgccacatctatgccaaggtgtctgggggccccagcctggagcagagatttgagagctactacaactactgcaacctcttcaactacatcctgaatgctgatggccctgcccccctggagctgcccaaccagtggctgtgggacatcattgatgagttcatctaccagttccagagcttcagccagtaccgctgcaagacagccaagaagtctgaggaggagattgacttcctgcggagcaaccccaagatctggaatgtgcacagcgtgctgaatgtgctgcacagcctggtggacaagagcaacatcaaccggcagctggaggtgtacaccagcggcggggaccctgagagcgtggccggggagtatggccgccacagcctgtacaagatgctgggctacttcagcctggtgggcctgctgcggctgcacagcctgctgggggactactaccaggccatcaaggtgctggagaacatcgagctgaacaagaagtccatgtacagccgggtgcctgagtgccaggtgaccacctactactacgtgggctttgcctacctgatgatgaggcgctaccaggatgccatccgggtgtttgccaacatcctgctgtacatccagaggaccaagtccatgttccagaggaccacctacaagtatgagatgatcaacaagcagaatgagcagatgcacgccctgctggccatcgccctgaccatgtaccccatgagaattgatgagagcatccacctgcagctgcgggagaagtacggggacaagatgctgaggatgcagaagggggacccccaggtgtatgaggagctgttctcctacagctgccccaagttcctgagccctgtggtgcccaactatgacaacgtgcaccccaactaccacaaggagcccttcctgcagcagctgaaggtgttcagtgatgaggtgcagcagcaggcccagctgagcaccatccgctccttcctgaagctgtacaccaccatgcctgtggccaagctggccggcttcctggacctgacagagcaggagttccgcatccagctgctggtgttcaagcacaagatgaagaacctggtgtggaccagcggcatcagcgccctggatggagagttccagagcgccagcgaggtggacttctacatcgacaaggacatgatccacatcgctgacaccaaggtggccaggagatatggagacttcttcatccggcagatccacaagtttgaggagctgaacagaaccctgaagaagatgggccagaggccctag

SEQ ID NO: 20789 - DNA, 789 bp, Artificial Sequence; identical to SEQ ID NO: 19488
  Description of Artificial Sequence: Synthetic coding sequence

SEQ ID NO: 20790 - DNA, 1626 bp, Artificial Sequence; identical to SEQ ID NO: 19205
  Description of Artificial Sequence: Synthetic coding sequence

SEQ ID NO: 20791 - DNA, 303 bp, Artificial Sequence
  Description of Artificial Sequence: Synthetic coding sequence
atgagcaccatcggcagctttgagggcttccaggccgtgtccctgaagcaggagggagatgaccagcccagcgagacagaccacctgtccatggaggaggaggaccccatgccccggcagatcagccggcagagctctgtgacagagagcaccctgtaccccaacccctaccaccagccctacatcagcaggaagtactttgccaccaggcctggggccatcgagacagccatggaggacctgaagggccacgtggccgagaccagcggggagaccatccagggcttctggctgctgacctag

SEQ ID NO: 20792 - DNA, 1425 bp, Artificial Sequence
  Description of Artificial Sequence: Synthetic coding sequence
atggagaggagcggccagagggtgaccacctgggactgtgaccagggcaagcacagcgacagcgactacagagaagatggcatggacctgggcagtgatgctggcagcagcagcagcagcagccgggccagcagccagagcaacagcaccaaggtgaccccctgcagcgagtgcaagagcagcagcagccctgggggcagcctggacctggtgtctgccctggaggactatgaggagcccttccctgtgtaccagaagaaggtgattgatgagtgggcccctgaggaggatggagaggaggaggaggaggaggatgagcgggaccagaggggctacagagatgacaggagccctgcccgggagcctggagatgtgtctgcccggaccaggtctgggggcggcggcggccgcagcgccaccacagccatgcctcctcctgtgcccaatggaaacctgcaccagcacgacccccaggacctgcggcacaatggaaatgtggtggtggccggccggcccagctgcagccggggcccccggcgggccatccagaagccccagcctgctgggggcagaagaagtggccggggccctgctgctgggggcctgtgcctgcagcccccagatggcggcacctgtgtgcctgaggagccccctgtgccccccatggactgggaggccctggagaagcacctggccggcctgcagttccgggagcaggaggcccagaagaatgaaagagagagcatccggcagaagctggccctgggcagcttctttgatgatggccctggcatctacaccagctgcagcaagagcggcaagcccagcctgagcagccggctgcagagcggcatgaacctgcagatctgctttgtgaatgattctggcagtgacaaggacagtgatgctgatgacagcaagacagagaccagcctggacacccccctgagccccatgagcaagcagagcagcagctacagcgaccgggacaccacagaggaggagagcgagagcctggatgacatggacttcctgacccggcagaagaagctgcaggccgaggccaagatggccctggccatggccaagcccatggccaagatgcaggtggaggtggagaagcagaacaggaagaagagccctgtggccgacctgctgccccacatgccccacatcagcgagtgcctgatgaagaggagcctgaagcccacagacctgcgggacatgaccatcggccagctgcaggtgattgtgaatgacctgcacagccagatcgagagcctgaatgaggagctggtgcagctgctgctgatcagagatgagctgcacacagagcaggatgccatgctggtggacatcgaggacctgaccaggcatgctgagagccagcagaagcacatggccgagaagatgcctgccaagtag

SEQ ID NO: 20793 - DNA, 690 bp, Artificial Sequence
  Description of Artificial Sequence: Synthetic coding sequence
atgcagcagagggtgctggagctgatcccccagatcgccaatgagcagctgacagaggagctgctgattgtgaatgacaacctgaacaacgtgttcctgcggcatgaaagatttgagcgcttcagaacaggccagaccaccaaggcccccagcgaggccgagcctgctgctgacctgattgacatgggccctgaccctgctgccactggaaacctgagcagccagctggccggcatgaacctgggcagcagctctgtgcgggccggcctgcagagcctggaggccagcggccgcctggaggatgaatttgacatgtttgccctgacccggggcagcagcctggccgaccagaggaaggaggtgaagtatgaggccccccaggccacagatggcctggccggggccctggatgcccggcagcagagcactggagccatccctgtgacccaggcctgcctgatggaggacatcgagcagtggctgagcacagatgtgggcaatgatgctgaggagcccaagggcgtgaccagcgaggagtttgacaagttcctggaggagcgggccaaggctgctgaccggctgcccaacctgagcagccccagcgctgagggccccccaggcccccccagcggccctgcccccaggaagaagacccaggagaaggatgatgacatgctgtttgccctgtag

SEQ ID NO: 20794 - DNA, 1650 bp, Artificial Sequence
  Description of Artificial Sequence: Synthetic coding sequence
atgagccgggtggccaagtaccgccggcaggtgtctgaagatcctgacatcgacagcctgctggagaccctgagccctgaggagatggaggagctggagaaggagctggatgtggtggaccctgatggctctgtgcctgtgggcctgcggcagaggaaccagacagagaagcagagcactggagtgtacaaccgggaggccatgctgaacttctgtgagaaggagaccaagaagctgatgcagcgggagatgtccatggatgagagcaagcaggtggagaccaagacagatgccaaggaggagaagatcatccggggcatcgacaagggccgggtgcgggctgctgtggacaagaaggaggccggcaaggatggccgcggggaggagagagctgtggccaccaagaaggaggaggagaagaagggcagtgacaggaacacaggcctgagccgggacaaggacaagaagcgggaggagatgaaggaggtggccaagaaggaggatgatgagaaggtgaagggggagaggaggaacacagacaccaggaaggagggggagaagatgaagagagctgggggcaacacagacatgaagaaggaggatgagaaggtgaagaggggcaccggcaacacagacaccaagaaggatgatgagaaggtgaagaagaatgagcccctgcacgagaaggaggccaaggatgacagcaagaccaagaccccagagaagcagacccccagcggccccaccaagcccagcgagggccctgccaaggtggaggaggaggccgcccccagcatctttgatgagcccctggagcgggtgaagaacaatgaccctgagatgacagaggtgaatgtgaacaacagcgactgcatcaccaatgagatcctggtgcgcttcacagaggccctggagttcaacacagtggtgaagctgtttgccctggccaacaccagggcagatgaccacgtggcctttgccatcgccatcatgctgaaggccaacaagaccatcaccagcctgaacctggacagcaaccacatcaccgggaagggcatcctggccatcttccgggccctgctgcagaacaacaccctgacagagctgcgcttccacaaccagaggcacatctgtggcggcaagacagagatggagatcgccaagctgctgaaggagaacaccaccctgctgaagctgggctaccactttgagctggccggccccaggatgacagtgaccaacctgctgagcaggaacatggacaagcagaggcagaagaggctgcaggagcagaggcaggcccaggaggccaagggggagaagaaggacctgctggaggtgcccaaggccggggctgtggccaagggcagccccaagcccagcccccagcccagccccaagcccagccccaagaacagccccaagaagggcggggccccagctgcccctcctcctcctcctccacccctggccccacccctcatcatggagaacctgaagaacagcctgagccctgccacccagaggaagatgggagacaaggtgctgcctgcccaggagaagaacagccgggaccagctgctggccgccatccgcagcagcaacctgaagcagctgaagaaggtggaggtgcccaagctgctgcagtag

SEQ ID NO: 20795 - DNA, 231 bp, Artificial Sequence
  Description of Artificial Sequence: Synthetic coding sequence
atgtctgccagctgtgatggctgtgtgggcagcaggcctcctgtgcacctggccagcggctacagcctggccgacctgctggtgctggagatgggcatgggcacccagtgctggacagaggaccagaggcgctggagcagcctgtggccctggagccacctgagcagtgaccccagcctgcccaacgtgcaggtgacccggctgaccctgctgtctgagcaggccccctag

SEQ ID NO: 20796 - DNA, 1416 bp, Artificial Sequence
  Description of Artificial Sequence: Synthetic coding sequence
atggccaacagctttgctgcccgcatcttcaccaccctgagtgacctgcagaccaacatggccaacctgaaggtgattggcatcgtcatcggcaagacagatgtgaagggcttcccagacaggaagaacatcggcagcgagcgctacaccttctccttcaccatccgggacagccctgcccactttgtgaatgctgcctcctggggcaatgaagactacatcaagagcctgagtgacagcttccgggtgggggactgtgtgatcatcgagaaccccctcatccagaggaaggagattgagcgggaggagaagttctccccagccacccccagcaactgcaagctgctgctgtctgagaaccacagcacagtgaaggtgtgcagcagctatgaggtggacaccaagctgctgagcctcatccacctgcctgtgaaggagagccatgactactacagcctgggggacatcgtggccaacggccacagcctgaatggccgcatcatcaacgtgctggccgctgtgaagtctgtgggggagcccaagtacttcaccaccagtgacaggaggaagggccagagatgtgaggtgcggctgtatgatgaaacagagagcagctttgccatgacctgctgggacaatgaaagcatcctgctggcccagagctggatgccccgggagaccgtcatctttgccagtgatgtgcgcatcaactttgacaagttcaggaactgcatgacagccaccgtcatcagcaagaccatcatcaccaccaacccagacatccctgaggccaacatcctgctgaacttcatccgggagaacaaggagaccaacgtgctggatgatgaaattgacagctacttcaaggagagcatcaacctgagcaccatcgtggatgtgtacacagtggagcagctgaagggcaaggccctgaagaatgaaggcaaggctgaccccagctatggcatcctgtatgcctacatcagcaccctgaacattgatgatgagaccaccaaggtggtgaggaaccgctgcagcagctgtggctacatcgtgaatgaggccagcaacatgtgcaccacctgcaacaagaacagcctggacttcaagtctgtgttcctgtccttccacgtgctgattgacctgacagaccacacaggcaccctgcacagctgcagcctgactggatctgtggccgaggagaccctgggctgcaccgtgcatgagttcctggccatgacagatgagcagaagacagccctgaagtggcagttcctgctggagaggagcaagatctacctgaagtttgtgctgagccaccgggcccggagcggcctgaagatctctgtgctgagctgcaagctggccgaccccacagaggccagcaggaacctgagcggccagaagcacgtgtag

SEQ ID NO: 20797 - DNA, 747 bp, Artificial Sequence
  Description of Artificial Sequence: Synthetic coding sequence
atggccaccagcgcccccctgcggagcctggaggaggaggtgacctgcagcatctgcctggactacctgcgggaccctgtgaccatcgactgtggccacgtgttctgccgcagctgcaccacagatgtgcggcccatcagcggcagcaggcctgtgtgccccctgtgcaagaagcccttcaagaaggagaacatccggcctgtgtggcagctggccagcctggtggagaacatcgagcggctgaaggtggacaagggccggcagcctggagaggtgacccgggagcagcaggatgccaagctgtgtgagcggcaccgggagaagctgcactactactgtgaagatgatggcaagctgctgtgtgtgatgtgccgggagagccgggagcaccggccccacacagctgtgctgatggagaaggccgcccagccccaccgggagaagatcctgaaccacctgagcaccctgcggcgggaccgggacaagatccagggcttccaggccaagggggaggccgacatcctggccgccctgaagaagctgcaggaccagaggcagtacatcgtggccgagtttgagcagggccaccagttcctgcgggagcgggaggagcacctgctggagcagctggccaagctggagcaggagctgacagagggccgggagaagttcaagagccggggcgtgggggagctggcccggctggccctggtgatcagcgagctggagggcaaggcccagcagtag

SEQ ID NO: 20798 - DNA, 2646 bp, Artificial Sequence
  Description of Artificial Sequence: Synthetic coding sequence
atgttctggaagtttgacctgcacaccagcagccacctggacaccctgctggagcgggaggacctgagcctgcctgagctgctggatgaagaagatgtgctgcaggagtgcaaggtggtgaacaggaagctgctggacttcctgctgcagcccccccacctgcaggccatggtggcctgggtgacccaggagcccccagacagcggggaggagcggctgcgctacaagtaccccagcgtggcctgtgagatcctgaccagtgatgtgccccagatcaatgatgccctgggcgcagatgagagcctgctgaaccggctgtatggcttcctgcagagcacaggcagcctgaaccccctgctggccagcttcttcagcaaggtgatgggcatcctgatcaacaggaagacagaccagctggtgtccttcctgaggaagaaggatgactttgtggacctgctgctgcagcacatcggcaccagcgccatcatggacctgctgctgcggctgctgacctgtgtggagcggccccagctgcggcaggatgtggtgaactggctgaatgaggagaagatcgtgcagaggctcatcgagcagatccaccccagcaaggatgagaaccagcacagcaatgccagccagagcctgtgtgacatcatccggctgagccgggagcagatgatccaggtgcaggacagccctgagccagaccagctgctggccaccctggagaagcaggagaccatcgagcagctgctgagcaacatgtttgaaggagagcagagccagagcgtgattgtgtctggcatccaggtgctgctgaccctgctggagccccggcggcccaggtctgagagcgtgacagtgaacagcttcttcagctctgtggatggccagctggagctgctggcccagggcgccctggagagcacagtgtcctctgtgggcgccctgcacgccctgcggccccggctgagctgcttccaccagctgctgctggagccccccaagctggagcccctgcagatgacctggggcatgctggccccacccctgggcaacacccggctgcacgtggtgaagctgctggccagcgccctgagcgccaatgatgctgccctgacccatgagctgctggccctggatgtgcccaacaccatgctggacctcttcttccactacgtgttcaacaacttcctgcacgcccaggtggagggctgtgtgtccaccatgctgagcctgggccccccaccagacagcagccctgagacccccatccagaaccctgtggtgaagcacctgctgcagcagtgccgcctggtggagcgcatcctgacctcctgggaggagaatgacagagtgcagtgtgccggcggccccaggaagggctacatgggccacctgaccagggtggccggggccctggtgcagaacacagagaagggccccaatgctgagcagctgcggcagctgctgaaggagctgcccagcgagcagcaggagcagtgggaggcctttgtgtctggccccctggccgagaccaacaagaagaacatggtggacctggtgaacacccaccacctgcacagcagcagtgatgatgaagatgaccggctgaaggagttcaacttccctgaggaggccgtgctgcagcaggccttcatggacttccagatgcagaggatgaccagcgccttcatcgaccacttcggcttcaatgatgaggagtttggagagcaggaggagagcgtgaatgccccctttgacaagacagccaacatcaccttcagcctgaatgctgatgatgagaaccccaatgccaacctgctggagatctgctacaaggaccgcatccagcagtttgatgatgatgaggaggaggaggatgaggaggaggcccagggcagcggggagagtgatggagaagatggagcctggcagggcagccagctggcccggggggcccggctgggccagcccccaggagtgcgcagcggcggcagcacagacagtgaagatgaggaggaggaggatgaggaggaggaggaggatgaggagggcatcggctgtgccgcccggggcggggccacccccctgagctaccccagccctggcccccagcccccaggccccagctggacagccacctttgatcctgtgcccacagatgcccccaccagcccccgggtgtctggagaggaggagctgcacactggacctccagccccccagggccccctgtctgtgccccagggcctgcccacccagagcctggccagccccccagccagagatgccctgcagctgcggagccaggaccccaccccaccttctgccccccaggaggccacagagggcagcaaggtgacagagcccagcgccccctgccaggccctggtgtccattggagacctgcaggccaccttccacggcatccgcagcgcccccagcagcagtgacagcgccacccgggaccccagcacctctgtgcctgccagcggggcccaccagcccccccagaccacagaaggagagaagagccctgagcccctgggcctgccccagagccagagcgcccaggccctgaccccaccacccatccccaacggcagcgcccctgagggccctgccagccctggcagccagtag

SEQ ID NO: 20799 - DNA, 354 bp, Artificial Sequence
  Description of Artificial Sequence: Synthetic coding sequence
atgaagttccagtacaaggaggtgcacccctttgagtacaggaagaaggagggggagaagatcaggaagaagtacccagacagagtgcccctcatcgtggagaaggcccccaaggcccgggtgcctgacctggacaggaggaagtacctggtgcccagcgacctgacagatggccagttctacctgctgatcaggaagaggatccacctgcggccagaagatgccctcttcttctttgtgaacaacaccatcccccccaccagcgccaccatgggccagctgtatgaggacagccatgaagaagatgacttcctgtatgtggcctacagcaatgaatctgtgtatggcaagtag

SEQ ID NO: 20800 - DNA, 1089 bp, Artificial Sequence
  Description of Artificial Sequence: Synthetic coding sequence
atgagggagatcgtgcacctgcaggccggccagtgtggcaaccagatcggggccaagttctgggaggtgatcagtgatgagcacggcatcgaccccaccggcacctaccatggagacagcgacctgcagctggagcgcatcaacgtgtactacaatgaggccactggaggcaactacgtgcccagggctgtgctggtggacctggagcccggcaccatggattctgtgcgcagcggccccttcggccagatcttccggccagacaactttgtgtttggccagagcggggccggcaacaactgggccaagggccactacacagaaggagctgagctggtggatgctgtgctggatgtggtgaggaaggaggccgagagctgtgactgcctgcagggcttccagctgaccacccccacctacggggacctgaaccacctggtgtctgccaccatgtctggagtgaccacctgcctgcgcttccctggccagctgaatgctgacctgaggaagctggccgtgaacatggtgcccttcccccggctgcacttcttcatgcctggctttgcccccctgaccagccggggcagccagcagtaccgggccctgactgtgcctgagctgacccagcagatgtttgatgccaagaacatgatggccgcctgtgaccccaggcatggccgctacctgactgtggccgctgtgttccggggccgcatgtccatgaaggaggtggatgagcagatgctgtctgtgcagagcaagaacagcagctactttgtggagtggatccccaacaacgtgaagacagctgtgtgtgacatccccccccggggcctgaagatggccgccaccttcatcggcaacagcacagccatccaggagctgttcaagaggatcagcgagcagttcaccgccatgttccggaggaaggccttcctgcactggtacacaggagagggcatggatgagatggagttcacagaagctgagagcaacatgaatgacctggtgtctgagtaccagcagtaccaggatgccacagctgaggagggggagtttgaggaggaggccgaggaggaggtggcctag

SEQ ID NO: 20801 - DNA, 654 bp, Artificial Sequence
  Description of Artificial Sequence: Synthetic coding sequence
atggaggagaccatgaagctggccaccatggaggacacagtggagtactgcctcttcctgatcccagatgagagccgggacagcgacaagcacaaggagatcctgcagaagtacatcgagcgcatcatcaccaggtttgcccccatgctggtgccctacatctggcagaaccagcccttcaacctgaagtacaagccaggcaagggcggcgtgcctgcccacatgtttggagtgaccaagtttggagacaacattgaagatgagtggttcatcgtgtatgtgatcaagcagatcaccaaggagttccctgagctggtggccagcaccaacagagtcttcttctgccacggggagctgtgcatcatcccagcccccaggaagagcggggctgagagctggctgcccaccaccccacccaccatcccccaggccctgaacatcatcacagcccacagcgagaagatcctggccagcgagagcatccgggctgctgtgaacagacgcatccggggctacccagagaagatccaggccagcctgcaccgggcccactgcttcctgcctgctggcatcgtggccgtgctgaagcagaggccccggctggtggccgctgctgtgcaggccttctacctgcgggaccccatcgacctgtag

SEQ ID NO: 20802 - DNA, 1188 bp, Artificial Sequence; identical to SEQ ID NO: 20054
  Description of Artificial Sequence: Synthetic coding sequence

SEQ ID NO: 20803 - DNA, 102 bp, Artificial Sequence
  Description of Artificial Sequence: Synthetic coding sequence
atgagcatcagcagtgatgaggtgaacttcctggtgtaccgctacctgcaggagagcggcttcagccacagcgccttcaccttcggcatcgagagccactag

SEQ ID NO: 20804 - DNA, 1242 bp, Artificial Sequence
  Description of Artificial Sequence: Synthetic coding sequence
atgtttgccagtgacctgctgcgggccctggactgctgccctggggccggcagcagcggcctgctgccccagctgggcccccggcagctgctggccttcaccgtgaactgcctgggcaaccaccgctacctgggcttctttgaggacctggagcagaggcacaaggcccaggtgctggtggaggacatcagtgacatcctggaggagcacgccgagaagcacttccacccctacatcgcctactgcagcaatgaggtgtaccagcagaggaccctgcagaagctgatcagcagcaatgctgccttccgggaggccctgcgggagattgaaagaagacctgcctgtggcggcctgcccatgctgtccttcctgatcctgcccatgcagagggtgacccggctgcccctgctgatggacaccctgtgcctgaagacccagggccacagcgagcgctacaaggccgccagccgggccctgaaggccatcagcaagctggtgcggcagtgcaatgaaggagcccacaggatggagaggatggagcagatgtacaccctgcacacccagctggacttcagcaaggtgaagagcctgcccctcatcagcgccagccgctggctgctgaagagaggagagctgttcctggtggaggagaccggcctcttcaggaagatcgccagccggcccacctgctacctgttcctgttcaatgatgtgctggtggtgaccaagaagaagtctgaggagagctacatggtgcaggactatgcccagatgaaccacatccaggtggagaagattgagcccagcgagctgcccctgcccggcggcggcaacagaagcagctctgtgccccaccccttccaggtgaccctgctgagaaattctgagggccggcaggagcagctgctgctgagcagtgacagcgccagtgaccgggcccgctggatcgtggccctgacccacagcgagcggcagtggcagggcctgagcagcaagggggacctgccccaggtggagatcaccaaggccttctttgccaagcaggctgatgaggtgaccctgcagcaggctgatgtggtgctggtgctgcagcaggaggatggctggctgtatggagagcggctgagagatggagagaccggctggttcccagaagattttgcccgcttcatcaccagccgggtggccgtggagggcaatgtgcggaggatggagcggctgcgggtggagacagatgtgtag

SEQ ID NO: 20805 - DNA, 1890 bp, Artificial Sequence
  Description of Artificial Sequence: Synthetic coding sequence
atggaggagagccccctgagccgggcccccagcagaggaggagtgaacttcctgaatgtggcccggacctacatccccaacaccaaggtggagtgccactacaccctgcccccaggcaccatgcccagcgccagtgactggattggcatcttcaaggtggaggccgcctgtgtgcgggactaccacacctttgtgtggagctctgtgcctgagagcaccacagatggcagccccatccacacctctgtgcagttccaggcctgcaaccagctggatgagagccagcaggagagaaatgacctgatgcagctgaagctgcagctggagggccaggtgacagagctgcggagccgggtgcaggagctggagcgggccctggccacagcccggcaggagcacacagagctgatggagcagtacaagggcatcagccgcagccatggagagatcacagaggagcgggacatcctgagccggcagcagggcgaccacgtggcccgcatcctggagctggaggatgacatccagaccatcagcgagaaggtgctgaccaaggaggtggagctggaccggctgcgggacacagtgaaggccctgacccgggagcaggagaagctgctgggccagctgaaggaggtgcaggccgacaaggagcagagcgaggccgagctgcaggtggcccagcaggagaaccaccacctgaacctggacctgaaggaggccaagtcctggcaggaggagcagagcgcccaggcccagaggctgaaggacaaggtggcccagatgaaggacaccctgggccaggcccagcagagggtggccgagctggagcccctgaaggagcagctgcggggggcccaggagctggccgccagcagccagcagaaggccaccctgctgggggaggagctggccagcgctgctgctgcccgggacaggaccatcgccgagctgcacaggagccggctggaggtggccgaggtgaatggccgcctggccgagctgggcctgcacctgaaggaggagaagtgccagtggagcaaggagagagctggcctgctgcagagcgtggaggccgagaaggacaagatcctgaagctgtctgctgagatcctgcggctggagaaggctgtgcaggaggagaggacccagaaccaggtgttcaagacagagctggcccgggagaaggacagcagcctggtgcagctgtctgagagcaagcgggagctgacagagctgcggagcgccctgcgggtgctgcagaaggagaaggagcagctgcaggaggagaagcaggagctgctggagtacatgaggaagctggaggcccggctggagaaggtggctgatgagaagtggaatgaagatgccaccacagaagatgaggaggccgctgtgggcctgagctgcccagctgccctgacagattctgaagatgagagccctgaggacatgaggctgcccccctacggcctgtgtgagcggggggaccccggcagcagccctgctggcccccgggaggccagccccctggtggtgatcagccagcctgcccccatcagcccccacctgagcggccctgctgaggacagcagcagtgacagcgaggccgaggatgagaagtctgtgctgatggctgctgtgcagagcggcggggaggaggccaacctgctgctgcctgagctgggcagcgccttctatgacatggccagcggcttcaccgtgggcaccctgtctgagaccagcactggaggccctgccacccccacctggaaggaatgtcccatctgcaaggagcgcttccctgctgagagtgacaaggatgccctggaggaccacatggatggccacttcttcttcagcacccaggaccccttcacctttgaatag

SEQ ID NO: 20806 - DNA, 2451 bp, Artificial Sequence
  Description of Artificial Sequence: Synthetic coding sequence
atgcccctgagcagccccaatgctgctgccacagccagtgacatggacaagaacagcggcagcaacagcagcagcgccagcagcggcagcagcaagggccagcagccccccaggtctgccagcgctggccctgctggggagagcaagcccaagagtgatggcaagaacagcagcggcagcaagcgctacaacaggaagcgggagctgagctaccccaagaatgaaagcttcaacaaccagagccgccgcagcagcagccagaagagcaagaccttcaacaagatgccaccccagaggggcggcggcagcagcaagctgttcagcagcagcttcaacggcggcagaagagatgaggtggccgaggcccagagagctgagttctccccagcccagttcagcggccccaagaagatcaacctgaaccacctgctgaacttcacctttgagccccggggccagacaggccactttgagggcagcggccacggctcctggggcaagaggaacaagtggggccacaagcccttcaacaaggagctgttcctgcaggccaactgccagtttgtggtgtctgaggaccaggactacacagcccactttgctgaccctgacaccctggtgaactgggactttgtggagcaggtgcgcatctgcagccatgaggtgcccagctgccccatctgcctgtacccacccacagctgccaagatcacccgctgtggccacatcttctgctgggcctgcatcctgcactacctgagcctgtctgagaagacctggagcaagtgccccatctgctacagctctgtgcacaagaaggacctgaagtctgtggtggccacagagagccaccagtatgtggtgggggacaccatcaccatgcagctgatgaagcgggagaagggcgtgctggtggccctgcccaagagcaagtggatgaatgtggaccaccccatccacctgggagatgagcagcacagccagtacagcaagctgctgctggccagcaaggagcaggtgctgcaccgggtggtgctggaggagaaggtggccctggagcagcagctggccgaggagaagcacaccccagagagctgcttcatcgaggccgccatccaggagctgaagacccgggaggaggccctgagcggcctggccggcagcagaagagaggtgactggagtggtggccgccctggagcagctggtgctgatggcccccctggccaaggagagcgtcttccagcccaggaagagcctgctgcagcagggcgtgctggagtacctgagcgcctttgatgaggagaccacagaggtgtgcagcctggacacccccagccggcccctggccctgcccctggtggaggaggaggaggccgtgtctgagcctgagcctgagggcctgcctgaggcctgtgatgacctggagctggctgatgacaacctgaaggagggcaccatctgcacagagagcagccagcaggagcccatcaccaagagcggcttcacccggctgagcagcagcccctgctactacttctaccaggctgaagatggccagcacatgttcctgcaccctgtgaatgtgcgctgcctggtgcgggagtatggcagcctggagaggagccctgagaagatcagcgccaccgtggtggagattgctggctacagcatgtctgaagatgtgcggcagaggcaccgctacctgagccacctgcccctgacctgtgagttcagcatctgtgagctggccctgcagccccctgtggtgtccaaggagaccctggagatgttcagtgatgacatcgagaagaggaagaggcagaggcagaagaaggcccgggaggagcggcggcgggagaggagaattgaaattgaggagaacaagaagcagggcaagtacccagaggtgcacatccccctggagaacctgcagcagtttcctgccttcaacagctacacctgcagcagtgacagcgccctgggccccaccagcacagagggccatggagccctgagcatcagccccctgagccgcagccctggcagccatgctgacttcctgctgacccccctgagccccacagccagccagggcagccccagcttctgtgtgggcagcctggaggaggacagccccttccccagctttgcccagatgctgcgggtgggcaaggccaaggcagatgtgtggcccaagacagcccccaagaaggatgagaacagcctggtgcccccagcccctgtggacagtgatggagagagtgacaacagcgacagagtgcctgtgcccagcttccagaacagcttcagccaggccatcgaggccgccttcatgaagctggacaccccagccaccagtgaccccctgtctgaggagaagggcggcaagaagaggaagaagcagaagcagaagctgctcttcagcacctctgtggtgcacaccaagtag

SEQ ID NO: 20807 - DNA, 429 bp, Artificial Sequence
  Description of Artificial Sequence: Synthetic coding sequence
atggccagccctgggaaggacaactacaggatgaagagctacaagaacaaggccctgaacccccaggagatgagaagaagaagagaggaggagggcatccagctgaggaagcagaagcgggaggagcagctgttcaagagaagaaatgtgtacctgcccagaaatgatgagagcatgctggagagccccatccaggaccctgacatcagcagcacagtgcccatccctgaggaggaggtggtgaccacagacatggtgcagatgatcttcagcaacaatgctgaccagcagctgacagccacccagaagttcaggaagctgctgagcaaggagcccaacccccccatcgaccaggtgatccagaagccaggagtggtgcagagatttgtgaagttcctggagagaaatgaaaactgcaccctgcagtag

SEQ ID NO: 20808 - DNA, 297 bp, Artificial Sequence
  Description of Artificial Sequence: Synthetic coding sequence
atgtctgagcagggcgacctgaaccaggccatcgccgaggagggcggcacagagcaggagacagccaccccagaaaatggcatcgtgaagtctgagagcctggatgaggaggagaagctggagctgcagaggcggctggaggcccagaaccaggagaggaggaagagcaagagcggggccggcaagggcaagctgaccaggagcctggccgtgtgtgaggagagcagcgcccggcctggaggagagagcctgcaggaccaggagagcatccacctgcagctgagcagcttctcctag

SEQ ID NO: 20809 - DNA, 1917 bp, Artificial Sequence
  Description of Artificial Sequence: Synthetic coding sequence
atggagaacctgcagaccaacttcagcctggtgcagggcagcaccaagaagctgaatggcatgggagatgatggcagccccccagccaagaagatgatcacagacatccacgccaacgggaagaccatcaacaaggtgcccaccgtgaagaaggagcacctggatgattatggagaggcccctgtggagacagatggagagcacgtgaagaggacctgcacctctgtgcctgagaccctgcacctgaaccccagcctgaagcacaccctggcccagttccacctgagcagccagagcagcctgggcggccctgctgccttcagcgcccggcacagccaggagagcatgagccccaccgtcttcctgcccctgcccagcccccaggtgctgcccggccccctgctgatccccagcgacagcagcacagagctgacccagacagtgctggagggggagagcatcagctgcttccaggtgggcggggagaagaggctgtgcctgccccaggtgctgaacagcgtgctgcgggagttcaccctgcagcagatcaacacagtgtgtgatgagctgtacatctactgcagccgctgcaccagtgaccagctgcacatcctgaaggtgctgggcatcctgcccttcaatgcccccagctgtggcctcatcaccctgacagatgcccagaggctgtgcaatgccctgctgcggcccaggaccttcccccagaatggatctgtgctgcctgccaagagcagcctggcccagctgaaggagaccggcagcgcctttgaggtggagcatgaatgtctgggcaagtgccagggcctgtttgccccccagttctacgtgcagccagatgccccctgcatccagtgcctggagtgctgcggcatgtttgccccccagacctttgtgatgcacagccacaggagcccagacaagaggacctgccactggggctttgagagcgccaagtggcactgctacctgcacgtgaaccagaagtacctgggcaccccagaggagaagaagctgaagatcatcctggaggagatgaaggagaagttctccatgaggtctgggaagaggaaccagagcaagacagatgcccccagcggcatggagctgcagagctggtaccctgtgatcaagcaggagggggaccacgtgtcccagacccacagcttcctgcaccccagctactacctgtacatgtgtgacaaggtggtggcccccaacgtgtccctgaccagcgctgtgtcccagagcaaggagctgaccaagacagaggccaatgccagcatcagcaacaacagcaccagcaagaggaagtctgagagcgccacctgcaacctggtgcgggacatcaacaaggtgggcatcggcctggtggccgccgccagcagccccctgctggtgaaggatgtgatctgtgaagatgacaagggcaagatcatggaggaggtgatgaggacctacctgaagcagcaggagaagctgaacctgatcctgcagaagaagcagcagctgcagatggaggtgaagatgctgagcagcagcaagtccatgaaggagctgacagaggagcagcagaacctgcagaaggagctggagagcctgcagaatgaacatgcccagaggatggaggagttctacgtggagcagaaggacctggagaagaagctggagcagatcatgaagcagaagtgcacctgtgacagcaacctggagaaggacaaggaggccgagtatgccggccagctggccgagctgcggcagaggctggaccatgctgaggccgaccggcaggagctgcaggatgagctgcggcaggagcgggaggcccggcagaagctggagatgatgatcaaggagctgaagctgcagatcctgaagagcagcaagacagccaaggagtag

SEQ ID NO: 20810 - DNA, 1530 bp, Artificial Sequence
  Description of Artificial Sequence: Synthetic coding sequence
atgaagaggggccgcctgcccagcagcagtgaagattctgatgacaatggcagcctgagcaccacctggagccagaacagccgcagccagcaccggcgcagcagctgcagcagacatgaggacaggaagcccagcgaggtgttcagaacagacctgatcacagccatgaagctgcatgacagctaccagctgaacccagatgagtactacgtgctggccgacccctggaggcaggagtgggagaagggcgtgcaggtgcctgtgtccccaggcaccatcccccagcctgtggcccgggtggtgtctgaggagaagagcctgatgttcatccggcccaagaagtacatcgtgagcagcggcagcgagcccccagagctgggctacgtggacatccgcaccctggccgacagcgtgtgccgctatgacctgaatgacatggatgctgcctggctggagctgaccaatgaggagttcaaggagatgggcatgcctgagctggatgagtacaccatggagcgggtgctggaggagtttgagcagcgctgctatgacaacatgaaccacgccatcgagacagaggagggcctgggcatcgagtatgatgaagatgtggtgtgtgatgtgtgccagagcccagatggagaagatggaaatgagatggtgttctgtgacaagtgcaacatctgtgtgcaccaggcctgctacggcatcctgaaggtgcctgagggctcctggctgtgcaggacctgtgccctgggcgtgcagcccaagtgcctgctgtgccccaagaagggcggggccatgaagcccaccaggagcggcaccaagtgggtgcacgtgtcctgtgccctgtggatccctgaggtgtccatcggcagccctgagaagatggagcccatcaccaaggtgagccacatccccagcagccgctgggccctggtgtgcagcctgtgcaatgagaagtttggagccagcatccagtgcagcgtgaagaactgcaggacagccttccacgtgacctgtgcctttgaccggggcctggagatgaagaccatcctggctgaaaatgatgaggtgaagttcaagagctactgccccaagcacagcagccacaggaagccagaggagagcctgggcaagggggccgcccaggagaatggagcccctgagtgcagccccaggaaccccctggagccctttgccagcctggagcagaaccgggaggaggcccaccgggtgtctgtgaggaagcagaagctgcagcagctggaggatgagttctacacctttgtgaacctgctggatgtggcccgggccctgcggctgcctgaggaggtggtggacttcctgtaccagtactggaagctgaagaggaaggtgaacttcaacaagcccctcatcacccccaagaaggatgaggaggacaacctggccaagcgggagcaggatgtgctcttccggcggctgcagctgttcacccacctgcggcaggacctggagcgggtgatgattgacacagacaccctgtag

SEQ ID NO: 20811 - DNA, 354 bp, Artificial Sequence
  Description of Artificial Sequence: Synthetic coding sequence
atggccttcagcggccgggcccggccctgcatcatcccagaaaatgaggagatccccagggctgccctgaacacagtgcatgaggccaacggcacagaagatgaaagagctgtgtccaagctgcagaggaggcacagtgatgtgaaggtgtacaaggagttctgtgacttctacgccaagttcaacatggccaatgccctggccagcgccacctgtgagcgctgcaagggcggctttgccccagctgagaccatcgtgaacagcaatggagagctgtaccacgagcagtgctttgtgtgtgcccagtgcttccagcagtttcctgagggcctcttctatgaggagaggacatag

SEQ ID NO: 20812 - DNA, 1110 bp, Artificial Sequence
  Description of Artificial Sequence: Synthetic coding sequence
atgaaggacacccaggacatccaggaggccagcaaggccatgcagaacaaggtgcatgagcaggaggacaagaatgagaagcagaagcagcgggaggacaagctgggcgtgtacagcctggtgcacttcagccccaagatgctgggctctgtggccaccaccctgcccctgagcagcagcaacagcagcggcatgcccctgggctactacctgagcagcccccagatcagccgggtgaccatcagcaccaccggccagctgaccagcaaggccaccgtgggcagctgcagccgggtggagaacagcctggatgccagccccttctctgtgcccaagaagcaggatgagagccccatgattggagatggagaggactacttcctgagcctgtttggagacagcaagaagctgacagcccacagcaactacacccagaagaccctgaagtacttctccatgatcctggaggaggtgggccagttcaccagcagcagcctgggagatgtggagattgctgaggtgaatgtgaagggcctgtttgtgaagctgatcaacagcagcctggacaaggagatggccatcggggaccacatcctgcagcagaatgtgaatggccagaccatcagcctgtaccgcttcctgcccaacatcgtgatgcaggccaacagcacagtgacagccatcgcctggtacacccccatccactggaagcaggcctgggagaagctggatgctgatgtggagttcaaccgctgcagcgtggtgagccccaccttcaggaagagggtcttccagtggacagccagcacagccaccatcaccaaggagaagcaggaccagcccaagaaggacatcagcaactaccaggtggagcaggcccaggtgctgctgaagcgggagaaggagatcccccccaccgtcttccccaacagaagcccctggtgccagaacccctacgtgtctgcccacccctactgccccctgattgagccccacaacaccagcacagctgggggccgcctggaccggcagcccaggaccaggagcacccggcccaacagagccagcggcagcaagaagaagaagaccagcgagagccagaagcagtag

SEQ ID NO: 20813 - DNA, 681 bp, Artificial Sequence
  Description of Artificial Sequence: Synthetic coding sequence
atggaccagagccgggtgctgctgtgggtgaaggccgagcccttcatcgtgggcgccctgcaggtgcccccacccagcaagttcagcctgcactacctgaggaagatcagcacctacgtgcagatccgggccacagaaggagcctacccccggctgtactggagcacctggaggcacatcgcctgtgggaagctgcagctggccaaggacctggcctggctgtactttgagatctttgacagcctgtccatgaagaccccagaggagcggctggagtggagcgaggtgctgagcaactgcatgtctgaggaggaggtggagaagcagaggaaccagctgtctgtggacaccctgcagttcctgctcttcctgtacatccagcagctgaacaaggtgtccctgcggaccagcctgattggagaggagtggcccagccccaggaacaagagccagagcccagacctgacagagaagagcaactgccacaacaagaactggaatgactacagccaccaggcctttgtgtatgaccacctgagtgacctgctggagctgctgctggaccccaagcagctgacagccagcttccacagcacccacagcagcctggtgtcccgggaggccgtggtggccctgtccttcctgattgagggcaccatcagccgggccaggaagatctag

SEQ ID NO: 20814 - DNA, 747 bp, Artificial Sequence
  Description of Artificial Sequence: Synthetic coding sequence
atgaatgaccggctgggagaagatgagagcctgctgatgaagctgtacagcttcctgctgaatgacagccccctgaaccccctgctggccagcttcttcagcaaggtgctgagcatcctgatcagcaggaagccagagcagatcgtggacttcctgaagaagaagcatgactttgtggacctgatcatcaagcacatcggcaccagcgccatcatggacctgctgctgcggctgctgacctgcatcgagcccccccagccccggcaggatgtgctgaactggctgaatgaggagaagatcatccagaggctggtggagatcgtgcaccccagccaggaggaggacagacacagcaatgccagccagagcctgtgtgaaattgtgcggctgagccgggaccagatgctgcagatccagaacagcacagagccagacctgctgctggccagcggcctgcctgacctgaatggagtgggcccccggggcctgctggtggacaacatgctgtggagccggctggtggtgtcctttgccagccacggccagggcctggcccccctggtggcccacgtggcctctgtggtgtggacctggtggctgctgcaccccaccgtggcctctgtggtgtggacctggtggctgctgcaccccacccagggcaacagcgtgctgctgcaccccacagactgctgggagcgggccagcggcaccttcctgtggggcatcatcctcttctgcctgtcctag

SEQ ID NO: 20815 - DNA, 1869 bp, Artificial Sequence; identical to SEQ ID NO: 19023
  Description of Artificial Sequence: Synthetic coding sequence

SEQ ID NO: 20816 - DNA, 4008 bp, Artificial Sequence
  Description of Artificial Sequence: Synthetic coding sequence
atggaggagatccctgtgaaggtggccgtgcgcatccggcccctgctgtgcaaggaggccctgcacaaccaccaggtgtgtgtgcgggtcatccccaacagccagcaggtgatcatcggccgggacagagtcttcacctttgattttgtgtttgggaagaacagcacccaggatgaggtgtacaacacctgcatcaagcccctggtgctgagcctgattgagggctacaatgccaccgtgtttgcctacggccagacaggcagcggcaagacctacaccatcggcggcggccacatcgcctctgtggtggagggccagaagggcatcatcccccgggccatccaggagatcttccagagcatcagcgagcaccccagcattgacttcaacgtgaaggtgtcctacatcgaggtgtacaaggaggacctgcgggacctgctggagctggagacctccatgaaggacctgcacatccgggaggatgagaagggcaacacagtcatcgtgggcgccaaggaatgtcatgtggagagcgctggggaggtgatgagcctgctggagatgggaaatgctgcccggcacacaggcaccacccagatgaatgagcacagcagccgcagccacgccatcttcaccatcagcatctgccaggtgcacaagaacatggaggccgcagaagatggctcctggtacagccccaggcacatcgtgtccaagttccactttgtggacctggccggcagcgagcgggtgaccaagacaggcaacacaggagagcgcttcaaggagagcatccagatcaacagcggcctgctggccctgggcaatgtcatcagcgccctgggggaccccaggaggaagagcagccacatcccctacagagatgccaagatcacccggctgctgaaggacagcctgggcggcagcgccaagacagtgatgatcacctgtgtgagccccagcagcagcaactttgatgagagcctgaacagcctgaagtatgccaacagagccaggaacatccggaacaagcccaccgtgaacttcagccctgagagtgacagaattgatgagatggagtttgagatcaagctgctgcgggaggccctgcagagccagcaggccggcgtgtcccagaccacccagatcaaccgggagggcagcccagacaccaaccgcatccacagcctggaggagcaggtggcccagctgcagggagaatgtctgggctaccagtgctgcgtggaggaggccttcaccttcctggtggacctgaaggacacagtgcggctgaatgagaagcagcagcacaagctgcaggagtggttcaacatgatccaggaggtgaggaaggctgtgctgaccagcttccggggcatcggcggcacagccagcctggaggagggcccccagcacgtgacagtgctgcagctgaagcgggagctgaagaagtgccagtgtgtgctggccgcagatgaggtggtgttcaaccagaaggagctggaggtgaaggagctgaagaaccaggtgcagatgatggtgcaggagaacaagggccatgctgtgtccctgaaggaggcccagaaggtgaaccggctgcagaatgagaagatcatcgagcagcagctgctggtggaccagctgtctgaggagctgaccaagctgaacctgtctgtgaccagcagcgccaaggagaactgtggagatggcccagatgcccgcatccctgagcggcggccctacacagtgccctttgacacccacctgggccactacatctacatccccagccggcaggacagcaggaaggtgcacaccagcccccccatgtacagcctggaccgcatctttgctggcttccgcaccaggagccagatgctgctgggccacatcgaggagcaggacaaggtgctgcactgccagttcagtgacaacagtgatgatgaggagagcgagggccaggagaagagcggcacccgctgccgcagccgctcctggatccagaagccagacagcgtgtgcagcctggtggagctgagtgacacccaggatgagacccagaagagtgacctggagaatgaagacctgaagattgactgcctgcaggagagccaggagctgaacctgcagaagctgaagaacagcgagcgcatcctgacagaggccaagcagaagatgagggagctgaccatcaacatcaagatgaaggaggacctgatcaaggagctgatcaagacaggaaatgatgccaagtctgtgtccaagcagtacagcctgaaggtgaccaagctggagcatgatgctgagcaggccaaggtggagctgattgagacccagaagcagctgcaggagctggagaacaaggacctgagtgatgtggccatgaaggtgaagctgcagaaggagttcaggaagaagatggatgctgccaagctgcgggtgcaggagatccagctgaagacaggccaggaggagggcctgaagcccaaggccgaggacctggatgcctgcaacctgaagaggaggaagggcagctttggcagcattgaccacctgcagaagctggatgagcagaagaagtggctggatgaggaggtggagaaggtgctgaaccagaggcaggagctggaggagctggaggccgacctgaagaagcgggaggccatcgtgtccaagaaggaggccctgctgcaggagaagagccacctggagaacaagaagctgcggagcagccaggccctgaacacagacagcctgaagatcagcacccggctgaacctgctggagcaggagctgtctgagaagaatgtgcagctgcagaccagcacagctgaggagaagaccaagatcagcgagcaggtggaggtgctgcagaaggagaaggaccagctgcagaagagaagacacaacgtggatgagaagctgaagaatggccgggtgctgagccctgaggaggagcacgtgctcttccagctggaggagggcatcgaggccctggaggccgccatcgagtacagaaatgaaagcatccagaaccggcagaagagcctgcgggccagcttccacaacctgagcagaggagaggccaacgtgctggagaagctggcctgcctgagccctgtggagatccgcaccatcctcttccgctacttcaacaaggtggtgaacctgcgggaggccgagaggaagcagcagctgtacaatgaggagatgaagatgaaggtgctggagcgggacaacatggtgcgggagctggagagcgccctggaccacctgaagctgcagtgtgaccggcggctgaccctgcagcagaaggagcacgagcagaagatgcagctgctgctgcaccacttcaaggagcaggatggagagggcatcatggagaccttcaagacctatgaggacaagatccagcagctggagaaggacctgtacttctacaagaagaccagccgggaccacaagaagaagctgaaggagctggtgggggaggccatccggcggcagctggcccccagcgagtaccaggaggccggagatggagtgctgaagccagagggcggcggcatgctgtctgaggagctgaagtgggccagcaggcctgagagcatgaagctgagcggccgggagcgggagatggacagcagcgccagcagcctgcggacccagcccaacccccagaagctgtgggaggacatccctgagctgccccccatccacagcagcctggcccctccttctggccacatgctgggcaatgaaaacaagacagaaacagatgacaaccagttcaccaagagccacagccggctgagcagccagatccaggtggtgggcaatgtgggccgcctgcatggagtgacccctgtgaagctgtgcaggaaggagctgcggcagatcagcgccctggagctgagcctgcggcgcagcagcctgggcgtgggcatcggctccatggctgctgacagcattgaggtgtccaggaagccccgggacctgaagacctag

SEQ ID NO: 20817 - DNA, 2745 bp, Artificial Sequence
  Description of Artificial Sequence: Synthetic coding sequence
atggaggagcgcatcaccaccctggagaagcgctacctggccgcccagcgggaggccaccagcatccatgacctgaatgacaagctggagaatgagctggccaacaaggagagcctgcaccggcagtgtgaggagaaggcccggcacctgcaggagctgctggaggtggccgagcagaagctgcagcagaccatgaggaaggccgagaccctgcctgaggtggaggccgagctggcccagagaattgctgccctgaccaaggccgaggagcggcacggcaacatcgaggagcacctgcggcagctggagggccagctggaggagaagaaccaggagctggcccgggtgcggcagcgggagaagatgaatgaagaccacaacaagaggctgagtgacacagtggaccggctgctgtctgagagcaatgaaaggctgcagctgcacctgaaggagaggatggccgccctggaggagaagaacaccctcatccaggagctggagagcagccagaggcagatcgaggagcagcaccaccacaagggccgcctgtctgaggagattgagaagctgcggcaggaggtggaccagctgaagggccggggcggcccctttgtggatggagtgcacagccgcagccacatgggcagcgctgctgatgtgcgcttcagcctgggcaccaccacccacgcccctcctggggtgcaccggcgctacagcgccctgcgggaggagagcgccaaggactgggagaccagccccctgcccggcatgctggccccagctgctggccctgcctttgacagcgaccctgagatcagtgatgtggatgaagatgagcccggcggcctggtgggcagcgcagatgtggtgagccccagcggccacagtgatgcccagaccctggccatgatgctgcaggagcagctggatgccatcaatgaggagatccgcatgatccaggaggagaaggagagcacagagctgcgggcagaggagattgagaccagggtgaccagcggctccatggaggccctgaacctgaagcagctgaggaagaggggcagcatccccaccagcctgacagccctgagcctggccagcgccagcccccccctgagcggccgcagcacccccaagctgaccagccgctctgctgcccaggacctggacaggatgggcgtgatgaccctgcccagcgacctgaggaagcacaggaggaagctgctgagccctgtgtcccgggaggagaaccgggaggacaaggccaccatcaagtgtgagaccagcccccccagcagccccaggaccctgcggctggagaagctgggccacccagccctgagccaggaggagggcaagagcgccctggaggaccagggcagcaaccccagcagcagcaacagcagccaggacagcctgcacaagggggccaagaggaagggcatcaagagcagcatcggccgcctgtttgggaagaaggagaagggccgcctcatccagctgagcagagatggagccactggacatgtgctgctgacagattctgagttctccatgcaggagcccatggtgcctgccaagctgggcacccaggccgagaaggaccggcggctgaagaagaagcaccagctgctggaggatgcccggaggaagggcatgccctttgcccagtgggatggccccaccgtggtgtcctggctggagctgtgggtgggcatgcctgcctggtacgtggccgcctgccgggccaacgtgaagagcggggccatcatgtctgccctgagtgacacagagatccagcgggagatcggcatcagcaatgccctgcaccggctgaagctgcggctggccatccaggagatggtgtccctgaccagccccagcgccccacccaccagcaggaccagcagtggaaatgtgtgggtgacccatgaggagatggagaccctggagaccagcaccaagacagacagcgaggagggctcctgggcccagaccctggcctatggagacatgaaccacgagtggattggaaatgagtggctgcccagcctgggcctgccccagtaccgcagctacttcatggagtgcctggtggatgccaggatgctggaccacctgaccaagaaggacctgcgggtgcacctgaagatggtggacagcttccacaggaccagcctgcagtatggcatcatgtgcctgaagaggctgaactatgacaggaaggagctggagaagagaagagaggagagccagcacgagatcaaggatgtgctggtgtggaccaatgaccaggtggtgcactgggtgcagagcatcggcctgcgggactatgccggcaacctgcatgaaagtggagtgcacggggccctgctggccctggatgagaactttgaccacaacaccctggccctgatcctgcagatccccacccagaacacccaggcccggcaggtgatggagcgggagttcaacaacctgctggccctgggcacagacaggaagctggatgatggagatgacaaggtgttcagaagagcccccagctggaggaagcgcttccggccccgggagcaccacggccggggcggcatgctgagcgccagcgctgagaccctgcctgctggcttccgggtgtccaccctgggcaccctgcagcccccaccagccccacccaagaagatcatgcctgaggcccacagccactacctgtatggccacatgctgagcgccttccgggactag

SEQ ID NO: 20818 - DNA, 1494 bp, Artificial Sequence
  Description of Artificial Sequence: Synthetic coding sequence
gatgtgggcggggaccggccctgggacagcggcaacacccagctgccccccaggaaccctgtgaaggccaatgccatgtttggagctggagatgaagatgacacagacttcctgagccccagcggcggggcccggctggccagcctgtttggcctggaccaggccgctgctggccatggaaatgagttcttccagtacacagcccccaagcagcccaagaagggccagggcacagctgccactggaaaccaggccacccccaagacagccccagccaccatgagcacccccaccatcctggtggccacagctgtgcacgcctaccgctacaccaacggccagtatgtgaagcagggcaagtttggagctgctgtgctgggcaaccacacagcccgggagtaccgcatcctgctgtacatcagccagcagcagcctgtgacagtggcccgcatccacgtgaactttgagctgatggtgcggcccaacaactacagcaccttctatgatgaccagaggcagaactggagcatcatgtttgaaagtgagaaggctgctgtggagttcaacaagcaggtgtgcatcgccaagtgcaacagcaccagcagcctggatgctgtgctgagccaggacctgattgtggctgatggccctgctgtggaggtgggggacagcctggaggtggcctacacaggctggctgttccagaaccacgtgctgggccaggtgtttgacagcacagccaacaaggacaagctgctgcggctgaagctgggcagcggcaaggtgatcaagggctgggaggatggcatgctgggcatgaagaagggcggcaagaggctgctgattgtgcccccagcctgtgctgtgggcagcgagggcgtgattggctggacccaggccacagacagcatcctggtgtttgaggtggaggtgcggcgggtgaagtttgcccgggacagcggcagtgatggccacagcgtgagcagccgggacagcgctgcccccagccccatccctggagctgacaacctgtctgctgaccctgtggtgagcccccccaccagcatccccttcaagagcggggagcccgccctgcggaccaagagcaacagcctgtctgagcagctggccatcaacaccagcccagatgctgtgaaggccaagctgatcagcaggatggccaagatgggccagcccatgctgcccatcctgcccccccagctggacagcaatgattctgaaattgaagatgtgaacaccctgcagggcggcggccagcctgtggtgacccccagcgtgcagcccagcctgcacccagcccacccagccctgccccagatgaccagccaggccccccagcccagcgtgacaggcctgcaggcccccagcgctgccctgatgcaggtgagcagcctggacagccacagcgctgtgtctggaaatgcccagagcttccaggtgaccttctacaaccgcatcaactacatcctgtag

SEQ ID NO: 20819 - DNA, 462 bp, Artificial Sequence
  Description of Artificial Sequence: Synthetic coding sequence
atgaacctggccgagatctgtgacaatgccaagaagggccgggagtatgccctgctgggcaactatgacagctccatggtgtactaccagggcgtgatgcagcagatccagaggcactgccagagcgtgcgggaccctgccatcaagggcaagtggcagcaggtgcggcaggagctgctggaggagtatgagcaggtgaagagcatcgtgtccaccctggagagcttcaagattgacaagcccccagacttccctgtgtcctgccaggatgagcccttccgggaccctgctgtgtggcccccacctgtgcctgctgagcaccgggccccaccccagatccggcggcccaaccgggaggtgcggcccctgaggaaggagatggccggcgtgggcgcccggggccctgtgggccgggcccaccccatcagcaagtctgagaagcccagcaccagccgggactag

SEQ ID NO: 20820 - DNA, 627 bp, Artificial Sequence
  Description of Artificial Sequence: Synthetic coding sequence
atgttccaggtgcctgattctgagggcggccgggccggcagccgggccatgaagcccccaggaggagagagcagcaacctgtttggcagccctgaggaggccacccccagcagccggcccaacaggatggccagcaacatcttcggccccacagaggagccccagaacatccccaagaggaccaaccccccaggcggcaaaggaagtggcatctttgatgagagcacccctgtgcagacccggcagcacctgaaccccccaggcggcaagaccagtgacatcttcggcagccctgtgacagccaccagccggctggcccaccccaacaagcccaccaggaacagccgggacagagtggccatgttctccttcccctttgcccagatgtctggagtgggccggggcctggtgctgtgtgagcccggctgcagcgccagccctggaagacatgacagctgcctggagacccgggccttccagatggccggccgctgcctgtgtggagatgagatgggccacccctggcccagcctgatgtgcagccctggcctgcggggcaccggccggggcgtgcgggtgggccgctggggccgggcctggagcctggaccagcagcctgccagctag

SEQ ID NO: 20821 - DNA, 591 bp, Artificial Sequence
  Description of Artificial Sequence: Synthetic coding sequence
atgcccttcagcaaggagaagtacatcctggacagcagccctgagaagctgcacaaggagctggaggaggagctgaagctgagcagcacagacctgcggagccacgcctggtaccacggccgcatcccccgggaggtgtctgagaccctggtgcagagaaatggagacttcctgatccgggacagcctgaccagcctgggggactatgtgctgacctgccgctggaggaaccaggccctgcacttcaagatcaacaaggtggtggtgaaggccggggagagctacacccacatccagtacctgtttgagcaggagagctttgaccacgtgcctgccctggtgcgctaccacgtgggcagcaggaaggctgtgtctgagcagagcggggccatcatctactgccctgtgaacagaaccttccccctgcgctacctggaggccagctatggcctgggccagggcagcagcaagccagccagccctgtgagccccagcggccccaagggcagccacatgaagagaagatctgtgaccatgacagatggcctgacagctgacaaggtgaccaggagtgatggctgccccacctag

SEQ ID NO: 20822 - DNA, 1986 bp, Artificial Sequence
  Description of Artificial Sequence: Synthetic coding sequence
atgcaggccaacggggccggcggcggcggcggcggcggcggcggcggcggcggcggcggcggcggcggcggcggccagggccagaccccagagctggcctgcctgagcgcccagaatggagagagcagccccagcagcagcagcagcgctggggacctggcccacgccaacggcctgctgcccagcgcccccagcgctgccagcaacaacagcaacagcctgaatgtgaacaacggggtgcctggaggagctgctgctgccagcagcgccaccgtggccgccgccagcgccaccacagctgccagcagcagcctggccaccccagagctgggcagcagcctgaagaagaagaagaggctgagccagagtgatgaagatgtgatccggctgattggccagcacctgaatggcctgggcctgaaccagacagtggacctgctgatgcaggagagcggctgccgcctggagcaccccagcgccaccaagttcaggaaccacgtgatggagggggactgggacaaggccgagaatgacctgaatgagctgaagcccctggtgcacagcccccacgccatcgtggtgcggggggccctggagatcagccagaccctgctgggcatcatcgtgaggatgaagttcctgctgctgcagcagaagtacctggagtacctggaggatggcaaggtgctggaggccctgcaggtgctgcgctgtgagctgacccccctgaagtacaacacagagcgcatccacgtgctgagcggctacctgatgtgcagccatgctgaggacctgcgggccaaggccgagtgggagggcaagggcacagccagccgcagcaagctgctggacaagctgcagacctacctgcccccatctgtgatgctgcccccccggcggctgcagaccctgctgcggcaggccgtggagctgcagagggaccgctgcctgtaccacaacaccaagctggacaacaacctggacagcgtgtccctgctgattgaccacgtgtgcagccggcggcagttcccctgctacacccagcagatcctgacagagcactgcaatgaggtgtggttctgcaagttcagcaatgatggcaccaagctggccaccggcagcaaggacaccaccgtcatcatctggcaggtggaccctgacacccacctgctgaagctgctgaagaccctggagggccacgcctacggcgtgtcctacatcgcctggagcccagatgacaactacctggtggcctgtggcccagatgactgcagcgagctgtggctgtggaatgtgcagacaggagagctgcggaccaagatgagccagagccatgaggacagcctgacctctgtggcctggaacccagatggcaagagatttgtgactggaggccagaggggccagttctaccagtgtgacctggatggcaacctgctggacagctgggagggcgtgcgggtgcagtgcctgtggtgcctgagtgatggcaagacagtgctggccagtgacacccaccagaggatccggggctacaactttgaggacctgacagacaggaacatcgtgcaggaggaccaccccatcatgtccttcaccatcagcaagaatggccgcctggccctgctgaatgtggccacccagggcgtgcacctgtgggacctgcaggacagagtgctggtgaggaagtaccagggcgtgacccagggcttctacaccatccacagctgcttcggcggccacaatgaagacttcatcgccagcggcagcgaggaccacaaggtgtacatctggcacaagaggtctgagctgcccatcgccgagctgaccggccacaccaggacagtgaactgtgtgtcctggaacccccagatccccagcatgatggccagcgccagtgatgatggcaccgtgcgcatctggggccctgcccccttcatcgaccaccagaacatcgaggaggagtgcagctccatggacagctag

SEQ ID NO: 20823 - DNA, 1113 bp, Artificial Sequence
  Description of Artificial Sequence: Synthetic coding sequence
atggagaagaagaagatggtgacccagggcaaccaggagcccaccaccaccccagatgccatggtgcagcccttcaccaccatccccttccccccaccaccccagaatggcatccccacagaatatggagtgccccacacccaggactatgccggccagacaggagagcacaacctgaccctgtatggcagcacccaggcccacggggagcagagcagcaacagccccagcacccagaatggcagcctgaccacagaaggaggagcccagacagatggccagcagagccagacccagagcagcgagaacagcgagagcaagagcacccccaagaggctgcacgtgagcaacatccccttccgcttccgggaccctgacctgcggcagatgtttggccagtttgggaagatcctggatgtggagatcatcttcaatgaaagaggcagcaagggcttcggctttgtgacctttgagaacagcgcagatgctgaccgggcccgggagaagctgcatggaacagtggtggagggcaggaagattgaggtgaacaatgccacagcccgggtgatgaccaacaagaagatggtgaccccctatgccaacggctggaagctgagccctgtggtgggcgctgtgtatggccctgagctgtatgctgccagcagcttccaggctgatgtgtccctgggcaatgatgctgctgtgcccctgagcggccggggcggcatcaacacctacatccccctcatcagcctgcccctggtgcccggcttcccctaccccacagctgccaccacagctgctgccttccggggggcccacctgcggggccggggccgcacagtgtatggagctgtgcgggctgtgcccccaacagccatcccagcctacccaggagtggacatgcagcccacagacatgcacagcctgctgctgcagccccagccccccctgctgcagcccctgcagcccctgactgtgacagtgatggccggctgcacccagcccacccccaccatgcccctgcccctgcccctggccatggagctggccctgtggagggtgtacacagaggtggccacagctgacctgcccccaacagaggtgacctag

SEQ ID NO: 20824 - DNA, 348 bp, Artificial Sequence
  Description of Artificial Sequence: Synthetic coding sequence
atgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctag

SEQ ID NO: 20825 - DNA, 3039 bp, Artificial Sequence
  Description of Artificial Sequence: Synthetic coding sequence
atgctgctgaagagcatcttcatcgtgtacatcttcttctacagcatcagcgagctgagcctggacagcaccctgcatgctgtgaacctgcactgcaacaacatcagcaagattgaggccatcgaccacatctggaacctgcagcacctggacctgagcagcaaccagatcagccgcatcgagggcctgaacaccctgaccaagctgtgcaccctgaacctgagctgcaacctgatcaccaaggtggagggcctggaggagctgatcaacctgacccggctgaatgtgtcctacaaccacattgatgacctgagcggcctcatccccctgcacggcatcaagcacaagctgcgctacatcgacctgcacagcaacagaattgacagcatccaccacctgctgcagtgcatggtgggcctgcacttcctgaccaacctgatcctggagaaggatggagatgacaaccctgtgtgccgcctgcccggctacagagctgtgatcctgcagaccctgccccagctgcgcatcctggactgcaagaacatctttggagagcctgtgaacctgacagagatcaacagcagccagctgcagtgcctggagggcctgctggacaacctggtgtccagtgacagccccctgaacatcagtgaagatgagatcatcgacaggatgcctgtgatcacagcccccattgatgagctggtgcccctggagcagtttgccagcacccccagtgatgctgtgctgaccagcttcatgtctgtgtgccagagcagcgagcctgagaagaacaaccatgaaaatgacctgcagaatgagatcaagctgcagaagctggatgaccagatcctgcagctgctgaatgagaccagcaacagcattgacaacgtgctggagaaggacccccggcccaagagggacacagacatcaccagcgagagtgactatggcaacaggaaggagtgcaacaggaaggtgcccaggaggagcaagatcccctatgatgccaagaccatccagaccatcaagcaccacaacaagaactacaacagctttgtgtcctgcaacaggaagatgaagccaccctacctgaaggagctgtatgtgagcagcagcctggccaactgccccatgctgcaggagagcgagaagcccaagacagagatcatcaaggtggaccagagccacagcgaggacaacacctaccagagcctggtggagcagctggaccaggagcgggagaagcgctggagggctgagcaggccgagaacaagctgatggactacattgatgagctgcacaagcacgccaatgagaaggaggacatccacagcctggccctgctgaccacagaccggctgaaggagatcatcttccgggagaggaacagcaagggccagctggaggtgatggtgcacaagctgcagaatgagatcaagaagctgactgtggagctgatgaaggccaaggaccagcaggaggaccacctgaagcacctgcggaccctggagaagaccctggagaagatggagcggcagaagaggcagcagcaggccgcccagatccgcctcatccaggaggtggagctgaaggccagcgctgctgaccgggagatctacctgctgcggaccagcctgcaccgggagcgggagcaggcccagcagctgcaccagctgctggccctgaaggagcaggagcacaggaaggagctggagacccgggagttcttcacagatgctgacttccaggatgccctggccaaggagatcgccaaggaggagaagaagcatgagcagatgatcaaggagtaccaggagaagattgatgtgctgagccagcagtacatggacctggagaatgagttcagaattgccctgactgtggaggcccggcgcttccaggatgtgaaggatggctttgaaaatgtggccacagagctggccaagagcaagcacgccctgatctgggcccagaggaaagaaaatgaaagcagcagcctcatcaaggacctgacctgcatggtgaaggagcagaagaccaagctggccgaggtgtccaagctgaagcaggagacagctgccaacctgcagaaccagatcaacaccctggagatcctgattgaagatgacaagcagaagagcatccagatcgagctgctgaagcatgagaaggtgcagctgatcagcgagctggccgccaaggagagcctcatcttcggcctgaggacagagaggaaggtgtggggccacgagctggcccagcagggcagcagcctggcccagaacagaggcaagctggaggcccagatcgagagcctgagcagagaaaatgaatgtctgaggaagaccaatgaaagtgacagtgatgccctgcgcatcaagtgcaagatcattgatgaccagacagagaccatcaggaagctgaaggactgcctgcaggagaaggatgagcacatcaagaggctgcaggagaagatcacagaaattgagaagtgcacccaggagcagctggatgagaagagcagccagctggatgaggtgctggagaagctggagcggcacaatgaaaggaaggagaagctgaagcagcagctgaagggcaaggaggtggagctggaggagatcaggaaggcctacagcaccctgaacaggaagtggcatgacaagggggagctgctgtgccacctggagacccaggtgaaggaggtgaaggagaagtttgagaacaaggagaagaagctgaaggccgagcgggacaagagcattgagctgcagaagaatgccatggagaagctgcacagcatggatgatgccttcaagaggcaggtggatgccatcgtggaggcccaccaggccgagatcgcccagctggccaatgagaagcagaagtgcatcgacagcgccaacctgaaggtgcaccagatcgagaaggagatgagggagctgctggaggagacctgcaagaacaagaagaccatggaggccaagatcaagcagctggcctttgccctgaatgagatccagcaggacatgtag

SEQ ID NO: 20826 - DNA, 4665 bp, Artificial Sequence
  Description of Artificial Sequence: Synthetic coding sequence
atgtctgccacctcctggttcctggtgagcagcagcggggcccggcaccggctgccccgggagctgatctttgtgggccgggaggagtgtgagctgatgctgcagagccgctctgtggacaagcagcacgccgtcatcaactatgaccaggacagagatgagcactgggtgaaggacctgggcagcctgaatggcacctttgtgaatgacatgaggatcccagaccagaagtatgtgaccctgaagctgaatgatgtgatccgcttcggctatgacagcaacatgtatgtgctggagcgggtgcagcaccgggtgcctgaggaggccctgaagcatgagaagtacaccagccagctgcaggtgtctgtgaagggcctggcccccaagaggtctgaggccctgcctgagcacaccccctactgtgaggccagcaaccccaggcctgagaagggggacagaagacctggaacagaagctgccagctaccgcacccccctgtatggccagcccagctggtggggagaagatgatggcagcaccctgcctgatgcccagaggcagggcgagccctacccagagcggcccaagggccctgtgcagcaggatggagagctgcacggcttccgggccccagctgagccccagggctgcagcttccggcgggagcccagctactttgagatccccaccaaggagaccccccagcccagccagcccccagaggtgcctgcccacgagatgcccaccaaggatgctgaggccggcggcggcggggccgcccctgtggtgcagagccacgccagcttcaccattgaatttgatgactgcagccctgggaagatgaagatcaaggaccacatcaccaagttcagcctgcggcagaggaggcctcctgggaaggaggccaccccaggagagatggtgtctgctgagaccaaggtggccgactggctggtgcagaatgaccccagcctgctgcaccgggtgggccctggagatgacagacacagcaccaagagtgacctgcctgtgcacaccaggaccctgaagggccacaagcatgaagatggcacccagagcgacagcgaggaccccctggccaaggccgccagcgctgctggggtgcccctggaggccagcggggagcaggtgcggctgcagaggcagatcaagagggacccccaggagctgctgcacaaccagcaggccttcgtcatcgagttctttgatgaggacacccccaggaagaagaggagccagagcttcacccacagccccagcggggaccccaaggctgacaagagaagaggccccaccccagctgaccgggaccggcccagcgtgcctgcccctgtgcaggccggcggccgcagcagcggcccccagagagctggcagcctgaagcgggagaagacagaggagcggctgggcagccccagccctgccagcaggaccccagcccggcccttcggctctgtgggcagaagaagccggctggcccaggacttcatggcccagtgcctgcgggagagcagccctgctgcccggcccagccctgagaaggtgccccctgtgctgcctgcccccctgacccctcatggcaccagccctgtgggcccccccaccccacctccagcccccacagacccccagctgaccaaggccaggaagcaggaggaggatgacagcctgagtgatgctggcacctacaccatcgagacagaggcccaggacacagaggtggaggaggccaggaagatgattgaccaggtgtttggagtgctggagagccctgagctgagccgggccagcagcgccaccttccggcctgtgatccggggggacagagatgaaagtgatgatggaggagtggcccagaggatggccctgctgcaggagtttgccagccggcccctgggcgccgccccccaggccgagcaccagggcctgcctgtgcccggcagccctgggggccagaagtgggtgagccgctgggccagcctggccgacagctacagcgaccccggcctgacagaagatggcctgggccggcggggcggggagcctgagggcagcctgcctgtgaggatgagaagaaggctgccccagctgcccagcgagagagctgacagccctgctggccctgagagcagcagaagaagtggccctggccccccagagctggacagcgagcagcccagccggctgtttggccaggaggagctggaccctgacagcctgagtgatgccagcggcagtgatggcggccggggccctgagcccggggtggagccccaggacagcagaagaagaagcccccaggagggccccacctggagccggggcagaagaagcccccgggcccctggagagcccaccccagccagcttcttcatcggggaccagaatggagatgctgtgctgagcaggaagcccctggccgcccctggagatggagagggcctgggccagacagcccagcccagccccccagccagagatggagtgtatgtgtctgccaatggaaggatggtgatccagctgcggcccggccgcagccctgagccagatggccctgccccagccttcctgcggcaggagagcttcaccaaggagcccgccagcggccccccagcccctgggaagccaccccacatcagcagccaccccctgctgcaggacctggccgccacccgggccgccaggatggacttccacagccaggacacccacctgatcctgaaggagacagaaacagccctggccgccctggaggcccggctgctgagcaacagcgtggatgctgaatgtgagggcggcagcaccccccggcccccagaagatgccctgagcggggacagtgatgtggacacagccagcacagtgtccctgcggagcggcaagagcggccccagccccaccaccccccagcccctgcgggcccagaaggagatgagccccagccccccagctgcccaggaccccggcggcacagccctggtgtctgcccgggagcagagcagcgagcggcagcaccaccccctgggccccacagacatgggccgcggggagcctgtgagaagaagtgccatccggcggggccaccggccccggggcagcctggactggcccagcgaggagcggggccctgtgctggcccacctgcccagcagtgatgtgatggccagcaaccacgagaccccagaggccactggagctggccgcctgggcagcaggaggaagccagctgcccccccacccagccctgctgcccgggaggagcagagccgcagcagcgccagcagccagaagggcccccaggccctgaccaggagcaacagcctgagcaccccccggcccacccgggccagccggctgcggcgggcccggctgggagatgccagtgacacagaagctgctgatggagagcggggcagcctgggcaaccctgagcctgtgggccggcctgctgctgagcaggccaagaagctgagccggctggacatcctggccatgcccaggaagagagctggcagcttcaccggcaccagtgaccctgaggccgccccagcccggaccagcttcagcggccgctctgtggagctgtgctgtgccagcaggaagcccaccatggccgaggcccgggctgtgtccaggaaggccgccaacacagccaccaccaccggcccccggcagcccttcagccgggcccggagcggcagcgcccgctacaccagcaccacccagacccccagggctggcagcagcagccgggcccggagccgggcccctggcccccgggacacagatgatgatgaggaggagccagacccctacggcttcatcgtgcagacagctgagattgctgagatcgcccggctgagccagaccctggtgaaggatgtggccatcctggcccaggagatccatgatgtggccggagatggagacaccctgggcagcagcgagcccgcccacagcgccagcctgagcaacatgcccagcaccccagccagcaccatcagcgcccgggaggagctggtgcagagaattcctgaggccagcctgaacttccagaaggtgcccccaggcagcctgaacagccgggactttgaccagaacatgaatgacagctgtgaagatgccctggccaacaagacccggcccaggaaccgggaggaggtgatctttgacaacctgatgctgaaccctgtgtcccagctgagccaggccatccgggagaacacagagcacctggccgagaagatgaagatcctcttccagaacacaggccgggcctgggaggacctggaggcccgcatcaatgcagaaaatgaggtgcccatcctgaagaccagcaacaaggagatcagcagcatcctgaaggagctgcggcgggtgcagaagcagctggaggtgatcaatgccatcgtggaccccagcggcagcctggacctgctgaccggcaacagaagcctggccagcagcgcccagcccggcctgggcaagggccgggtggccgcccagagcccccccagccctgccagcgctgaggccctgctgcctgccctgcccctgaggaacttcccccagagggccagctgtggcccccccagcctgcctgaccccaccttcctgcctgatgctgagcgcttcctgatctag

SEQ ID NO: 20827 - DNA, 696 bp, Artificial Sequence
  Description of Artificial Sequence: Synthetic coding sequence
atcatcctgctgctggtgcccagcgaggagacagatgaaaatgacctgatcctggaggtgacagctggggtgggcggcggcctgcggcatgccagcgccagcattggaggcagcgaggcctaccgccacatgaagtttgagggcggcgtgcaccgggtgcagagggtgcccaagacagagaagcagggccgggtgcacaccagcaccatgacagtggccatcctgccccagcccacagagatcaacctggtgatcaaccccaaggacctgagaattgacaccaagagggccagcggggccggcggccagcacgtgaacaccacagacagcgctgtgcgcatcgtgcacctgcccactggagtggtgtctgagtgccagcaggagaggagccagctgaagaacaaggagctggccatgaccaagctgcgggccaagctgtacagcatgcacctggaggaggagatcaacaagaggcagaatgccaggaagatccagatcggcagcaagggccgctctgagaagatccgcacctacaacttcccccagaacagagtgacagaccaccgcatcaacaagaccctgcatgacctggagaccttcatgcagggcgactacctgctggatgagctggtgcagagcctgaaggagtatgctgactatgagagcctggtggagatcatcagccagaaggtgtag

SEQ ID NO: 20828 - DNA, 483 bp, Artificial Sequence; identical to SEQ ID NO: 20009
  Description of Artificial Sequence: Synthetic coding sequence

SEQ ID NO: 20829 - DNA, 423 bp, Artificial Sequence
  Description of Artificial Sequence: Synthetic coding sequence
atgcagtttggagagctgctggccgctgtgaggaaggcccaggccaacgtgatgctgttcctggaggagaaggagcaggccgccctgagccaggccaacggcatcaaggcccacctggagtacagatctgctgagatggagaagagcaagcaggagctggagaccatggccgccatcagcaacacagtgcagttcctggagatgtgcatgaccagccgcagcaccaggacccagcacaccagcatcagcggctgcagaagaagaacagcccggagccccacccccaggcctggcagcatccccaccaggaccagccctgctggcagctgcacaggaggccgctgctgccccagccgggtgtgcacctgcaccggcaccatcctgcgctggaggagcagcggccaggcccccatgctggcctag

SEQ ID NO: 20830 - DNA, 819 bp, Artificial Sequence
  Description of Artificial Sequence: Synthetic coding sequence
atggccagcagcaacacagtgctgatgaggctggtggccagcgcctacagcatcgcccagaaggccggcatgattgtgagaagagtgattgctgagggggacctgggcatcgtggagaagacctgtgccacagacctgcagaccaaggctgaccggctggcccagatgagcatctgcagcagcctggccaggaagttccccaagctgaccatcatcggggaggagctggtggtgtgggtggaccccctggatggcaccaaggagtacacagagggcctgctggacaacgtgacagtgctgattggaattgcctatgagggcaaggccatcgccggggtcatcaaccagccctactacaactatgaagctggcccagatgctgtgctgggccgcaccatctggggcgtgctgggcctgggcgccttcggcttccagctgaaggaggtgcctgctgggaagcacatcatcaccaccaccaggagccacagcaacaagctggtgacagactgtgtggccgccatgaacccagatgctgtgctgcgggtgggcggggccggcaacaagatcatccagctgattgagggcaaggccagcgcctacgtgtttgccagccctggctgcaagaagtgggacacctgtgcccctgaggtgatcctgcatgctgtgggcggcaagctgacagacatccacggcaatgtgctgcagtaccacaaggatgtgaagcacatgaacagcgctggggtgctggccaccctgagaaattatgactactatgccagccgggtgcctgagagcatcaagaatgccctggtgccctag

SEQ ID NO: 20831 - DNA, 606 bp, Artificial Sequence
  Description of Artificial Sequence: Synthetic coding sequence
atggagagcaaccacaagtctggagatggcctgagcggcacccagaaggaggccgccctgcgggccctggtgcagaggacaggctacagcctggtgcaggagaatggccagaggaaatatggaggccccccacctggctgggatgctgcccctcctgagcggggctgtgagatcttcatcggcaagctgccccgggacctgtttgaagatgagctgatccccctgtgtgagaagattggcaagatctatgagatgaggatgatgatggacttcaacggcaacaacagaggctacgcctttgtgaccttcagcaacaaggtggaggccaagaatgccatcaagcagctgaacaactatgagatcagaaatggccgcctgctgggcgtgtgtgcctctgtggacaactgccgcctgtttgtgggcggcatccccaagaccaagaagcgggaggagatcctgtctgagatgaagaaggtgacagagggcgtggtggatgtgattgtgtaccccagcgctgctgacaagaccaagaacagaggatttgcctttgtggagtatgagagccacagagctgctgccatggcccggaggaagctgctgccctag

SEQ ID NO: 20832 - DNA, 1905 bp, Artificial Sequence
  Description of Artificial Sequence: Synthetic coding sequence
atggccctgagcaagcgggagctggatgagctgaagccctggattgagaagacagtgaagagggtgctgggcttcagcgagcccaccgtggtgacagctgccctgaactgtgtgggcaagggcatggacaagaagaaggctgctgaccacctgaagcccttcctggatgacagcaccctgcgctttgtggacaagctgtttgaagctgtggaggagggccgcagcagccgccacagcaagagcagcagtgacaggagcaggaagcgggagctgaagatcaagcagatgatggaggccgccacccggcagatcgaggagaggaagaagcagctgtccttcatcagcccccccaccccccagcccaagacccccagcagcagccagcctgagcggctgcccatcggcaacaccatccagcccagccaggccgccaccttcatgaatgatgccatcgagaaggccaggaaggctgctgagctgcaggcccgcatccaggcccagctggccctgaagccaggcctgattggaaatgccaacatggtgggcctggccaacctgcacgccatgggcatcgccccacccaaggtggagctgaaggaccagaccaagcccacccccctcatcctggatgagcagggccgcacagtggatgccaccgggaaggagattgagctgacccacaggatgcccaccctgaaggccaacatccgggctgtgaagcgggagcagttcaagcagcagctgaaggagaagcccagcgaggacatggagagcaacaccttctttgacccccgggtgtccatcgcccccagccagaggcagaggaggaccttcaagttccatgacaagggcaagtttgagaagatcgcccagaggctgcggaccaaggcccagctggagaagctgcaggccgagatcagccaggccgccaggaagacaggcatccacaccagcacccggctggccctgattgcccccaagaaggagctgaaggagggggacatccctgagattgagtggtgggacagctacatcatccccaacggctttgacctgacagaggagaaccccaagcgggaggactacttcggcatcaccaacctggtggagcacccagcccagctgaacccccctgtggacaatgacacccctgtgaccctgggcgtgtacctgaccaagaaggagcagaagaagctgcggcggcagacccggcgggaggcccagaaggagctgcaggagaaggtgcggctgggcctgatgcctcctcctgagcccaaggtgcgcatcagcaacctgatgagggtgctgggcacagaggccgtgcaggaccccaccaaggtggaggcccacgtgcgggcccagatggccaagaggcagaaggcccacgaggaggccaatgctgccaggaagctgacagctgagcagaggaaggtgaagaagatcaagaagctgaaggaggacatcagccagggcgtgcacatctctgtgtacagagtgaggaacctgagcaacccagccaagaagttcaagattgaggccaatgccggccagctgtacctgactggagtggtggtgctgcacaaggatgtgaatgtggtggtggtggagggcggccccaaggcccagaagaagttcaagaggctgatgctgcaccgcatcaagtgggatgagcagaccagcaacaccaagggagatgatgatgaggagagtgatgaggaggccgtgaagaagaccaacaagtgtgtgctggtgtgggagggcacagccaaggacaggagctttggagagatgaagttcaagcagtgccccacagagaacatggcccgggagcacttcaagaagcatggagctgagcactactgggacctggccctgtctgagagcgtgctggagagcacagactag

SEQ ID NO: 20833 - DNA, 3192 bp, Artificial Sequence
  Description of Artificial Sequence: Synthetic coding sequence
atgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctggtgggtgcgggagggcttcttcaagccagagtaccaggcccggctgccccaggccactggagagaccttctccatgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggagagccagatgctgaggtggtggtgggcaccaccaggcctgagaccctgcctggagatgtggccgtggccgtgcacccagatgacagccgctacacccacctgcacggccggcagctgcggcaccccctgatgggccagcccctgcccctcatcacagattatgctgtgcagccccacgtgggcaccggggctgtgaaggtgaccccagcccacagccctgcagatgctgagatgggcgcccggcacggcctgagccccctgaatgtgattgctgaagatggcaccatgaccagcctgtgtggggactggctgcagggcctgcacagatttgtggcccgggagaagatcatgtctgtgctgtctgagtggggcctcttccggggcctgcagaaccaccccatggtgctgcccatctgcagccgctctggagatgtgattgagtacctgctgaagaaccagtggtttgtgcgctgccaggagatgggcgcccgggccgccaaggctgtggagagcggggccctggagctgagccccagcttccaccagaagaactggcagcactggttcagccacatcggggactggtgtgtgtcccggcagctgtggtggggccaccagatcccagcctacctggtggtggaggaccacgcccagggcgaggaggactgctgggtggtgggccgctctgaggccgaggcccgggaggtggccgctgagctgaccggccggcctggagctgagctgaccctggagcgggaccctgatgtgctggacacctggttcagcagcgccctcttccccttcagcgccctgggctggccccaggagaccccagacctggcccgcttctaccccctgagcctgctggagactggaagtgacctgctgctcttctgggtgggccgcatggtgatgctgggcacccagctgaccggccagctgcccttcagcaaggtgctgctgcaccccatggtgcgggaccggcagggcaggaagatgagcaagagcctgggcaatgtgctggacccccgggacatcatcagcggcgtggagatgcaggtgctgcaggagaagctgcggagcggcaacctggaccctgctgagctggccatcgtggccgccgcccagaagaaggacttcccccacggcatcccagaatgtggcacagatgccctgcgcttcaccctgtgcagccatggagtgcaggccggggacctgcacctgtctgtgtctgaggtgcagagctgccgccacttctgcaacaagatctggaatgccctgcgcttcatcctgaatgccctgggggagaagtttgtgccccagcctgctgaggagctgagccccagcagccccatggatgcctggatcctgagccggctggccctggccgcccaggagtgtgagcggggcttcctgacccgggagctgagcctggtgacccacgccctgcaccacttctggctgcacaacctgtgtgatgtgtacctggaggccgtgaagcctgtgctgtggcacagcccccggcccctgggccccccccaggtgctcttcagctgtgccgacctgggcctgcggctgctggcccccctgatgcccttcctggccgaggagctgtggcagaggctgcccccccggcccggctgccccccagcccccagcatctctgtggccccctaccccagcgcctgcagcctggagcactggaggcagcctgagctggagcggcgcttcagccgggtgcaggaggtggtgcaggtgctgcgggccctgcgggccacctaccagctgaccaaggcccggccccgggtgctgctgcagagcagcgagcccggggaccagggcctgtttgaggccttcctggagcccctgggcaccctgggctactgtggggctgtgggcctgctgcccccaggagctgctgcccccagcggctgggcccaggcccccctgagtgacacagcccaggtgtacatggagctgcagggcctggtggacccccagatccagctgcccctgctggccgcccggcgctacaagctgcagaagcagctggacagcctgacagcccggaccccatctgagggggaggccggcacccagaggcagcagaagctgagcagcctgcagctggagctgagcaagctggacaaggccgccagccacctgcggcagctgatggatgagcccccagcccctggcagccctgagctgtag

SEQ ID NO: 20834 - DNA, 2118 bp, Artificial Sequence
  Description of Artificial Sequence: Synthetic coding sequence
atgattgacagcgtgaagctgcggcgggacagcgctgctgacttcttcagccactatgagtacctgtgtgccctgcagaacagcgtgcccctgcctgctgtgcgggcctgcctgcgggagggcgtgctggacttcaatgctgaccggctgcggggcgtggactgggcccccctgctgagcaccctgaagatcaacaaggacctgcccctggtgtccatcaagagcttcttccagccctggctgggggacaccggcagtgacatgaacaagttctgccgcagccgggtgcctgccatccgctacaaggatgtgaccttccagctgtgcaaggccctgaagggctgcctgagcatcagctctgtgctgaagaacctggagctgaatggcctcatcctgcgggagcgggacctgaccatcctggccaagggcctgaacaagagcgccagcctggtgcacctgagcctggccaactgccccatcggagatggcggcctggagatcatctgccagggcatcaagagcagcatcaccctgaagacagtgaacttcaccggctgcaacctgacctggcagggcgctgaccacatggccaagatcctgaagtaccagaccatgagaagacatgaggagacctgggccgagagcctgcgctacagaagaccagacctggactgcatggccggcctgcggcgcatcaccctgaactgcaacaccctcatcggggacctgggcgcctgtgcctttgctgacagcctgtctgaggacctgtggctgcgggccctggacctgcagcagtgtggcctgaccaatgaaggagccaaggccctgctggaggccctggagaccaacaccaccctggtggtgctggacatcaggaagaaccccctgattgaccacagcatgatgaaggccgtcatcaagaaggtgctgcagaatggccgcagcgccaagtctgagtaccagtggatcaccagccccagcgtgaaggagcccagcaagacagccaagcagaagaggaggaccatcatcctgggcagcggccacaagggcaaggccaccatccgcatcggcctggccaccaagaagcctgtgagcagcggcaggaagcacagcctgggcaaggagtactatgccccagcccccctgcccccaggagtgtctggcttcctgccctggaggacagctgagcgggccaagaggcaccggggcttccccctcatcaagacccgggacatctgcaaccagctgcagcagcccggcttccctgtgacagtgacagtggagagccccagcagcagcgaggtggaggaggtggatgacagcagcgagagcgtgcatgaggtgcctgagaagaccagcattgagcaggaggccctgcaggagaagctggaggagtgcctgaagcagctgaaggaggagagggtcatccggctgaaggtggacaagagggtgtctgagctggagcatgaaaatgcccagctgaggaacatcaacttcagcctgtctgaggccctgcacgcccagagcctgaccaacatgatcctggatgatgaaggagtgctgggcagcattgaaaattccttccagaagttccacgccttcctggacctgctgaaggatgctggcctgggccagctggccaccatggccggcatcgaccagagcgacttccagctgctgggccacccccagatgaccagcacagtgagcaacccccccaaggaggagaagaaggccctggaggatgagaagccagagcccaagcagaatgccctgggccagatgcagaacatccaggtgtccatctgcatgcagagcgcctacaatgaaggcaccctgatgaagttccagaagatcactggagatgcccgcatccccctgcccctggacagcttccctgtgcctgtgtccaccccagagggcctgggcaccagcagcaacaacctgggcgtgcctgccacagagcagaggcaggagagctttgagggcttcatcgccaggatgtgcagccccagcccagatgccaccagcggcaccggcagccagaggaaggaggaggagctgagcaggaacagccgcagcagcagcgagaagaagaccaagacaggcagccactag

SEQ ID NO: 20835 - DNA, 1287 bp, Artificial Sequence
  Description of Artificial Sequence: Synthetic coding sequence
atggcctggcagagcaggaaaggaggccacttccgggaggtggccatgcagtggaaggtgaccctgaccagccgctggggcctgctgcggcactgccaggtgctggccggcctgctgcacctgggcaacatccagtttgctgcctctgaagatgaggcccagccctgccagcccatggatgatgccaagtacagcgtgaggacagctgccagcctgctgggcctgcctgaagatgtgctgctggagatggtgcagatccgcaccatccgggccggccggcagcagcaggtgttcaggaagccctgtgcccgggcagaatgtgacacccggcgggactgcctggccaagctgatctatgcccggctgtttgactggctggtgtctgtcatcaacagcagcatctgtgccgacacagacagctggaccaccttcatcggcctgctggatgtgtatggctttgagagcttcccagacaacagcctggagcagctgtgcatcaactatgccaatgagaagctgcagcagcactttgtggcccactacctgcgggcccagcaggaggagtatgctgtggagggcctggagtggagcttcatcaactaccaggacaaccagccctgcctggacctgattgagggcagccccatcagcatctgcagcctcatcaatgaagaatgtcggctgaaccggcccagcagcgctgcccagctgcagaccagaattgaaacagccctggccggcagcccctgcctgggccacaacaagctgagccgggagcccagcttcatcgtggtgcactacgccggccctgtgcgctaccacacagctggcctggtggagaagaacaaggaccccatccccccagagctggatggagtggaggagaagcacttcagccaggccccctgcagcctgagcaccagccccctgcagacccggctgctggaggccatcatccggctgtggcccctgggcctggtgctggccaacacagccatgggcgtgggcagcttccagaggaagctggtggtgtgggcctgcctgcagctgccccggggcagccccagcagctacacagtgcagacagcccaggaccaggccggcgtgaccagcatccgggccctgccccagggcagcatcaagttccactgcaggaagagccccctgcgctatgctgacatctgcccagagcccagcccctacagcatcaccggcttcaaccagatcctgctggagcggcacaggctcatccacgtgaccagcagcgccttcaccggcctgggctag

SEQ ID NO: 20836 - DNA, 927 bp, Artificial Sequence; identical to SEQ ID NO: 18763
  Description of Artificial Sequence: Synthetic coding sequence

SEQ ID NO: 20837 - DNA, 429 bp, Artificial Sequence
  Description of Artificial Sequence: Synthetic coding sequence
atgagcctgcacggcaagaggaaggagatctacaagtatgaggccccctggacagtgtatgccatgaactggagcgtgcggccagacaagcgcttccggctggccctgggcagctttgtggaggagtacaacaacaaggtggtgatcctggatgtgcgggtgccctgcacccctgtggcccggctgaacaaccaccgggcctgtgtgaatggcatcgcctgggccccccacagcagctgccacatctgcacagctgctgatgaccaccaggccctgatctgggacatccagcagatgccccgggccatcgaggaccccatcctggcctacacagctgagggggagatcaacaacgtgcagtgggccagcacccagcctgactggatcgccatctgctacaacaactgcctggagatcctgcgggtgtag

SEQ ID NO: 20838 - DNA, 1233 bp, Artificial Sequence
  Description of Artificial Sequence: Synthetic coding sequence
atggccgcccccagccccagcggcggcggcggcagcggcggcggcagcggcagcggcaccccaggccctgtgggcagccctgcccctggccaccctgctgtgtcctccatgcagggcttccagatcaacttctgtgagaaggcccagagcaagaggaaggccctgaagctgaactttgccaacccccccttcaagagcacagcccgcttcaccctgaaccccaaccccactggagtgcagaacccccacatcgagcggctgcggacccacagcattgagagcagcggcaagctgaagatcagccctgagcagcactgggacttcaccgctgaggacctgaaggacctgggggagatcggccgcggggcctacggctctgtgaacaagatggtgcacaagcccagcggccagatcatggctgtgaagaggatccgcagcacagtggatgagaaggagcagaagcagctgctgatggacctggatgtggtgatgaggagcagtgactgcccctacatcgtgcagttctacggggccctcttccgggagggggactgctggatctgcatggagctgatgagcaccagctttgacaagttctacaagtatgtgtacagcgtgctggatgatgtgattcctgaggagatcctgggcaagatcaccctggccaccgtgaaggccctgaaccacctgaaggagaacctgaagatcatccaccgggacatcaagcccagcaacatcctgctggacagaagtggcaacatcaagctgtgtgactttggcatcagcggccagctggtggacagcatcgccaagaccagagatgctggctgccggccctacatggcccctgagagaattgaccccagcgccagccggcagggctatgatgtgcggagtgatgtgtggagcctgggcatcaccctgtatgagctggccaccggccgcttcccctaccccaagtggaacagcgtgtttgaccagctgacccaggtggtgaagggggaccccccccagctgagcaacagcgaggagcgggagttcagccccagcttcatcaactttgtgaacctgtgcctgaccaaggatgagagcaagaggcccaagtacaaggagctgctgaagcaccccttcatcctgatgtatgaggagagagctgtggaggtggcctgctacgtgtgcaagatcctggaccagatgcctgccacccccagcagccccatgtatgtggactag

SEQ ID NO: 20839 - DNA, 687 bp, Artificial Sequence
  Description of Artificial Sequence: Synthetic coding sequence
atgcagctggccgtggtgtctgaggagcaggaccagaacctgaacagactcatctgctggatcctgatgcagttcatctacatcagcagtgactatgtgtttgatggcaccaaccccccctaccgggaggaggacatcccagcccccctgaacctgtatggcaagaccaagctggatggagagaaggctgtgctggagaacaacctgggcgctgctgtgctgcgcatccccatcctgtatggagaggtggagaagctggaggagagcgctgtgacagtgatgtttgacaaggtgcagttcagcaacaagagcgccaacatggaccactggcagcagcgcttccccacccacgtgaaggatgtggccaccgtgtgccggcagctggccgagaagaggatgctggaccccagcatcaagggcaccttccactggagcggaaatgagcagatgaccaagtatgagatggcctgtgccatcgcagatgccttcaacctgcccagcagccacctgcggcccatcacagacagccctgtgctgggcgcccagaggcccagaaatgcccagctggactgcagcaagctggagaccctgggcatcggccagaggacccccttcagaattggcatcaaggagagcctgtggcccttcctgattgacaagcgctggaggcagacagtgttccactag

SEQ ID NO: 20840 - DNA, 1101 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagacagcgccttccaggtgaccaccggctaccagctgcctgtgtacaactaccagcccttccctgcctaccccagcagccccttccaggtgacagctggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccagcagccccttccaggtgaccaccggctaccagctgcctgtgtacaactaccaggccttccctgcctaccccaacagcgctgtgcaggtgaccaccggctaccagttccacgtgtacaactaccagatgccaccccagtgccctgtgggggagcagaggaggaacctgtggacagaggcctacaagtggtggtacctggtgtgcctgatccagaggcgggactag

SEQ ID NO: 20841 - DNA, 306 bp, Artificial Sequence
  Description of Artificial Sequence: Synthetic coding sequence
atggccagcgctggcacccagcactacagcatcggcctgcggcagaagaacagcttcaagcagagcggccccagcggcaccgtgcctgccaccccacctgagaagcccagcgagggccgggtgtggccccaggcccaccagcaggtgaagcccatctggaagctggagaagaagcaggtggagaccctgtctgctggcctgggccctggcctgctgggcgtgcccccccagcctgcctacttcttctgccccagcaccctgtgcagcagcggcaccacagctgtgattgctggccacagcagctag

SEQ ID NO: 20842 - DNA, 2121 bp, Artificial Sequence
  Description of Artificial Sequence: Synthetic coding sequence
atgattgacagcgtgaagctgcggcgggacagcgctgctgacttcttcagccactatgagtacctgtgtgccctgcagaacagcgtgcccctgcctgctgtgcgggcctgcctgcgggagggcgtgctggacttcaatgctgaccggctgcggggcgtggactgggcccccctgctgagcaccctgaagatcaacaaggacctgcccctggtgtccatcaagagcttcttccagccctggctgggggacaccggcagtgacatgaacaagttctgccgcagccgggtgcctgccatccgctacaaggatgtgaccttccagctgtgcaaggccctgaagggctgcctgagcatcagctctgtgctgaagaacctggagctgaatggcctcatcctgcgggagcgggacctgaccatcctggccaagggcctgaacaagagcgccagcctggtgcacctgagcctggccaactgccccatcggagatggcggcctggagatcatctgccagggcatcaagagcagcatcaccctgaagacagtgaacttcaccggctgcaacctgacctggcagggcgctgaccacatggccaagatcctgaagtaccagaccatgagaagacatgaggagacctgggccgagagcctgcgctacagaagaccagacctggactgcatggccggcctgcggcgcatcaccctgaactgcaacaccctcatcggggacctgggcgcctgtgcctttgctgacagcctgtctgaggacctgtggctgcgggccctggacctgcagcagtgtggcctgaccaatgaaggagccaaggccctgctggaggccctggagaccaacaccaccctggtggtgctggacatcaggaagaaccccctgattgaccacagcatgatgaaggccgtcatcaagaaggtgctgcagaatggccgcagcgccaagtctgagtaccagtggatcaccagccccagcgtgaaggagcccagcaagacagccaagcagaagaggaggaccatcatcctgggcagcggccacaagggcaaggccaccatccgcatcgtgggcctggccaccaagaagcctgtgagcagcggcaggaagcacagcctgggcaaggagtactatgccccagcccccctgcccccaggagtgtctggcttcctgccctggaggacagctgagcgggccaagaggcaccggggcttccccctcatcaagacccgggacatctgcaaccagctgcagcagcccggcttccctgtgacagtgacagtggagagccccagcagcagcgaggtggaggaggtggatgacagcagcgagagcgtgcatgaggtgcctgagaagaccagcattgagcaggaggccctgcaggagaagctggaggagtgcctgaagcagctgaaggaggagagggtcatccggctgaaggtggacaagagggtgtctgagctggagcatgaaaatgcccagctgaggaacatcaacttcagcctgtctgaggccctgcacgcccagagcctgaccaacatgatcctggatgatgagggcgtgctgggcagcattgagaacagcttccagaagttccacgccttcctggacctgctgaaggatgctggcctgggccagctggccaccatggccggcatcgaccagagcgacttccagctgctgggccacccccagatgaccagcacagtgagcaacccccccaaggaggagaagaaggccctggaggatgagaagccagagcccaagcagaatgccctgggccagatgcagaacatccagttccagaagatcactggagatgcccgcatccccctgcccctggacagcttccctgtgcctgtgtccaccccagagggcctgggcaccagcagcaacaacctgggcgtgcctgccacagagcagaggcaggagagctttgagggcttcatcgccaggatgtgcagccccagcccagatgccaccagcggcaccggcagccagaggaaggaggaggagctgagcaggaacagccgcagcagcagcgagaagaagaccaagacaggagagtacaccaagaagcacagcgacaagcagcaccctgggaaggacctgcacagctag

SEQ ID NO: 20843 - DNA, 1932 bp, Artificial Sequence
  Description of Artificial Sequence: Synthetic coding sequence
atggcctgccagcagagccgctaccacagcttcagcagcgccagccggctgcagccccggcccagcggcgtgaccattgatgagagcttcctgacagaggacaagagcacccagaacaggaagctgctgcagaagaggaggaccctggagctgcctgctgcccccctgagccactgccaggcccctgtgctgggcggcaccgggaagctgcccacccagggcgcccccccagctggccctggccaccgcttccaccctggcaccaaggctgctgcccaccagcgggagaagatccgggccctggagcccctgaaggccaagctggtgacagtgaatgaagactgcaatgaaagaatcctggccatgagagctgaggagaagtatgagatcagcctgctgaagaaggagaagatgaacctgctgaagctgattgacaagaagaatgaggagaagatcagcctgcagagcgaggtgaccaagctgaggaagaacctggccgaggagtacctgcactacctgtctgaaagagatgcctgcaagatcctgattgctgacctgaatgagctgcgctaccagcgggaggacatgagcctggcccagagccctggcatctggggagaagatcctgtgaagctgaccctggccctgaagatgacccggcaggacctgaccaggacccagatggagctgaacaacatgaaggccaactttggagatgtggtgccccggcgggactttgagatgcaggagaagaccaacaaggacctgcaggagcagctggacaccctgcgggccagctatgaggaggtgaggaaggagcacgagatcctgatgcagctgcacatgagcaccctgaaggagcgggaccagttcttcagcgagctgcaggagatccagaggaccagcacccccaggccagactggaccaagtgcaaggatgtggtggccggcggccctgagcgctggcagatgctggccgagggcaagaacagcgaccagctggtggatgtgctgctggaggagatcggcagcggcctgctgcgggagaaggacttcttccctggcctgggctacggggaggccatcccagccttcctgcgctttgatggcctggtggagaacaagaagcccagcaagaaggatgtggtgaacctgctgaaggatgcctggaaggagcggctggccgaggagcagaaggagaccttcccagacttcttcttcaacttcctggagcaccgcttcggccccagtgatgccatggcctgggcctacaccatctttgagaacatcaagatcttccacagcaatgaggtgatgagccagttctatgctgtgctgatgggcaagagaagtgaaaatgtgtatgtgacccagaaggagaccgtggcccagctgctgaaggagatgaccaatgctgacagccagaatgaaggcctgctgaccatggagcagttcaacacagtgctgaagagcaccttccccctgaagacagaggagcagatccaggagctgatggaggccggcggctggcaccccagcagcagcaatgctgacctgctgaactaccgcagcctcttcatggaggatgaggagggccagagcgagccctttgtgcagaagctgtgggagcagtacatggatgagaaggatgagtacctgcagcagctgaagcaggagctgggcatcgagctgcacgaggaggtgaccctgcccaagctgcggggcggcctgatgaccatcgaccccagcctggacaagcagacagtgaacacctacatgagccaggccttccagctgcctgagagcgagatgcctgaggagggagatgagaaggaggaggccgtggtggagatcctgcagacagccctggagcggctgcaggtgattgacatccggcgggtgggcccccgggagcctgagcccgccagctag

SEQ ID NO: 20844 - DNA, 474 bp, Artificial Sequence
  Description of Artificial Sequence: Synthetic coding sequence
atggccaccagcgcccccctgcggagcctggaggaggaggtgacctgcagcatctgcctggactacctgcgggaccctgtgaccatcgactgtggccacgtgttctgccgcagctgcaccacagatgtgcggcccatcagcggcagcaggcctgtgtgccccctgtgcaagaagcccttcaagaaggagaacatccggcctgtgtggcagctggccagcctggtggagaacatcgagcggctgaaggtggacaagggccggcagcctggagaggtgacccgggagcagcaggatgccaagctgtgtgagcggcaccgggagaagctgcactactactgtgaagatgatggcaagctgctgtgtgtgatgtgccgggagagccgggagcaccggccccacacagctgtgctgatggagaaggccgcccagccccaccgggagaagatcctgaaccacctgagcaccctgaggtag

SEQ ID NO: 20845 - DNA, 939 bp, Artificial Sequence
  Description of Artificial Sequence: Synthetic coding sequence
atggcccagccctaccccccagcccagtacccacctccaccccagaatggcatcccagcagaatatgcccctcctccaccccaccccacccaggactacagcggccagacccctgtgcccacagaacatggcatgaccctgtacaccccagcccagacccaccctgagcagcccggcagcgaggccagcacccagcccatcgccggcacccagacagtgccccagacagatgaagctgcccagacagacagccagcccctgcaccccagcgaccccacagagaagcagcagcccaagaggctgcacgtgagcaacatccccttccgcttccgggaccctgacctgcggcagatgtttggccagtttgggaagatcctggatgtggagatcatcttcaatgaaagaggcagcaagggcttcggctttgtgacctttgagaccagcagtgatgctgaccgggcccgggagaagctgaatggcaccatcgtggagggcaggaagattgaggtgaacaatgccacagcccgggtgatgaccaacaagaagacaggcaacccctacaccaacggctggaagctgaaccctgtggtgggcgctgtgtatggccctgagttctatgctgtgacaggcttcccctaccccaccaccggcacagctgtggcctacagaggagcccacctgcggggccggggccgggctgtgtacaacaccttccgggccgcccctcctcctccacccatccccacctacggggctgtggtgtaccaggacggcttctacggggctgagatctatggaggctatgctgcctaccgctatgcccagcctgctgctgctgctgctgcctacagcgacagctatggccgggtgtatgctgctgctgacccctaccaccacaccatcggccctgctgccacctacagcatcggcaccatgtag

SEQ ID NO: 20846 - DNA, 300 bp, Artificial Sequence
  Description of Artificial Sequence: Synthetic coding sequence
atggccagcctgctgcaggaccagctgaccacagaccaggacctgctgctgatgcaggagggcatgcccatgaggaaggtgcgcagcaagtcctggaagaagctgcgctacttccggctgcagaatgatggcatgacagtgtggcacgcccggcaggcccggggcagcgccaagcccagcttcagcatcagtgatgtggagaccatcagaaatggacatgattctgagctgctgcggagcctggccgaggagctgcccctggagcagggcttcaccatcgtgttccacggcagaagatag

SEQ ID NO: 20847 - DNA, 1620 bp, Artificial Sequence; identical to SEQ ID NO: 19050
  Description of Artificial Sequence: Synthetic coding sequence

SEQ ID NO: 20848 - DNA, 480 bp, Artificial Sequence
  Description of Artificial Sequence: Synthetic coding sequence
atggccaccagcgcccccctgcggagcctggaggaggaggtgacctgcagcatctgcctggactacctgcgggaccctgtgaccatcgactgtggccacgtgttctgccgcagctgcaccacagatgtgcggcccatcagcggcagcaggcctgtgtgccccctgtgcaagaagcccttcaagaaggagaacatccggcctgtgtggcagctggagaagatcctgaaccacctgagcaccctgcggcgggaccgggacaagatccagggcttccaggccaagggggaggccgacatcctggccgccctgaagaagctgcaggaccagaggcagtacatcgtggccgagtttgagcagggccaccagttcctgcgggagcgggaggagcacctgctggagcagctggccaagctggagcaggagctgacagagggccgggagaagttcaagagcagaggagtgggggagctggccaggtag

SEQ ID NO: 20849 - DNA, 579 bp, Artificial Sequence; identical to SEQ ID NO: 20257
  Description of Artificial Sequence: Synthetic coding sequence

SEQ ID NO: 20850 - DNA, 309 bp, Artificial Sequence
  Description of Artificial Sequence: Synthetic coding sequence
atgcacaacagaagccagggcttcttcttcagcagctgccacccccagaaccacgtgtcctatggctgccagagccccagcttcatcttctgccgctgccagagcctgaactttgtgtccaggacctgctaccccctgagctacttctcctatggcaaccagaccatcggcagcatcagcaacagcttccgcagcctgaactacgtgagccacagcttccagcccatctccttcatgcacagcagcttccagcctgcctgcagcgactttgtgggctggcagagccccttcctgcggaggacctgctag

SEQ ID NO: 20851 - DNA, 723 bp, Artificial Sequence
  Description of Artificial Sequence: Synthetic coding sequence
atggacctggtgcggctgggcctggagcggggggagacagccaaggaggccctggatgtgattgtgtccctgctggaggagcacggccagggcggcaactactttgaagatgccaacagctgccacagcttccagagcgcctacctgattgtggacagagatgaggcctgggtgctggagaccatcggcaagtactgggccgctgagaaggtgacagagagcatcaccgtgcagaccatgatgaacaccctgcgggacaaggccagcggcgtgtgcattgattctgagttcttcctgaccacagccagcggcgtgtctgtgctgccccagaacagaagcagcccctgcatccactacttcaccggcaccccagaccccagccgcagcatcttcaagcccttcatctttgtggatgatgtgaagctggtgcccaagacccagagcccctgctttggagatgatgatcctgccaagaaggagccccgcttccaggagaagccagacagaagacatgagctgtacaaggcccacgagtgggcccgggccatcatcgagagtgaccaggagcagggcaggaagctgcggagcaccatgctggagctggagaagcagggcctggaggccatggaggagatcctgaccagcagcgagcccctggaccctgctgaggtgggggacctcttctatgactgtgtggacacagagatcaagttcttcaagtag

SEQ ID NO: 20852 - DNA, 900 bp, Artificial Sequence
  Description of Artificial Sequence: Synthetic coding sequence
tgaagagaggaggacatctaccagtttgcctactgctacccctacacctacacccgcttccagcactacctggacagcctgcagaagaggaacatggactacttcttccgggagcagctgggccagagcgtgcagcagaggaagctggacctgctgaccatcaccagcccagacaacctgcgggagggcgctgagcagaaggtggtgttcatcaccggccgggtgcaccctggagagacccccagcagctttgtgtgccagggcatcatcgacttcctggtgtcccagcaccccatcgcctgtgtgctgcgggagtacctggtgttcaagatcgcccccatgctgaacccagatggagtgtacctgggcaactaccgctgcagcctgatgggctttgacctgaacagacactggctggaccccagcccctgggtgcaccccaccctgcacggcgtgaagcagctgattgtgcagatgtacaatgaccccaagaccagcctggagttctacatcgacatccacgcccacagcaccatgatgaatggcttcatgtatggcaacatctttgaagatgaggagcgcttccagaggcaggccatcttccccaagctgctgtgccagaatgctgaggacttctcctacagcagcaccagcttcaacagagatgctgtgaaggccggcaccggccgccgcttcctgggcggcctgctggaccacaccagctactgctacaccctggaggtgtccttctacagctacatcatcagcggcaccacagctgctgtgccctacacagaggaggcctgcatcctgagcccccacccagccctgggccagcccagcagcagccgggagtaccccagcctgaccggccaggagctgggcccccagctgaggtag

SEQ ID NO: 20853 - DNA, 1041 bp, Artificial Sequence
  Description of Artificial Sequence: Synthetic coding sequence
atggctgctgctgagcccgccagcagcggccagcaggccccagctggccagggccagggccagaggcccccaccccagcccccccaggcccaggccccccagcccccacctccaccccagctgggcggggccggcggcggcagcagcagacatgagaagagcctgggcctgctgaccaccaagtttgtgtccctgctgcaggaggccaaggatggagtgctggacctgaaggctgctgctgacaccctggccgtgcggcagaagaggcgcatctatgacatcaccaacgtgctggagggcatcgacctgattgagaagaagagcaagaacagcatccagtggaagggcgtgggcgccggctgcaacaccaaggaggtgattgaccggctgcgctacctgaaggccgagattgaggacctggagctgaaggagcgggagctggaccagcagaagctgtggctgcagcagagcatcaagaatgtgatggatgacagcatcaacaaccgcttctcctatgtgacccatgaggacatctgcaactgcttcaatggagacaccctgctggccatccaggcccccagcggcacccagctggaggtgcccatccctgagatgggccagaatggccagaagaagtaccagatcaacctgaagagccacagcggccccatccacgtgctgctgatcaacaaggagagcagcagcagcaagcctgtggtgtttcctgtgcccccaccagatgacctgacccagcccagcagccagagcctgacccctgtgaccccccagaagagctccatggccacccagaacctgcctgagcagcacgtgtctgagaggagccaggccctgcagcagaccagcgccacagacatcagcagcgctggcagcatcagcggggacatcattgatgagctgatgagcagtgatgtgttccccctgctgcggctgagccccaccccagcagatgactacaacttcaacctggatgacaatgaaggagtgtgtgacctgtttgatgtgcagatcctgaactactag

SEQ ID NO: 20854 - DNA, 396 bp, Artificial Sequence
  Description of Artificial Sequence: Synthetic coding sequence
atgagcaagcgctacctgcagaaggccaccaagggcaagctgctgatcatcatcttcatcgtgaccctgtggggcaaggtggtgagcagcgccaaccaccacaaggcccaccacgtgaagacaggcacctgtgaggtggtggccctgcaccgctgctgcaacaagaacaagattgaggagaggagccagacagtgaagtgcagctgcttccctggccaggtggccggcaccacccgggccgcccccagctgtgtggatgccagcatcgtggagcagaagtggtggtgccacatgcagccctgcctggagggggaggagtgcaaggtgctgcctgacaggaagggctggagctgcagcagcggcaacaaggtgaagaccaccagggtgacccactag

SEQ ID NO: 20855 - DNA, 306 bp, Artificial Sequence
  Description of Artificial Sequence: Synthetic coding sequence
atgcccttcttcggcaacaccttcagccccaagaagaccccacccaggaagagcgccagcctgagcaacctgcacagcctggacaggagcacccgggaggtggagctgggcctggagtatggcagccccaccatgaacctggccggccagagcctgaagtttgaaaatggccagtggattgctgagactggagtgtctgggggcgtggacagaagagaggtgcagaggctgcggcggaggaaccagcagctggaggaggagaacaacctgctgcggctgaaggtggacatcctgctggacatgtag

SEQ ID NO: 20856 - DNA, 393 bp, Artificial Sequence
  Description of Artificial Sequence: Synthetic coding sequence
atggacatcagcaagggcctgcccggcatgcagggcggcctgcacatctggatcagcgagaacaggaagatggtgcctgtgcctgagggcgcctacggcaacttctttgaggagcactgctacgtgatcctgcacgtgccccagagccccaaggccacccagggcgccagcagtgacctgcactactgggtgggcaagcaggccggggctgaggcccagggcgctgctgaggccttccagcagaggctgcaggatgagctgggcggccagacagtgctgcaccgggaggcccagggccacgagagtgactgcttctgcagctacttccggcccggcatcatctacagaaaaggaggcctggccagtgacctgaagcacgtggagaccaactag

SEQ ID NO: 20857 - DNA, 51 bp, Artificial Sequence
  Description of Artificial Sequence: Synthetic coding sequence
atgtgcaccagcgagaccttccaggccctggacacctttgaggccaggtag

SEQ ID NO: 20858 - DNA, 5553 bp, Artificial Sequence
  Description of Artificial Sequence: Synthetic coding sequence
atggagagcaacttcaaccaggagggcgtgccccggcccagctatgtgttttctgctgaccccatcgcccggcccagcgagatcaactttgatggcatcaagctggacctgagccatgagttcagcctggtggcccccaacacagaggccaacagctttgagagcaaggactacctgcaggtgtgcctgcgcatccggcccttcacccagagcgagaaggagctggagagcgagggctgtgtgcacatcctggacagccagacagtggtgctgaaggagccccagtgcatcctgggccgcctgtctgagaagagcagcggccagatggcccagaagttctccttcagcaaggtgtttggacctgccaccacccagaaggagttcttccagggctgcatcatgcagcctgtgaaggacctgctgaagggccagagccgcctcatcttcacctacggcctgaccaacagcggcaagacctacaccttccagggcacagaagaaaatattggcatcctgcccaggaccctgaatgtgctgtttgacagcctgcaggagcggctgtacaccaagatgaacctgaagccccacaggagccgggagtacctgcggctgagcagcgagcaggagaaggaggagatcgccagcaagagcgccctgctgcggcagatcaaggaggtgacagtgcacaatgacagtgatgacaccctgtatggcagcctgaccaacagcctgaacatcagcgagtttgaggagagcatcaaggactatgagcaggccaacctgaacatggccaacagcatcaagttctctgtgtgggtgtccttctttgagatctacaatgagtacatctatgacctgtttgtgcctgtgagcagcaagttccagaagaggaagatgctgcggctgagccaggatgtgaagggctacagcttcatcaaggacctgcagtggatccaggtgtctgacagcaaggaggcctaccgcctgctgaagctgggcatcaagcaccagagcgtggccttcaccaagctgaacaatgccagcagccgcagccacagcatcttcaccgtgaagatcctgcagattgaagattctgagatgagcagggtcatccgggtgtctgagctgagcctgtgtgacctggccggcagcgagaggaccatgaagacccagaatgaaggagagcggctgcgggagaccggcaacatcaacaccagcctgctgaccctgggcaagtgcatcaacgtgctgaagaacagcgagaagagcaagttccagcagcacgtgcccttccgggagagcaagctgacccactacttccagagcttcttcaacgggaagggcaagatctgcatgattgtgaacatcagccagtgctacctggcctatgatgagaccctgaatgtgctgaagttcagcgccatcgcccagaaggtgtgtgtgcctgacaccctgaacagcagccaggagaagctgtttggacctgtgaagagcagccaggatgtgtccctggacagcaacagcaacagcaagatcctgaatgtgaagagggccaccatctcctgggagaacagcctggaggacctgatggaggatgaggacctggtggaggagctggagaatgctgaggagacccagaatgtggagaccaagctgctggatgaggacctggacaagaccctggaggagaacaaggccttcatcagccatgaggagaagaggaagctgctggacctgattgaggacctgaagaagaagctgatcaatgagaagaaggagaagctgaccctggagttcaagatccgggaggaggtgacccaggagttcacccagtactgggcccagcgggaggccgacttcaaggagaccctgctgcaggagcgggagatcctggaggagaatgctgagcggcggctggccatcttcaaggacctggtgggcaaatgtgacacccgggaggaggccgccaaggacatctgtgccaccaaggtggagacagaggagacccacaactacgtgggctttgaggacatcatcgacagcctgcaggacaacgtggccgacatcaagaagcaggccgagatcgcccacctgtacatcgccagcctgcctgacccccaggaggccacagcctgcctggagctgaagttcaaccagatcaaggccgagctggccaagaccaagggggagctgatcaagaccaaggaggagctgaagaagcgggagaatgaaagtgacagcctcatccaggagctggagaccagcaacaagaagatcatcacccagaaccagaggatcaaggagctgatcaacatcatcgaccagaaggaggacaccatcaatgagttccagaacctgaagagccacatggagaacaccttcaagtgcaatgacaaggctgacaccagcagcctcatcatcaacaacaagctgatctgcaatgagaccgtggaggtgcccaaggacagcaagagcaagatctgcagcgagaggaagagggtgaatgaaaatgagctgcagcaggatgagcccccagccaagaagggcaccaccagcgctgccagcagccggcggctgaggaagctgatcagcaagcctgtgaacagaacccggcagacagagggccacagcctggtgtccatccacgtgtcctctgccatcacagaggaccagaagaagtctgaggaggtgcggcccaacattgctgagattgaggacatccgggtgctgcaggagaacaatgaaggcctgcgggccttcctgctgaccattgaaaatgagctgaagaatgagaaggaggagaaggccgagctgaacaagcagatcgtgcacttccagcaggagctgagcctgtctgagaagaagaacctgaccctgagcaaggaggtgcagcagatccagagcaactatgacatcgccatcgccgagctgcacgtgcagaagagcaagaaccaggagcaggaggagaagatcatgaagctgagcaatgaaattgaaacagccaccaggagcatcaccaacaacgtgtcccagatcaagctgatgcacaccaagattgatgagctgcggaccctggacagcgtgtcccagatcagcaacatcgacctgctgaacctgcgggacctgagcaatggcagcgaggaggacaacctgcccaacacccagctggacctgctgggcaatgactacctggtgtccaagcaggtgaaggagtaccgcatccaggagcccaaccgggagaacagcttccacagcagcattgaggccatctgggaggagtgcaaggagatcgtgaaggccagcagcaagaagagccaccagatcgaggagctggagcagcagatcgagaagctgcaggccgaggtgaagggctacaaggatgagaacaaccggctgaaggagaaggagcacaagaaccaggatgacctgctgaaggagaaggagaccctcatccagcagctgaaggaggagctgcaggagaagaatgtgaccctggatgtgcagatccagcacgtggtggagggcaagagggccctgtctgagctgacccagggcgtgacctgctacaaggccaagatcaaggagctggagaccatcctggagacccagaaggtggagtgcagccacagcgccaagctggagcaggacatcctggagaaggagagcatcatcctgaagctggagaggaacctgaaggagttccaggagcacctgcaggacagcgtgaagaacaccaaggacctgaatgtgaaggagctgaagctgaaggaggagatcacccagctgaccaacaacctgcaggacatgaagcacctgctgcagctgaaggaggaggaggaggagaccaaccggcaggagacagagaagctgaaggaggagctgagcgccagcagcgcccggacccagaacctgaaggctgacctgcagaggaaggaggaggactatgctgacctgaaggagaagctgacagatgccaagaagcagatcaagcaggtgcagaaggaggtgtctgtgatgagagatgaggacaagctgctgcgcatcaagatcaatgagctggagaagaagaagaaccagtgcagccaggagctggacatgaagcagaggaccatccagcagctgaaggagcagctgaacaaccagaaggtggaggaggccatccagcagtatgaaagagcctgcaaggacctgaatgtgaaggagaagatcatcgaggacatgaggatgaccctggaggagcaggagcagacccaggtggagcaggaccaggtgctggaggccaagctggaggaggtggagcggctggccacagagctggagaagtggaaggagaagtgcaatgacctggagaccaagaacaaccagaggagcaacaaggagcacgagaacaacacagatgtgctgggcaagctgaccaacctgcaggatgagctgcaggagagcgagcagaagtacaatgctgacaggaagaagtggctggaggagaagatgatgctgatcacccaggccaaggaggccgagaacatccggaacaaggagatgaagaagtatgcagaagatcgggagcgcttcttcaagcagcagaatgagatggagatcctgacagcccagctgacagagaaggacagcgacctgcagaagtggagggaggagcgggaccagctggtggccgccctggagatccagctgaaggccctgatcagcagcaatgtgcagaaggacaatgaaattgagcagctgaagaggatcatcagcgagaccagcaagattgagacccagatcatggacatcaagcccaagaggatcagcagcgctgaccctgacaagctgcagacagagcccctgagcaccagctttgagatcagcaggaacaagattgaagatggctctgtggtgctggacagctgtgaggtgtccacagaaaatgaccagagcacccgcttccccaagccagagctggagatccagttcacccccctgcagcccaacaagatggctgtgaagcaccctggctgcaccacccctgtgacagtgaagatccccaaggccaggaagaggaagagcaatgagatggaggaggacctggtgaagtgtgagaacaagaagaatgccacccccaggaccaacctgaagttccccatcagtgatgacaggaacagctctgtgaagaaggagcagaaggtggccatccggcccagcagcaagaagacctacagcctgcggagccaggccagcatcattggagtgaacctggccaccaagaagaaggagggcaccctgcagaagtttggagacttcctgcagcacagccccagcatcctgcagagcaaggccaagaagatcatcgagaccatgagcagcagcaagctgagcaatgtggaggccagcaaagaaaatgtgtcccagcccaagagggccaagaggaagctgtacaccagcgagatcagcagccccatcgacatcagcggccaggtgatcctgatggaccagaagatgaaggagagtgaccaccagatcatcaagaggcggctgcggaccaagacagccaagtag

SEQ ID NO: 20859 - DNA, 1527 bp, Artificial Sequence; identical to SEQ ID NO: 20134
  Description of Artificial Sequence: Synthetic coding sequence

SEQ ID NO: 20860 - DNA, 975 bp, Artificial Sequence
  Description of Artificial Sequence: Synthetic coding sequence
atgtttattggaggcctgtcctggcagaccagcccagacagcctgcgggactacttcagcaagtttggagagatccgggagtgcatggtgatgagggaccccaccaccaagaggagccggggcttcggctttgtgacctttgctgaccctgcctctgtggacaaggtgctgggccagccccaccacgagctggacagcaagaccatcgaccccaaggtggccttcccccggcgggcccagcccaagatggtgaccaggaccaagaagatctttgtgggcggcctgagcgccaacacagtggtggaggatgtgaagcagtactttgagcagtttgggaaggtggaggatgccatgctgatgtttgacaagaccaccaacagacaccggggctttggatttgtgacctttgaaaatgaagatgtggtggagaaggtgtgtgagatccacttccacgagatcaacaacaagatggtggagtgcaagaaggcccagcccaaggaggtgatgtttcctcctggcacccggggccgggcccggggcctgccctacaccatggatgccttcatgctgggcatgggcatgctgggctaccccaactttgtggccacctacggccggggctacccaggctttgcccccagctatggctaccagtttcctggcttccctgctgctgcctacggccctgtggccgctgctgctgtggccgccgcccggggctctgtgctgaacagctacagcgcccagcccaactttggagccccagccagccctgctggcagcaacccagcccggcctgggggcttccctggggccaacagccctggccctgtggccgacctgtatggccctgccagccaggacagcggcgtgggcaactacatctctgctgccagcccccagcccggcagcggcttcggccacggcattgctggccccctgattgccacagccttcaccaacggctaccactag

SEQ ID NO: 20861 - DNA, 333 bp, Artificial Sequence
  Description of Artificial Sequence: Synthetic coding sequence
tgacacaagccctgctacggggccctgtttggcccccggggcgtgaacattggaggagtgggcagctacctgtacaacccccccacccccagccctggctgcaccacccccctgagccccagcagcttcagccccccccggcccaggacaggcctgccccagggcaagaagacagagaaggtgatgagcctgggcaggaactggcaccggccctgcctgcgctgccagcgctgccacaagaccctgacagctggcagccacgccgagcatgatggagtgccctactgccacgtgccctgctacggctacctgtttggccccaaggccctgtag

SEQ ID NO: 20862 - DNA, 411 bp, Artificial Sequence
  Description of Artificial Sequence: Synthetic coding sequence
atgacagaggacagccagaggaacttccgctctgtgtactatgagaaggtgggcttccggggcgtggaggagaagaagagcctggagatcctgctgaaggatgaccggctggacacagagaagctgtgcaccttcagccagcgcttccccctgcccagcatgtaccgggccctggtgtggaaggtgctgctgggcatcctgcccccccaccacgagagccacgccaaggtgatgatgtacaggaaggagcagtacctggatgtgctgcacgccctgaaggtggtgcgctttgtgtctgatgccaccccccaggccgaggtgtacctgaggatgtaccagctggagagcggcaagctgcccaggagccccagcttccccctggagccagatgatgaggtgttcctggcctag

SEQ ID NO: 20863 - DNA, 1686 bp, Artificial Sequence
  Description of Artificial Sequence: Synthetic coding sequence
atggccagccagttctgcctgcctgagagcccctgcctgagccccccacccctgagccccctggccctggcccccagcagcgccatccgggaccagaggacagccaccaagtgggtggccatgatcccccagaagaaccagacagccagcggggacagcctggatgtgcgggtgcccagcaagccctgcctgatgaagcagaagaagagcccctgcctgtgggagatccagaagctgcaggagcagcgggagaagagaagaaggctgcagcaggagatccgggcccggcgggccctggatgtgaacaccaggaaccccaactatgagatcatgcacatgattgaggagtaccgccgccacctggacagcagcaagatctctgtgctggagcccccccaggagcaccgcatctgtgtgtgtgtgaggaagaggcccctgaaccagcgggagaccaccctgaaggaccacgcctttgatgacaaggccagcaatgagctggtgtaccagttcaccgcccagcccctggtggagagcatcttcaggaagggcatggccacctgctttgcctacggccagacaggcagcggcaagacctacaccatgggcggggacttcagcggcacagcccaggactgcagcaagggcatctatgccctggtggcccaggatgtgttcctgctgctgaggaacagcacctatgagaagctggacctgaaggtgtatggcaccttctttgagatctacggcggcaaggtgtatgacctgctgaactggaagaagaagctgcaggtgctggaggatggcaaccagcagatccaggtggtgggcctgcaggagaaggaggtgtgctgcgtggaggaggtgctgaacctggtggagatcggcaacagctgcaggaccagccggcagacccctgtgaatgcccacagcagccgcagccatgctgtgttccagatcatcctgaagagcggccgcatcatgcacggcaagttcagcctggtggacctggccggaaatgaaagaggagctgacaccaccaaggccagcaggaagaggcagctggagggcgctgagatcaacaagagcctgctggccctgaaggagtgcatcctggccctgggccagaacaagccccacacccccttccgggccagcaagctgaccctggtgctgcgggacagcttcatcggccagaacagcagcacctgcatgattgccaccatcagccctggcatgaccagctgtgagaacaccctgaacaccctgcgctatgccaacagagtgaagaagctgaatgtggatgtgcggccctaccaccggggccactaccccatcggccacgaggcccccaggatgctgaagagccacatcggcaacagcgagatgagcctgcagagagatgagttcatcaagatcccctacgtgcagagcgaggagcagaaggagattgaggaggtggagaccctgcccaccctgctgggcaaggacaccaccatcagcggcaagggcagcagccagtggctggagaacatccaggagagagctggaggagtgcaccacgacatcgacttctgcatcgcccggagcctgagcatcctggagcagaagattgatgccctgacagagatccagaagaagctgaagctgctgctggccgacctgcacgtgaagagcaaggtggagtag

SEQ ID NO: 20864 - DNA, 375 bp, Artificial Sequence
  Description of Artificial Sequence: Synthetic coding sequence
tgaagcgcctgcatcggcaactgcagcacagccctggaggagctgacagatgacatgacagaggacttcctgcctgtgctgcgggagtacatcctgtacagcgacagcatgaagtctgtgctgaagaagagggaccaggtgcaggccgagtatgaggccaagctggaggccgtggccctgaggaaagaagatcggcccaaggtgcctgcagatgtggagaagtgccaggacaggatggagtgcttcaatgctgacctgaaggctgacatggagcgctggcagaacaacaagaggcaggacttccggcagctgctgatgggcatggctgacaagaacatccagtactatgagaagagcattgctgacctgaagtag

SEQ ID NO: 20865 - DNA, 747 bp, Artificial Sequence; identical to SEQ ID NO: 20797
  Description of Artificial Sequence: Synthetic coding sequence

SEQ ID NO: 20866 - DNA, 1125 bp, Artificial Sequence
  Description of Artificial Sequence: Synthetic coding sequence
atggacttcaacatgaagaagctggccagtgatgctggcatcttcttcaccagggctgtgcagttcacagaggagaagtttggccaggccgagaagacagagctggatgcccactttgagaacctgctggcccgggctgacagcaccaagaactggacagagaagatcctgcggcagacagaggtgctgctgcagcccaaccccagcgcccgggtggaggagttcctgtatgagaagctggacaggaaggtgcccagccgggtgaccaacggggagctgctggcccagtacatggctgatgctgccagcgagctgggccccaccaccccctacggcaagaccctcatcaaggtggccgaggccgagaagcagctgggcgctgctgagcgggacttcatccacacagccagcatctccttcctgacccccctgaggaacttcctggagggggactggaagaccatcagcaaggagcggcggctgctgcagaacagaaggctggacctggatgcctgcaaggcccggctgaagaaggccaaggctgctgaggccaaggccaccctgtggaatgatgaggtggacaaggccgagcaggagctgcgggtggcccagacagaatttgaccggcaggccgaggtgacccggctgctgctggagggcatcagcagcacccacgtgaaccacctgcgctgcctgcatgaatttgtgaagagccagaccacctactatgcccagtgctaccgccacatgctggacctgcagaagcagctgggccgcttccctggcacctttgtgggcaccacagagcccgccagcccccccctgagcagcaccagccccaccacagctgctgccaccatgcctgtggtgcccagcgtggccagcctggcccctcctggagaggccagcctgtgcctggaggaggtggcccccccagccagcggcaccaggaaggcccgggtgctgtatgactatgaagctgctgacagcagcgagctggccctgctggctgatgagctgatcaccgtgtacagcctgcccggcatggaccctgactggctgattggagagcggggcaacaagaagggcaaggtgcctgtgacctacctggagctgctgtcctag

SEQ ID NO: 20867 - DNA, 1188 bp, Artificial Sequence; identical to SEQ ID NO: 20054
  Description of Artificial Sequence: Synthetic coding sequence

SEQ ID NO: 20868 - DNA, 1131 bp, Artificial Sequence
  Description of Artificial Sequence: Synthetic coding sequence
atggagaagaagaagatggtgacccagggcaaccaggagcccaccaccaccccagatgccatggtgcagcccttcaccaccatccccttccccccaccaccccagaatggcatccccacagaatatggagtgccccacacccaggactatgccggccagacaggagagcacaacctgaccctgtatggcagcacccaggcccacggggagcagagcagcaacagccccagcacccagaatggcagcctgaccacagaaggaggagcccagacagatggccagcagagccagacccagagcagcgagaacagcgagagcaagagcacccccaagaggctgcacgtgagcaacatccccttccgcttccgggaccctgacctgcggcagatgtttggccagtttgggaagatcctggatgtggagatcatcttcaatgaaagaggcagcaagggcttcggctttgtgacctttgagaacagcgcagatgctgaccgggcccgggagaagctgcatggaacagtggtggagggcaggaagattgaggtgaacaatgccacagcccgggtgatgaccaacaagaagatggtgaccccctatgccaacggctggaagctgagccctgtggtgggcgctgtgtatggccctgagctgtatgctgccagcagcttccaggctgatgtgtccctgggcaatgatgctgctgtgcccctgagcggccggggcggcatcaacacctacatccccctcatcatccctggcttcccctaccccacagctgccaccacagctgctgccttccggggggcccacctgcggggccggggccgcacagtgtatggagctgtgcgggctgtgcccccaacagccatcccagcctacccaggagtggtgtaccaggacggcttctatggagctgacctgtatggaggctacgccgcctaccgctatgcccagcctgccacagccacagctgccacagctgctgctgctgctgctgctgcctacagtgatggctacggccgggtgtacacagctgacccctaccacgccctggccccagctgccagctatggagtgggcgctgtggccagcctgtaccggggcggctacagcagatttgccccctactag

SEQ ID NO: 20869 - DNA, 1638 bp, Artificial Sequence
  Description of Artificial Sequence: Synthetic coding sequence
atgggcaccccctggaggcctcccagccggcggccctggcgctggcccaccggctgcaccaggaagacctgtggcccccccacctggagcctggagaggaccaggtcctggctgagcggccgggagcacagcgtcttcaccggggtggccatcgtgcactgcagcagcaaggaccaccagctggacaccagggtgtctgagttctatgaggagaccaaggtgaagttcagcgagctgtctgaggagctgctgtgggagtatgtgcacagcggggagcccatggacaaggccggcggctacggcatccaggccctgggcggcatgctggtggagagcgtgcacggggacttcctgaatgtggtgggcttccccctgaaccacttctgcaagcagctggtgaagctgtactacccacccaggcctgaggacctgcggcgctctgtgaagcatgacagcatcccagctgctgacacctttgaggacctgagtgatgtggagggcggcggcagcgagcccacccagagagatgctggcagcagagatgagaaggccgaggccggggaggccggccaggccacagctgaggccgagtgccacaggacccgggagaccctgccccccttccccacccggctgctggagctgattgagggcttcatgctgagcaagggcctgctgacagcctgcaagctgaaggtgtttgacctgctgaaggatgaggccccccagaaggctgctgacatcgccagcaaggtggatgccagcgcctgtggcatggagcggctgctggacatctgtgccgccatgggcctgctggagaagacagagcagggctacagcaacacagaaacagccaacgtgtacctggccagtgatggagagtacagcctgcacggcttcatcatgcacaacaatgacctgacctggaacctcttcacctacctggagtttgccatccgggagggcaccaaccagcaccaccgggccctgggcaagaaggcagaagatctcttccaggatgcctactaccagagccctgagacccggctgcgcttcatgagggccatgcacggcatgaccaagctgacagcctgccaggtggccacagccttcaacctgagccgcttcagcagcgcctgtgatgtgggcggctgcaccggggccctggcccgggagctggcccgggagtaccccaggatgcaggtgacagtgtttgacctgcctgacatcatcgagctggccgcccacttccagcccccaggcccccaggccgtgcagatccactttgctgctggggacttcttccgggaccccctgcccagcgctgagctgtatgtgctgtgccgcatcctgcatgactggccagatgacaaggtgcacaagctgctgagccgggtggccgagagctgcaagccaggggccggcctgctgctggtggagaccctgctggatgaggagaagagggtggcccagagggccctgatgcagagcctgaacatgctggtgcagacagagggcaaggagaggagcctgggggagtaccagtgcctgctggagctgcacggcttccaccaggtgcaggtggtgcacctgggcggcgtgctggatgccatcctggccaccaaggtggccccctag

SEQ ID NO: 20870 - DNA, 621 bp, Artificial Sequence
  Description of Artificial Sequence: Synthetic coding sequence
atgagccagaccagcctgaagcagaagaagaatgaacctggcatgaggagcagcaaggagagcctggaggccgagaagaggaaggagagtgacaagacaggagtgcggctgagcaaccagatgagaagagctgtgaaccccaaccacagcctgcgctgctgccccttccagggccacagcagctgccgccgctgcctgtgtgccgctgagggcacagccctgggcccctgccacaccatccgcatctacatccacatgtgcctgctgtgggagcagggccagcagatcaccatgatgagggtgtcccgggaccacaccacagattctggaggagagccccagaccacctggggcagccaggagagcagcctgaggaagacagacagccggggctacctggtgcgcagccagtggagccgcatcagccgcagccccagcaccaaggcccccagcattgatgagcccaggagcaggaacaccagcgccaagctgcccagcagcagcaccagcagcaggacccccagcaccagccccagcctgcatgacagcagccccccacccctgagcggccagcccagcctgcagcccccagccagcccccagctgcccaggagcctgtag

SEQ ID NO: 20871 - DNA, 414 bp, Artificial Sequence
  Description of Artificial Sequence: Synthetic coding sequence
atggcccctggcacccccaagagcctgctgctgagcgccagcatcaagcgggagggggagagccccacagccagcccccacagcagcgccacagatgacctgcaccacagcgaccgctaccagaccttcctgcgggtgcgggccaaccggcagacccggctgaatgcccgcatcggcaagatgaagaggaggaagcaggatgagggccaggtgtgccccctgtgcaaccggcccctggccggcagcgagcaggagatgagcagacatgtggagcactgcctgagcaagcgggagggcagctgcatggccgaggatgatgctgtggacatcgagcacgagaacaacaacagatttgaggagtatgagtggtgtggccagaagaggatccgggccaccaccctgctggagggctag

SEQ ID NO: 20872 - DNA, 570 bp, Artificial Sequence
  Description of Artificial Sequence: Synthetic coding sequence
atgatccccatctgccctgtggtgtccttcacctacgtgcccagccggctgggagaagatgccaagatggccactggaaactacttcggcttcacccacagcggggctgctgctgctgctgctgctgcccagtacagccagcagcctgccagcggcgtggcctacagccaccccaccaccgtggccagctacacagtgcaccaggcccctgtggccgcccacacagtgacagctgcctatgccccagctgctgccaccgtggccgtggcccggcctgcccctgtggccgtggccgccgccgccacagctgctgcctacggcggctaccccacagcccacacagccacagattatggctacacccagaggcagcaggaggcccctcctcctcctcctccagccaccacccagaactaccaggacagctacagctatgtgcgcagcacagccccagctgtggcctatgacagcaagcagtactaccagcagcctgctgccacagaagctggcagcagcagcagctgctgctgctgctgcaacagctgcctggaccgggaccacctgtactag

SEQ ID NO: 20873 - DNA, 387 bp, Artificial Sequence
  Description of Artificial Sequence: Synthetic coding sequence
atggatgctgacagtgatgtggccctggacatcctgatcaccaacgtggtgtgtgtgttccgcacccgctgccacctgaacctgaggaagatcgccctggagggcgccaacgtcatctacaagagagatgtgggcaaggtgctgatgaagctgaggaagccccgcatcacagccaccatctggagcagcggcaagatcatctgcacaggagccaccagcgaggaggaggccaagtttggagcccggcggctggcccggagcctgcagaagctgggcttccaggtgatcttcacagacttcaaggtggtgaatgtgctggccgtgtgcaacatgccctttgagatccggctgcctgagttcaccaagaacaaccggccccacgcctag

SEQ ID NO: 20874 - DNA, 381 bp, Artificial Sequence
  Description of Artificial Sequence: Synthetic coding sequence
atgtggacagcccggggccccttcagaagagaccgctggagcagtgaagatgaggaggccgccggccccagccaggccctgagccccctgctgagtgacaccaggaagatcgtgtctgagggggagctggaccagctggcccagatccggcccctcatcttcaacttccacgagcagacagccatcaaggactgcctgaagatcctggaggagaagacagctgcctatgacatcatgcaggagttcatggccctggagctgaagaacctgcctggagagttcaacagcggcaaccagcccagcaaccgggagaagaaccgctacagagacatcctgcccttccagcaccacggctacagcggccccaatgaaagaacatag

SEQ ID NO: 20875 - DNA, 912 bp, Artificial Sequence
  Description of Artificial Sequence: Synthetic coding sequence
gaagatgagtacatccagagccacaactttgacagcgccatgaaggtgaccagccagggccagcccagccctgtggagccccggggccccttctacttctgccgcctgctgctggatgacctgggcatgaacagctgggacaggaggaagaacttccacctgctgaagaagaacagcaagctgctgcgggagctgaagaacctggacagccggcagtgccgggagacccacaagattgctgtgttctacatcgccgagggccaggaggacaagtgcagcatcctgagcaatgaaagaggcagccaggcctatgaagattttgtggccggcctgggctgggaggtggacctgagcacccactgcggcttcatgggcggcctgcagagaaatggcagcacaggccagacagccccctactatgccaccagcacagtggaggtgatcttccacgtgtccaccaggatgcccagcgacagtgatgacagcctgaccaagaagctgcggcacctgggcaatgatgaggtgcacatcgtgtggagcgagcacagccgggactacagaagaggcatcatccccacagcctttggagatgtgtccatcatcatctaccccatgaagaaccacatgttcttcatcgccatcaccaagaagccagaggtgcccttcttcggccccctgtttgatggagccatcgtgtctgggaagctgctgcccagcctggtgtgtgccacctgcatcaatgccagcagagctgtgaagtgcctgatccccctgtaccagagcttctatgaggagcgggccctgtacctggaggccatcatccagaaccaccgggaggtgatgacctttgaggactttgctgcccaggtgttcagccccagccccagctacagcctgagcggcacagactag

SEQ ID NO: 20876 - DNA, 2883 bp, Artificial Sequence
  Description of Artificial Sequence: Synthetic coding sequence
atggaggtgcaggtgtcccaggccagcctgggctttgagctgacctctgtggagaagagcctgcgggagtggagccggctgagccgggaggtgattgcctggctgtgccccagcagccccaacttcatcctgaacttccccccacctccttctgccagctctgtgtccatggtgcagctgttcagcagccccttcggctaccagagccccagcggccacagcgaggaggagcgggagggcaacatgaagagcgccaagccccaggtgaaccacagccagcacggggagagccagagggccctgagccccctgcagagcaccctgagcagcgctgccagccccagccaggcctatgagacctacattgaaaatggcctcatctgcctgaagcacaagatccggaacatcgagaagaagaagctgaagctggaggactacaaggaccggctgaagagcggggagcacctgaacccagaccagctggaggccgtggagaagtatgaggaggtgctgcacaacctggagtttgccaaggagctgcagaagaccttcagcggcctgagcctggacctgctgaaggcccagaagaaggcccagaggcgggagcacatgctgaagctggaggccgagaagaagaagctgcggaccatcctgcaggtgcagtatgtgctgcagaacctgacccaggagcacgtgcagaaggacttcaagggcggcctgaatggagctgtgtacctgcccagcaaggagctggactacctgatcaagttcagcaagctgacctgcccagagagaaatgaaagcctgtctgtggaggaccagatggagcagagcagcctgtacttctgggacctgctggagggcagcgagaaggctgtggtgggcaccacctacaagcacctgaaggacctgctgagcaagctgctgaacagcggctactttgagagcatccctgtgcccaagaatgccaaggagaaggaggtgcccctggaggaggagatgctgatccagagcgagaagaagacccagctgagcaagacagaatctgtgaaggagagcgagagcctgatggagtttgcccagcctgagatccagccccaggagttcctgaacagacgctacatgacagaggtggactacagcaacaagcagggcgaggagcagccctgggaggccgactatgccaggaagcccaacctgcccaagcgctgggacatgctgacagagccagatggccaggagaagaagcaggagagcttcaagtcctgggaggccagcggcaagcaccaggaggtgtccaagccagctgtgtccctggagcagaggaagcaggacaccagcaagctgcggagcaccctgcctgaggagcagaagaagcaggagatcagcaagagcaagcccagccccagccagtggaagcaggacacccccaagagcaaggccggctacgtgcaggaggagcagaagaagcaggagacccccaagctgtggcctgtgcagctgcagaaggagcaggaccccaagaagcagacccccaagtcctggacccccagcatgcagagcgagcagaacaccaccaagtcctggaccacccccatgtgtgaggagcaggacagcaagcagcctgagacccccaagtcctgggagaacaacgtggagagccagaagcacagcctgaccagccagagccagatcagccccaagtcctggggcgtggccacagccagcctcatccccaatgaccagctgctgcccaggaagctgaacacagagcccaaggatgtgcccaagcctgtgcaccagcctgtgggcagcagcagcaccctgcccaaggaccctgtgctgaggaaggagaagctgcaggacctgatgacccagatccagggcacctgcaacttcatgcaggagagcgtgctggactttgacaagcccagcagcgccatccccaccagccagcccccatctgccaccccaggcagccctgtggccagcaaggagcagaacctgagcagccagagcgacttcctgcaggagcccctgcaggccaccagcagccctgtgacctgcagcagcaatgcctgcctggtgaccacagaccaggccagcagcggcagcgagacagagttcatgaccagcgagaccccagaggccgccatccccccaggcaagcagcccagcagcctggccagccccaacccccccatggccaagggcagcgagcagggcttccagagccccccagccagcagcagctctgtgaccatcaacacagcccccttccaggccatgcagacagtgttcaacgtgaatgcccccctgccccccaggaaggagcaggagatcaaggagagcccctacagccctggctacaaccagagcttcaccacagccagcacccagaccccaccccagtgccagctgcccagcatccacgtggagcagacagtgcacagccaggagacagccaactaccacccagatggcaccatccaggtgtccaatggcagcctggccttctacccagcccagaccaacgtgttcccccggcccacccagccctttgtgaacagccggggctctgtgcggggctgcacccggggcggccgcctcatcaccaacagctaccgcagccctgggggctacaagggctttgacacctaccggggcctgcccagcatcagcaatggaaactacagccagctgcagttccaggcccgggagtacagcggggccccctacagccagagggacaacttccagcagtgctacaagaggggcggcaccagcggcggcccccgggccaacagccgggccaactgcttcatcatgaggaacagcctgctgctgatcaagcagcagggcggcgtcatcctgctgaggtag

SEQ ID NO: 20877 - DNA, 1746 bp, Artificial Sequence
  Description of Artificial Sequence: Synthetic coding sequence
aacaacaacggcacctatgatggcatcgcctactttgagtgcaaggagaagcacggcatctttgccccaccccagaagatcagccacatccctgagaactttgatgattatgtggacatcaatgaagatgaggactgctacagtgatgagcgctaccagtgctacaaccaggagcagaatgacacagagggccccaaggaccgggagaaggatgtgtctgagtacttctatgagaagagcctgcccagcgtgaatgacatcgaggcctctgtgaacagaagccgcagcctgaagattgaaacagacaacgtgcaggacatcagcggcgtgctggaggcccacgtgcaccagcagagctctgtggacagccagatcagcagcaaagaaaacaaggacctgatcagtgatgccacagagaaggtgtccattgctgctgaagatgacaccctggacaacaccttcagcgaggagctggagaagcagcagcagttcacagaggaggaggacaacctgtatgcagaggccagcgagaagctgtgcacccccctgctggacctgctgacccgggagaagaaccagctggaggcccagctgaagagcagcctgaatgaggagaagaagagcaagcagcagctggagaagatcagcctgctgacagacagcctgctgaaggtgtttgtgaaggacacagtgaaccagctgcagcagatcaagaagaccagagatgagaagatccagctgagcaaccaggagctgctgggagatgaccagaagaaggtgaccccccaggacctgagccagaatgtggaggagcagagccccagcatcagcggctgcttcctgagcagcgagctggaggatgagaaggaggagatcagcagcccagacatgtgccccaggcctgagagccctgtgtttggagccagcggccaggaggagctggccaagaggctggccgagctggagctgagccgggagttcctgagcgccctgggagatgaccaggactggtttgatgaggactttggcctgagcagcagccacaagatccagaagaacaaggccgaggagaccatcgtgcccctgatggccgagcccaagagggtgacccagcagccctgtgagaccctgctggccgtgccccacacagctgaggaggtggagatcctggtgcacaatgctgctgaggagctgtggaagtggaaggagctgggccatgacctgcacagcatcagcatccccaccaagctgctgggctgtgccagcaagggcctggacatcgagagcaccagcaagagggtgtacaagcaggccgtgtttgacctgaccaaggagatctttgaggagatctttgctgaggaccccaacctgaaccagcctgtgtggatgaagccctgccgcatcaacagcagctacttccggcgggtgaagaaccccaacaacctggatgagatcaagagcttcatcgccagcgaggtgctgaagctgttcagcctgaagaaggagcccaaccacaagacagactggcagaagatgatgaagtttggaaggaagaagagggacagagtggaccacatcctggtgcaggagctgcacgaggaggaggcccagtgggtgaactatgatgaagatgagctgtgtgtgaagatgcagctggctgatggcatctttgagaccctcatcaaggacaccattgatgtgctgaaccagatcagcgagaagcagggccgcatgctgctggtgtag

SEQ ID NO: 20878 - DNA, 345 bp, Artificial Sequence
  Description of Artificial Sequence: Synthetic coding sequence
atgtggagcctgacagccagcgagggggagagcaccacagcccacttcttcctgggcgctggagatgagggcctgggcacccggggcatcggcatgaggcctgaggagagtgacagcgagctgctggaggatgaggaggatgaggtgcccccagagccccagatcatcgtgggcatctgtgccatgaccaagaagagcaagagcaagcccatgacccagatcctggagcggctgtgccgctttgactacctgactgtggtgatcctgggagaagatgtgatcctgaatgaacctgtggagaactggcccagctgccactgcctgatctccttccacagcaagtag

SEQ ID NO: 20879 - DNA, 918 bp, Artificial Sequence
  Description of Artificial Sequence: Synthetic coding sequence
atggaggccgagagcttcccctgcctgctgcggcccttcttcaaggagaggagctgtgccctgcggcctgccttccacacagccaagtgtgagaagctgcagaaggagaaggaggagctggagaggagatttgaggccgagatggcccggctgcaggaggagcacggggaccagctgctgagcatccgctgccagcaccaggagcaggtggaggacctgacagccagccatgatgctgccctgctggagatggagaacaaccacacagtggccatcaccatcctgcaggatgaccatgaccacaaggtgcaggagctgatgagcacccatgagctggagaagaaggagctggaggagaactttgagaagctgcggctgagcctgcaggaccaggtggacaccctgaccttccagagccagagcctgcgggaccgggccaggagatttgaggaggccctgaggaagaacacagaggagcagctggagatcgccctggccccctaccagcacctggaggaggacatgaagagcctgaagcaggtgctggagatgaagaaccagcagatccacgagcaggagaagaagatcctggagctggagaagctggccgagaagaacatcatcctggaggagaagatccaggtgctgcagcagcagaatgaagacctgaaggccagaattgaccagaacacagtggtgacccggcagctgtctgaggagaatgccaacctgcaggagtatgtggagaaggagacccaggagaagaagaggctgagcaggaccaatgaggagctgctgtggaagctgcagacaggagaccccaccagccccatcaagctgagccccaccagccctgtgtaccggggcagcagcagcggccccagcagccctgcccgggtgtccaccaccccaagatag

SEQ ID NO: 20880 - DNA, 2319 bp, Artificial Sequence
  Description of Artificial Sequence: Synthetic coding sequence
atgcaggagctggaggagctgaggaagcagctgggctctgtggccaccggcagcaccctgcagcagagcctggagctgaagaggaagatgctgcgggacaagcagaacaagaagaacagcggccagcacctgcccatcttccctgcctgggtgtatgaaagacctgccctgattggagacttcctgattggagctggcatcagcacagacacagccctgcccatcggcaccctgcccctggccagccaggagagcgctgtggtggaggacctgctgtatgtgctggtgggcgtggatggccgctacgtgtctgcccagcccctggccggccggcagagcaggaccttcctggtggaccccaacctggacctgagcatccgggagctggtgcaccgcatcctgcctgtggccgccagctacagcgctgtgacccgcttcatcgaggagaagagcagctttgaatatggccaggtgaaccacgccctggccgccgccatgaggaccctggtgaaggagcacctgatcctggtgtcccagctggagcagctgcaccggcagggcctgctgagcctgcagaagctgtggttctacatccagcctgccatgaggaccatggacatcctggccagcctggccacctctgtggacaagggagaatgtctgggcggcagcaccctgagcctgctgcatgaccgctccttctcctacacaggagacagccaggcccaggagctgtgcctgtacctgaccaaggccgccagcgccccctactttgaggtgctggagaagtggatctaccggggcatcatccatgacccctacagcgagttcatggtggaggagcacgagctgaggaaggagcgcatccaggaggactacaatgacaagtactgggaccagcgctacaccatcgtgcagcagcagatccccagcttcctgcagaagatggctgacaagatcctgagcacaggcaagtacctgaatgtggtgcgggagtgtggccatgatgtgacctgccctgtggccaaggagatcatctacaccctgaaggagcgggcctacgtggagcagatcgagaaggccttcaactatgccagcaaggtgctgctggacttcctgatggaggagaaggagctggtggcccacctgcggagcatcaagcgctacttcctgatggaccagggcgacttctttgtgcacttcatggacctggccgaggaggagctgaggaagcctgtggaggacatcaccccaccccggctggaggccctgctggagctggccctgaggatgagcacagccaacacagaccccttcaaggatgacctgaagattgacctgatgcctcatgacctgatcacccagctgctgcgggtgctggccatcgagaccaagcaggagaaggccatggcccatgctgaccccacagagctggccctgagcggcctggaggccttctcctttgactacatcgtgaagtggcccctgagcctcatcatcaacaggaaggccctgacccgctaccagatgctgttccgccacatgttctactgcaagcacgtggagcggcagctgtgcagcgtgtggatcagcaacaagacagccaagcagcacagcctgcacagcgcccagtggtttgctggggccttcaccctgcggcagaggatgctgaactttgtgcagaacatccagtactacatgatgtttgaggtgatggagcccacctggcacatcctggagaagaacctgaagagcgccagcaacattgatgatgtgctgggccaccacacaggcttcctggacacctgcctgaaggactgcatgctgaccaaccctgagctgctgaaggtgttcagcaagctgatgtctgtgtgtgtgatgttcaccaactgcatgcagaagttcacccagagcatgaagctggatggagagctgggcggccagaccctggagcacagcacagtgctgggcctgcctgctggagctgaggagcgggccaggaaggagctggccaggaagcacctggccgagcacgccgacacagtgcagctggtgtctggctttgaggccaccatcaacaagtttgacaagaacttcagcgcccacctgctggacctgctggcccggctgagcatctacagcaccagtgactgtgagcacggcatggccagcgtcatcagccggctggacttcaacggcttctacacagagcggctggagcggctgtctgctgagaggagccagaaggccaccccccaggtgcctgtgctgcggggccccccagccccagccccccgggtggccgtgacagcccagtag

SEQ ID NO: 20881 - DNA, 1203 bp, Artificial Sequence
  Description of Artificial Sequence: Synthetic coding sequence
atggacttcaacatgaagaagctggccagtgatgctggcatcttcttcaccagggctgtgcagttcacagaggagaagtttggccaggccgagaagacagagctggatgcccactttgagaacctgctggcccgggctgacagcaccaagaactggacagagaagatcctgcggcagacagaggtgctgctgcagcccaaccccagcgcccgggtggaggagttcctgtatgagaagctggacaggaaggtgcccagccgggtgaccaacggggagctgctggcccagtacatggctgatgctgccagcgagctgggccccaccaccccctacggcaagaccctcatcaaggtggccgaggccgagaagcagctgggcgctgctgagcgggacttcatccacacagccagcatctccttcctgacccccctgaggaacttcctggagggggactggaagaccatcagcaaggagcggcggctgctgcagaacagaaggctggacctggatgcctgcaaggcccggctgaagaaggccaaggctgctgaggccaaggccaccaccgtgcctgacttccaggagacccggcccaggaactacatcctgagcgccagcgccagcgccctgtggaatgatgaggtggacaaggccgagcaggagctgcgggtggcccagacagaatttgaccggcaggccgaggtgacccggctgctgctggagggcatcagcagcacccacgtgaaccacctgcgctgcctgcacgagtttgtgaagagccagaccacctactatgcccagtgctaccgccacatgctggacctgcagaagcagctgggcagcagccagggcgccatcttccctggcacctttgtgggcaccacagagcccgccagcccccccctgagcagcaccagccccaccacagctgctgccaccatgcctgtggtgcccagcgtggccagcctggcccctcctggagaggccagcctgtgcctggaggaggtggcccccccagccagcggcaccaggaaggcccgggtgctgtatgactatgaagctgctgacagcagcgagctggccctgctggctgatgagctgatcaccgtgtacagcctgcccggcatggaccctgactggctgattggagagcggggcaacaagaagggcaaggtgcctgtgacctacctggagctgctgtcctag

SEQ ID NO: 20882 - DNA, 1827 bp, Artificial Sequence
  Description of Artificial Sequence: Synthetic coding sequence
atgcccttctggcccatccgctgcctgaagaggagcaggaggatgccccggggcggggccggggagcgggagaaggtgcctgccaaccctgaggccctgctgctgatggccagcagccagagggacatggaggactgggtgcaggccatcagaagagtcatctgggcccccctgggcggcggcatcttcggccagaggctggaggagaccgtgcaccacgagaggaaatatggcccccggctggcccccctgctggtggagcagtgtgtggacttcatccgggagcggggcctgacagaggagggcctcttcaggatgcctggccaggccaacctggtgcgggacctgcaggacagctttgactgtggggagaagcccctgtttgacagcaccacagatgtgcacacagtggccagcctgctgaagctgtacctgcgggagctgcctgagcctgtggtgccctttgcccgctatgaggacttcctgagctgtgcccagctgctgaccaaggatgaaggagagggcaccctggagctggccaagcaggtgagcaacctgccccaggccaactacaacctgctgcgctacatctgcaagttcctggatgaggtgcaggcctacagcaatgtgaacaagatgtctgtgcagaacctggccaccgtgtttggccccaacatcctgcggccccaggtggaggaccctgtgaccatcatggagggcaccagcctggtgcagcacctgatgacagtgctgatcaggaagcacagccagctgttcaccgcccctgtgcctgagggccccaccagcccccggggcggcctgcagtgtgctgtgggctggggcagcgaggaggtgacccgggacagccagggcgagcccggcggccctggcctgcctgcccacaggaccagcagcctggatggagctgctgtggccgtgctgagcaggacagcccccaccggccctggcagccgctgcagccctgggaagaaggtgcagaccctgcccagctggaagagcagcttccggcagcccaggagcctgagcggcagccccaagggcggcggcagcagcctggaggtgcccatcatcagcagcggcggcaactggctgatgaatggcctgagcagcctgcggggccaccggcgggccagcagcggggaccggctgaaggacagcggctctgtgcagaggctgagcacctatgacaacgtgcctgcccctggcctggtgcccggcatccccagcgtggcctccatggcctggagcggggccagcagcagcgagagctctgtgggcggcagcctgagcagctgcacagcctgccgggccagtgacagcagcgcccggagcagcctgcacacagactgggccctggagcccagccccctgcccagcagcagcgaggaccccaagagcctggacctggaccacagcatggatgaagctggagctggggccagcaacagcgagcccagcgagccagacagccccacccgggagcacgcccggcgctctgaggccctgcagggcctggtgacagagctgcgggcagagctgtgccggcagaggacagaatatgaaagatctgtgaagagaattgaggagggcagcgctgacctgaggaagaggatgagccggctggaggaggagctggaccaggagaagaagaagtacatcatgctggagatcaagctgagaaattctgagcgggcccgggaggatgctgagaggaggaaccagctgctgcagcgggagatggaggagttcttcagcaccctgggcagcctgactgtgggcgccaagggggcccgggcccccaagtag

SEQ ID NO: 20883 - DNA, 708 bp, Artificial Sequence
  Description of Artificial Sequence: Synthetic coding sequence
atgttttctgaggagtgcatcatggatgtgattggctgcctggagtatgaccctgccctgagccagcccaggaagcaccgggagttcctgaccaagacagccaagttcaaggaggtgatccccatcagtgaccctgagctgaagcagaagatccaccagacctacagagtgcagtacatccaggacatggtgctgcccaccccatctgtgtttgaggagaacatgctgagcaccctgcacagcttcatcttcttcaacaaggtggagatcgtgggcatgctgcaggaggatgagaagttcctgacagacctgtttgcccagctgacagatgaggccacagatgaggagaagaggcaggagctggtgaacttcctgaaggagttctgtgccttcagccagaccctgcagccccagaacagagatgccttcttcaagaccctgagcaacatgggcatcctgcctgccctggaggtgatcctgggcatggatgacacccaggtgcgctctgctgccacagacatcttctcctacctggtggagtacaaccccagcatggtgcgggagtttgtgatgcaggaggcccagcagaatgatgatgtgtccaagaagctgacagagcagaagatcaccagcaaggtgaacatcatctgcaccaacagcaagtacctgtacatcggcagctacaactgcttctactacagcttctag

SEQ ID NO: 20884 - DNA, 3513 bp, Artificial Sequence
  Description of Artificial Sequence: Synthetic coding sequence
gtgtacaagggccgccacgtgaagacaggccagctggccgccatcaaggtgatggatgtgacagaagatgaggaggaggagatcaagctggagatcaacatgctgaagaagtacagccaccacaggaacatcgccacctactacggggccttcatcaagaagagccccccaggccatgatgaccagctgtggctggtgatggagttctgtggggccggcagcatcacagacctggtgaagaacaccaagggcaacaccctgaaggaggactggatcgcctacatcagccgggagatcctgcggggcctggcccacctgcacatccaccacgtgatccaccgggacatcaagggccagaatgtgctgctgacagaaaatgctgaggtgaagctggtggactttggagtgtctgcccagctggacagaacagtgggcagaagaaacaccttcatcggcaccccctactggatggcccctgaggtgattgcctgtgatgagaacccagatgccacctatgactacagaagtgacctgtggagctgtggcatcacagccatcgagatggccgagggcgccccacccctgtgtgacatgcaccccatgagggccctcttcctgatccccagaaatcctccaccccggctgaagagcaagaagtggagcaagaagttcttctccttcatcgagggctgcctggtgaagaactacatgcagaggcccagcacagagcagctgctgaagcaccccttcatccgggaccagcccaatgaaaggcaggtgcgcatccagctgaaggaccacatcgacaggaccaggaagaagagaggagagaaggatgaaacagaatatgagtacagcggcagcgaggaggaggaggaggaggtgcctgagcaggagggggagcccagcagcatcgtgaatgtgcctggagagagcaccctgcggcgggacttcctgcggctgcagcaggagaacaaggagaggtctgaggccctgcggcggcagcagctgctgcaggagcagcagctgcgggagcaggaggagtacaagaggcagctgctggccgagcggcagaagagaattgagcagcagaaggagcagaggcggcggctggaggagcagcagaggcgggagcgggaggcccggcggcagcaggagcgggagcagaggagaagagagcaggaggagaagaggcggctggaggagctggagaggaggaggaaggaggaggaggagcggcggcgggcagaggaggagaagagaagagtggagcgggagcaggagtacatccggcggcagctggaggaggagcagaggcacctggaggtgctgcagcagcagctgctgcaggagcaggccatgctgctgcatgaccaccggcggccccacccccagcacagccagcagcccccaccaccccagcaggagaggagcaagcccagcttccacgcccctgagcccaaggcccactatgagcctgctgaccgggcccgggaggtggaggaccgcttcaggaagaccaaccacagcagccctgaggcccagagcaagcagacaggccgggtgctggagccccctgtgcccagccgctctgagagcttcagcaatggaaattctgagagcgtgcacccagccctgcagaggcctgctgagccccaggtgcctgtgaggaccaccagccgcagccctgtgctgagcagaagagacagccccctgcagggcagcggccagcagaacagccaggccggccagaggaacagcaccagcattgagccccggctgctgtgggagcgggtggagaagctggtgccccggcccggcagcggcagcagcagcggcagcagcaacagcggcagccagcccggcagccaccctggcagccagagcggcagcggggagcgcttccgggtgcgcagcagcagcaagtctgagggcagccccagccagaggctggagaatgctgtgaagaagccagaggacaagaaggaggtgttccggcccctgaagccagctgacctgacagccctggccaaggagctgcgggctgtggaggatgtgcggcccccccacaaggtgacagactacagcagcagcagcgaggagagcggcaccacagatgaggaggatgatgatgtggagcaggagggcgcagatgagagcaccagcggccctgaggacaccagggctgccagcagcctgaacctgagcaatggagaaacagagagcgtgaagaccatgattgtgcatgatgatgtggagagcgagcccgccatgacccccagcaaggagggcaccctgattgtgcggcagacccagagcgccagcagcaccctgcagaagcacaagagcagcagcagcttcacccccttcatcgacccccggctgctgcagatcagccccagcagcggcaccaccgtgacctctgtggtgggcttcagctgtgatggcatgaggcctgaggccatccggcaggaccccaccaggaaaggatctgtggtgaatgtgaaccccaccaacacccggccccagagcgacaccccagagatcaggaagtacaagaagcgcttcaacagcgagatcctgtgtgccgccctgtggggcgtgaacctgctggtgggcacagagagcggcctgatgctgctggacaggagcggccagggcaaggtgtaccccctcatcaacagaagacgcttccagcagatggatgtgctggagggcctgaatgtgctggtgaccatcagcggcaagaaggacaagctgcgggtgtactacctgtcctggctgaggaacaagatcctgcacaatgaccctgaggtggagaagaagcagggctggaccaccgtgggggacctggagggctgtgtgcactacaaggtggtgaagtatgaaagaatcaagttcctggtgattgccctgaagagctctgtggaggtgtatgcctgggcccccaagccctaccacaagttcatggccttcaagagctttggagagctggtgcacaagcccctgctggtggacctgactgtggaggagggccagaggctgaaggtgatctacggcagctgtgccggcttccacgctgtggatgtggacagcggctctgtgtatgacatctacctgcccacccacatccagtgcagcatcaagccccacgccatcatcatcctgcccaacacagatggcatggagctgctggtgtgctatgaagatgagggcgtgtatgtgaacacctacggccgcatcaccaaggatgtggtgctgcagtggggcgagatgcccacctctgtggcctacatccgcagcaaccagaccatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgtacttcatgaccctgggccgcaccagcctgctgtcctggtag

SEQ ID NO: 20885 - DNA, 1476 bp, Artificial Sequence
  Description of Artificial Sequence: Synthetic coding sequence
gtcatcatccaccgggtgctggagaagcaggaggtggaggtgttctacccagactttggaaacatcggcatcgtgcagaagagcagcctgcgcttcctgaagtgctgctacaccaagctgcctgcccaggccatcccctgcagcctggcctgggtgcggcctgtggaggagcactggaccagcaaggccatcctgcagttccagaagctgtgtggcctgaagcccctggtgggcgtggtggatgaatatgtggatggcatcctgaacatcttcctgtgtgacaccagcagcaatgaagatgtgtacttccaccacgtgctgaggacagagggccacgccatcgtgtgccgggagaacatcagcagcaagggcttcagcgagctgaaccccctggccctgtacaccaccagcagcggcggccctgaggacatcgtgctgacagagctgggctaccccagccagcagcactacttcaatgaagacaggaagatcagcccccagagcaaggagagcgagctgcgcatcctgcaggacatcaatgatgagaagagcctgagccacctgaagtctgagagcaaggagcccctgaaggacagcgagtttgagagcctgaagacctgcaacaagagctttgaggaggaccccaagtggagcaaccctgagcccaatgacctgaaggaggagaatgaagatgagatccccaccggcatgccctgcctggagagcgtgaccatcggagatgacatctgggatgagaactggctgcccctgcaggccaagatgggcaaaggaggagatgctgccagccacctgttcaccgccagcctgggcggcaagaaccagtacagcagctgcaaggagatgccccagaaggactggtgcttcagcacccccaaggacacctgggatgacagctggcagcccagcggcctggtgaatggcaccaaggtggaggtgcacaagccagaggtgctgggcgcccaggagaagaacacaggcaccaacagaacccagaagcagctggacatcaatggcagcagtgacagcagcaccctgcccaagctggaggagttctgcaccagcctgacccagagcgagcagagcgcagatggcagccagagcgagcccaacaacagccagacccagcccaagcagatccagctgagcacagctgccccctgcagcaccacagctgtggatgacagcgctgagaagcccagcggctctgtggagagcagccctgagatcctgaagaatgaagacttcagcagcagccgggccatcaccctgtacaaggacaagaggcaggagagcgtggaccagctgagcctcatcctgtcctatgagtgccagatcagccagaagctgtacatccccaggagcacagccacagctgccctgggcgccgccgcccggctggccaccagccgcagcctgctgcactggtaccccagcgtgaagaggatggaggcctag

SEQ ID NO: 20886 - DNA, 426 bp, Artificial Sequence
  Description of Artificial Sequence: Synthetic coding sequence
atgcccaccaccagcaggcctgccctggatgtgaagggcggcaccagccctgccaaggaggatgccaaccaggagatgagctctgtggcctacagcaacctggccgtgaaggacaggaaggctgtggccatcctgcactacccaggagtggccagcaatggcaccaaggccagcggggcccccaccagcagcagcggcagccccatcggcagccccaccaccaccccacccaccaagccacccagcttcaacctgcacccagccccccacctgctggcctccatgcacctgcagaagctgaacagccagtaccagggcatggctgctgccaccccaggccagcctggagaggccggccccctgcagaactgggactttggagcccaggccggcggcgctgagagcctgagccccagcgctggatag

SEQ ID NO: 20887 - DNA, 1188 bp, Artificial Sequence; identical to SEQ ID NO: 20054
  Description of Artificial Sequence: Synthetic coding sequence

SEQ ID NO: 20888 - DNA, 1344 bp, Artificial Sequence
  Description of Artificial Sequence: Synthetic coding sequence
atggccacagacagctgggccctggccgtggatgagcaggaggccgctgtgaagtccatgaccaacctgcagatcaaggaggagaaggtgaaggctgacaccaacggcatcatcaagaccagcaccacagctgagaagacagatgaggaggagaaggaggaccgggccgcccagagcctgctgaacaagctgatccgcagcaacctggtggacaacaccaaccaggtggaggtgctgcagagggaccccaacagccccctgtacagcgtgaagagctttgaggagctgcggctgccccagaacctgattgcccagagccagagcggcaccgggaagacagctgcctttgtgctggccatgctgagccgggtggagcccagcgaccgctacccccagtgcctgtgcctgagccccacctatgagctggccctgcagacaggcaaggtgattgagcagatgggcaagttctacccagagctgaagctggcctatgctgtgcggggcaacaagctggagcggggccagaagatcagcgagcagatcgtgattggcaccccaggcaccgtgctggactggtgcagcaagctgaagttcatcgaccccaagaagatcaaggtgtttgtgctggatgaagcagatgtgatgattgccacccagggccaccaggaccagagcatccgcatccagaggatgctgcccaggaactgccagatgctgctcttcagcgccacctttgaggacagcgtgtggaagtttgcccagaaggtggtgcctgaccccaacgtcatcaagctgaagcgggaggaggagaccctggacaccatcaagcagtactacgtgctgtgcagcagcagagatgagaagttccaggccctgtgcaacctgtatggagccatcaccatcgcccaggccatgatcttctgccacaccaggaagacagcctcctggctggccgctgagctgagcaaggagggccaccaggtggccctgctgagcggggagatgatggtggagcagagagctgctgtgattgagcgcttccgggagggcaaggagaaggtgctggtgaccaccaacgtgtgtgcccggggcattgatgtggagcaggtgtctgtggtgatcaactttgacctgcctgtggacaaggatggcaacccagacaatgagacctacctgcacagaattggaagaacaggccgctttgggaagaggggcctggccgtgaacatggtggacagcaagcacagcatgaacatcctgaaccgcatccaggagcacttcaacaagaagattgagcggctggacacagatgacctggatgaaattgagaagatcgccaactag

SEQ ID NO: 20889 - DNA, 630 bp, Artificial Sequence
  Description of Artificial Sequence: Synthetic coding sequence
atggccagcagtgacctggagcagctgtgcagccacgtgaatgagaagattggcaacatcaagaagaccctgagcctgaggaactgtggccaggagcccaccctgaagacagtgctgaacaagattggagatgagatcatcgtcatcaatgagctgctgaacaagctggagctggagatccagtaccaggagcagaccaacaacagcctgaaggagctgtgtgagagcctggaggaggactacaaggacatcgagcacctgaaggaaaatgtgcccagccacctgccccaggtgacagtgacccagagctggtacatgaagagccggctgacctacaaccagatcaatgatgtgatcaaggagatcaacaaggctgtgatcagcaagtacaagatcctgcaccagcccaagaagtccatgaacagcgtgaccaggaacctgtaccaccgcttcattgatgaggagaccaaggacaccaagggccgctacttcatcgtggaggccgacatcaaggagttcaccaccctgaaggctgacaagaagttccacgtgctgctgaacatcctgcggcactgccggcggctgtctgaggtgcggggcggcggcctgacccgctacgtgatcacctag

SEQ ID NO: 20890 - DNA, 1125 bp, Artificial Sequence
  Description of Artificial Sequence: Synthetic coding sequence
atggattctgtgcgcagcggccccttcggccagctgttccggccagacaacttcatcttcggccagacaggagctggcaacaactgggccaagggccactacacagaaggagctgagctggtggatgctgtgctggatgtggtgaggaaagaatgtgagcactgtgactgcctgcagggcttccagctgacccacagcctgggcggcggcactggaagtggcatgggcaccctgctgatcagcaagatccgggaggagttcccagaccgcatcatgaacaccttctctgtgatgcccagccccaaggtgtctgacacagtggtggagccctacaatgccaccctgtctgtgcaccagctggtggagaacacagatgagacctactgcatcgacaatgaggccctgtatgacatctgcttccgcaccctgaagctgaccacccccacctacggggacctgaaccacctggtgtctgccaccatgtctggagtgaccaccagcctgcgcttccctggccagctgaatgctgacctgaggaagctggccgtgaacatggtgcccttcccccggctgcacttcttcatgcctggctttgcccccctgaccagccggggcagccagcagtaccgggccctgactgtgcctgagctgacccagcagatgtttgatgccaggaacatgatggccgcctgtgaccccaggcatggccgctacctgactgtggccaccgtcttccggggccccatgtccatgaaggaggtggatgagcagatgctggccatccagagcaagaacagcagctactttgtggagtggatccccaacaacgtgaaggtggccgtgtgtgacatccccccccggggcctgaagatggccagcaccttcatcggcaacagcacagccatccaggagctgttcaagaggatcagcgagcagttcagcgccatgttccggaggaaggccttcctgcactggttcaccggggagggcatggatgagatggagttcacagaagctgagagcaacatgaatgacctggtgtctgagtaccagcagtaccaggatgccacagccaatgatggagaggaggcctttgaagatgaggaggaggagattgatggatag

SEQ ID NO: 20891 - DNA, 2289 bp, Artificial Sequence
  Description of Artificial Sequence: Synthetic coding sequence
atggccagcctgctgcaggaccagctgaccacagaccaggacctgctgctgatgcaggagggcatgcccatgaggaaggtgcgcagcaagtcctggaagaagctgcgctacttccggctgcagaatgatggcatgacagtgtggcacgcccggcaggcccggggcagcgccaagcccagcttcagcatcagtgatgtggagaccatcagaaatggacatgattctgagctgctgcggagcctggccgaggagctgcccctggagcagggcttcaccatcgtgttccacggccgccgcagcaacctggacctgatggccaacagcgtggaggaggcccagatctggatgaggggcctgcagctgctggtggacctggtgacctccatggaccaccaggagcggctggaccagtggctgagtgactggttccagagaggagacaagaaccaggacggcaagatgtccttccaggaggtgcagaggctgctgcacctgatgaatgtggagatggaccaggagtatgccttcagcctcttccaggccgctgacaccagccagagcggcaccctggagggggaggagtttgtgcagttctacaaggccctgaccaagagagctgaggtgcaggagctgtttgagagcttcagcgcagatggccagaagctgaccctgctggagttcctggacttcctgcaggaggagcagaaggagcgggactgcaccagcgagctggccctggagctgattgacagatatgagcccagcgacagcggcaagctgcggcacgtgctgtccatggatggcttcctgagctacctgtgcagcaaggatggagacatcttcaacccagcctgcctgcccatctaccaggacatgacccagcccctgaaccactacttcatctgcagcagccacaacacctacctggtgggggaccagctgtgtggccagagctctgtggagggctacatccgggccctgaagaggggctgccgctgtgtggaggtggatgtgtgggatggccccagcggggagcctgtggtgtaccacggccacaccctgaccagccgcatcctcttcaaggatgtggtggccaccgtggcccagtatgccttccagaccagtgactaccctgtgatcctgagcctggagacccactgctcctgggagcagcagcagaccatggcccggcacctgacagagatcctgggggagcagctgctgagcaccaccctggatggagtgctgcccacccagctgcccagccctgaggagctgcggaggaagatcctggtgaagggcaagaagctgaccctggaggaggacctggagtatgaggaggaggaggccgagcctgagctggaggagagcgagctggccctggagagccagtttgaaacagagcctgagccccaggagcagaacctgcagaacaaggacaagaagaagaagagcaagcccatcctgtgcccagccctgagcagcctggtgatctacctgaagtctgtgtccttccgctccttcacccacagcaaggagcactaccacttctatgagatcagcagcttcagcgagaccaaggccaagaggctcatcaaggaggccggaaatgaatttgtgcagcacaacacctggcagctgagccgggtgtaccccagcggcctgaggacagacagcagcaactacaacccccaggagctgtggaatgccggctgccagatggtggccatgaacatgcagacagctggcctggagatggacatctgtgatggccacttccggcagaatggaggctgcggctacgtgctgaagccagacttcctgcgggacatccagagcagcttccaccctgagaagcccatcagccccttcaaggcccagaccctgctgatccaggtgatcagcggccagcagctgcccaaggtggacaagaccaaggagggcagcatcgtggaccccctggtgaaggtgcagatcttcggcgtgcggctggacacagcccggcaggagaccaactacgtggagaacaacggcttcaacccctactggggccagaccctgtgcttccgggtgctggtgcctgagctggccatgctgcgctttgtggtgatggactatgactggaagagcagaaatgacttcatcggccagtacaccctgccctggacctgcatgcagcagggctaccgccacatccacctgctgagcaaggatggcatcagcctgcggcctgccagcatctttgtgtacatctgcatccaggagggcctggagggagatgagagctag

SEQ ID NO: 20892 - DNA, 1461 bp, Artificial Sequence
  Description of Artificial Sequence: Synthetic coding sequence
atggccgagctgcagatgctgctggaggaggagatccctgggggccggcgggccctgtttgacagctacaccaacctggagcgggtggccgactactgtgagaacaactacatccagagcgctgacaagcagagggccctggaggagaccaaggcctacaccacccagagcctggcctctgtggcctacctgatcaacaccctggccaacaacgtgctgcagatgctggacatccaggccagccagctgcggaggatggagagcagcatcaaccacatcagccagacagtggacatccacaaggagaaggtggcccggcgggagatcggcatcctgaccaccaacaagaacaccagcaggacccacaagatcatcgccccagccaacctggagaggcctgtgcgctacatcaggaagcccatcgactacaccatcctggatgacattggacatggagtgaagtggctgctgcgcttcaaggtgtccacccagaacatgaagatgggcggcctgcccaggaccaccccacccacccagaagccacccagcccccccatgtctgggaagggcaccctgggccgccacagcccctaccgcaccctggagcctgtgcggccccctgtggtgcccaatgactatgtgcccagccccaccaggaacatggcccccagccagcagagccctgtgaggacagcctctgtgaaccagaggaacagaacctacagcagcagcggcagcagcggcggcagccaccccagcagccgcagcagcagccgggagaacagcggcagcggctctgtgggcgtgcccatcgctgtgcccacccccagcccccccagcgtcttccctgccccagctggcagcgctggcaccccacccctgcctgccaccagcgccagcgccccagcccccctggtgcctgccaccgtgcccagcagcacagccccagatgctgctgctgggggcgcccagaccctggctgatggcttcaccagccccaccccacctgtggtgagcagcaccccacccaccggccaccctgtgcagttctacagcatgaacagacctgccagccgccacaccccacccaccatcggcggcagcctgccctaccgccggccccccagcatcaccagccagaccagcctgcagaaccagatgaatggaggccccttctacagccagaaccctgtgtctgacaccccacctcctcctcctcctgtggaggagcctgtgtttgatgagagccccccacctcctcctcctcctgaggactatgaggaggaggaggccgctgtggtggagtacagcgacccctatgcagaagaagatcctccctgggcccccaggagctacctggagaaggtggtggccatctatgactacaccaaggacaaggaggatgagctgtccttccaggagggcgccatcatctacgtgatcaagaagaatgatgactag

SEQ ID NO: 20893 - DNA, 2145 bp, Artificial Sequence
  Description of Artificial Sequence: Synthetic coding sequence
atgctgagccccaagatccggcaggcccggcgggcccggagcaagagcctggtgatgggagagcagagccgcagccctggccgcatgccctgcccccaccggctgggccctgtgctgaaggccggctggctgaagaagcagaggagcatcatgaagaactggcagcagcgctggtttgtgctgcggggggaccagctgttctactacaaggacaaggatgagatcaagccccagggcttcatcagcctgcagggcacccaggtgacagagctgcccccaggccctgaggaccccgggaagcacctgtttgagatcagccctggaggagctggggagcgggagaaggtgcctgccaaccctgaggccctgctgctgatggccagcagccagagggacatggaggactgggtgcaggccatcagaagagtcatctgggcccccctgggcggcggcacagcccggcgcagccacgcccaccccctggagcccctgcccccaggcatcttcggccagaggctggaggagaccgtgcaccacgagaggaaatatggcccccggctggcccccctgctggtggagcagtgtgtggacttcatccgggagcggggcctgacagaggagggcctcttcaggatgcctggccaggccaacctggtgcgggacctgcaggacagctttgactgtggggagaagcccctgtttgacagcaccacagatgtgcacacagtggccagcctgctgaagctgtacctgcgggagctgcctgagcctgtggtgccctttgcccgctatgaggacttcctgagctgtgcccagctgctgaccaaggatgaaggagagggcaccctggagctggccaagcaggtgagcaacctgccccaggccaactacaacctgctgcgctacatctgcaagttcctggatgaggtgcaggcctacagcaatgtgaacaagatgtctgtgcagaacctggccaccgtgtttggccccaacatcctgcggccccaggtggaggaccctgtgaccatcatggagggcaccagcctggtgcagcacctgatgacagtgctgatcaggaagcacagccagctgttcaccgcccctgtgcctgagggccccaccagcccccggggcggcctgcagtgtgctgtgggctggggcagcgaggaggtgacccgggacagccagggcgagcccggcggccctggcctgcctgcccacaggaccagcagcctggatggagctgctgtggccgtgctgagcaggacagcccccaccggccctggcagccgctgcagccctgggaagaaggtgcagaccctgcccagctggaagagcagcttccggcagcccaggagcctgagcggcagccccaagggcggcggcagcagcctggaggtgcccatcatcagcagcggcggcaactggctgatgaatggcctgagcagcctgcggggccaccggcgggccagcagcggggaccggctgaaggacagcggctctgtgcagaggctgagcacctatgacaacgtgcctgcccctggcctggtgcccggcatccccagcgtggcctccatggcctggagcggggccagcagcagcgagagctctgtgggcggcagcctgagcagctgcacagcctgccgggccagtgacagcagcgcccggagcagcctgcacacagactgggccctggagcccagccccctgcccagcagcagcgaggaccccaagagcctggacctggaccacagcatggatgaagctggagctggggccagcaacagcgagcccagcgagccagacagccccacccgggagcacgcccggcgctctgaggccctgcagggcctggtgacagagctgcgggcagagctgtgccggcagaggacagaatatgaaagatctgtgaagagaattgaggagggcagcgctgacctgaggaagaggatgagccggctggaggaggagctggaccaggagaagaagaagtacatcatgctggagatcaagctgagaaattctgagcgggcccgggaggatgctgagaggaggaaccagctgctgcagcgggagatggaggagttcttcagcaccctgggcagcctgactgtgggcgccaagggggcccgggcccccaagtag

SEQ ID NO: 20894 - DNA, 381 bp, Artificial Sequence; identical to SEQ ID NO: 20874
  Description of Artificial Sequence: Synthetic coding sequence

SEQ ID NO: 20895 - DNA, 2442 bp, Artificial Sequence
  Description of Artificial Sequence: Synthetic coding sequence
atgtctgagcagggcgacctgaaccaggccatcgccgaggagggcggcacagagcaggagacagccaccccagaaaatggcatcgtgaagtctgagagcctggatgaggaggagaagctggagctgcagaggcggctggaggcccagaaccaggagaggaggaagagcaagagcggggccggcaagggcaagctgaccaggagcctggccgtgtgtgaggagagcagcgcccggcctggaggagagagcctgcaggaccaggagagcatccacctgcagctgagcagcttcagcagcctgcaggaggaggacaagagcaggaaggatgattctgagcgggagaaggagaaggacaagaacaaggacaagaccagcgagaagcccaagatccgcatgctgagcaaggactgcagccaggagtacacagacagcactggaattgacctgcacgagttcctgatcaacaccctgaagaacaacagccgggacaggatgatcctgctgaagatggagcaggagatcatcgacttcatcgctgacaacaacaaccactacaagaagttcccccagatgagcagctaccagaggatgctggtgcaccgggtggccgcctacttcggcctggaccacaacgtggaccagacaggcaagagcgtcatcatcaacaagaccagcagcacccgcatccctgagcagcgcttctgtgagcacctgaaggatgagaagggggaggagagccagaagcgcttcatcctgaagagggacaacagcagcattgacaaggaggacaaccagagcgtgtgcagccaggagagcctgtttgtggagaacagccggctgctggaggacagcaacatctgcaatgagacctacaagaagaggcagctgttccggggcaacagagatggcagcggccgcaccagcggcagccggcagagcagcagtgaaaatgagctgaagtggagcgaccaccagagggcctggagcagcacagacagcgacagcagcaacagaaacctgaagccagccatgaccaagacagccagctttggaggcatcaccgtgctgaccaggggggacagcaccagcagcaccaggagcacaggcaagctgagcaaggccggcagcgagagcagcagcagcgctggcagcagcggcagcctgagcaggacccacccccccctgcagagcacccccctggtgtctggagtggccgccggcagccctggctgtgtgccctacccagaaaatggaattggaggccaggtggcccccagcagcaccagctacatcctgctgcccctggaggccgccaccggcatccccccaggcagcatcctgctgaacccccacacaggccagccctttgtgaacccagatggcaccccagccatctacaacccccccaccagccagcagcccctgcggagcgccatggtgggccagagccagcagcagcccccccagcagcagcccagcccccagccccagcagcaggtgcagcccccccagccccagatggccggccccctggtgacccagagcgtgcagggcctgcaggccagcagccagagcgtgcagtacccagctgtgtccttccccccccagcacctgctgcctgtgagccccacccagcacttccccatgagagatgatgtggccacccagtttggccagatgaccctgagccggcagagcagtggagagaccccagagcccccatctggccctgtgtaccccagcagcctgatgccccagcctgcccagcagcccagctatgtgattgccagcacaggccagcagctgcccaccggcggcttcagcggcagcggcccccccatcagccagcaggtgctgcagcccccacccagcccccagggctttgtgcagcagcccccaccagcccagatgcctgtgtactactaccccagcggccagtaccccaccagcaccacccagcagtaccggcccatggcccctgtgcagtacaatgcccagaggagccagcagatgccccaggccgcccagcaggccggctaccagcctgtgctgagcggccagcagggcttccagggcctcatcggcgtgcagcagcccccccagagccagaatgtcatcaacaaccagcagggcacccctgtgcagagcgtgatggtgtcctaccccaccatgagcagctaccaggtgcccatgacccagggcagccagggcctgccccagcagagctaccagcagcccatcatgctgcccaaccaggccggccagggcagcctgcctgccaccggcatgcctgtgtactgcaatgtgaccccacccaccccccagaacaacctgcggctgattggcccccactgccccagcagcacagtgcctgtgatgtctgccagctgcaggaccaactgtgcctccatgagcaatgccggctggcaggtgaagttctag

SEQ ID NO: 20896 - DNA, 1467 bp, Artificial Sequence
  Description of Artificial Sequence: Synthetic coding sequence
atgaatggagccctggaccacagcgaccagcctgaccctgatgccatcaagatgtttgtgggccagatccccaggtcctggagcgagaaggagctgaaggagctgtttgagccctatggagctgtgtaccagatcaacgtgctgcgggacaggagccagaaccccccccagagcaagggctgctgctttgtgaccttctacaccaggaaggccgccctggaggcccagaatgccctgcacaacatcaagaccctgcccggcatgcaccaccccatccagatgaagccagctgacagcgagaagagcaatgctgtggaggacaggaagctgttcatcggcatggtgtccaagaagtgcaatgaaaatgacatccgggtgatgttcagccccttcggccagatcgaggagtgccgcatcctgcggggcccagatggcctgagccggggctgtgcctttgtgaccttcagcacccgggccatggcccagaatgccatcaaggccatgcaccagagccagaccatggagggctgcagcagccccatcgtggtgaagtttgctgacacccagaaggacaaggagcagaggcggctgcagcagcagctggcccagcagatgcagcagctgaacacagccacctggggcaacctgaccggcctgggcggcctgaccccccagtacctggccctgctgcagcaggccaccagcagcagcaacctgggcgccttcagcggcatccagcagatggccggcatgaatgccctgcagctgcagaacctggccaccctggccgctgctgctgctgctgcccagaccagcgccaccagcaccaatgccaaccccctgagcaccaccagcagcgccctgggcgccctgaccagccctgtggccgccagcacccccaacagcacagctggggccgccatgaacagcctgaccagcctgggcaccctgcagggcctggccggggccaccgtgggcctgaacaacatcaatgccctggccggcaccatcaacagcatggccgccctgaatggaggcctgggcgccaccggcctgaccaacggcacagctggcaccatggatgccctgacccaggcctacagcggcatccagcagtatgctgctgctgccctgcccaccctgtacagccagagcctgctgcagcagcagagcgctgctggcagccagaaggagggccctgagggcgccaacctcttcatctaccacctgccccaggagtttggagaccaggacatcctgcagatgttcatgccctttggaaatgtcatcagcgccaaggtgttcatcgacaagcagaccaacctgagcaagtgcttcggctttgtgtcctatgacaaccctgtgtctgcccaggccgccatccaggccatgaatggcttccagatcggcatgaagaggctgaaggtgcagctgaagaggagcaagaatgacagcaagccctactag

SEQ ID NO: 20897 - DNA, 474 bp, Artificial Sequence; identical to SEQ ID NO: 20844
  Description of Artificial Sequence: Synthetic coding sequence

SEQ ID NO: 20898 - DNA, 303 bp, Artificial Sequence
  Description of Artificial Sequence: Synthetic coding sequence
atggccagcgaggacatcgccaagctggccgagaccctggccaagacccaggtggccggcggccagctgtccttcaagggcaagagcctgaagctgaacacagcagaagatgccaaggatgtgatcaaggagattgaggactttgacagcctggaggccctgcggctggagggcaacacagtgggcgtggaggccgcccgggtgattgccaaggccctggagaagaagtctgagctgaagcgctgccactggagcgacatgttcaccggccgcctgaggacagagatccccccagccctgtag

SEQ ID NO: 20899 - DNA, 459 bp, Artificial Sequence
  Description of Artificial Sequence: Synthetic coding sequence
atgtctgtgacctatgatgacagcgtgggcgtggaggtgtccagtgacagcttctgggaggtgggcaactacaagaggacagtgaagagaattgatgatggccaccggctgtgcagcgacctgatgaactgcctgcacgagcgggccagaattgagaaggcctatgcccagcagctgacagagtgggcccggcgctggaggcagctggtggagaagggcccccagtatggcaccgtggagaaggcctggatggccttcatgtctgaggccgagcgggtgtctgagctgcacctggaggtgaaggccagcctgatgaatgatgactttgagaagatcaagaactggcagaaggaggccttccacaagcagatgatgggcggcttcaaggagaccaaggaggctgaagatggcttcaggaaggcccagaagccctgggccaagaagctgaaggaggtgtag

SEQ ID NO: 20900 - DNA, 543 bp, Artificial Sequence
  Description of Artificial Sequence: Synthetic coding sequence
atgtttgccagtgacctgctgcgggccctggactgctgccctggggccggcagcagcggcctgctgccccagctgggcccccggcagctgctggccttcaccgtgaactgcctgggcaaccaccgctacctgggcttctttgaggacctggagcagaggcacaaggcccaggtgctggtggaggacatcagtgacatcctggaggagcacgccgagaagcacttccacccctacatcgcctactgcagcaatgaggtgtaccagcagaggaccctgcagaagctgatcagcagcaatgctgccttccgggaggccctgcgggagattgaaagaagacctgcctgtggcggcctgcccatgctgtccttcctgatcctgcccatgcagagggtgacccggctgcccctgctgatggacaccctgtgcctgaagacccagggccacagcgagcgctacaaggccgccagccgggccctgaaggccatcagcaagctggtgcggcagtgcaatgaaggagcccacaggatggagaggatggagtag

SEQ ID NO: 20901 - DNA, 2487 bp, Artificial Sequence; identical to SEQ ID NO: 19576
  Description of Artificial Sequence: Synthetic coding sequence

SEQ ID NO: 20902 - DNA, 4455 bp, Artificial Sequence
  Description of Artificial Sequence: Synthetic coding sequence
atgaggatcccagaccagaagtatgtgaccctgaagctgaatgatgtgatccgcttcggctatgacagcaacatgtatgtgctggagcgggtgcagcaccgggtgcctgaggaggccctgaagcatgagaagtacaccagccagctgcaggtgtctgtgaagggcctggcccccaagaggtctgaggccctgcctgagcacaccccctactgtgaggccagcaaccccaggcctgagaagggggacagaagacctggaacagaagctgccagctaccgcacccccctgtatggccagcccagctggtggggagaagatgatggcagcaccctgcctgatgcccagaggcagggcgagccctacccagagcggcccaagggccctgtgcagcaggatggagagctgcacggcttccgggccccagctgagccccagggctgcagcttccggcgggagcccagctactttgagatccccaccaaggagaccccccagcccagccagcccccagaggtgcctgcccacgagatgcccaccaaggatgctgaggccggcggcggcggggccgcccctgtggtgcagagccacgccagcttcaccattgaatttgatgactgcagccctgggaagatgaagatcaaggaccacatcaccaagttcagcctgcggcagaggaggcctcctgggaaggaggccaccccaggagagatggtgtctgctgagaccaaggtggccgactggctggtgcagaatgaccccagcctgctgcaccgggtgggccctggagatgacagacacagcaccaagagtgacctgcctgtgcacaccaggaccctgaagggccacaagcatgaagatggcacccagagcgacagcgaggaccccctggccaaggccgccagcgctgctggggtgcccctggaggccagcggggagcaggtgcggctgcagaggcagatcaagagggacccccaggagctgctgcacaaccagcaggccttcgtcatcgagttctttgatgaggacacccccaggaagaagaggagccagagcttcacccacagccccagcggggaccccaaggctgacaagagaagaggccccaccccagctgaccgggaccggcccagcgtgcctgcccctgtgcaggccggcggccgcagcagcggcccccagagagctggcagcctgaagcgggagaagacagaggagcggctgggcagccccagccctgccagcaggaccccagcccggcccttcggctctgtgggcagaagaagccggctggcccaggacttcatggcccagtgcctgcgggagagcagccctgctgcccggcccagccctgagaaggtgccccctgtgctgcctgcccccctgacccctcatggcaccagccctgtgggcccccccaccccacctccagcccccacagacccccagctgaccaaggccaggaagcaggaggaggatgacagcctgagtgatgctggcacctacaccatcgagacagaggcccaggacacagaggtggaggaggccaggaagatgattgaccaggtgtttggagtgctggagagccctgagctgagccgggccagcagcgccaccttccggcctgtgatccggggggacagagatgaaagtgatgatggaggagtggcccagaggatggccctgctgcaggagtttgccagccggcccctgggcgccgccccccaggccgagcaccagggcctgcctgtgcccggcagccctgggggccagaagtgggtgagccgctgggccagcctggccgacagctacagcgaccccggcctgacagaagatggcctgggccggcggggcggggagcctgagggcagcctgcctgtgaggatgagaagaaggctgccccagctgcccagcgagagagctgacagccctgctggccctgagagcagcagaagaagtggccctggccccccagagctggacagcgagcagcccagccggctgtttggccaggaggagctggaccctgacagcctgagtgatgccagcggcagtgatggcggccggggccctgagcccggggtggagccccaggacagcagaagaagaagcccccaggagggccccacctggagccggggcagaagaagcccccgggcccctggagagcccaccccagccagcttcttcatcggggaccagaatggagatgctgtgctgagcaggaagcccctggccgcccctggagatggagagggcctgggccagacagcccagcccagccccccagccagagatggagtgtatgtgtctgccaatggaaggatggtgatccagctgcggcccggccgcagccctgagccagatggccctgccccagccttcctgcggcaggagagcttcaccaaggagcccgccagcggccccccagcccctgggaagccaccccacatcagcagccaccccctgctgcaggacctggccgccacccgggccgccaggatggacttccacagccaggacacccacctgatcctgaaggagacagaaacagccctggccgccctggaggcccggctgctgagcaacagcgtggatgctgaatgtgagggcggcagcaccccccggcccccagaagatgccctgagcggggacagtgatgtggacacagccagcacagtgtccctgcggagcggcaagagcggccccagccccaccaccccccagcccctgcgggcccagaaggagatgagccccagccccccagctgcccaggaccccggcggcacagccctggtgtctgcccgggagcagagcagcgagcggcagcaccaccccctgggccccacagacatgggccgcggggagcctgtgagaagaagtgccatccggcggggccaccggccccggggcagcctggactggcccagcgaggagcggggccctgtgctggcccacctgcccagcagtgatgtgatggccagcaaccacgagaccccagaggccactggagctggccgcctgggcagcaggaggaagccagctgcccccccacccagccctgctgcccgggaggagcagagccgcagcagcgccagcagccagaagggcccccaggccctgaccaggagcaacagcctgagcaccccccggcccacccgggccagccggctgcggcgggcccggctgggagatgccagtgacacagaagctgctgatggagagcggggcagcctgggcaaccctgagcctgtgggccggcctgctgctgagcaggccaagaagctgagccggctggacatcctggccatgcccaggaagagagctggcagcttcaccggcaccagtgaccctgaggccgccccagcccggaccagcttcagcggccgctctgtggagctgtgctgtgccagcaggaagcccaccatggccgaggcccgggctgtgtccaggaaggccgccaacacagccaccaccaccggcccccggcagcccttcagccgggcccggagcggcagcgcccgctacaccagcaccacccagacccccagggctggcagcagcagccgggcccggagccgggcccctggcccccgggacacagatgatgatgaggaggagccagacccctacggcttcatcgtgcagacagctgagattgctgagatcgcccggctgagccagaccctggtgaaggatgtggccatcctggcccaggagatccatgatgtggccggagatggagacaccctgggcagcagcgagcccgcccacagcgccagcctgagcaacatgcccagcaccccagccagcaccatcagcgcccgggaggagctggtgcagagaattcctgaggccagcctgaacttccagaaggtgcccccaggcagcctgaacagccgggactttgaccagaacatgaatgacagctgtgaagatgccctggccaacaagacccggcccaggaaccgggaggaggtgatctttgacaacctgatgctgaaccctgtgtcccagctgagccaggccatccgggagaacacagagcacctggccgagaagatgaagatcctcttccagaacacaggccgggcctgggaggacctggaggcccgcatcaatgcagaaaatgaggtgcccatcctgaagaccagcaacaaggagatcagcagcatcctgaaggagctgcggcgggtgcagaagcagctggaggtgatcaatgccatcgtggaccccagcggcagcctggacctgctgaccggcaacagaagcctggccagcagcgcccagcccggcctgggcaagggccgggtggccgcccagagcccccccagccctgccagcgctgaggccctgctgcctgccctgcccctgaggaacttcccccagagggccagctgtggcccccccagcctgcctgaccccaccttcctgcctgatgctgagcgcttcctgatctag

SEQ ID NO: 20903 - DNA, 150 bp, Artificial Sequence
  Description of Artificial Sequence: Synthetic coding sequence
atgtaccccaaccccctcatctactgcacctgctgggacccctggaacctgggccccaggaagctgatcaagaccccccagctgcccaggaagaacagcacaggcagcagcaagctgacccccctggtgcctgcccccaagaaccactag

SEQ ID NO: 20904 - DNA, 948 bp, Artificial Sequence; identical to SEQ ID NO: 18329
  Description of Artificial Sequence: Synthetic coding sequence

SEQ ID NO: 20905 - DNA, 3015 bp, Artificial Sequence
  Description of Artificial Sequence: Synthetic coding sequence
atgaaggccaccacccccctgcagacagtggaccggcccaaggactggtacaagaccatgttcaagcagatccacatggtgcacaagccaggcctgtacaaccccccctacagcgcccagagccaccctgctgccaagacccagacctaccggcccctgagcaagagccacagcgacaacagccccaatgccttcaaggatgccagcagccctgtgcccccaccccacgtgcccccacctgtgccccccctgcggccccgggacaggagcagcacagagaagcatgactgggaccccccagacaggaaggtggacaccaggaagttccgctctgagcccaggagcatctttgaatatgagcccgggaagagcagcatcctgcagcacgagaggcctgccagcctgtaccagagcagcattgacaggagcctggagcggcccatgagcagcgcctccatggccagtgacttcaggaagaggaggaagtctgagcctgctgtgggccccccccggggcctgggggaccagagcgccagcaggaccagccctggccgggtggacctgcccggcagcagcaccaccctgaccaagagcttcaccagcagcagccccagcagccccagccgggccaagggaggagatgacagcaagatctgccccagcctgtgcagctacagcggcctgaatggaaaccccagcagcgagctggactactgcagcacctaccggcagcacctggatgtgccccgggacagcccccgggccatctccttcaagaatggctggcagatggcccggcagaatgctgagatctggagcagcacagaggagaccgtgagccccaagatcaagagccgcagctgtgatgacctgctgaatgatgactgtgacagcttcccagaccccaaggtgaagtctgagagcatgggcagcctgctgtgtgaggaggacagcaaggagagctgccccatggcctggggcagcccctacgtgcctgaggtgcgcagcaatggccgcagccgcatccgccacaggtctgccagaaatgcccctggcttcctgaagatgtacaagaagatgcaccgcatcaacaggaaggacctgatgaacagcgaggtgatctgcagcgtgaagagccgcatcctgcagtatgagagcgagcagcagcacaaggacctgctgcgggcctggagccagtgcagcacagaggaggtgccccgggacatggtgcccacccgcatcagcgagtttgagaagctgatccagaagagcaagtccatgcccaacctgggagatgacatgctgagccctgtgaccctggagcccccccagaatggcctgtgccccaagaggcgcttcagcattgagtacctgctggaggaggagaaccagagcggccccccagcccggggccggcggggctgccagagcaatgccctggtgcccatccacatcgaggtgaccagtgatgagcagccccgggcccacgtggagttcagtgacagcgaccaggatggagtggtgtctgaccacagcgactacatccacctggagggcagcagcttctgcagcgagagtgactttgaccacttctccttcaccagcagcgagagcttctacggcagcagccaccaccaccaccaccaccaccaccaccaccaccgccacctgatcagcagctgcaagggccgctgcccagccagctacacccgcttcaccaccatgctgaagcatgagcgggcccggcatgagaacacagaggagccccggcggcaggagatggaccccggcctgagcaagctggccttcctggtgtcccctgtgcccttccggaggaagaagaacagcgcccccaagaagcagacagagaaggccaagtgcaaggcctctgtgtttgaggccctggacagcgccctgaaggacatctgtgaccagatcaaggccgagaagaagaggggcagcctgcctgacaacagcatcctgcacaggctcatcagcgagctgctgcctgatgtgcctgagaggaacagcagcctgcgggccctgcggcgcagccccctgcaccagcccctgcaccccctgcccccagatggagccatccactgccccccctaccagaatgactgtggccgcatgcccaggtctgccagcttccaggatgtggacacagccaacagcagctgccaccaccaggaccggggcggggccctgcaggaccgggagagccccaggagctacagcagcaccctgacagacatgggccgcagcgccccccgggagcggcggggcaccccagagaaggagaagctgcctgccaaggctgtgtatgacttcaaggcccagaccagcaaggagctgtccttcaagaagggggacacagtgtacatcctgaggaagattgaccagaactggtatgaaggagagcaccacggccgggtgggcatcttccccatctcctatgtggagaagctgaccccacctgagaaggcccagcctgcccggcccccacctccagcccagcctggagagatcggggaggccatcgccaagtacaacttcaatgctgacaccaacgtggagctgagcctgaggaaaggagacagagtcatcctgctgaagagggtggaccagaactggtatgagggcaagatccctggcaccaaccggcagggcatcttccctgtgtcctatgtggaggtggtgaagaagaacaccaagggagctgaggactacccagacccccccatcccccacagctacagcagtgaccgcatccacagcctgagcagcaacaagccccagaggcctgtgttcacccatgagaacatccagggcggcggggagcccttccaggccctgtacaactacaccccaagaaatgaagatgagctggagctgcgggagagtgatgtgattgatgtgatggagaagtgtgatgatggctggtttgtgggcaccagcaggaggaccaagttcttcggcaccttccctggcaactacgtgaagaggctgtag

SEQ ID NO: 20906 - DNA, 981 bp, Artificial Sequence
  Description of Artificial Sequence: Synthetic coding sequence
atggctgctgctgctgctgctgctgctgccaccaacggcaccggcggcagcagcggcatggaggtggatgctgctgtgcccagcgtgatggcctgtggggtgactggatctgtgtctgtggccctgcaccccctggtgatcctgaacatcagtgaccactggatccgcatgaggagccaggagggccggcctgtgcaggtgattggagccctgattggcaagcaggagggcaggaacatcgaggtgatgaacagctttgagctgctgagccacacagtggaggagaagatcatcatcgacaaggagtactactacaccaaggaggagcagttcaagcaggtgttcaaggagctggagttcctgggctggtacaccaccggcggccccccagaccccagcgacatccacgtgcacaagcaggtgtgtgagatcatcgagagccccctcttcctgaagctgaaccccatgaccaagcacacagacctgcctgtgtctgtgtttgaatctgtgattgacatcatcaatggagaggccaccatgctgtttgctgagctgacctacaccctggccacagaggaggccgagagaattggagtggaccacgtggccaggatgacagccaccggcagcggggagaacagcacagtggccgagcacctgattgcccagcacagcgccatcaagatgctgcacagccgggtgaagctgatcctggagtatgtgaaggccagcgaggccggggaggtgcccttcaaccacgagatcctgcgggaggcctatgccctgtgccactgcctgcctgtgctgagcacagacaagttcaagacagacttctatgaccagtgcaatgatgtgggcctgatggcctacctgggcaccatcaccaagacctgcaacaccatgaaccagtttgtgaacaagttcaacgtgctgtatgaccggcagggcattggaagaaggatgaggggcctcttcttctag

SEQ ID NO: 20907 - DNA, 780 bp, Artificial Sequence
  Description of Artificial Sequence: Synthetic coding sequence
tgattcaccgcccaggcccccagcggccgcggggctgctgtgggcagcggcacccggctggccagcctgcggctgctgacagagctggagagccctgcctggtggcccttcagcagcaagctgtggaagaccccacctgagaccaagccccgggaggatgtgtccatgaccagctgtgagccctttgggaaggagggcatcctgatcaagatcccagctgtgatcagccacaggacagagagccacgtgaagccaggccgcctgactgtgctggtgtctggcctggagatccatgacagcagcagcctgctgatgcacagatttgaaagagaagatgtggatgacatcaaggtgcacagcccctatgagatcagcatccggcagcgcttcatcggcaagccagacatggcctaccgcctcatcagcgccaagatgcctgaggtgatccccatcctggaggtgcagttcagcaagaagatggagctgctggaggatgccctggtgctgcggagcgcccggaccagcagccctgctgagaagagctgcagcgtgtggcatgctgccagcggcctgatgggccgcaccctgcaccgggagcccccagctggggaccaggagggcacagccctgcacctgcagaccagcctgcctgccctgtctgaggccgacacccaggagctgacccagggcttccggcccatgagcctgagcacccagacagtgctggtgatgctgtgcagcgagagcgctggggccctgtggaggcagaggctgtcctag

SEQ ID NO: 20908 - DNA, 1038 bp, Artificial Sequence
  Description of Artificial Sequence: Synthetic coding sequence
atggctgctgctgagcccgccagcagcggccagcaggccccagctggccagggccagggccagaggcccccaccccagcccccccaggcccaggccccccagcccccacctccaccccagctgggcggggccggcggcggcagcagcagacatgagaagagcctgggcctgctgaccaccaagtttgtgtccctgctgcaggaggccaaggatggagtgctggacctgaaggctgctgctgacaccctggccgtgcggcagaagaggcgcatctatgacatcaccaacgtgctggagggcatcgacctgattgagaagaagagcaagaacagcatccagtggaagggcgtgggcgccggctgcaacaccaaggaggtgattgaccggctgcgctacctgaaggccgagattgaggacctggagctgaaggagcgggagctggaccagcagaagctgtggctgcagcagagcatcaagaatgtgatggatgacagcatcaacaaccgcttctcctatgtgacccatgaggacatctgcaactgcttcaatggagacaccctgctggccatccaggcccccagcggcacccagctggaggtgcccatccctgagatgggccagaatggccagaagaagtaccagatcaacctgaagagccacagcggccccatccacgtgctgctgatcaacaaggagagcagcagcagcaagcctgtggtgtttcctgtgcccccaccagatgacctgacccagcccagcagccagagcctgacccctgtgaccccccagaagagctccatggccacccagaacctgcctgagcagcacgtgtctgagaggagccaggccctgcagcagaccagcgccacagacatcagcagcggcagcatcagcggggacatcattgatgagctgatgagcagtgatgtgttccccctgctgcggctgagccccaccccagcagatgactacaacttcaacctggatgacaatgaaggagtgtgtgacctgtttgatgtgcagatcctgaactactag

SEQ ID NO: 20909 - DNA, 96 bp, Artificial Sequence
  Description of Artificial Sequence: Synthetic coding sequence
atgacagtgccctggaggcctgggaagaggcgcatcacctacaaggaggaggaggacctgaccctgcagcccaggagctgcctgcagtgcagctag

SEQ ID NO: 20910 - DNA, 489 bp, Artificial Sequence
  Description of Artificial Sequence: Synthetic coding sequence
atgaacaaccagaagcagcagaagcccaccctgagcggccagcgcttcaagaccaggaagagagatgagaaggagagatttgaccccacccagttccaggactgcatcatccagggcctgacagaaacaggaacagacctggaggccgtggccaagttcctggatgccagcggggccaagctggactaccgccgctatgcagagaccctgtttgacatcctggtggccggcggcatgctggcccctgggggcaccctggctgatgacatgatgaggacagatgtgtgtgtgtttgctgcccaggaggacctggagaccatgcaggcctttgcccaggtgttcaacaagctgatccgccgctacaagtacctggagaagggctttgaagatgaggtgaagaagctgctgctcttcctgaagggcttcagcgagagcgagaggaacaagctggccatgctgactggagtgctgctggccaacggcacctag

SEQ ID NO: 20911 - DNA, 270 bp, Artificial Sequence
  Description of Artificial Sequence: Synthetic coding sequence
atggctgctgccactggagaccccggcctgagcaagctgcagtttgcccccttcagcagcgccctggatgtgggcttctggcatgagctgacccagaagaagctgaatgagtaccgcctggatgaggcccccaaggacatcaagggctactactacaatggagacagcgctggcctgcctgcccggctgaccctggagttcagcgcctttgacatgtctgcccccaccccagcccgctgctgcccagccatcggcaccctgtacaactag

SEQ ID NO: 20912 - DNA, 2025 bp, Artificial Sequence; identical to SEQ ID NO: 19458
  Description of Artificial Sequence: Synthetic coding sequence

SEQ ID NO: 20913 - DNA, 1923 bp, Artificial Sequence
  Description of Artificial Sequence: Synthetic coding sequence
atggagaaccagctggccaagagcacagaggagaggaccttccagtaccaggacagcctgcccagcctgcctgtgcccagcctggaggagagcctgaagaagtacctggagagcgtgaccaggacctgctaccagatccggggcctggaccctgatgccaagaggggcttcctggacctgacccgggagggcatccaggtgaagccctttgccaaccaggaggagtacaagaagacagaggagatcgtgcagaagttccagagcggcatcggggagaagctgcaccagaagctgctggagcgggccaagggcaagaggaactggctggaggagtggtggctgaatgtggcctacctggatgtgcgcatccccagccagctgaatgtgaactttgctggccctgctgcccactttgagcactactggccacccaaggagggcacccagctggagcggggcagcatcaccctgtggcacaacctgaactactggcagctgctgaggaaggagaaggtgcctgtgcacaaggtgggcaacacccccctggacatgaaccagttcaggatgctgttcagcacctgcaaggtgcccggcatcacccgggacagcatcatgaactacttcagaacagagagcgagggccgcagccccaaccacatcgtggtgctgtgccggggccgggcctttgtgtttgatgtgattcatgagggctgcctggtgaccccacctgagctgctgcggcagctgacctacatccacaagaagtgccacagcgagccagatggccctggcattgctgccctgaccagcgaggagaggacccgctgggccaaggcccgggagtacctgattggcctggaccctgagaacctggccctgctggagaagatccagagcagcctgctggtgtacagcatggaggacagcagcccccacgtgaccccagaggactacagcgagatcatcgccgccatcctgattggagaccccaccgtgcgctggggagacaagagctacaacctgatctccttcagcaatggagtgtttggctgcaactgtgaccacgccccctttgatgccatgatcatggtgaacatctcctactacgtggatgagaagatcttccagaatgaaggccgctggaagggcagcgagaaggtgcgggacatccccctgcctgaggagctgatcttcatcgtggatgagaaggtgctgaatgacatcaaccaggccaaggcccagtacctgcgggaggccagtgacctgcagattgctgcctatgccttcaccagctttgggaagaagctgaccaagaacaagatgctgcacccagacaccttcatccagctggccctgcagctggcctactaccgcctgcacggccaccctggctgctgctatgaaacagccatgaccaggcacttctaccacggccgcacagagaccatgaggagctgcaccgtggaggccgtgcgctggtgccagagcatgcaggaccccagcgtgaacctgcgggagcggcagcagaagatgctgcaggcctttgccaagcacaacaagatgatgaaggactgcagcgctggaaaaggatttgacagacacctgctgggcctgctgctgattgccaaggaggagggcctgcctgtgcctgagctgttcacagaccccctcttcagcaagagcggcggcggcggcaactttgtgctgagcaccagcctggtgggctacctgcgggtgcagggcgtggtggtgcccatggtgcacaacggctacggcttcttctaccacatcagagatgacagatttgtggtggcctgcagcgcctggaagagctgcccagagacagatgctgagaagctggtgcagctgaccttctgtgccttccatgacatgatccagctgatgaacagcacccacctgtag

SEQ ID NO: 20914 - DNA, 474 bp, Artificial Sequence; identical to SEQ ID NO: 20844
  Description of Artificial Sequence: Synthetic coding sequence

SEQ ID NO: 20915 - DNA, 432 bp, Artificial Sequence
  Description of Artificial Sequence: Synthetic coding sequence
tgaacaagacacttcaaggagagcatcaagttcatccacgagtgccgcctgcggggggagagctgcctggtgcactgcctggccggcgtgagccgctctgtgaccctggtgattgcctacatcatgacagtgacagactttggctgggaggatgccctgcacacagtgcgggccggccgcagctgtgccaaccccaacgtgggcttccagaggcagctgcaggagtttgagaagcatgaggtgcaccagtaccggcagtggctgaaggaggagtatggagagagccccctgcaggatgctgaggaggccaagaacatcctgggcaagtacaaggagcagggccgcacagagccccagcccggggcccggcgctggagcagcttccctgccctggcccccctgacctatgacaactacaccacagagacctag

SEQ ID NO: 20916 - DNA, 495 bp, Artificial Sequence
  Description of Artificial Sequence: Synthetic coding sequence
atggtgaacagcgtcatcttctttgacatcaccgtggatggcaagcccctgggccgcatcagcatcaagcagtttgctgacaagatccccaagacagctgagaacttccgggccctgagcactggagagaagggcttccgctacaagggcagctgcttccaccgcatcatccctggcttcatgtgccagggcggggacttcacccaccccaatggaactggagacaagagcatctatggagagaagtttgatgatgagaacctgatcaggaagcacactggaagtggcatcctgtccatggccaatgccggccccaacaccaacggcagccagttcttcatctgcacagccaagacagagtggctggatggcaagcacgtggccttcggcaaggtgaaggagcgggtgaacatcgtggaggccatggagcacttcggctacagaaacagcaagaccagcaagaagatcaccatcgctgactgtggccagttctag

SEQ ID NO: 20917 - DNA, 468 bp, Artificial Sequence
  Description of Artificial Sequence: Synthetic coding sequence
atgtctgagggggagagccagacagtgctgagcagcggcagtgaccccaaggtggagagcagcagcagcgcccctggcctgacctctgtgagcccccctgtgaccagcaccaccagcgctgccagccctgaggaggaggaggagagtgaagatgaaagtgagatcctggaggagagcccctgtggccgctggcagaagagaagagaggaggtgaaccagagaaatgtgcccggcattgattctgcctacctggccatggacacagaggagggcgtggaggtggtgtggaatgaggtgcagttcagcgagaggaagaactacaagctgcaggaggagaaggtgcgggctgtgtttgacaacctgatccagctggagcacctgaacatcgtgaagttccacaagtactgggccgacatcaaggagaacaaggcccgggtcatcttcatcacagagtacatgagcagctag

SEQ ID NO: 20918 - DNA, 837 bp, Artificial Sequence
  Description of Artificial Sequence: Synthetic coding sequence
atgtggcccttccccagccgcagcctcttccccccacccacccaggcctggctgcagacagtgtccagtgaccctgaggcccagggctggggcgcctggaatgagaccaaggagatcctgggccctgagggcggggagggcaaggaggagaaggaggaggaggaggatgctgaggaggaccaggatggagatgctggcttcctgctgagcctgctggagcaggagaacctggctgaatgtcccctgcctgaccaggagctggaggccatcaagatgaaggtgtgtgccatggagcaggccgagggcaccccccggcccccaggagtgcagcagcaggccgaggaggaggagggcacagctgctggccagctgctgagccctgagaccgtgggctgccccctgagcggcaccccagaggagaaggtggaggccgaccacaggtctgtgtatgtgggcaatgtggactatggaggcagcgctgaggagctggaggcccacttcagccgctgtggggaggtgcaccgggtgaccatcctgtgtgacaagttcagcggccaccccaagggctacgcctacattgaatttgccaccaagggctctgtgcaggccgctgtggagctggaccagagcctcttccggggccgggtcatcaaggtgctgcccaagaggaccaacttccctggcatcagcagcacagacagaggaggcctgcggggccaccctggcagcagaggagcccccttcccccacagcggcctgcagggccggccccggctgcggccccagggccagaacagagcccggggcaagttcagcccctggttcagcccctactag

SEQ ID NO: 20919 - DNA, 132 bp, Artificial Sequence
  Description of Artificial Sequence: Synthetic coding sequence
atgtctgagcagggcgacctgaaccaggccatcgccgaggagggcggcacagagcaggagacagccaccccagaaaatggcatcgtgaagtctgagagcctggatgaggaggagaagctggagctgcagtag

SEQ ID NO: 20920 - DNA, 390 bp, Artificial Sequence
  Description of Artificial Sequence: Synthetic coding sequence
atggctgatgaggagctggaggccctgcggcggcagaggctggccgagctgcaggccaagcatggagaccctggagatgctgcccagcaggaggccaagcaccgggaggccgagatgaggaacagcatcctggcccaggtgctggaccagagcgcccgggcccggctgagcaacctggccctggtgaagccagagaagaccaaggctgtggagaactacctgatccagatggcccgctatggccagctgtctgagaaggtgtccctggacagcctggaggagctgtactgctacctgctgtaccagaacatggccagcaagggccagctgcacctgcactggatcacagagttcctgctgaccctgcggaggaactgctggagggagtag

SEQ ID NO: 20921 - DNA, 2286 bp, Artificial Sequence
  Description of Artificial Sequence: Synthetic coding sequence
atgaggaagcaggaggtgaggacaggccgggaggccggccagggccacggcaccggcagccctgctgagcaggtgaaggccctgatggacctgctggccggcaagggcagccagggcagccaggccccccaggccctggacaggaccccagatgcccccctgggcccctgcagcaatgacagccgcatccagaggcacaggaaggccctgctgagcaaggtgggcggcggccctgagctgggcggcccctggcaccggctggccagcctgctgctggtggagggcctgacagacctgcagctgcgggagcatgacttcacccaggtggaggccacccggggcggcggccacccagccaggacagtggccctggacaggctcttcctgcccctgagccgggtgtctgtgcccccccgggtgtccatcaccatcggcgtggccggcatgggcaagaccaccctggtgcgccactttgtgcggctgtgggcccacggccaggtgggcaaggacttcagcctggtgctgcccctgaccttccgggacctgaacacccatgagaagctgtgtgccgacaggctcatctgcagcgtcttcccccacgtgggggagcccagcctggccgtggccgtgcctgcccgggccctgctgatcctggatggcctggatgaatgtaggacccccctggacttcagcaacacagtggcctgcacagaccccaagaaggagatccctgtggaccacctgatcaccaacatcatccggggcaacctcttccctgaggtgtccatctggatcaccagccggcccagcgccagcggccagatccctgggggcctggtggacaggatgacagagatccggggcttcaatgaggaggagatcaaggtgtgcctggagcagatgtttcctgaggaccaggccctgctgggctggatgctgagccaggtgcaggccgaccgggccctgtacctgatgtgcaccgtgcctgccttctgccgcctgaccggcatggccctgggccacctgtggaggagcaggacaggcccccaggatgctgagctgtggccacccaggaccctgtgtgagctgtacagctggtacttcaggatggccctgtctggagagggccaggagaagggcaaggccagcccccgcatcgagcaggtggcccatggaggcaggaagatggtgggcaccctgggccgcctggccttccacggcctgctgaagaagaagtatgtgttctatgagcaggacatgaaggcctttggagtggacctggccctgctgcagggcgccccctgcagctgcttcctgcagcgggaggagaccctggccagctctgtggcctactgcttcacccacctgagcctgcaggagtttgtggccgccgcctactactacggggccagccggcgggccatctttgacctcttcacagagagcggcgtgtcctggccccggctgggcttcctgacccacttccgctctgctgcccagagggccatgcaggccgaggatggccgcctggatgtgttcctgcgcttcctgagcggcctgctgagcccccgggtgaatgccctgctggccggcagcctgctggcccagggcgagcaccaggcctaccgcacccaggtggccgagctgctgcagggctgcctgcggccagatgctgctgtgtgtgcccgggccatcaacgtgctgcactgcctgcacgagctgcagcacacagagctggcccggtctgtggaggaggccatggagagcggggccctggcccggctgaccggccctgcccaccgggccgccctggcctacctgctgcaggtgtctgatgcctgtgcccaggaggccaacctgagcctgagcctgagccagggcgtgctgcagagcctgctgccccagctgctgtactgcaggaagctgcggctggacaccaaccagttccaggaccctgtgatggagctgctgggctctgtgctgagcggcaaggactgccgcatccagaagatcagcctggccgagaaccagatcagcaacaagggggccaaggccctggcccggagcctgctggtgaacagaagcctgaccagcctggacctgcggggcaacagcatcggcccccagggcgccaaggccctggctgatgccctgaagatcaacagaaccctgaccagcctgcgggtgaagttcatgtaccacaagattgactgcttccggcgggtgcctgaggctgatgcctgcaaccccagcaccctgggcggccagggccgctggatcacctag

SEQ ID NO: 20922 - DNA, 474 bp, Artificial Sequence; identical to SEQ ID NO: 20844
  Description of Artificial Sequence: Synthetic coding sequence

SEQ ID NO: 20923 - DNA, 1473 bp, Artificial Sequence
  Description of Artificial Sequence: Synthetic coding sequence
atgaccatcggccgcatggagaatgtggaggtgttcaccgctgagggcaagggccggggcctgaaggccaccaaggagttctgggccgctgacatcatctttgctgagcgggcctacagcgctgtggtgtttgacagcctggtgaactttgtgtgccacacctgcttcaagaggcaggagaagctgcaccgctgtggccagtgcaagtttgcccactactgtgacaggacctgccagaaggatgcctggctgaaccacaagaatgaatgttctgccatcaagagatatggcaaggtgcccaatgaaaacatccggctggccgcccgcatcatgtggagggtggagcgggagggcaccggcctgacagagggctgcctggtgtctgtggatgacctgcagaaccacgtggagcactttggagaggaggagcagaaggacctgcgggtggatgtggacaccttcctgcagtactggccaccccagagccagcagttctccatgcagtacatcagccacatctttggagtcatcaactgcaatggcttcaccctgagtgaccagaggggcctgcaggccgtgggcgtgggcatcttccccaacctgggcctggtgaaccacgactgctggcccaactgcaccgtcatcttcaacaacggcaaccatgaagctgtgaagtccatgttccacacccagatgagaattgagctgcgggccctgggcaagatcagcgagggggaggagctgactgtgtcctacatcgacttcctgaatgtgtctgaggagaggaagaggcagctgaagaagcagtactactttgactgcacctgtgagcactgccagaagaagctgaaggatgacctcttcctgggcgtgaaggacaaccccaagcccagccaggaggtggtgaaggagatgatccagttcagcaaggacaccctggagaagattgacaaggcccggtctgagggcctgtaccacgaggtggtgaagctgtgccgggagtgcctggagaagcaggagcctgtgtttgctgacaccaacatctacatgctgaggatgctgagcatcgtgtctgaggtgctgagctacctgcaggcctttgaggaggccagcttctacgcccggaggatggtggatggctacatgaagctgtaccaccccaacaatgcccagctgggcatggctgtgatgagagctggcctgaccaactggcacgccggcaacatcgaggtgggccacggcatgatctgcaaggcctatgccatcctgctggtgacccacggccccagccaccccatcaccaaggacctggaggccatgagggtgcagacagagatggagctgaggatgttccggcagaatgagttcatgtactacaagatgagggaggccgccctgaacaaccagcccatgcaggtgatggccgagcccagcaatgagcccagccctgccctcttccacaagaagcagtag

SEQ ID NO: 20924 - DNA, 1491 bp, Artificial Sequence
  Description of Artificial Sequence: Synthetic coding sequence
atgtggggccgcttcctggcccctgaggccagcggccgggacagccctgggggcgcccgctccttccctgctggccctgactacagcagcgcctggctgcctgccaatgaaagcctgtggcaggccaccaccgtgcccagcaaccacaggaacaaccacatcagaagacacagcatcgccagtgacagcggggacaccggcatcggcaccagctgcagcgacagcgtggaggaccacagcaccagcagcggcaccctgtccttcaagcccagccagagcctcatcaccctgcccacagcccacgtgatgcccagcaacagcagcgccagcatcagcaagctgcgggagagcctgaccccagatggcagcaagtggagcaccagcctgatgcagaccctgggcaaccacagcagaggagagcaggacagcagcctggacatgaaggacttccggcccctgaggaagtggagcagcctgagcaagctgacagccccagacaactgtggccagggcggcaccgtgtgccgggaggagagcagaaatggcctggagaagattggcaaggccaaggccctgaccagccagctgcggaccatcggccccagctgcctgcatgacagcatggagatgctgcggctggaggacaaggagatcaacaagaagaggagcagcaccctggactgcaagtacaagtttgagagctgcagcaaggaggacttccgggccagcagcagcaccctgcggcggcagcctgtggacatgacctacagcgccctgcctgagagcaagcccatcatgaccagcagcgaggcctttgagccccccaagtacctgatgctgggccagcaggccgtgggcggcgtgcccatccagcccagcgtgaggacccagatgtggctgacagagcagctgcggaccaaccccctggagggcaggaacacagaagattcctacagcctggccccctggcagcagcagcagatcgaggacttccggcagggcagcgagacccccatgcaggtgctgaccggcagcagccggcagagctacagccctggctaccaggacttcagcaagtgggagagcatgctgaagatcaaggagggcctgctgcggcagaaggagatcgtcatcgaccggcagaagcagcagatcacccacctgcacgagcgcatccgggacaatgagctgcgggcccagcacgccatgctgggccactacgtgaactgtgaagattcctatgtggccagcctgcagccccagtatgagaacaccagcctgcagacccccttcagcgaggagagcgtgagccacagccagcagggcgagtttgagcagaagctggccagcacagagaaggaggtgctgcagctgaatgagttcctgaagcagaggctgagcctcttcagcgaggagaagaagaagctggaggagaaggtgggcttcagcaacaaggtggagctgggccagcagcacttcctgagcatctag

SEQ ID NO: 20925 - DNA, 1083 bp, Artificial Sequence
  Description of Artificial Sequence: Synthetic coding sequence
atggccgagctgcagcagctgcaggagtttgagatccccaccggccgggaggccctgcggggcaaccacagcgccctgctgcgggtggccgactactgtgaggacaactacgtgcaggccacagacaagaggaaggccctggaggagaccatggccttcaccacccaggccctggcctctgtggcctaccaggtgggcaacctggccggccacaccctgaggatgctggacctgcagggcgccgccctgcggcaggtggaggccaggatggtgaacatgcacatggagaaggtggcccggcgggagatcggcaccctggccaccgtgcagaggctgcccccaggccagaaggtgattgcccctgagaacctgccccccctgaccccctactgccggcggcccctgaactttggctgcctggatgacattggacatggcatcaaggacctgagcacccagctgagcaggacaggcaccctgagcaggaagagcatcaaggccccagccaccccagccagcgccaccctgggccggcccccacgcatccctgagcctgtgcacctgcctgtggtgcctgatggccgcctgtctgctgccagcagcgccttcagcctggccagcgctggcagcgctgagggcgtgggcggggcccccacccccaagggccaggccgcccccccagccccacccctgcccagcagcctggaccccccacctcctcctgctgctgtggaggtgttccagaggcctcccaccctggaggagctgagccccccacctccagatgaggagctgcccctgcccctggacctgcccccacctccacccctggatggagatgagctgggcctgcccccacctcctcctggctttggaccagatgagcccagctgggtgcctgccagctacctggagaaggtggtgaccctgtacccctacaccagccagaaggacaatgagctgtccttcagcgagggcaccgtcatctgtgtgacccggcgctacagtgatggctggtgtgagggcgtgtcctctgagggcaccggcttcttccctggcaactacgtggagcccagctgctag

SEQ ID NO: 20926 - DNA, 201 bp, Artificial Sequence
  Description of Artificial Sequence: Synthetic coding sequence
atgctgcgctgtggccagatgatctttgcccaggccctggtgtgccgccacctgggccgggactggcgctggacccagaggaagaggcagcctgacagctacttctctgtgctgaatgccttcatcgacaggaaggacagctactacagcatccaccagatcgcccagatgggcgtgggggagggcaagagcattggatag

SEQ ID NO: 20927 - DNA, 1476 bp, Artificial Sequence
  Description of Artificial Sequence: Synthetic coding sequence
atggagcagcccccagcccccaagagcaagctgaagaagctgtctgaggacagcctgaccaagcagcctgaggaggtgtttgatgtgctggagaagctgggggagggcagctatggcagcgtcttcaaggccatccacaaggagagcggccaggtggtggccatcaagcaggtgcctgtggagagtgacctgcaggagatcatcaaggagatcagcatcatgcagcagtgtgacagcccctacgtggtgaagtactacggcagctacttcaagaacacagacctgtggatcgtgatggagtactgtggggccggctctgtgtctgacatcatccggctgaggaacaagaccctgattgaagatgaaattgccaccatcctgaagagcaccctgaagggcctggagtacctgcacttcatgaggaagatccaccgggacatcaaggccggcaacatcctgctgaacacagagggccacgccaagctggccgactttggagtggccggccagctgacagacaccatggccaagaggaacacagtcatcggcacccccttctggatggcccctgaggtgatccaggagatcggctacaactgtgtggccgacatctggagcctgggcatcaccagcattgagatggccgagggcaagccaccctatgctgacatccaccccatgagggccatcttcatgatccccaccaaccccccacccaccttcaggaagccagagctgtggagcgatgacttcacagactttgtgaagaagtgcctggtgaagaaccctgagcagagggccacagccacccagctgctgcagcaccccttcatcaagaatgccaagcctgtgtccatcctgcgggacctgatcacagaggccatggagatcaaggccaagagacatgaggagcagcagcgggagctggaggaggaggaggagaacagtgatgaagatgagctggacagccacaccatggtgaagacctctgtggagagcgtgggcaccatgagggccaccagcaccatgtctgagggcgcccagaccatgattgagcacaacagcaccatgctggagagtgacctgggcaccatggtgatcaacagtgaagatgaggaggaggaggatggcaccatgaagagaaatgccaccagcccccaggtgcagaggcccagcttcatggactactttgacaagcaggacttcaagaacaagagccatgagaactgcaaccagaacatgcatgagcccttccccatgagcaagaatgtgtttcctgacaactggaaggtgccccaggatggagactttgacttcctgaagaacctgagcctggaggagctgcagatgaggctgaaggccctggaccccatgatggagcgggagattgaggagctgcggcagcgctacacagccaagaggcagcccatcctggatgccatggatgccaagaagaggcggcagcagaacttctag

SEQ ID NO: 20928 - DNA, 126 bp, Artificial Sequence
  Description of Artificial Sequence: Synthetic coding sequence
atgagcagcaagggcagcagcacagatggccgcacagacctggccaacggcagcctgagcagcagccctgaggagatgtctggagctgaggagggccgggagaccagcagcggcatcgaggtgtag

SEQ ID NO: 20929 - DNA, 945 bp, Artificial Sequence
  Description of Artificial Sequence: Synthetic coding sequence
atgcccaacgtggccgagacagagaggagcaatgattctggaaatggagagcacaagtctgagaggaagagccctgaggagaacctgcagggcgctgtgaagagcttctgcaccagcgccagcggggcccccctgggccccaagggagatggccactacccctggagctgccctgtgacccacacccgggagaagatctatgccatctgcagcgactatgccttcctgaaccaggccaccagcatctacaagacccccaaccccagccgcagcccctgcctgcctgacagcaccagcctgtctgctggcaacaacagcagccgctacatcggcatccccaccagcaccagcgagatcatctacaatgaggagaacagcctggagaacctgagcaacagcctgggcaagctgcccctggcctgggagattgacaagtcagaatttgatggagtgaccaccaacagcaagcacaagtctggaaatgccaagaagcaggtgtccaagaggaagaccagtgacaagaagggccgctaccagaaggaatgtccccagcacagccccctggaggacatcaagcagaggaaggtgctggacctgcggcgctggtactgcatcagccggccccagtacaagaccagctgtggcatcagcagcctcatcagctgctggaacttcctgtacagcaccatgggcgccggcaacctgccccccatcacccaggaggaggccctgcacatcctgggcttccagcccccatttgaggacatccgcttcggccccttcaccggcaacaccaccctgatgcgctggttccggcagatcaatgaccacttccacgtgaagggctgcagctatgtgctgtacaagccccacggcaagaacaagacagctggggagacagctggggacctgagccaccacaggaagctgaacatcggcagctag

SEQ ID NO: 20930 - DNA, 1500 bp, Artificial Sequence
  Description of Artificial Sequence: Synthetic coding sequence
atgcctgagatccgggtgacccccctgggcgccggccaggatgtgggccgcagctgcatcctggtgtccattgctgggaagaatgtgatgctggactgtggcatgcacatgggcttcaatgatgatgtggatgatgagctggagatcaaggcctactatgccggccacgtgctgggcgccgccatgttccagatcaaggtgggcagcgagagcgtggtgtacacaggagactacaacatgaccccagacagacacctgggcgccgcctggattgacaagtgccggcccaacctgctgatcacagagagcacctacgccaccaccatccgggacagcaagcgctgccgggagcgggacttcctgaagaaggtgcatgaaacagtggagcggggcggcaaggtgctgatccctgtgtttgccctgggccgggcccaggagctgtgcatcctgctggagaccttctgggagaggatgaacctgaaggtgcccatctacttcagcacaggcctgacagagaaggccaaccactactacaagctgttcatcccctggaccaaccagaagatcaggaagacctttgtgcagaggaacatgtttgagttcaagcacatcaaggcctttgaccgggcctttgctgacaaccctggccccatggtggtgtttgccaccccaggcatgctgcatgctggccagagcctgcagatcttcaggaagtgggccggaaatgagaagaacatggtgatcatgcctggctactgtgtgcagggcaccgtgggccacaagatcctgagcggccagaggaagctggagatggagggccggcaggtgctggaggtgaagatgcaggtggagtacatgtccttcagcgcccacgcagatgccaagggcatcatgcagctggtgggccaggccgagcctgagagcgtgctgctggtgcatggagaggccaagaagatggagttcctgaagcagaagattgagcaggagctgcgggtgaactgctacatgcctgccaatggagagaccgtgaccctgcccaccagccccagcatccctgtgggcatcagcctgggcctgctgaagcgggagatggcccagggcctgctgcctgaggccaagaagccccggctgctgcacggcaccctcatcatgaaggacagcaacttccggctggtgagcagcgagcaggccctgaaggagctgggcctggccgagcaccagctgcgcttcacctgccgggtgcacctgcatgacaccaggaaggagcaggagacagccctgcgggtgtacagccacctgaagtctgtgctgaaggaccactgtgtgcagcacctgcctgatggctctgtgacagtggagagcgtgctgctgcaggccgccgcccccagcgaggaccccggcaccaaggtgctgctggtgtcctggacctaccaggatgaggagctgggcagcttcctgaccagcctgctgaagaagggcctgccccaggcccccagctag

SEQ ID NO: 20931 - DNA, 396 bp, Artificial Sequence
  Description of Artificial Sequence: Synthetic coding sequence
ggcaccatcagctgcagcacaggcaccctgcagaggaggaacctgggccctgagcggcagacaggcctgctgctgctgggcatgaaggagaaccaggagctgaagaccatccaggccaacctgagccggcagagggtggagcaccagtgcctgagcagcgaggagctgaagcagcgcttccccaacatccggctgcccagaggagaggtgggcctgctggacaacagcggcggcgtcatctatgcctacaaggccctgcgggccctgcaggatgccatccggcagctgggcggcatcgtgagagatggagagaaggtggtggagatcaaccctggcctgctggtgacagtgaagaccaccagccgcagctaccaggccaagagcctggtgatctag

SEQ ID NO: 20932 - DNA, 687 bp, Artificial Sequence
  Description of Artificial Sequence: Synthetic coding sequence
atgagccgggagcggggcagccgctctgaggagcccggggccggcaaccgggagagcggcagccgggagcccggcctggccgctgctgccatgagcacagtggacctggcccgggtgggcgcctgcatcctgaagcatgctgtgactggagaggccgtggagctgcggagcctgtggagggagcacgcctgtgtggtggccggcctgcggcgcttcggctgtgtggtgtgccgctggatcgcccaggacctgagcagcctggccggcctgctggaccagcacggcgtgcggctggtgggcgtgggccctgaggccctgggcctgcaggagttcctggatggagactactttgctggggagctgtacctggatgagagcaagcagctgtacaaggagctgggcttcaagcgctacaacagcctgagcatcctgcctgctgccctgggcaagcctgtgagagatgtggccgccaaggccaaggctgtgggcatccagggcaacctgagcggggacctgctgcagagcggcggcctgctggtggtgtccaaaggaggagacaaggtgctgctgcactttgtgcagaagagccctggggactatgtgcccaaggagcacatcctgcaggtgctgggcatctctgctgaggtgtgtgccagtgaccccccccagtgtgaccgggaggtgtag

SEQ ID NO: 20933 - DNA, 654 bp, Artificial Sequence
  Description of Artificial Sequence: Synthetic coding sequence
atgaacttcagcgaggtgttcaagctgagcagcctgctgtgcaagttctccccagatggcaagtacctggccagctgtgtgcagtaccgcctggtggtgagagatgtgaacaccctgcagatcctgcagctgtacacctgcctggaccagatccagcacatcgagtggagcgctgacagcctcttcatcctgtgtgccatgtacaagaggggcctggtgcaggtgtggagcctggagcagcctgagtggcactgcaagattgatgagggcagcgctggcctggtggccagctgctggagcccagatggccgccacatcctgaacaccacagagttccacctgcgcatcaccgtgtggagcctgtgcaccaagtctgtgtcctacatcaagtaccccaaggcctgcctgcagggcatcaccttcaccagagatggccgctacatggccctggccgagcggcgggactgcaaggactatgtgtccatctttgtgtgcagcgactggcagctgctgcgctacaagatcctgctgtacagcctggatggccgcctgctgagcacctacagcgcctatgagtggagcctgggcatcaagtctgtggcctggagccccagcagccagttcctggccgtgggcagctatgatggcaagtag

SEQ ID NO: 20934 - DNA, 483 bp, Artificial Sequence; identical to SEQ ID NO: 20009
  Description of Artificial Sequence: Synthetic coding sequence

SEQ ID NO: 20935 - DNA, 951 bp, Artificial Sequence
  Description of Artificial Sequence: Synthetic coding sequence
atggaggagaacaacctgcagtgcagctctgtggtggatggcaactttgaggaggtgccccgggagacagccatccagttcaagccacccctgtaccggcagcgctaccagtttgtgaagaacctggtggaccagcacgagcccaagaaggtggccgacctgggctgtggggacaccagcctgctgcggctgctgaaggtgaacccctgcatcgagctgctggtgggcgtggacatcaatgaagacaagctgcgctggaggggggacagcctggcccccttcctgggggacttcctgaagccccgggacctgaacctgaccatcaccctgtaccacggctctgtggtggagcgggacagccggctgctgggctttgacctgatcacctgcatcgagctgattgagcacctggacagcggggacctggcccgcttccctgaggtggtgtttggctacctgagccccagcatgatcgtcatcagcacccccaacagcgagttcaaccccctcttccccagcgtgaccctgcgggacagcgaccacaagtttgagtggaccaggatggagttccagacctgggccctgtatgtggccaacagatatgactacagcgtggagttcaccggggtgggggagcccccagctggagcagaaaatgtgggctactgcacccagatcggcatcttcaggaagaatggaggcaaggccacagagagctgcctgtctgagcagcacgaccagcacgtgtacaaggctgtgttcaccaccagctaccccagcctgcagcaggagcgcttcttcaagctggtgctggtgaatgaggtgtcccagcaggtggagagcctgcgggtgagccacctgcccaggaggaaggagcaggccggggagcggggggacaagcccaaggacatcggcggcagcaaggcccctgtgccctgcttcggcccctag

SEQ ID NO: 20936 - DNA, 1056 bp, Artificial Sequence
  Description of Artificial Sequence: Synthetic coding sequence
atgtggacccccaggcctgccctgcacgtgcacgtgatcctgtacagccccatccaccgctgctacgcccgggctgaccccaccatgggccgcatctgggtggatgctgctgtgccctgcctggaggagtgtggcttcctgctgcacttcagagatggctgctaccacctggagaccagcacccaccacttcctgagccacgtggacaggctcttcagccagcccagcagccagacagccttccacatgcaggtgcggcctgggggcctggtggccctgtgtgatggagagggcggcatgctgtacccccagggcacccacctgctgctgggcatgggctgcaaccccatgagaggagaggagtggttcatcctgcagcactgccccacctgggtgtccctgcggagcaagacaggccgcttcatcagcgtcatctatgatggagaggtgcgggccgccagcgagcggctgaacaggatgagcctcttccagtttgaatgtgacagcgagagccccaccgtgcagctgcggagcgccaacggctactacctgagccagaggaggcacagagctgtgatggctgatggccaccccctggagagtgacaccttcttcaggatgcactggaactgtggccgcatcatcctgcagagctgccggggccgcttcctgggcatcgcccccaacagcctgctgatggccaacgtcatcctgcccggccccaatgaggagtttggcatcctgtttgccaacagaagcttcctggtgctgcggggccgctatggctacgtgggcagcagcagcggccatgacctgatccagtgcaaccaggaccagcctgaccgcatccacctgctgccctgccggcccggcatctaccacttccagggcggcatcctgctggtgaacaacatcctgtggcacctgagccccctgggccaggtgtgcccccagctgctgtaccgggccagcggggagcagctgacccactgcaccggcccccagtggctgctgcacgccagccggcccaagtggcaccctgtgggccggcagtag

SEQ ID NO: 20937 - DNA, 333 bp, Artificial Sequence
  Description of Artificial Sequence: Synthetic coding sequence
atgcagatcagcagcgagaaggaggaggatgacaatgagaagaggcaggaccccggggacaactgggaggagggcggcggcggcggcggcggcatggagaagagcagcggcccctggaacaagacagcccctgtgcaggcccccccagcccctgtgattgtgacagagaccccagagcccgccatgaccagcggcgtgtacagacctcctggggcccggctgaccaccaccaggaagaccccccagggccccccagagatctacagcgacacccagttccccagcctgcagagcacagccaagcacgtggagagcaggaagtacctgaagtag

SEQ ID NO: 20938 - DNA, 972 bp, Artificial Sequence
  Description of Artificial Sequence: Synthetic coding sequence
atggagggccatgaccccaaggagcctgagcagctgaggaagctgttcatcggcggcctgagctttgagaccacagatgacagcctgcgggagcactttgagaagtggggcaccctgacagactgtgtggtgatgagggacccccagaccaagaggagccggggcttcggctttgtgacctacagctgtgtggaggaggtggatgctgccatgtgtgcccggccccacaaggtggatggccgggtggtggagcccaagagagctgtgtcccgggaggacagcgtgaagccaggggcccacctgactgtgaagaagatctttgtgggcggcatcaaggaggacacagaggagtacaacctgcgggactactttgagaagtatggcaagattgagaccatcgaggtgatggaggaccggcagagcggcaagaagaggggctttgcctttgtgacctttgatgaccatgacacagtggacaagatcgtggtgcagaagtaccacaccatcaatggccacaactgtgaggtgaagaaggccctgagcaagcaggagatgcagagcgctggcagccagaggggccggggcggcggcagcggcaacttcatgggccggggcggcaactttggaggcggcggcggcaactttggccggggcggcggcaactacggcggcggccctggctacagcagccggggcggctacggcggcggcggccctggctacggcaaccagggcggcggctacggcggcggcggcggctatgatggctacaatgaaggaggcaactttggaggcggcaactacggcggcggcggcaactacaatgactttggaaactacagcggccagcagcagagcaactacggccccatgaagggcggcagctttggaggccgcagcagcggcagcccctatggaggcggctacggcagcggcggcggcagcggcggctacggcagccgccgcttctag

SEQ ID NO: 20939 - DNA, 291 bp, Artificial Sequence
  Description of Artificial Sequence: Synthetic coding sequence
aacatccagctggtggctgatggctgctgcaacctgcagaagcagatccagatcacccagctgtttggagtgcctgtggtggtggccctgaatgtgttcaagacagacaccagggctgagattgacctggtgtgtgagctggccaagagagctggggcctttgatgctgtgccctgctaccactggagcgtgggcggcaaaggatctgtggacctggcccgggctgtgcgggaggccgccagcaagaggagccgcttccagttcctgtatgatgtgcagcccttctcctag

SEQ ID NO: 20940 - DNA, 483 bp, Artificial Sequence
  Description of Artificial Sequence: Synthetic coding sequence
atgacagatgtgcctgccaccttcacccaggccgagtgcaatggagacaagcccccagaaaatggccagcagaccatcaccaagatcagcgaggagctgacagatgtggacagccccctgccccactacagagtggagcccagcctggagggcgccctgaccaagggcagccaggaggagaggaggaagctgcagggcaacatgctgctgaacagctccatggaggacaagatgctgaaggaaaatcctgaggagaagctgttcatcgtgcacaaggccatcacagacctgagcctgcaggagaccagcgcagatgagatgaccttccgggagggccaccagtgggagaagatccccctgagcggcagcaaccaggagatccggcggcagaaggagcgcatcacagagcagcccctgaaggaggaggaggatgaggacaggaagaacaagggccaccaggccgctgagattgagtggctgtag

SEQ ID NO: 20941 - DNA, 480 bp, Artificial Sequence; identical to SEQ ID NO: 20848
  Description of Artificial Sequence: Synthetic coding sequence

SEQ ID NO: 20942 - DNA, 432 bp, Artificial Sequence
  Description of Artificial Sequence: Synthetic coding sequence
atggacagcagccagcagaagaccttccggggccatgatgcccctgtgctgagcctgagctttgaccccaaggacatcttcctggccagcgccagctgtgatggctctgtgcgggtgtggcagatcagtgaccagacctgtgccatctcctggcccctgctgcagaagtgcaatgatgtgatcaatgccaagagcatctgccgcctggcctggcagcccaagagcggcaagctgctggccatccctgtggagaagtctgtgaagctgtacagaagagagagctggagccaccagtttgacctgagtgacaacttcatcagccagaccctgaacatcgtgacctggagcccctgtggccagtacctggccgccggcagcatcaatggcctcatcatcgtgtggaatgtggagaccaaggactgcatggagtag

SEQ ID NO: 20943 - DNA, 2109 bp, Artificial Sequence
  Description of Artificial Sequence: Synthetic coding sequence
atgacagagcgctgcagcctgtggagcgccctgtctgctgctgcctgctgcttctaccggggcagctttgtgcaggtgcagttcagcaaggagaagtacatcctggacagcagccctgagaagctgcacaaggagctggaggaggagctgaagctgagcagcacagacctgcggagccacgcctggtaccacggccgcatcccccgggaggtgtctgagaccctggtgcagagaaatggagacttcctgatccgggacagcctgaccagcctgggggactatgtgctgacctgccgctggaggaaccaggccctgcacttcaagatcaacaaggtggtggtgaaggccggggagagctacacccacatccagtacctgtttgagcaggagagctttgaccacgtgcctgccctggtgcgctaccacgtgggcagcaggaaggctgtgtctgagcagagcggggccatcatctactgccctgtgaacagaaccttccccctgcgctacctggaggccagctatggcctgggccagggcagcagcaagccagccagccctgtgagccccagcggccccaagggcagccacatgaagagaagatctgtgaccatgacagatggcctgacagctgacaaggtgaccaggagtgatggctgccccaccagcaccagcctgccccggccccgggacagcatccgcagctgtgccctgtccatggaccagatcccagacctgcacagccccatgagccccatcagcgagagccccagcagccctgcctacagcacagtgaccagggtgcatgctgccccagctgcccccagcgccacagccctgcctgccagccctgtggcccggcgcagcagcgagccccagctgtgccccggcagcgcccccaagacccacggggagagtgacaagggcccccacaccagccccagccacaccctgggcaaggccagccccagccccagcctgagcagctacagcgaccctgacagcggccactactgccagctgcagccccctgtgcggggcagccgggagtgggccgccacagagaccagcagccagcaggcccggagctatggagagcggctgaaggagctgtctgaaaatggagcccctgagggggactggggcaagaccttcaccgtgcccatcgtggaggtgaccagcagcttcaacccagccaccttccagagcctgctgatcccccgggacaaccggcccctggaggtgggcctgctgaggaaggtgaaggagctgctggccgaggtggatgcccggaccctggcccggcacgtgaccaaggtggactgcctggtggcccgcatcctgggcgtgaccaaggagatgcagaccctgatgggcgtgcgctggggcatggagctgctgaccctgccccacggccggcagctgcggctggacctgctggagcgcttccacaccatgagcatcatgctggccgtggacatcctgggctgcaccggcagcgctgaggagcgggccgccctgctgcacaagaccatccagctggccgctgagctgcggggcaccatgggcaacatgttctcctttgctgctgtgatgggcgccctggacatggcccagatcagccggctggagcagacctgggtgaccctgcggcagaggcacacagagggcgccatcctgtatgagaagaagctgaagcccttcctgaagagcctgaatgaaggcaaggagggcccccccctgagcaacaccaccttcccccacgtgctgcccctcatcaccctgctggagtgtgacagcgcccctcctgagggccctgagccctggggcagcacagaacatggagtggaggtggtgctggcccacctggaggccgccaggacagtggcccaccacggcggcctgtaccacaccaatgctgaggtgaagctgcagggcttccaggcccggcctgagctgctggaggtgttcagcacagagttccagatgaggctgctgtggggcagccagggcgccagcagcagccaggccaggagatatgagaagtttgacaaggtgctgacagccctgagccacaagctggagcctgctgtgcgcagcagcgagctgtag

SEQ ID NO: 20944 - DNA, 585 bp, Artificial Sequence
  Description of Artificial Sequence: Synthetic coding sequence
atgacagaggacagccagaggaacttccgctctgtgtactatgagaaggtgggcttccggggcgtggaggagaagaagagcctggagatcctgctgaaggatgaccggctgggcatcctgcccccccaccacgagagccacgccaaggtgatgatgtacaggaaggagcagtacctggatgtgctgcacgccctgaaggtggtgcgctttgtgtctgatgccaccccccaggccgaggtgtacctgaggatgtaccagctggagagcggcaagctgcccaggagccccagcttccccctggagccagatgatgaggtgttcctggccatcgccaaggccatggaggagatggtggaggacagcgtggactgctactggatcaccaggagatttgtgaaccagctgaacaccaagtacagagacagcctgccccagctgcccaaggcctttgagcagtacctgaacctggaggatggccgcctgctgacccacctgaggatgtgcagcgctgcccccaagctgccctatgacctgtggttcaagcgctgctttgctggctgcctgcctgagagcagcctgcagtag

SEQ ID NO: 20945 - DNA, 2334 bp, Artificial Sequence
  Description of Artificial Sequence: Synthetic coding sequence
atggagcccaaggaggccaccgggaaggagaacatggtgaccaagaagaagaacctggccttcctgcggagccggctgtacatgctggagaggaggaagacagacacagtggtggagagctctgtgtctggggaccacagcggcaccctgcggcgcagccagagcgacagaacagagtacaaccagaagctgcaggagaagatgaccccccagggagaatgttctgtggccgagaccctgaccccagaggaggagcaccacatgaagaggatgatggccaagcgggagaagatcatcaaggagctgatccagacagagaaggactacctgaatgacctggagctgtgtgtgcgggaggtggtgcagcccctgaggaacaagaagacagaccggctggatgtggacagcctcttcagcaacattgaatctgtgcaccagatcagcgccaagctgctgagcctgctggaggaggccaccacagatgtggagcccgccatgcaggtgattggagaggtgttcctgcagatcaagggccccctggaggacatctacaagatctactgctaccaccatgatgaggcccacagcatcctggagagctatgagaaggaggaggagctgaaggagcacctgagccactgcatccagagcctgaagaagatctacatgcaggagggcaagcccaacctgctggacatgggcagcctgatgatcaagcccatccagagggtgatgaagtaccccctgctgctgtgtgagctgaggaacagcaccccacccagccacccagactaccgggccctggatgatgcctttgctgctgtgaaggacatcaacgtgaacatcaatgagctgaagaggaggaaggacctggtgctgaagtacaagaagaatgatgaagatgagagcctgaaggacaagctgagcaagctgaacatccacagcatcagcaagaagagcaagagggtgaccaaccacctgaagatcctgaccagaggagagagccaggtgaaggacaacaccttcaaccgggaggagaagctgttccgggccctggagaagacagtgcggctgtgtgtgaagaacatcagcctgtgcctgcagcacatccaggatgccatgcccctggccctgcagagcgtgatggacctgcaggagatctcctacaacaaggatgatgagatggactacagcgagaccctgagcaatgccctgaacagctgccacgactttgccagccacctgcagaggctcatcctgacccccctgagcgccctgctgagcctcttccctggcccccacaagctgatccagaagagatatgacaagctgctggactgcaacagctacctgcagaggagcactggagaggagagtgacctggccaagaaggagtatgaggccctgaatgcccagctggtggaggagctgcaggccttcaaccaggccgccaggaagatcctgctgaactgcctgtgcagcttcatcaccctgctgcgggacctgatgctggtggcccagcaggcctacagcaccctggtgcccatgcccctgctggtgagcagcatcagcgagatccagaaccaggtgctggaggagatccagaacctgaactgtgtgaaggagaacagcgccaccttcatcgagaggaagctgagctttgagaagaagaagcctgtgcagatcctgcctgagatgccccaccagacagacatccacaggagcaagctgctgagcacctacagcgctgaggagctgtaccaggccaagaggaagtgcaatgccacccaggagtatgacatcaacctgctggagggggacctggtggccgtcatcgagcagaaggaccccctgggcagcaccagccgctggctggtggacacaggaaatgtgaagggctacgtgtacagcagcttcctgaagccctacaacccagccaagatgcagaaggtggatgctgagaaccgcttctgtgatgatgactttgagaacatcagcctgtttgtgagcagcaggcctgccagtgacagcgtgacaggcaccagcgagagcagcatcggggacagcagcagcagcctgagcggcacctgtgggaagtttgagaccaatggaacagatgtggacagcttccaggaggtggatgagcagatcttctatgctgtgcacgccttccaggcccggagtgaccacgagctgagcctgcaggagtaccagagggtgcacatcctgcgcttctgtgacctgagcggcaacaaggagtggtggctggccgaggcccagggccagaagggctacgtgcctgccaactacctgggcaagatgacctacgcctag

SEQ ID NO: 20946 - DNA, 543 bp, Artificial Sequence
  Description of Artificial Sequence: Synthetic coding sequence
tgaagccagcccaagagctttgagaacagccctggggacctgggcaacagcagcctgcccacagctggctacaagagggcccagaccagcggcatcgaggaggagaccgtgaaggagaagaagaggaaaggaaacaagcagagcaagcacggccctggccggcccaagggcaacaagaaccaggagaatgtgagccacctgtctgtgtcctctgccagccccaccagctctgtggccagcgctgctggcagcatcaccagcagcagcctgcagaagagccccaccctgctgagaaatggcagcctgcagagcctgtctgtgggcagcagccctgtgggcagcgagatctccatgcagtacagacatgatggagcctgccccaccaccagcatctacaacagcaatgatgtggccgtgtccttccccaacgtggtgtctggcagcggcagcagcacccctgtgagcagcagccacctgccccagcagagcagcggccacctgcagcaggtgggcgccctgagccccagcgctgtgagcagctag

SEQ ID NO: 20947 - DNA, 384 bp, Artificial Sequence
  Description of Artificial Sequence: Synthetic coding sequence
atgaccaccaagaacctggagaccaaggtgacagtgaccagcagccccatcagaggagctggagatggcatggagacagaggagccccccaagtctgtggaggtgaccagcggcgtgcagagcaggaagcaccacagcctgcagagcccctggaagaaggctgtgcccagcgagagccctggggtgctgcagctgggcaagatgctgacagagaaggccatggaggtgaaggctgtgcgcatcctggtgcccaaggccgccatcacccatgacatccccaacaagaacaccaaggtgaagagcctgggccaccacaagggggagttcctgggccagagcgagggcgtgattgagcccaacaaggagctgtctgaggtgaagtag

SEQ ID NO: 20948 - DNA, 1683 bp, Artificial Sequence
  Description of Artificial Sequence: Synthetic coding sequence
atgtctgagcacagcaggaacagcgaccaggaggagctgctggatgaggagatcaatgaagatgagatcctggccaacctgtctgctgaggagctgaaggagctgcagagcgagatggaggtgatggccccagaccccagcctgcctgtgggcatgatccagaaggaccagacagacaagcccccaactggaaacttcaaccacaagagcctggtggactacatgtactgggagaaggccagcaggaggatgctggaggaggagcgggtgcctgtgacctttgtgaagtctgaggagaagacccaggaggagcacgaggagattgagaagaggaacaagaacatggcccagtacctgaaggagaagctgaacaatgaaattgtggccaacaagcgggagagcaagggcagcagcaacatccaggagacagatgaggaggatgaggaggaggaggatgatgatgatgatgatgaaggagaagatgatggagaggagagcgaggagaccaaccgggaggaggagggcaaggccaaggagcagatccggaactgtgagaacaactgccagcaggtgacagacaaggccttcaaggagcagagggacaggcctgaggcccaggagcagagcgagaagaagatcagcaagctggaccccaagaagctggccctggacaccagcttcctgaaggtgtccacccggcccagcggcaaccagacagacctggatggcagcctgcggcgggtgaggaagaatgaccctgacatgaaggagctgaacctgaacaacatcgagaacatccccaaggagatgctgctggactttgtgaatgccatgaagaagaacaagcacatcaagaccttcagcctggccaacgtgggcgcagatgaaaatgtggcctttgccctggccaacatgctgcgggagaacagaagcatcaccaccctgaacatcgagagcaacttcatcactggaaaaggaattgtggccatcatgcgctgcctgcagttcaatgagaccctgacagagctgcgcttccacaaccagaggcacatgctgggccaccacgccgagatggagatcgcccggctgctgaaggccaacaacaccctgctgaagatgggctaccactttgagctgcccggccccaggatggtggtgaccaacctgctgaccaggaaccaggacaagcagaggcagaagaggcaggaggagcagaagcagcagcagctgaaggagcagaagaagctgattgccatgctggagaatggcctgggcctgcccccaggcatgtgggagctgctgggcggccccaagccagacagcaggatgcaggagttcttccagcccccaccaccccggccccccaacccccagaatgtgcccttcagccagaggtctgagatgatgaagaagcccagccaggcccccaagtacagaacagatcctgacagcttccgggtggtgaagctgaagaggatccagaggaagagcaggatgcctgaggcccgggagcccccagagaagaccaacctgaaggatgtgatcaagaccctgaagcctgtgcccaggaaccggcccccacccctggtggagatcaccccccgggaccagctgctgaatgacatccgccacagctctgtggcctacctgaagcctgtgcagctgcccaaggagctggcctag

SEQ ID NO: 20949 - DNA, 51 bp, Artificial Sequence; identical to SEQ ID NO: 20857
  Description of Artificial Sequence: Synthetic coding sequence

SEQ ID NO: 20950 - DNA, 513 bp, Artificial Sequence
  Description of Artificial Sequence: Synthetic coding sequence
atgcccatcctgctcttcctgattgacaccagcgcctccatgaaccagaggagccacctgggcaccacctacctggacacagccaagggagctgtggagaccttcatgaagctgcgggcccgggaccctgccagcagaggagaccgctacatgctggtgacctttgaggagcccccctatgccatcaaggccggctggaaggagaaccacgccaccttcatgaatgagctgaagaacctgcaggccgagggcctgaccaccctgggccagagcctgaggacagcctttgacctgctgaacctgaaccggctggtgacaggcatcgacaactacggccagggcaggaaccccttcttcctggagcccgccatcatcatcaccatcacagatggcagcaagctgaccaccaccagcggcgtgcaggatgaggccgtgcacatcctgtgtgtgctgcaggagtgcctgatctctgtgtggagcccctggtgcaggaagtacaaggtgggctggtag

SEQ ID NO: 20951 - DNA, 204 bp, Artificial Sequence
  Description of Artificial Sequence: Synthetic coding sequence
atgagcagaagaagatttgactgccgcagcatcagcggcctgctgaccaccaccccccagatccccatcaagatggagaacttcaacaacttctacatcctgaccagcaaggagctgggccggggcaagtttgctgtggtgcggcagtgcatcagcaagagcacaggccaggagtatgctgccaagttcctgaagaagaggtag

SEQ ID NO: 20952 - DNA, 1107 bp, Artificial Sequence
  Description of Artificial Sequence: Synthetic coding sequence
atgctgagcaagaggggctgccacgcccgcatctatgctgacttccccatccggcggctcatcagccagaggagcagcctggagaccctggaggacattgaagaaaatgcccccctgcggcgctgcaggaccctgagcggcagcccccggcccaagaacttcaagaagatccacttcatcaagaacatgaggcagcacgacaccagaaatggaagaattgtgctgatctctggaagaagaagcttctgcagcatcttctctgtgctgccctacagagacagcacccaggtgggggacctgaagctggatggcggccggcagagcactggagctgtgtccctgaaggagatcatcggcctggagggcgtggagctgggcgcagatggcaagacagtgtcctacacccagttcctgctgcccaccaatgccttcggggcccggaggaacaccatcgacagcaccagcagcttcagccagttcaggaacctgagccacaggagcctgagcatcggccgggccagcggcacccagggcagcctggacaccggcagtgacctgggggacttcatggactatgaccccaacctgctggatgacccccagtggccctgtgggaagcacaagagggtgctgatcttccccagctacatgaccaccgtgattgattatgtgaagcccagcgacctgaagaaggacatgaatgagaccttcaaggagaagttcccccacatcaagctgaccctgagcaagatccgcagcctgaagcgggagatgaggaagctggcccaggaggactgtggcctggaggagcccaccgtggccatggcctttgtgtactttgagaagctggccctgaagggcaagctgaacaagcagaacaggaagctgtgtgccggggcctgtgtgctgctggccgccaagattggaagtgacctgaagaagcatgaggtgaagcacctgattgacaagctggaggagaagttccggctgaacagaagagagctgattgcctttgagttccctgtgctggtggccctggagtttgccctgcacctgcctgagcacgaggtgatgccccactaccgccgcctggtgcagagcagctag

SEQ ID NO: 20953 - DNA, 795 bp, Artificial Sequence
  Description of Artificial Sequence: Synthetic coding sequence
atgacagatgtgcctgccaccttcacccaggccgagtgcaatggagacaagcccccagaaaatggccagcagaccatcaccaagatcagcgaggagctgacagatgtggacagccccctgccccactacagagtggagcccagcctggagggcgccctgaccaagggcagccaggaggagaggaggaagctgcagggcaacatgctgctgaacagctccatggaggacaagatgctgaaggagaccagcgcagatgagatgaccttccgggagggccaccagtgggagaagatccccctgagcggcagcaaccaggagatccggcggcagaaggagcgcatcacagagcagcccctgaaggaggaggaggatgaggacaggaagaacaagggccaccaggccgctgagattgagtggctgggcttcaggaagcccagccaggccgacatgctgcacagcaagcatgatgaggagcagaaggtgtgggatgaggagattgatgatgatgatgatgacaactgcaacaatgatgaagatgaggtgcgggtcatcgagttcaagaagaagcatgaggaggtgtcccagttcaaggaggagggagatgccagcgaggacagccccctgagcagcgccagcagccaggccgtgaccccagatgagcagcccaccctgggcaagaagagtgacatcagcagaaatgcctacagccgctacaacaccatctcctacaggaagatcaggaagggcaacaccaagcagagaattgatgaatttgagagcatgatgcacctgtag

SEQ ID NO: 20954 - DNA, 4302 bp, Artificial Sequence; identical to SEQ ID NO: 18796
  Description of Artificial Sequence: Synthetic coding sequence

SEQ ID NO: 20955 - DNA, 810 bp, Artificial Sequence
  Description of Artificial Sequence: Synthetic coding sequence
atgtttcctgccctggagacccacctgaagcagaccatcccagacccctatgaggacttcatgtaccgccacctgcagtactacggctacttcaaggcccagaggggcagcctgcccaacagcgccacccaccagcacgtgaggaagaacaacccccagtgcctgctgaatggcagcctgggggagaaggatgacctgatcccagacaccctgcagaaggagaagctgctgtacagccacatgctgagcctgccccacctgcggagccggcagctgctgtatgatgagctggatgaggtgaacccccggctgcgggagccccaggagctgttcagcatcctgagcaccaagaggcccctgcaggccccccgctggcccattgaatgtgaggtgatcaaggagaacatccaccacatcgagtgggccccaccccagcctgagtacttctaccagcccaagggaaatgagaaggtgcctgagatcgtgggggagaagaagggcaccgtggtgtaccagctggacagcgtgcccatcgagggcagctacttcaccagcagccgggtgggcggcaagaggggcatcgtgaaggagctggccgtgaccctgcagggccctgaggacaacaccctgctgtttgagagcagatttgagagcggcaacctgcagaaggctgtgcgggtggaccccatgtccatgaacagcccctgtgagctgaccagcaccctgaccaacaccctgagcggcttcatctttgtgttccgcaccccagagaagatgctgcccatcgccagccccctgagcacctgctag

SEQ ID NO: 20956 - DNA, 975 bp, Artificial Sequence
  Description of Artificial Sequence: Synthetic coding sequence
atgcccctgcaggtgtctgactacagctggcagcagaccaagacagctgtgttcctgagcctgcccctgaagggcgtgtgtgtgcgggacacagatgtgttctgcacagagaactacctgaaggtgaacttcccccccttcctgtttgaggccttcctgtatgcccccattgatgatgagagcagcaaggccaagattggaaatgacaccatcgtgttcaccctgtacaagaaggaggccgccatgtgggagaccctgtctgtgactggagtggacaaggagatgatgcagaggatccgggagaagagcatcctgcaggcccaggagcgggccaaggaggccacagaggccaaggccgccgccaagcgggaggaccagaagtatgccctgtctgtgatgatgaagattgaggaggaggagaggaagaagattgaggacatgaaggaaaatgaaagaatcaaggccaccaaggccctggaggcctggaaggagtaccagaggaaggccgaggagcagaagaagatccagcgggaggagaagctgtgccagaaggagaagcagatcaaggaggagaggaagaagatcaagtacaagagcctgaccaggaacctggccagcaggaacctggcccccaagggcaggaacagcgagaacatcttcacagagaagctgaaggaggacagcatcccagcccccaggtctgtgggcagcatcaagatcaacttcacccccagggtcttccccacagccctgcgggagagccaggtggccgaggaggaggagtggctgcacaagcaggccgaggcccggcgggccatgaacacagacattgctgagctgtgtgacctgaaggaggaggagaagaaccctgagtggctgaaggacaagggcaagccagagcgctgcctgaagatccctgtgaccgtcatccacctggtggtgggcctgagctctgtgatgaggggccagatctag

SEQ ID NO: 20957 - DNA, 162 bp, Artificial Sequence
  Description of Artificial Sequence: Synthetic coding sequence
atgcagaccagcagcagccgctctgtgcacctgtctgagtggcagaagaactactttgccatcaccagcggcatctgcaccggccccaaggcagatgcctaccgggcccagatcctgcgcatccagtatgcctgggccaacagcgagatcagccaggtgtag

SEQ ID NO: 20958 - DNA, 2079 bp, Artificial Sequence
  Description of Artificial Sequence: Synthetic coding sequence
atggtgaccaccctgggccccaagatggctgctgagtggggcggcggcgtgggctacagcggcagcggccctggccgcagccgctggcgctggagcggctctgtgtgggtgcgctctgtgctgctgctgctgggcggcctgcgggccagcgccaccagcacccctgtgtccctgggcagcagccccccctgccgccaccacgtgcccagcgacacagaggtgatcaacaaggtgcacctgaaggccaaccacgtggtgaagagagatgtggatgagcacctgcgcatcaagacagtgtatgacaagtctgtggaggagctgctgcctgagaagaagaacctggtgaagaacaagctgttcccccaggccatctcctacctggagaagaccttccaggtgcggcggcctgctggcaccatcctgctgagccggcagtgtgccaccaaccagtacctgaggaaagaaaatgacccccaccgctactgcacaggagaatgtgccgcccacaccaagtgtggccctgtgattgtgcctgaggagcacctgcagcagtgccgggtgtaccggggcggcaagtggccccatggagctgtgggcgtgcctgaccaggagggcatcagtgatgctgactttgtgctgtatgtgggcgccctggccacagagcgctgcagccatgagaacatcatctcctatgctgcctactgccagcaggaggccaacatggaccggcccatcgccggctacgccaacctgtgccccaacatgatcagcacccagccccaggagtttgtgggcatgctgagcacagtgaagcatgaggtgatccacgccctgggcttctctgctggcctgtttgccttctaccatgacaaggatggcaaccccctgaccagcagatttgctgatggcctgccccccttcaactacagcctgggcctgtaccagtggagcgacaaggtggtgaggaaggtggagcggctgtgggatgtgcgggacaacaagatcgtgcgccacacagtgtacctgctggtgaccccccgggtggtggaggaggccaggaagcactttgactgccctgtgctggagggcatggagctggagaaccagggcggcgtgggcacagagctgaaccactgggagaagaggctgctggagaatgaggccatgacaggcagccacacccagaacagagtgctgagccgcatcaccctggccctgatggaggacaccggctggtacaaggccaactacagcatggccgagaagctggactggggccggggcatgggctgtgactttgtgaggaagagctgcaagttctggattgaccagcagaggcagaagaggcagatgctgagcccctactgtgacaccctgcggagcaaccccctgcagctgacctgccggcaggaccagagagctgtggccgtgtgcaacctgcagaagttccccaagcccctgccccaggagtaccagtactttgatgagctgagcggcatcccagctgaggacctgccctactacggcggctctgtggagattgctgactactgccccttcagccaggagttctcctggcacctgtctggagagtaccagaggagcagtgactgccgcatcctggagaaccagcctgagatcttcaagaactatggagctgagaagtatggcccccacagcgtgtgcctgatccagaagagcgcctttgtgatggagaagtgtgagaggaagctgagctacccagactggggcagcggctgctaccaggtgtcctgcagcccccagggcctgaaggtgtgggtgcaggacaccagctacctgtgcagcagagctggccaggtgctgcctgtgtccatccagatgaatggctggattcatgatggcaacctgctgtgccccagctgctgggacttctgtgagctgtgccccccagagacagaccccccagccaccaacctgacccgggccctgcccctggacctgtgcagctgcagcagcagcctggtggtgaccctgtggctgctgctgggcaacctcttccccctgctggccggcttcctgctgtgcatctggcactag

SEQ ID NO: 20959 - DNA, 3021 bp, Artificial Sequence
  Description of Artificial Sequence: Synthetic coding sequence
atggacagcagccagcagaagaccttccggggccatgatgcccctgtgctgagcctgagctttgaccccaaggacatcttcctggccagcgccagctgtgatggctctgtgcgggtgtggcagatcagtgaccagacctgtgccatctcctggcccctgctgcagaagtgcaatgatgtgatcaatgccaagagcatctgccgcctggcctggcagcccaagagcggcaagctgctggccatccctgtggagaagtctgtgaagctgtacagaagagagagctggagccaccagtttgacctgagtgacaacttcatcagccagaccctgaacatcgtgacctggagcccctgtggccagtacctggccgccggcagcatcaatggcctcatcatcgtgtggaatgtggagaccaaggactgcatggagcgggtgaagcatgagaagggctacgccatctgtggcctggcctggcaccccacctgtggccgcatctcctacacagatgctgagggcaacctgggcctgctggagaatgtgtgtgaccccagcggcaagaccagcagcagcaaggtgagcagccgggtggagaaggactacaatgacctgtttgatggagatgacatgagcaatgctggggacttcctgaatgacaatgctgtggagatccccagcttcagcaagggcatcatcaatgatgatgaagatgatgaggacctgatgatggccagcggccggccccggcagaggagccacatcctggaggatgatgagaacagcgtggacatctccatgctgaagacaggcagcagcctgctgaaggaggaggaggaggatggccaggagggcagcatccacaacctgcccctggtgaccagccagaggcccttctatgatggccccatgcccaccccccggcagaagcccttccagagcggcagcacccccctgcacctgacccaccgcttcatggtgtggaacagcatcggcatcatccgctgctacaatgatgagcaggacaatgccattgatgtggagttccatgacaccagcatccaccacgccacccacctgagcaacaccctgaactacaccatcgctgacctgagccatgaggccatcctgctggcctgtgagagcacagatgagctggccagcaagctgcactgcctgcacttcagctcctgggacagcagcaaggagtggatcatcgacctgccccagaatgaagacatcgaggccatctgcctgggccagggctgggccgccgccgccaccagcgccctgctgctgcggctcttcaccatcggcggcgtgcagaaggaggtgttcagcctggccggccctgtggtgtccatggccggccacggggagcagctgttcatcgtgtaccaccggggcaccggctttgatggagaccagtgcctgggcgtgcagctgctggagctgggcaagaagaagaagcagatcctgcacggggaccccctgcccctgaccaggaagagctacctggcctggattggcttctctgctgagggcaccccctgctacgtggacagcgagggcatcgtgaggatgctgaacagaggcctgggcaacacctggacccccatctgcaacacccgggagcactgcaagggcaagagtgaccactactgggtggtgggcatccacgagaacccccagcagctgcgctgcatcccctgcaagggcagccgcttcccccccaccctgcccaggcctgctgtggccatcctgtccttcaagctgccctactgccagatcgccacagagaagggccagatggaggagcagttctggaggagcgtcatcttccacaaccacctggactacctggccaagaatggctatgaatatgaggagagcaccaagaaccaggccaccaaggagcagcaggagctgctgatgaagatgctggccctgagctgcaagctggagcgggagttccgctgtgtggagctggccgacctgatgacccagaatgctgtgaacctggccatcaagtatgccagccgcagcaggaagctgatcctggcccagaagctgtctgagctggccgtggagaaggctgctgagctgacagccacccaggtggaggaggaggaggaggaggaggacttcaggaagaagctgaatgccggctacagcaacacagccacagagtggagccagccccgcttcaggaaccaggtggaggaggatgctgaagattctggagaggctgatgatgaggagaagccagagatccacaagccaggccagaacagcttcagcaagagcaccaacagcagtgatgtgtctgccaagtctggagctgtgaccttcagcagccagggccgggtgaaccccttcaaggtgtctgccagcagcaaggagcccgccatgtccatgaacagcgcccggagcaccaacatcctggacaacatgggcaagagcagcaagaagagcacagccctgagcaggaccaccaacaatgagaagagccccatcatcaagcccctcatccccaagcccaagcccaagcaggccagcgctgccagctacttccagaagaggaacagccagaccaacaagacagaggaggtgaaggaggagaacctgaagaatgtgctgtctgagaccccagccatctgccccccccagaacacagagaaccagaggcccaagacaggcttccagatgtggctggaggagaacagaagcaacatcctgagtgacaacccagacttcagtgatgaagctgacatcatcaaggagggcatgatccgcttccgggtgctgagcacagaggagaggaaggtgtgggccaacaaggccaagggggagacagccagcgagggcacagaggccaagaagaggaagagggtggtggatgaaagtgatgaaacagagaaccaggaggagaaggccaaggagaacctgaacctgagcaagaagcagaagcccctggacttcagcaccaaccagaagctgagcgcctttgccttcaagcaggagtag

SEQ ID NO: 20960 - DNA, 540 bp, Artificial Sequence
  Description of Artificial Sequence: Synthetic coding sequence
atgacagaggacagccagaggaacttccgctctgtgtactatgagaaggtgggcttccggggcgtggaggagaagaagagcctggagatcctgctgaaggatgaccggctggacacagagaagctgtgcaccttcagccagcgcttccccctgcccagcatgtaccgggccctggtgtggaaggtgctgctgggcatcctgcccccccaccacgagagccacgccaaggtgatgatgtacaggaaggagcagtacctggatgtgctgcacgccctgaaggtggtgcgctttgtgtctgatgccaccccccaggccgaggtgtacctgaggatgtaccagctggagagcggcaagctgcccaggagccccagcttccccctggagccagatgatgaggtgttcctggccatcgccaaggccatggaggagatggtggaggacagcgtggactgctactggatcaccaggagatttgtgaaccagctgaacaccaagtacagagacagcctgccccagctggagggcatcaacgtgggctag

SEQ ID NO: 20961 - DNA, 3189 bp, Artificial Sequence
  Description of Artificial Sequence: Synthetic coding sequence
atgatcagcaagggcggcagcgaggccctgctgcagaccctggtggacacagccaggacagcccccccagactatgacatcctgctgcccctcttccggctgctggccaaggtgggcctgcgggacaagaagattggaaggaaggccctggagctggaggccctggatgtgaccctcatcctggccaggaagaacctgagccacggccagaacctgctgcactgcctgtgggccctgcgggtgtttgccagctctgtgtccatgggcgccatgctgggcatcaatggagccatggagctgctcttcaaggtgatcaccccctacaccaggaagaggacccaggccatccgggccgccacagaggtgctggccgccctgctgaagagcaagagcaatggccggcgggctgtgaacagaggctacgtgaccagcctgctgggcctgcaccaggactggcacagccatgacacagccaatgcctacgtgcagatcagaagaggcctgctgctgtgcctgcggcacatcgccgccctgcggagcggccgggaggccttcctggccgcccagggcatggagatcctcttcagcaccacccagaactgcctggatgacaagtccatggagcctgtgatctctgtggtgctgcagatcctgcggcagtgctaccccaccagccccctgcccctggtgacagccagcagcgcctatgccttccctgtgcccggctgcatcaccacagagccccctcatgacctgcctgaagaagattttgaagatgatggagatgatgaggtggacaaggacagcgacacagaagatggcaaggtggaggatgatgacctggagacagatgtgaacaagctgagcagcaagccaggcctggacaggcctgaggaggagctgatgcagtatgaggtgatgtgcctggagctgagctacagctttgaggagctgcagagcaagctgggagatgacctgaacagcgagaagacccagtatgccaaccaccaccacatcccagctgctgccagcagcaagcagcactgctacagcaaggaccagagcagctgtggccaggagcgggagtatgctgtgcagaccagcctgctgtgccgggtgaagacaggccgcagcacagtgcacctgggcagcaagaagaaccctggggtgaacctgtaccagaatgtgcagagcaacagcctgcggcgggacagcagcgagagcgagatcccagacatccaggccagccccaaggcagatgcctgggatgtggatgccatcttctgccccaggatgtctgccagcttcagcaacagcaccaggacccgggaggtggtgaaggtgattgacaagctgctgcagacccacctgaagagggtgcccttccatgacccctacctgtacatggccaaggcccggaggaccagctctgtggtggacttcaagatgatggccttcccagatgtgtggggccactgccccccacccaccacccagcccatgctggagaggaaatgtggggtgcagaggatccgcatctttgaggacatccggcggctcatccagcccagtgatgtgatcaacaaggtggtgttcagcctggatgagccctggcccctgcaggacaatgccagcaactgcctgcgcttcttcagcaagtttgagagcggcaacctgaggaaggccatccaggtgcgggagtttgaatatgacctgctggtgaatgctgatgtgaacagcacccagcaccagcagtggttctacttcaaggtgtctggcatgcaggccgccatcccctaccacttcaacatcatcaactgtgagaagcccaacagccagttcaactacggcatgcagcccaccctgtacagcgtgaaggaggccctgctgggcaagcccacctggatcagaacaggccacgagatctgctactacaagaaccactaccggcagagcacagctgtggccggcggggccagcggcaagtgctactacaccctgacctttgctgtgaccttcccccacagtgaagatgtgtgctacctggcctaccactacccctacacctacacagccctgatgacccacctggacatcctggagaagtctgtgaacctgaaggaggtgtacttccggcaggatgtgctgtgccagaccctgggcggcaacccctgccccctggtgaccatcacagccatgcctgagagcaacagtgatgagcacctggagcagttccgccaccggccctaccaggtgatcacagcccgggtgcaccctggagagagcaatgcctcctgggtgatgaagggcaccctggagttcctggtgtccagtgaccctgtggcccggctgctgcgggagaacttcatcttcaagatcatccccatgctgaacccagatggagtcatcaatggaaaccaccgctgcagcctgagcggggaggacctgaaccggcagtggctgagccccagcgcccacctgcagcccaccatctaccacgccaagggcctgctgtaccacctgagcagcatcggccgcagccctgtggtgttctgtgacttccacggccacagccagaagaagaatgtgttcctgtatggctgcagcatcaaggagaccctgtggcaggccgcctgcaccgtgggcaccagcaccatcctggaggaggtgaactaccgcaccctgcccaagatcctggacaagctggccccagccttcaccatgagcagctgcagcttcctggtggagaagagccgggccagcacagcccgggtggtggtgtggagggagatgggcgtgagccgcagctacaccatggagagcagctactgcggctgcaaccagggcccctaccagtgcacccagaggctgctggagaggaccaagaatgaaagagcccaccctgtggatggcctgcagggcctgcagtttggcacccgggagctggaggagatgggcgccatgttctgcctgggcctgctgatcctggagctgaagagcgccagctgcagccaccagctgctggcccaggccgccaccctgctgtctgcagaagaagatgccctggaccagcacctgcagaggctgaagagcagcaacttcctgcccaagcacatctggtttgcctaccacttctttgccatcaccaacttcttcaagatgaacctgctgctgcacgtgagcccctag

SEQ ID NO: 20962 - DNA, 738 bp, Artificial Sequence
  Description of Artificial Sequence: Synthetic coding sequence
atggctgctgcccctccttcctactgctttgtggccttccccccccgggccaaggatggcctggtggtgtttgggaagaacagcgcccggcccagagatgaggtgcaggaggtggtgtacttctctgctgctgaccacgagcctgagagcaaggtggagtgcacctacatcagcattgaccaggtgcccaggacctacgccatcatgatcagcaggcctgcctggctgtggggcgctgagatgggcgccaatgagcacggcgtgtgcatcgccaatgaggccatcaacacccgggagcctgctgctgagattgaggccctgctgggcatggacctggtgcggctgggcctggagcggggggagacagccaaggaggccctggatgtgattgtgtccctgctggaggagcacggccagggcggcaactactttgaagatgccaacagctgccacagcttccagagcgcctacctgattgtggacagagatgaggcctgggtgctggagaccatcggcaagtactgggccgctgagaaggtgacagaaggagtgcgctgcatctgcagccagctgagcctgaccaccaagatggatgctgagcaccctgagctgcggagctatgcccagagccagggctggtggacaggagagggggagttcaacttcagcgaggtgttcagccctgtggaggaccacctggactgtggggccggcaaggacagcctggagaagcagtag

SEQ ID NO: 20963 - DNA, 99 bp, Artificial Sequence
  Description of Artificial Sequence: Synthetic coding sequence
atgtctgagcagggcgacctgaaccaggccatcgccgaggagggcggcacagagcaggagacagccaccccagaaaatggcatcgtgaagtctgagtag

SEQ ID NO: 20964 - DNA, 132 bp, Artificial Sequence
  Description of Artificial Sequence: Synthetic coding sequence
tgagtgctgggcagccccaagccagaggagatccccctgacctggatccagcccggcaccaccgtgctgaactgcagccatgacttcctgtctgagagcctcatcatcatccggaggatggccatcttctag

SEQ ID NO: 20965 - DNA, 339 bp, Artificial Sequence
  Description of Artificial Sequence: Synthetic coding sequence
atgtttgccaagctgaagaagaagattgctgaggagacagctgtggcccagaggcctggaggagccacccgcatccccaggtctgtgtccaaggagagcgtggcctccatgggcgctgacagcggagatgactttgccagtgatggcagcagcagccgggaggacctgagcagccagctgctgcggagaaatgagcagatcaggaagctggaggcccggctgagtgactatgcagagcaggtgaggaacctgcagaagatcaaggagaagctggagatcgccctggagaagcaccaggacagctccatgaggaagttccaggagcagaatgagacctag

SEQ ID NO: 20966 - DNA, 579 bp, Artificial Sequence; identical to SEQ ID NO: 20257
  Description of Artificial Sequence: Synthetic coding sequence

SEQ ID NO: 20967 - DNA, 1458 bp, Artificial Sequence
  Description of Artificial Sequence: Synthetic coding sequence
atggccccccggctgcagctggagaaggccgcctggcgctgggccgagaccgtgcggcctgaggaggtgtcccaggagcacatcgagacagcctaccgcatctggctggagccctgcatccggggcgtgtgcagaagaaactgcaagggcaaccccaactgcctggtgggcatcggggagcacatctggctgggggagattgatgaaaattccttccacaacattgatgaccccaactgtgagaggaggaagaagaacagctttgtgggcctgaccaacctgggcgccacctgctacgtgaacaccttcctgcaggtgtggttcctgaacctggagctgcggcaggccctgtacctgtgccccagcacctgcagcgactacatgctgggagatggcatccaggaggagaaggactatgagccccagaccatctgtgagcacctgcagtacctgtttgccctgctgcagaacagcaacagacgctacatcgaccccagcggctttgtgaaggccctgggcctggacaccggccagcagcaggatgcccaggagttcagcaagctgttcatgagcctgctggaggacaccctgagcaagcagaagaacccagatgtgaggaacatcgtgcagcagcagttctgtggggagtatgcctacgtgacagtgtgcaaccagtgtggccgggagagcaagctgctgagcaagttctatgagctggagctgaacatccagggccacaagcagctgacagactgcatcagcgagttcctgaaggaggagaagctggagggggacaaccgctacttctgtgagaactgccagagcaagcagaatgccaccaggaagatccggctgctgagcctgccctgcaccctgaacctgcagctgatgagatttgtgtttgaccggcagacaggccacaagaagaagctgaacacctacatcggcttcagcgagatcctggacatggagccctacgtggagcacaagggcggcagctatgtgtatgagctgtctgctgtgctgatccaccggggcgtgtctgcctacagcggccactacatcgcccacgtgaaggacccccagagcggggagtggtacaagttcaatgatgaggacatcgagaagatggagggcaagaagctgcagctgggcatcgaggaggacctggccgagcccagcaagagccagaccaggaagcccaagtgtgggaagggcacccactgcagcagaaatgcctacatgctggtgtaccgcctgcagacccaggagaagcccaacaccaccgtgcaggtgcctgccttcctgcaggagctggtggaccgggacaacagcaagtttgaggagtggtgcatcgagatggccgagatgaggaagcagagcgtggacaagggcaaggccaagcatgaggaggtgaaggagctgtaccagaggctgcctgctggagctggcctgtag

SEQ ID NO: 20968 - DNA, 1119 bp, Artificial Sequence; identical to SEQ ID NO: 18969
  Description of Artificial Sequence: Synthetic coding sequence

SEQ ID NO: 20969 - DNA, 1548 bp, Artificial Sequence
  Description of Artificial Sequence: Synthetic coding sequence
atgtctgagggggagagccagacctctgtgagcccccctgtgaccagcaccaccagcgctgccagccctgaggaggaggaggagagtgaagatgaaagtgagatcctggaggagagcccctgtggccgctggcagaagagaagagaggaggtgaaccagagaaatgtgcccggcattgattctgcctacctggccatggacacagaggagggcgtggaggtggtgtggaatgaggtgcagttcagcgagaggaagaactacaagctgcaggaggagaaggtgcgggctgtgtttgacaacctgatccagctggagcacctgaacatcgtgaagttccacaagtactgggccgacatcaaggagaacaaggcccgggtcatcttcatcacagagtacatgagcagcggcagcctgaagcagttcctgaagaagaccaagaagaaccacaagaccatgaatgagaaggcctggaagcgctggtgcacccagatcctgagcgccctgagctacctgcacagctgtgacccccccatcatccacggcaacctgacctgtgacaccatcttcatccagcacaacggcctcatcaagattggctctgtggccccagacaccatcaacaaccacgtgaagacctgccgggaggagcagaagaacctgcacttctttgccccagaatatggagaggtgaccaacgtgaccacagctgtggacatctacagctttggcatgtgtgccctggagatggctgtgctggagatccagggcaatggagagagcagctatgtgccccaggaggccatcagcagcgccatccagctgctggaggaccccctgcagcgggagttcatccagaagtgcctgcagagcgagcccgcccggcggcccacagcccgggagctgctcttccacccagccctgtttgaggtgcccagcctgaagctgctggccgcccactgcatcgtgggccaccagcacatgatcccagaaaatgccctggaggagatcaccaagaacatggacaccagcgctgtgctggccgagatcccagctggccctggccgggagcctgtgcagaccctgtacagccagagccctgccctggagctggacaagttcctggaggatgtgagaaatggcatctaccccctgacagccttcggcctgccccggccccagcagccccagcaggaggaggtgaccagccctgtggtgccccccagcgtgaagacccccaccccagagcctgctgaggtggagaccaggaaggtggtgctgatgcagtgcaacattgaatctgtggaggagggcgtgaagcaccacctgaccctgctgctgaagctggaggacaagctgaacagacacctgagctgtgacctgatgcccaatgaaaacatccctgagctggccgctgagctggtgcagctgggcttcatcagcgaggccgaccagagccggctgaccagcctgctggaggagaccctgaacaagttcaactttgccaggaacagcaccctgaacagcgctgctgtgacagtgagcagctag

SEQ ID NO: 20970 - DNA, 435 bp, Artificial Sequence
  Description of Artificial Sequence: Synthetic coding sequence
atgagcagccccctggccagcctgagcaagaccaggaaggtgcccctgcccagcgagcccatgaaccctggaagaagaggcatccgcatctatggagatgaagatgaggtggacatgctgagtgatggctgcggcagcgaggagaagatctctgtgcccagctgctacggcggcattggagcccctgtgtcccggcaggtgcctgccagccatgattctgagctgatggccttcatgaccaggaagctgtgggacctggagcagcaggtgaaggcccagacagatgagatcctgagcaaggaccagaagattgctgccctggaggacctggtgcagaccctgcggccccaccctgctgaggccaccctgcagaggcaggaggagctggagaccatgtgtgtgcagctgcagaggcaggtgcgggagatggagtag

SEQ ID NO: 20971 - DNA, 1047 bp, Artificial Sequence
  Description of Artificial Sequence: Synthetic coding sequence
atgcctgccccaccctgtgccagctgccacgccgcccgggccgccctgcggcggcccctgagcggccaggccctgtgtggggcctgcttctgtgccgcctttgaggccgaggtgctgcacacagtgctggccggccgcctgctgcccccaggagctgtggtggccgtgggcgccagcggcggcaaggacagcacagtgctggcccacgtgctgcgggccctggccccccggctgggcatcagcctgcagctggtggccgtggatgagggcattggaggctacagagatgctgccctggccgctgtgcggcggcaggccgcccgctgggagctgcccctgactgtggtggcctatgaggacctgtttggaggctggaccatggatgctgtggcccggagcacagctggcagcggccgcagccgcagctgctgcaccttctgtggggtgctgcggcggcgggccctggaggagggcgcccggcgggtgggcgccacccacatcgtgacaggccacaatgctgatgacatggccgagaccgtgctgatgaacttcctgcggggagatgctggccgcctggcccggggcggcggcctgggcagccctggagagggcggggccctgccccgctgccggcccctgcagtttgccagccagaaggaggtggtgctgtatgcccacttccggcggctggactacttcagcgaggagtgtgtgtatgcccctgaggccttccggggccacgcccgggacctgctgaagaggctggaggccgcccggcccagcgctgtgctggacctggtgcacagcgctgagcggctggccctggccccagctgcccggccccccaggcctggggcctgcagccgctgtggggccctggccagccgggccctgtgccaggcctgtgccctgctggatggcctgaacagaggccggccccggctggccatcggcaaaggaagaagaggcctggatgaggaggccaccccaggcacccctggggaccctgcccggcccccagccagcaaggctgtgcccaccttctag

SEQ ID NO: 20972 - DNA, 321 bp, Artificial Sequence
  Description of Artificial Sequence: Synthetic coding sequence
atgcctgaggaccaggtgggcaagctggaggccacagagaacaccatcagcgccatggctgctgctgctgctgagcagcagcagttctacctgctgctgggcaacctgctgagcccagacaacgtggtgaggaagcaggccgaggagacctatgagaacatccctggccagagcaagatcaccttcctgctgcaggccatccggaacaccacagctgctgaggaggcccggcagatggctgctgtgctgctgcggcggctgctgagcagcgcctttgatgaggtgtacccagccctgcccagtgatgtgcagacagcctag

SEQ ID NO: 20973 - DNA, 198 bp, Artificial Sequence
  Description of Artificial Sequence: Synthetic coding sequence
atggagctgcgctgtggcggcctgctcttcagcagcagatttgacagcggcaacctggcccacgtggagaaggtggagagcctgagcagtgatggagagggcgtgggcggcggggccagcgccctgaccagcggcatcgccagcagcccagactatgagttcaacgtgtggaccaggccagactgtgccgagacctag

SEQ ID NO: 20974 - DNA, 1371 bp, Artificial Sequence; identical to SEQ ID NO: 20778
  Description of Artificial Sequence: Synthetic coding sequence

SEQ ID NO: 20975 - DNA, 1275 bp, Artificial Sequence
  Description of Artificial Sequence: Synthetic coding sequence
atggaccagcccagcggccgctccttcatgcaggtgctgtgtgagaagtacagccctgagaacttcccctacagaagaggccctggcatgggcgtgcacgtgcctgccaccccccagggcagccccatgaaggaccggctgaacctgcccagcgtgctggtgctgaacagctgtggcatcacctgtgctggagatgagaaggagattgctgccttctgtgcccacgtgtctgagctggacctgagtgacaacaagctggaggactggcatgaggtgtccaagatcgtgtccaatgtgccccagctggagttcctgaacctgagcagcaaccccctgaacctgtctgtgctggagaggacctgtgccggcagcttcagcggcgtgaggaagctggtgctgaacaacagcaaggcctcctgggagaccgtgcacatgatcctgcaggagctgcctgacctggaggagctgttcctgtgcctgaatgactatgaaacagtgtcctgccccagcatctgctgccacagcctgaagctgctgcacatcacagacaacaacctgcaggactggacagagatcaggaagctgggcgtgatgttccccagcctggacaccctggtgctggccaacaaccacctgaatgccatcgaggagccagatgacagcctggcccggctcttccccaacctgcggagcatcagcctgcacaagagcggcctgcagagctgggaggacatcgacaagctgaacagcttccccaagctggaggaggtgcggctgctgggcatccccctgctgcagccctacaccacagaggagaggaggaagctggtgattgcccggctgcccagcgtgtccaagctgaatggatctgtggtgacagatggagagcgggaggacagcgagcgcttcttcatccgctactacgtggatgtgccccaggaggaggtgcccttccgctaccacgagctgatcaccaagtatggcaagctggagcccctggccgaggtggacctgcggccccagagcagcgccaaggtggaggtgcacttcaatgaccaggtggaggagatgagcatccggctggaccagacagtggccgagctgaagaagcagctgaagaccctggtgcagctgcccaccagcaacatgctgctgtactactttgaccacgaggcccccttcggccctgaggagatgaagtacagcagccgggccctgcacagctttggcatcagagatggagacaagatctacgtggagagcaagaccaagtag

SEQ ID NO: 20976 - DNA, 264 bp, Artificial Sequence
  Description of Artificial Sequence: Synthetic coding sequence
atgagcatcagcagtgatgaggtgaacttcctggtgtaccgctacctgcaggagagcggcttcagccacagcgccttcaccttcggcatcgagagccacatcagccagagcaacatcaacggggccctggtgcccccagctgccctgatcagcatcatccagaagggcctgcagtatgtggaggccgaggtgtccatcaatgaagatggcaccctgtttgatggccggcccatcgagagcctgagcctgattgatgctgtgtag

SEQ ID NO: 20977 - DNA, 360 bp, Artificial Sequence; identical to SEQ ID NO: 19124
  Description of Artificial Sequence: Synthetic coding sequence

SEQ ID NO: 20978 - DNA, 23907 bp, Artificial Sequence
  Description of Artificial Sequence: Synthetic coding sequence
atggaccagccccagttcagcggggccccccgcttcctgacccggcccaaggcctttgtggtgtctgtgggcaaggatgccaccctgagctgccagatcgtgggcaaccccaccccccaggtgtcctgggagaaggaccagcagcctgtggccgccggggcccgcttccggctggcccaggatggagacctgtaccgcctgaccatcctggacctggccctgggggacagcggccagtatgtgtgccgggccagaaatgccatcggggaggcctttgctgctgtgggcctgcaggtggatgctgaggccgcctgtgccgagcaggccccccacttcctgctgcggcccaccagcatccgggtgcgggagggcagcgaggccaccttccgctgccgggtgggcggcagccccaggcctgctgtgtcctggagcaaggatggccggcggctgggggagccagatggcccccgggtgcgggtggaggagctgggggaggccagcgccctgcgcatccgggccgcccggcccagagatggcggcacctatgaggtgcgggcagagaaccccctgggcgccgccagcgctgctgctgccctggtggtggacagtgatgctgctgacacagccagccggcccggcaccagcacagctgccctgctggcccacctgcagaggcggcgggaggccatgagagctgagggcgccccagccagcccccccagcacaggcaccaggacctgcaccgtgacagagggcaagcacgcccggctgagctgctacgtgactggagagcccaagccagagaccgtgtggaagaaggatggccagctggtgacagagggccgccgccacgtggtgtatgaagatgcccaggagaactttgtgctgaagatcctcttctgcaagcagagcgaccggggcctgtacacctgcacagccagcaacctggtgggccagacctacagctctgtgctggtggtggtgcgggagcctgctgtgcccttcaagaagaggctgcaggacctggaggtgcgggagaaggagagcgccaccttcctgtgtgaggtgccccagcccagcacagaagctgcctggttcaaggaggagacccggctgtgggccagcgccaagtatggcatcgaggaggagggcacagaaagaaggctgactgtgagaaatgtgtctgcagatgatgatgctgtgtacatctgtgagaccccagagggcagcaggacagtggccgagctggccgtgcagggcaacctgctgaggaagctgcccaggaagacagctgtgcgggtgggggacacagccatgttctgtgtggagctggccgtgcctgtgggccctgtgcactggctgaggaaccaggaggaggtggtggccggcggccgggtggccatctctgctgagggcaccaggcacaccctgaccatcagccagtgctgcctggaggatgtgggccaggtggccttcatggccggggactgccagaccagcacccagttctgtgtgtctgcccccaggaagccacccctgcagccccctgtggaccctgtggtgaaggccaggatggagagcagcgtcatcctgtcctggagccccccaccccacggggagaggcctgtgaccattgatggctacctggtggagaagaagaagctgggcacctacacctggatccgctgccacgaggccgagtgggtggccaccccagagctgactgtggctgatgtggccgaggagggcaacttccagttccgggtgtctgccctgaacagctttggccagagcccctacctggagttccctggcaccgtgcacctggcccccaagctggccgtgaggacccccctgaaggctgtgcaggccgtggagggcggggaggtgaccttctctgtggacctgactgtggccagcgctggggagtggttcctggatggccaggccctgaaggccagctctgtgtatgagatccactgtgacaggaccaggcacaccctgaccatccgggaggtgcctgccagcctgcacggggcccagctgaagtttgtggccaatggaattgagagcagcatccgcatggaggtgcgggccgcccctggcctgacagccaacaagcccccagctgctgctgcccgggaggtgctggcccggctgcacgaggaggcccagctgctggccgagctgagtgaccaggccgctgctgtgacctggctgaaggatggccgcaccctgagccctggccccaagtatgaggtgcaggccagcgctggccggcgggtgctgctggtgagagatgtggccagagatgatgctggcctgtatgaatgtgtgtcccggggcggcagaattgcctaccagctgtctgtgcagggcctggcccgcttcctgcacaaggacatggccggcagctgtgtggatgctgtggccggcggccctgcccagtttgaatgtgagaccagcgaggcccacgtgcacgtgcactggtacaaggatggcatggagctgggccacagcggggagcgcttcctgcaggaggatgtgggcaccaggcaccggctggtggccgccaccgtgacccggcaggatgagggcacctacagctgccgggtgggggaggacagcgtggacttccggctgcgggtgtctgagcccaaggtggtgtttgccaaggagcagctggcccggaggaagctgcaggccgaggccggggccagcgccaccctgagctgtgaggtggcccaggcccagacagaggtgacctggtacaaggatggcaagaagctgagcagcagcagcaaggtgtgcatggaggccaccggctgcacccggcggctggtggtgcagcaggccggccaggctgatgctggggagtacagctgtgaggccggcggccagaggctgtccttccacctggatgtgaaggagcccaaggtggtgtttgccaaggaccaggtggcccacagcgaggtgcaggccgaggccggggccagcgccaccctgagctgtgaggtggcccaggcccagacagaggtgatgtggtacaaggatggcaagaagctgagcagcagcctgaaggtgcacgtggaggccaagggctgcagaagaaggctggtggtgcagcaggccggcaagacagatgctggggactacagctgtgaggcccggggccagagggtgtccttccggctgcacatcacagagcccaagatgatgtttgccaaggagcagagcgtgcacaatgaggtgcaggccgaggccggggccagcgccatgctgagctgtgaggtggcccaggcccagacagaggtgacctggtacaaggatggcaagaagctgagcagcagcagcaaggtgggcatggaggtgaagggctgcacccggcggctggtgctgccccaggccggcaaggcagatgctggggagtacagctgtgaggccggcggccagagggtgtccttccacctgcacatcacagagcccaagggcgtgtttgccaaggagcagagcgtgcacaatgaggtgcaggccgaggccggcaccacagccatgctgagctgtgaggtggcccagccccagacagaggtgacctggtacaaggatggcaagaagctgagcagcagcagcaaggtgaggatggaggtgaagggctgcacccggcggctggtggtgcagcaggtgggcaaggcagatgctggggagtacagctgtgaggccggcggccagagggtgtccttccagctgcacatcacagagcccaaggctgtgtttgccaaggagcagctggtgcacaatgaggtgaggacagaggccggggccagcgccaccctgagctgtgaggtggcccaggcccagacagaggtgacctggtacaaggatggcaagaagctgagcagcagcagcaaggtgcgcatcgaggccgccggctgcatgaggcagctggtggtgcagcaggccggccaggctgatgctggggagtacacctgtgaggccggcggccagaggctgtccttccacctggatgtgtctgagcccaaggctgtgtttgccaaggagcagctggcccacaggaaggtgcaggccgaggccggggccatcgccaccctgagctgtgaggtggcccaggcccagacagaggtgacctggtacaaggatggcaagaagctgagcagcagcagcaaggtgaggatggaggccgtgggctgcacccggcggctggtggtgcagcaggcctgccaggccgacacaggagagtacagctgtgaggccggcggccagaggctgtccttcagcctggatgtggccgagcccaaggtggtgtttgccaaggagcagcctgtgcaccgggaggtgcaggcccaggccggggccagcaccaccctgagctgtgaggtggcccaggcccagacagaggtgatgtggtacaaggatggcaagaagctgtccttcagcagcaaggtgaggatggaggccgtgggctgcacccggcggctggtggtgcagcaggccggccaggccgtggccggggagtacagctgtgaggccggcagccagaggctgtccttccacctgcacgtggccgagcccaaggctgtgtttgccaaggagcagcctgccagccgggaggtgcaggccgaggccggcaccagcgccaccctgagctgtgaggtggcccaggcccagacagaggtgacctggtacaaggatggcaagaagctgagcagcagcagcaaggtgaggatggaggccgtgggctgcacccggcggctggtggtgcaggaggccggccaggctgatgctggggagtacagctgcaaggccggggaccagaggctgtccttccacctgcacgtggccgagcccaaggtggtgtttgccaaggagcagcctgcccaccgggaggtgcaggccgaggccggggccagcgccaccctgagctgtgaggtggcccaggcccagacagaggtgacctggtacaaggatggcaagaagctgagcagcagcagcaaggtgcgggtggaggccgtgggctgcacccggcggctggtggtgcagcaggccggccaggccgaggccggggagtacagctgtgaggccggcggccagcagctgtccttccggctgcaggtggccgagctggagccccagatcagcgagcggccctgccggcgggagcccctggtggtgaaggagcacgaggacatcatcctgacagccaccctggccacccccagcgctgccaccgtgacctggctgaaggatggagtggagatccgccgcagcaagagacatgaaacagccagccagggcgacacccacaccctgactgtgcatggagcccaggtgctggacagcgccatctacagctgccgggtgggcgctgagggccaggacttccctgtgcaggtggaggaggtggccgccaagttctgccgcctgctggagcctgtgtgtggggagctgggcggcaccgtgaccctggcctgtgagctgagccctgcctgtgccgaggtggtgtggaggtgtggcaacacccagctgcgggtgggcaagcgcttccagatggtggccgagggccctgtgcgcagcctgactgtgctgggcctgcgggcagaagatgctggggagtatgtgtgtgagagcagagatgaccacaccagcgcccagctgactgtgtctgtgccccgggtggtgaagttcatgagcggcctgagcacagtggtggccgaggagggcggggaggccaccttccagtgtgtggtgagccccagtgatgtggccgtggtgtggttcagagatggagccctgctgcagcccagcgagaagtttgccatcagccagagcggggccagccacagcctgaccatcagtgacctggtgctggaggatgctggccagatcaccgtggaggccgagggcgccagcagcagcgctgccctgcgggtgcgggaggcccctgtgctcttcaagaagaagctggagccccagacagtggaggagaggagctctgtgaccctggaggtggagctgacccggccctggccagagctgcgctggaccagaaatgccacagccctggcccctgggaagaatgtggagatccatgctgagggcgcccggcaccggctggtgctgcacaacgtgggctttgctgaccggggcttcttcggctgtgagaccccagatgacaagacccaggccaagctgactgtggagatgaggcaggtgcggctggtgcggggcctgcaggccgtggaggcccgggagcagggcacagccaccatggaggtgcagctgagccatgctgatgtggatggctcctggaccagagatggcctgcgcttccagcagggccccacctgccacctggccgtgcggggccccatgcacaccctgaccctgagcggcctgcggccagaagattctggcctgatggtgttcaaggccgagggcgtgcacaccagcgcccggctggtggtgacagagctgcctgtgtccttcagccggcccctgcaggatgtggtgaccacagagaaggagaaggtgaccctggagtgtgagctgagccggcccaacgtggatgtgcgctggctgaaggatggagtggagctgcgggccggcaagaccatggccatcgccgcccagggcgcctgccgcagcctgaccatctaccgctgtgaatttgctgaccagggcgtgtatgtgtgtgatgcccatgatgcccagagcagcgcctctgtgaaggtgcagggccgcacctacaccctcatctaccgccgggtgctggctgaagatgctggggagatccagtttgtggctgaaaatgctgagagccgggcccagctgcgggtgaaggagctgcctgtgaccctggtgcggcccctgcgggacaagatcgccatggagaagcacagaggagtgctggagtgccaggtgtcccgggccagcgcccaggtgcgctggttcaagggcagccaggagctgcagcccggccccaagtatgagctggtgtctgatggcctgtacaggaagctgatcatcagtgatgtgcatgctgaagatgaggacacctacacctgtgatgctggagatgtgaagaccagcgcccagttctttgtggaggagcagagcatcaccatcgtgcggggcctgcaggatgtgacagtgatggagcccgccccagcctggtttgaatgtgagaccagcatccccagcgtgcggccccccaagtggctgctgggcaagacagtgctgcaggccggcggcaatgtgggcctggagcaggagggcaccgtgcaccggctgatgctgcggaggacctgcagcaccatgacaggccctgtgcacttcaccgtgggcaagagccgcagcagcgcccggctggtggtgtctgacatccctgtggtgctgacccggcccctggagcccaagacaggccgggagctgcagagcgtggtgctgagctgtgacttccggcctgcccccaaggctgtgcagtggtacaaggatgacacccccctgagccccagcgagaagttcaagatgagcctggagggccagatggccgagctgcgcatcctgcggctgatgccagcagatgctggggtgtaccgctgccaggccggcagcgcccacagcagcacagaggtgacagtggaggcccgggaggtgacagtgacaggccccctgcaggatgctgaggccacagaggagggctgggccagcttcagctgtgagctgagccatgaagatgaggaggtggagtggagcctgaatggcatgcccctgtacaatgacagcttccacgagatcagccacaagggccgccgccacaccctggtgctgaagagcatccagagagcagatgctggcatcgtgcgggccagcagcctgaaggtgtccaccagcgcccggctggaggtgcgggtgaagcctgtggtgttcctgaaggccctggatgacctgtctgctgaggagcggggcaccctggccctgcagtgtgaggtgtctgaccctgaggcccacgtggtgtggaggaaggatggagtgcagctgggccccagcgacaagtatgacttcctgcacacagctggcacccggggcctggtggtgcatgatgtgtccccagaagatgctggcctgtacacctgccacgtgggcagcgaggagacccgggcccgggtgcgggtgcatgacctgcacgtgggcatcaccaagaggctgaagaccatggaggtgctggagggggagagctgcagctttgaatgtgtgctgagccatgaaagtgccagtgaccctgccatgtggacagtgggcggcaagacagtgggcagcagcagccgcttccaggccacccggcagggcaggaagtacatcctggtggtgcgggaggccgcccccagtgatgctggggaggtggtgttttctgtgcggggcctgaccagcaaggccagcctgattgtgcgggagaggcctgctgccatcatcaagcccctggaggaccagtgggtggcccctggagaagatgtggagctgcgctgtgagctgagcagagctggcacccctgtgcactggctgaaggacaggaaggccatcaggaagagccagaagtatgatgtggtgtgtgagggcaccatggccatgctggtgatccggggggccagcctgaaggatgctggggagtacacctgtgaggtggaggccagcaagagcacagccagcctgcacgtggaggagaaggccaactgcttcacagaggagctgaccaacctgcaggtggaggagaagggcacagctgtgttcacctgcaagacagagcaccctgctgccaccgtgacctggaggaagggcctgctggagctgcgggccagcggcaagcaccagcccagccaggagggcctgaccctgcggctgaccatcagcgccctggagaaggctgacagcgacacctacacctgtgacatcggccaggcccagagccgggcccagctgctggtgcagggcagaagagtgcacatcatcgaggacctggaggatgtggatgtgcaggagggcagcagcgccaccttccgctgccgcatcagccctgccaactatgagcctgtgcactggttcctggacaagacccccctgcacgccaatgagctgaatgaaattgatgcccagcccggcggctaccacgtgctgaccctgcggcagctggccctgaaggacagcggcaccatctactttgaggccggggaccagagggccagcgctgccctgcgggtgacagagaagcccagcgtcttcagccgggagctgacagatgccaccatcacagaaggagaggacctgaccctggtgtgtgagaccagcacctgtgacatccctgtgtgctggaccaaggatggcaagaccctgcggggcagcgcccgctgccagctgagccatgagggccaccgggcccagctgctgatcactggagccaccctgcaggacagcggccgctacaagtgtgaggccggcggggcctgcagcagcagcatcgtgcgggtgcacgcccggcctgtgcgcttccaggaggccctgaaggacctggaggtgctggagggcggggccgccaccctgcgctgtgtgctgagctctgtggccgcccctgtgaagtggtgctacggcaacaacgtgctgcggcctggggacaagtacagcctgcggcaggagggcgccatgctggagctggtggtgaggaacctgcggccccaggacagcggccgctacagctgcagctttggagaccagaccaccagcgccaccctgactgtgacagccctgcctgcccagttcatcggcaagctgaggaacaaggaggccacagagggcgccacagccaccctgcgctgtgagctgagcaaggccgcccctgtggagtggaggaaaggaagtgagaccctgagagatggagaccgctactgcctgcggcaggatggagccatgtgtgagctgcagatccggggcctggccatggtggatgctgctgagtacagctgtgtgtgtggggaggagaggaccagcgccagcctgaccatccggcccatgcctgcccacttcatcggccgcctgcggcaccaggagagcattgagggcgccacagccaccctgcgctgtgagctgagcaaggccgcccctgtggagtggaggaagggccgggagagcctgagagatggagacagacacagcctgcggcaggatggagctgtgtgtgagctgcagatctgtggcctggccgtggctgatgctggggagtacagctgtgtgtgtggggaggagaggaccagcgccaccctgactgtgaaggccctgcctgccaagttcacagagggcctgagaaatgaggaggccgtggagggcgccacagccatgctgtggtgtgagctgagcaaggtggcccctgtggagtggaggaaaggacctgagaacctgagagatggagaccgctacatcctgcggcaggagggcacccgctgtgagctgcagatctgtggcctggccatggctgatgctggggagtacctgtgtgtgtgtggccaggagaggaccagcgccaccctgaccatccgggccctgcctgcccgcttcattgaagatgtgaagaaccaggaggcccgggagggcgccacagctgtgctgcagtgtgagctgaacagcgctgcccctgtggagtggaggaaaggaagtgagaccctgagagatggagaccgctacagcctgcggcaggacggcaccaagtgtgagctgcagatccggggcctggccatggctgacacaggagagtacagctgtgtgtgtggccaggagaggaccagcgccatgctgactgtgcgggccctgcccatcaagttcacagagggcctgagaaatgaggaggccacagagggcgccacagctgtgctgcgctgtgagctgagcaagatggcccctgtggagtggtggaagggccacgagaccctgagagatggagacagacacagcctgcggcaggatggagcccgctgtgagctgcagatccggggcctggtggctgaagatgctggggagtacctgtgcatgtgtgggaaggagaggaccagcgccatgctgactgtgcgggccatgcccagcaagttcatcgagggcctgagaaatgaggaggccacagaaggagacacagccaccctgtggtgtgagctgagcaaggccgcccctgtggagtggaggaaaggacatgagaccctgagagatggagacagacacagcctgcggcaggacggcagccgctgtgagctgcagatccggggcctggccgtggtggatgctggggagtacagctgtgtgtgtggccaggagaggaccagcgccaccctgactgtgcgggccctgcctgcccgcttcattgaagatgtgaagaaccaggaggcccgggagggcgccacagctgtgctgcagtgtgagctgagcaaggccgcccctgtggagtggaggaaaggaagtgagaccctgcggggcggggaccgctacagcctgcggcaggacggcacccgctgtgagctgcagatccacggcctgtctgtggccgacacaggagagtacagctgtgtgtgtggccaggagaggaccagcgccaccctgactgtgcgggccccccagcccgtcttccgggagcccctgcagagcctgcaggccgaggagggcagcacagccaccctgcagtgtgagctgtctgagcccacagccaccgtggtgtggagcaagggcggcctgcagctgcaggccaacggccggcgggagccccggctgcagggctgcacagctgagctggtgctgcaggacctgcagcgggaggacaccggggagtacacctgcacctgtggcagccaggccaccagcgccaccctgactgtgacagctgcccctgtgcgcttcctgcgggagctgcagcaccaggaggtggatgaaggaggaacagcccacctgtgctgtgagctgagcagagctggggcctctgtggagtggaggaagggcagcctgcagctgttcccctgtgccaagtaccagatggtgcaggatggagctgctgctgagctgctggtgcggggcgtggagcaggaggatgctggggactacacctgtgacaccggccacacccagagcatggccagcctgtctgtgcgggtgccccggcccaagttcaagacccggctgcagagcctggagcaggagactggagacatcgcccggctgtgctgccagctgagtgatgctgagagcggggctgtggtgcagtggctgaaggagggcgtggagctgcatgctggccccaagtatgagatgaggagccagggcgccacccgggagctgctgatccaccagctggaggccaaggacaccggggagtatgcctgtgtgactggaggccagaagacagctgccagcctgcgggtgacagagcctgaggtgaccatcgtgcggggcctggtggatgctgaggtgacagcagatgaagatgtggagttcagctgtgaggtgtccagagctggggccaccggggtgcagtggtgcctgcagggcctgcccctgcagagcaatgaggtgacagaggtggccgtgagagatggccgcatccacaccctgcggctgaagggcgtgaccccagaagatgctggcaccgtgtccttccacctgggcaaccacgccagcagcgcccagctgactgtgcgggcccctgaggtgaccatcctggagcccctgcaggatgtgcagctgtctgagggccaggatgccagcttccagtgccgcctgagccgggccagcggccaggaggcccgctgggccctgggcggcgtgcccctgcaggccaatgagatgaatgacatcaccgtggagcagggcaccctgcacctgctgaccctgcacaaggtgaccctggaggatgctggcaccgtgtccttccacgtgggcacctgcagcagcgaggcccagctgaaggtgacagccaagaacacagtggtgcggggcctggagaatgtggaggccctggagggcggggaggccctgtttgagtgccagctgagccagcctgaggtggccgcccacacctggctgctggatgatgagcctgtgcacaccagtgaaaatgctgaggtggtgttctttgaaaatggcctgcggcacctgctgctgctgaagaacctgcggccccaggacagctgccgggtgaccttcctggccggggacatggtgaccagcgccttcctgactgtgcggggctggaggctggagatcctggagcccctgaagaatgctgctgtgcgggccggggcccaggcctgcttcacctgcaccctgtctgaggccgtgcctgtgggggaggcctcctggtacatcaatggagctgctgtgcagccagatgacagcgactggacagtgacagcagatggcagccaccacgccctgctgctgcggagcgcccagccccaccacgccggggaggtgacctttgcctgcagagatgctgtggccagcgcccggctgactgtgctgggcctgcctgaccccccagaagatgctgaggtggtggcccggagcagccacacagtgaccctgtcctgggccgcccccatgtctgatggcggcggcggcctgtgtggctacagagtggaggtgaaggagggcgccaccggccagtggaggctgtgccacgagctggtgcccggcccagaatgtgtggtggatggcctggcccctggagagacctaccgcttccgggtggccgctgtgggccctgtgggcgctggggagcctgtgcacctgccccagacagtgcggctggccgagccccccaagcctgtgcccccccagcccagcgcccctgagagccggcaggtggccgctggagaagatgtgtccctggagctggaggtggtggccgaggccggggaggtgatctggcacaagggcatggagcgcatccagcccggcggccgctttgaggtggtgtcccagggccggcagcagatgctggtgatcaagggcttcaccgctgaggaccagggcgagtaccactgcggcctggcccagggcagcatctgcccagctgctgccaccttccaggtggccctgagccctgcctctgtggatgaggccccccagcccagcctgcccccagaggccgcccaggagggggacctgcacctgctgtgggaggccctggccaggaagaggaggatgagccgggagcccaccctggacagcatcagcgagctgcctgaggaggatggccgcagccagaggctgccccaggaggccgaggaggtggccccagacctgtctgagggctacagcacagcagatgagctggccaggactggagatgctgacctgagccacaccagcagtgatgatgagagcagagctggcacccccagcctggtgacctacctgaagaaggccggccggcccggcaccagccccctggccagcaaggtgggcgccccagctgcccccagcgtgaagccccagcagcagcaggagcccctggccgctgtgcggccccccctgggggacctgagcaccaaggacctgggggaccccagcatggacaaggctgctgtgaagatccaggccgccttcaagggctacaaggtgaggaaggagatgaagcagcaggagggccccatgttcagccacaccttcggggacacagaggcccaggtgggagatgccctgcggctggagtgtgtggtggccagcaaggcagatgtgcgggcccgctggctgaaggatggagtggagctgacagatggccgccaccaccacatcgaccagctgggagatggcacctgcagcctgctgatcaccggcctggacagagcagatgctggctgctacacctgccaggtgagcaacaagtttggccaggtgacccacagcgcctgtgtggtggtgtctggcagcgagagcgaggccgagagcagcagtggaggagagctggatgatgccttccggcgggccgcccggcggctgcacaggctcttccgcaccaagagccctgctgaggtgtctgatgaggagctgttcctgtctgcagatgagggccctgctgagcctgaggagcctgctgactggcagacctacagagaagatgagcacttcatctgcatccgctttgaggccctgacagaggcccggcaggccgtgacccgcttccaggagatgtttgccaccctgggcatcggcgtggagatcaagctggtggagcagggcccccggcgggtggagatgtgcatcagcaaggagaccccagcccctgtggtgcccccagagcccctgcccagcctgctgaccagtgatgctgcccctgtgttcctgacagagctgcagaaccaggaggtgcaggacggctaccctgtgtcctttgactgtgtggtgacaggccagcccatgcccagcgtgcgctggttcaaggatggcaagctgctggaggaggatgaccactacatgatcaatgaagaccagcagggcggccaccagctgatcatcacagctgtggtgcctgctgacatgggcgtgtaccgctgcctggccgagaacagcatgggcgtgagcagcaccaaggccgagctgcgggtggacctgaccagcacagattatgacacagctgctgatgccacagagagcagcagctacttcagcgcccagggctacctgagcagccgggagcaggagggcacagagagcaccacagatgagggccagctgccccaggtggtggaggagctgcgggacctgcaggtggcccctggcacccggctggccaagttccagctgaaggtgaagggctacccagccccccggctgtactggttcaaggatggccagcccctgacagccagcgcccacatccgcatgacagacaagaagatcctgcacaccctggagatcatctctgtgacccgggaggacagcggccagtatgctgcctacatcagcaatgccatgggcgccgcctacagcagcgcccggctgctggtgcggggcccagatgagcctgaggagaagccagccagtgatgtgcatgagcagctggtgccccccaggatgctggagcgcttcacccccaagaaggtgaagaagggcagcagcatcaccttctctgtgaaggtggagggccggcctgtgcccaccgtgcactggctgcgggaggaggccgagcggggcgtgctgtggattggccctgacaccccaggctacacagtggccagcagcgcccagcagcacagcctggtgctgctggatgtgggccggcagcaccagggcacctacacctgcatcgccagcaatgctgctggccaggccctgtgcagcgccagcctgcacgtgtctggcctgcccaaggtggaggagcaggagaaggtgaaggaggccctgatcagcaccttcctgcagggcaccacccaggccatcagcgcccagggcctggagacagccagctttgctgacctgggcggccagaggaaggaggagcccctggccgccaaggaggccctgggccacctgagcctggccgaggtgggcacagaggagttcctgcagaagctgaccagccagatcacagagatggtgtctgccaagatcacccaggccaagctgcaggtgcctggaggagacagtgatgaggacagcaagaccccatctgccagccccaggcatggccgcagccggcccagcagcagcatccaggagagcagcagcgagagtgaagatggagatgcccggggggagatctttgacatctacgtggtgacagctgactacctgcccctgggcgctgagcaggatgccatcaccctgcgggagggccagtatgtggaggtgctggatgctgcccaccccctgcgctggctggtgaggaccaagcccaccaagagcagccccagccggcagggctgggtgtccccagcctacctggaccggcggctgaagctgagccctgagtggggcgctgctgaggcccctgagttccctggagaggccgtgtctgaagatgagtacaaggcccggctgagcagcgtcatccaggagctgctgagcagcgagcaggcctttgtggaggagctgcagttcctgcagagccaccacctgcagcacctggagcgctgcccccacgtgcccatcgctgtggccggccagaaggccgtcatcttcagaaatgtgcgggacatcggccgcttccacagcagcttcctgcaggagctgcagcagtgtgacacagatgatgatgtggccatgtgcttcatcaagaaccaggccgcctttgagcagtacctggagttcctggtgggccgggtgcaggccgagagcgtggtggtgtccacagccatccaggagttctacaagaagtatgcagaggaggccctgctggccggggaccccagccagcccccacctccacccctgcagcactacctggagcagcctgtggagcgggtgcagcgctaccaggccctgctgaaggagctgatccggaacaaggccaggaaccggcagaactgtgccctgctggagcaggcctatgctgtggtgtctgccctgccccagagagctgagaacaagctgcacgtgtccctgatggagaactacccaggcaccctgcaggccctgggggagcccatccggcagggccacttcatcgtgtgggagggcgcccctggggccaggatgccctggaagggccacaacagacatgtgttcctgttcaggaaccacctggtgatctgcaagccccggcgggacagcaggacagacacagtgtcctatgtgttcaggaacatgatgaagctgagcagcattgacctgaatgaccaggtggagggagatgaccgggcctttgaggtgtggcaggagcgggaggacagcgtgaggaagtacctgctgcaggccaggacagccatcatcaagagctcctgggtgaaggagatctgtggcatccagcagaggctggccctgcctgtgtggaggcccccagactttgaggaggagctggccgactgcacagctgagctgggggagaccgtgaagctggcctgccgggtgacaggcacccccaagcctgtgatctcctggtacaaggatggcaaggctgtgcaggtggacccccaccacatcctgattgaggaccctgatggcagctgtgccctgatcctggacagcctgactggagtggacagcggccagtacatgtgctttgctgccagcgctgctggcaactgcagcaccctgggcaagatcctggtgcaggtgcccccaagatttgtgaacaaggtgcgggccagcccctttgtggagggagaagatgcccagttcacctgcaccattgaaggagccccctacccccagatccgctggtacaaggatggagccctgctgaccaccggcaacaagttccagaccctgtctgagcccaggagcggcctgctggtgctggtgatccgggccgccagcaaagaagacctgggcctgtatgaatgtgagctggtgaaccggctgggcagcgcccgggccagcgctgagctgcgcatccagagccccatgctgcaggcccaggagcagtgccaccgggagcagctggtggccgctgtggaggacaccaccctggagagagctgaccaggaggtgacctctgtgctgaagaggctgctgggccccaaggcccctggccccagcactggagacctgaccggccctggcccctgccccaggggggccccagccctgcaggagaccggcagccagccccctgtgacaggcaccagcgaggccccagctgtgcccccccgggtgccccagcccctgctgcacgagggccctgagcaggagcctgaggccatcgcccgggcccaggagtggacagtgcccatccgcatggagggcgccgcctggccaggggccggcaccggggagctgctgtgggatgtgcacagccacgtggtgcgggagaccacccagaggacctacacctaccaggccatcgacacccacacagcccggccccccagcatgcaggtgaccattgaagatgtgcaggcccagacaggaggaacagcccagtttgaggccatcatcgagggggacccccagcccagcgtgacctggtacaaggacagcgtgcagctggtggacagcacccggctgagccagcagcaggagggcaccacctacagcctggtgctgcggcacgtggccagcaaggatgctggggtgtacacctgcctggcccagaacacaggaggccaggtgctgtgcaaggccgagctgctggtgctgggcggggacaatgaaccagattctgagaagcagagccacaggaggaagctgcacagcttctatgaggtgaaggaggagatcggccggggcgtgtttggatttgtgaagagggtgcagcacaagggcaacaagatcctgtgtgccgccaagttcatccccctgcggagcaggacccgggcccaggcctaccgggagcgggacatcctggccgccctgagccaccccctggtgacaggcctgctggaccagtttgagaccaggaagaccctcatcctgatcctggagctgtgcagcagcgaggagctgctggaccggctgtacaggaagggcgtggtgacagaggccgaggtgaaggtgtacatccagcagctggtggagggcctgcactacctgcacagccatggagtgctgcacctggacatcaagcccagcaacatcctgatggtgcacccagcccgggaggacatcaagatctgtgactttggatttgcccagaacatcaccccagctgagctgcagttcagccagtatggcagccctgagtttgtgtccccagagatcatccagcagaaccctgtgtctgaggccagtgacatctgggccatgggcgtcatctcctacctgagcctgacctgcagcagcccctttgctggggagagtgaccgggccaccctgctgaatgtgctggagggccgggtgtcctggagcagccccatggccgcccacctgtctgaagatgccaaggacttcatcaaggccaccctgcagagggccccccaggcccggcccagcgctgcccagtgcctgagccacccctggttcctgaagtccatgcctgctgaggaggcccacttcatcaacaccaagcagctgaagttcctgctggcccggagccgctggcagaggagcctgatgagctacaagagcatcctggtgatgaggagcatccctgagctgctgcggggccccccagacagccccagcctgggcgtggcccggcacctgtgccgggacaccggcggcagcagcagcagcagcagcagcagtgacaatgagctggccccctttgcccgggccaagagcctgccccccagccctgtgacccacagccccctgctgcacccccggggcttcctgcggcccagcgccagcctgcctgaggaggccgaggccagcgagaggagcacagaggccccagcccccccagccagccctgagggcgccggccccccagctgcccagggctgtgtgcccaggcacagcgtcatccgcagcctcttctaccaccaggccggggagagccctgagcacggggccctggcccctggcagccgccgccacccagcccggcggcggcacctgctgaagggcggctacatcgccggggccctgcccggcctgcgggagcccctgatggagcaccgggtgctggaggaggaggccgcccgggaggagcaggccaccctgctggccaaggcccccagctttgaaacagccctgcggctgcctgccagcggcacccacctggcccctggccacagccacagcctggagcatgacagccccagcaccccccggcccagcagcgaggcctgtggggaggcccagaggctgcccagcgcccccagcggcggggcccccatccgggacatgggccacccccagggcagcaagcagctgcccagcactggaggccaccctggaacagcccagcctgagcggcccagcccagacagcccctggggccagcctgcccccttctgccaccccaagcagggcagcgccccccaggagggctgcagcccccaccctgctgtggccccctgccccccaggcagcttccccccaggcagctgcaaggaggcccccctggtgcccagcagccccttcctgggccagccccaggcccccccagccccagccaaggccagcccccccctggacagcaagatgggccctggggacatcagcctgcccggccggcccaagccaggcccctgcagcagccctggcagcgccagccaggccagcagcagccaggtgagcagcctgcgggtgggcagcagccaggtgggcacagagcccggccccagcctggatgctgagggctggacccaggaggccgaggacctgagtgacagcacccccaccctgcagaggccccaggagcaggccaccatgaggaagttcagcctgggcggccggggcggctacgccggcgtggccggctacggcacctttgcctttggaggagatgctgggggcatgctgggccagggccccatgtgggccagaattgcctgggccgtgtcccagagcgaggaggaggagcaggaggaggcccgggcagagagccagagcgaggagcagcaggaggcccgggcagagagccccctgccccaggtgtctgcccggcctgtgcctgaggtgggccgggcccccaccaggagcagccctgagcccaccccctgggaggacatcggccaggtgtccctggtgcagatccgggacctgtctggagatgctgaggccgctgacaccatcagcctggacatcagcgaggtggaccctgcctacctgaacctgagtgacctgtatgacatcaagtacctgccctttgagttcatgatcttcaggaaggtgcccaagagcgcccagcctgagccccccagccccatggccgaggaggagctggccgagttccctgagcccacctggccctggccaggagagctgggcccccatgctggcctggagatcacagaggagagtgaagatgtggatgccctgctggccgaggccgctgtgggcaggaagaggaagtggagcagccccagccgcagcctcttccacttccctggccgccacctgcccctggatgagcctgctgagctgggcctgcgggagcgggtgaaggcctctgtggagcacatcagccgcatcctgaagggccggcctgagggcctggagaaggagggcccccccaggaagaagccaggcctggccagcttccggctgagcggcctgaagtcctgggaccgggcccccaccttcctgcgggagctgagtgatgaaacagtggtgctgggccagagcgtgaccctggcctgccaggtgtctgcccagcctgctgcccaggccacctggagcaaggatggagcccccctggagagcagcagccgggtgctgatcagcgccaccctgaagaacttccagctgctgaccatcctggtggtggtggccgaggacctgggcgtgtacacctgcagcgtgtccaatgccctgggcaccgtgaccaccaccggggtgctgaggaaggccgagcggcccagcagcagcccctgcccagacattggagaggtgtatgcagatggagtgctgctggtgtggaagcctgtggagagctatggccctgtgacctacatcgtgcagtgcagcctggagggcggctcctggaccaccctggccagtgacatctttgactgctgctacctgaccagcaagctgagcagaggaggcacctacaccttcagaacagcctgtgtgtccaaggccggcatgggcccctacagcagccccagcgagcaggtgctgctgggcggccccagccacctggccagcgaggaggagagccagggccgcagcgcccagcccctgcccagcaccaagacctttgccttccagacccagatccagaggggccgcttctctgtggtgcggcagtgctgggagaaggccagcggccgggccctggccgccaagatcatcccctaccaccccaaggacaagacagctgtgctgcgggagtatgaggccctgaagggcctgcggcacccccacctggcccagctgcatgctgcctacctgagccccaggcacctggtgctgatcctggagctgtgcagcggccctgagctgctgccctgcctggccgagcgggccagctacagcgagagcgaggtgaaggactacctgtggcagatgctgagcgccacccagtacctgcacaaccagcacatcctgcacctggacctgcggtctgagaacatgatcatcacagagtacaacctgctgaaggtggtggacctgggcaatgcccagagcctgagccaggagaaggtgctgcccagcgacaagttcaaggactacctggagaccatggcccctgagctgctggagggccagggcgctgtgccccagacagacatctgggccatcggcgtgacagccttcatcatgctgtctgctgagtaccctgtgtcctctgagggcgcccgggacctgcagaggggcctgaggaagggcctggtgcggctgagccgctgctacgccggcctgagcggcggcgctgtggccttcctgcggagcaccctgtgtgcccagccctggggccggccctgtgccagcagctgcctgcagtgcccctggctgacagaggagggccctgcctgcagcaggcctgcccctgtgaccttccccacagcccggctgcgggtgtttgtgaggaaccgggagaagaggcgggccctgctgtacaagaggcacaacctggcccaggtgaggtag

SEQ ID NO: 20979 - DNA, 750 bp, Artificial Sequence
  Description of Artificial Sequence: Synthetic coding sequence
atgacagaggacagccagaggaacttccgctctgtgtactatgagaaggtgggcttccggggcgtggaggagaagaagagcctggagatcctgctgaaggatgaccggctggacacagagaagctgtgcaccttcagccagcgcttccccctgcccagcatgtaccgggccctggtgtggaaggtgctgctgggcatcctgcccccccaccacgagagccacgccaaggtgatgatgtacaggaaggagcagtacctggatgtgctgcacgccctgaaggtggtgcgctttgtgtctgatgccaccccccaggccgaggtgtacctgaggatgtaccagctggagagcggcaagctgcccaggagccccagcttccccctggagccagatgatgaggtgttcctggccatcgccaaggccatggaggagatggtggaggacagcgtggactgctactggatcaccaggagatttgtgaaccagctgaacaccaagtacagagacagcctgccccagctgcccaaggcctttgagcagtacctgaacctggaggatggccgcctgctgacccacctgaggatgtgcagcgctgcccccaagctgccctatgacctgtggttcaagcgctgctttgctggctgcctgcctgagagcagcctgcagagggtgtgggacaaggtggtgtctggcagctgcaagatcctggtgtttgtggccgtggagatcctgctgaccttcaagatcaagtag

SEQ ID NO: 20980 - DNA, 417 bp, Artificial Sequence
  Description of Artificial Sequence: Synthetic coding sequence
atgagcagcctgggcgccagctttgtgcagatcaagtttgatgacctgcagttctttgagaactgtggcggcggcagctttggatctgtgtaccgggccaagtggatcagccaggacaaggaggtggccgtgaagaagctgctgaagattgagaaggaggccgagatcctgtctgtgctgagccacaggaacatcatccagttctatggagtcatcctggagccccccaactacggcatcgtgacagaatatgccagcctgggcagcctgtatgactacatcaacagcaacagaagtgaggagatggacatggaccacatcatgacctgggccacagatgtggccaagggcatgcactacctgcacatggaggcccctgtgaaggtgatccaccgggacctgaagagcagaaattag

SEQ ID NO: 20981 - DNA, 1122 bp, Artificial Sequence
  Description of Artificial Sequence: Synthetic coding sequence
atggccagcagctctgtgcccccagccaccgtgtctgctgccacagctggccctggccctggcttcggctttgccagcaagaccaagaagaagcactttgtgcagcagaaggtgaaggtgttccgggctgctgaccccctggtgggcgtcttcctgtggggcgtggcccacagcatcaatgagctgagccaggtgcccccacctgtgatgctgctgcctgatgacttcaaggccagcagcaagatcaaggtgaacaaccacctgttccaccgggagaacctgcccagccacttcaagttcaaggagtactgcccccaggtgttcaggaacctgcgggacagatttggaattgatgaccaggactacctgtacatcgtgaagtgccacggcaacaccctgctgccccagttcctgggcatgtacagagtgtctgtggacaatgaagacagctacatgctggtgatgaggaacatgttcagccaccggctgcctgtgcacaggaaatatgacctgaagggcagcctggtgtcccgggaggccagtgacaaggagaaggtgaaggagctgcccaccctgaaggacatggacttcctgaacaagaaccagaaggtgtacatcggggaggaggagaagaagatcttcctggagaagctgaagagagatgtggagttcctggtgcagctgaagatcatggactacagcctgctgctgggcatccatgacatcatccggggcagcgagcctgaggaggaggcccctgtgcgggaggatgaaagtgaggtggatggagactgcagcctgaccggccccccagccctggtgggcagctatggcaccagccctgagggcatcggcggctacatccacagccaccggcccctgggccctggagaatttgagagcttcattgatgtgtatgccatccgctctgctgagggcgccccccagaaggaggtgtacttcatgggcctgattgacatcctgacccagtatgatgccaagaagaaggccgcccacgccgccaagacagtgaagcacggggccggggctgagatcagcacagtgcaccctgagcagtatgccaagcgcttcctggacttcatcaccaacatctttgcctag

SEQ ID NO: 20982 - DNA, 549 bp, Artificial Sequence
  Description of Artificial Sequence: Synthetic coding sequence
atggaggagatcccagcccaggaggccgccggcagcccccgggtgcagttccagagcctggagacccagagtgaatgtctgagccctgagccccagtttgtgcaggacacagacatggagcagggcctgaccggcggcttccccatcagcaagccagatggcatcagccagctggagcaggacctgcaggtgtttgacctggagaccaagacccgggaggtgctgagagatgactgcagtgatggagagacccgggaggagaacaagctgctgatccccaagcagaagatcagcgaggaggtgcacagctacaaggtgcgggtgggccgcctgaagcatgacatcacccaggtgcctgagacccgggaggtgtacaagtctgaggaccggctggagcggctgcaggagatcctgaggaagttcctgtacctggagcgggagttccggcagatcaccatcagcaaggagaccttcaccagcgagaagaacaatgaatgtcatgagcctgagaagagcttcagcctggacagcaccattgatgctgactag

SEQ ID NO: 20983 - DNA, 2253 bp, Artificial Sequence
  Description of Artificial Sequence: Synthetic coding sequence
atgagcctgggcaaggcctatggagtggagagccacgtgctgagccctgctgagaccaagaccctgtaccccctgatgaatgtggatgacctgtatggcaccctgtatgtgccccatgatggcaccatggaccctgctggcacctgcaccaccctggcccgggccgccagcgcccggggggcccaggtgattgagaactgccctgtgacaggcatccgggtgtggacagatgactttggagtgcggcgggtggccggcgtggagacccagcacggcagcatccagaccccctgtgtggtgaactgtgccggcgtgtgggccagcgctgtgggccgcatggccggcgtgaaggtgcccctggtggccatgcaccacgcctacgtggtgacagaaagaattgagggcatccagaacatgcccaacgtgcgggaccatgatgcctctgtgtacctgcggctgcagggagatgccctgtctgtgggcggctatgaggccaaccccatcttctgggaggaggtgtctgacaagtttgccttcggcctgtttgacctggactgggaggtgttcacccagcacattgaaggagccatcaacagagtgcctgtgctggagaagacaggcatcaagagcacagtgtgtggccctgagagcttcaccccagaccacaagcccctgatgggagaggcccctgagctgcggggcttcttcctgggctgcggcttcaacagcgctggcatgatgctgggcggcggctgcggccaggagctggcccactggatcatccacggccggcctgagaaggacatgcacggctatgacatccgccgcttccaccacagcctgacagaccacccccgctggatccgggagaggagccatgagagctatgccaagaactacagcgtggtgttcccccatgatgagcccctggccggcaggaacatgaggcgggaccccctgcacgaggagctgctgggccagggctgtgtgttccaggagagacatggctgggagcggcccggctggttccacccccggggccctgcccctgtgctggagtatgactactatggagcctacggcagccgggcccacgaggactatgcctacagaaggctgctggctgatgagtacacctttgccttccccccccaccacgacaccatcaagaaggagtgcctggcctgcagaggagctgctgctgtgtttgacatgagctactttgggaagttctacctggtgggcctggatgccaggaaggctgctgactggctgttcagcgcagatgtgtccaggcctcctggcagcacagtgtacacctgcatgctgaaccacagaggaggaacagaaagtgacctgactgtgtcccggctggcccccagccaccaggccagccccctggccccagcctttgaaggagatggctactacctggccatgggcggcgctgtggcccagcacaactggagccacatcaccaccgtgctgcaggaccagaagagccagtgccagctgattgacagcagcgaggacctgggcatgatcagcatccagggccctgccagccgggccatcctgcaggaggtgctggatgctgacctgagcaatgaggccttccccttcagcacccacaagctgctgcgggccgccggccacctggtgcgggccatgaggctgagctttgtgggggagctgggctgggagctgcacatccccaaggccagctgtgtgcctgtgtacagagctgtgatggccgccggggccaagcacggcctcatcaatgccggctaccgggccatcgacagcctgagcattgagaagggctaccgccactggcacgccgacctgcggccagatgacagccccctggaggccggcctggccttcacctgcaagctgaagagccctgtgcccttcctgggccgggaggccctggagcagcagagagctgctggcctgcggcggcggctggtgtgcttcaccatggaggacaaggtgcccatgtttggcctggaggccatctggagaaatggccaggtggtgggccacgtgagaagagctgactttggatttgccatcgacaagaccatcgcctacggctacatccatgaccccagcggcggccctgtgtccctggactttgtgaagagcggggactatgccctggagaggatgggcgtgacctatggagcccaggcccacctgaagagcccctttgaccccaacaacaagagggtgaagggcatctactag

SEQ ID NO: 20984 - DNA, 459 bp, Artificial Sequence; identical to SEQ ID NO: 20899
  Description of Artificial Sequence: Synthetic coding sequence

SEQ ID NO: 20985 - DNA, 1620 bp, Artificial Sequence; identical to SEQ ID NO: 19050
  Description of Artificial Sequence: Synthetic coding sequence

SEQ ID NO: 20986 - DNA, 1266 bp, Artificial Sequence
  Description of Artificial Sequence: Synthetic coding sequence
atgatggaggacaacaagcagctggccctgagaattgatggagctgtgcagagcgccagccaggaggtgaccaacctgcgggcagagctgacagccaccaacagaaggctggccgagctgagcggcggcggcggccctggccctggccctggagctgctgccagcgccagcgctgctggggacagcgctgccaccaacatggagaacccccagctgggcgcccaggtgctgctgcgggaggaggtgtcccggctgcaggaggaggtgcacctgctgcggcagatgaaggagatgctggccaaggacctggaggagagccagggcggcaagagcagcgaggtgctgagcgccacagagctgcgggtgcagctggcccagaaggagcaggagctggcccgggccaaggaggccctgcaggccatgaaggctgacaggaagaggctgaagggggagaagacagacctggtgtcccagatgcagcagctgtatgccaccctggagagccgggaggagcagctgcgggacttcatccggaactatgagcagcacaggaaggagagtgaagatgctgtgaaggccctggccaaggagaaggacctgctggagcgggagaagtgggagctgcggcggcaggccaaggaggccacagaccacgccacagccctgcggagccagctggacctgaaggacaacaggatgaaggagctggaggccgagctggccatggccaagcagagcctggccaccctgaccaaggatgtgcccaagaggcacagcctggccatgcctggagagaccgtgctgaatggaaaccaggagtgggtggtgcaggccgacctgcccctgacagctgccatccggcagagccagcagaccctgtaccacagccaccccccccaccctgctgaccggcaggccgtgcgggtgagcccctgccacagccggcagcccagcgtcatcagtgatgccagcgctgctgagggggacaggagcagcacccccagcgacatcaacagccccaggcacaggacccacagcctgtgcaatggagacagccctggccctgtgcagaagaacctgcacaaccccatcgtgcagagcctggaggacctggaggaccagaagaggaagaagaagaaggagaagatgggcttcggcagcatcagccgggtgtttgcccggggcaagcagaggaagagcctggaccccggcctgtttgatggaacagccccagactactacattgaagaagatgctgactggtag

SEQ ID NO: 20987 - DNA, 492 bp, Artificial Sequence
  Description of Artificial Sequence: Synthetic coding sequence
atggtgggcggcggcggcgtgggcggcggcctgctggagaatgccaaccccctcatctaccagaggtctggagagaggcctgtgacagctggggaggaggatgagcaggtgcctgacagcattgatgcccgggagatctttgacctgatccgcagcatcaatgaccctgagcaccccctgaccctggaggagctgaatgtggtggagcaggtgcgggtgcaggtgtctgaccctgagagcacagtggccgtggccttcacccccaccatcccccactgcagcatggccaccctgattggcctgagcatcaaggtgaagctgctgcggagcctgccccagcgcttcaagatggatgtgcacatcaccccaggcacccacgccagcgagcacgctgtgaacaagcagctggccgacaaggagcgggtggccgccgccctggagaacacccacctgctggaggtggtgaaccagtgcctgagcgcccggagctag

SEQ ID NO: 20988 - DNA, 207 bp, Artificial Sequence
  Description of Artificial Sequence: Synthetic coding sequence
atgagcatcagcagtgatgaggtgaacttcctggtgtaccgctacctgcaggagagcggcttcagccacagcgccttcaccttcggcatcgagagccacatcagccagagcaacatcaacggggccctggtgcccccagctgccctgatcagcatcatccagaagggcctgcagtatgtggaggccgaggtgtccatcaatgaatag

SEQ ID NO: 20989 - DNA, 534 bp, Artificial Sequence
  Description of Artificial Sequence: Synthetic coding sequence
atgagcagcaatgaatgcttcaagtgtggccgcagcggccactgggcccgggagtgccccactggaggcggccggggccggggcatgaggagccggggccggggcggcttcaccagtgaccggggcttccagtttgtgagcagcagcctgcctgacatctgctaccgctgtggggagagcggccacctggccaaggactgtgacctgcaggaggatgcctgctacaactgtggccggggcggccacatcgccaaggactgcaaggagcccaagcgggagcgggagcagtgctgctacaactgtgggaagccaggccacctggcccgggactgtgaccacgcagatgagcagaagtgctacagctgtggggagtttggccacatccagaaggactgcaccaaggtgaagtgctaccgctgtggggagactggacatgtggccatcaactgcagcaagaccagcgaggtgaactgctaccgctgtggggagagcggccacctggcccgggagtgcaccatcgaggccacagcctag

SEQ ID NO: 20990 - DNA, 429 bp, Artificial Sequence
  Description of Artificial Sequence: Synthetic coding sequence
atgacccagctgcggcaggtgctggagagccggctgcagaggcccctgcctgaggacctggcccggctgtggcctgtggtgatcctgtgccagctggccaaccagctgcggcccaggtctgtgcccttcatccacgtgcccagccctgctgtgcccaagctgagcgccctgaaggccaggaagaatgtggagagcttcctggaggcctgcaggaagatgggcgtgcctgaggccgacctgtgcagccccagcgacctgctgcagggcacagcccggggcctgaggacagccctggaggccgtgaagagggtgggcggcaaggccctgccccccctgtggccacccagcggcctgggcggctttgtggtgttctacgtggtgctgatgctgctgctgtatgtgacctacacccggctgctgggcagctag

SEQ ID NO: 20991 - DNA, 1296 bp, Artificial Sequence
  Description of Artificial Sequence: Synthetic coding sequence
atggaggacctgaagggccccaccgtgtcctccttcctgagcggcatgaagacagagctgtacccaggagtgacagccatcgacatgatgtacaaggagggcctgcacggcgtggacaatggcatcctgatctttgacaaggtgcgcatcccccgggagaacctgctggacaagtttggatctgtggccccagatggccagtaccacagccccatccggaacaagagcgcccgcttcaatgccatgctggccgccctgacccccagccggctggccgtggccttccaggccatgggcgccatgaagctgggcctgaccatcgccatccgctacagccacagccggcggcagtttggccccaagaccaaggaggaggtgaagatcatcgagcaccagacccagaccctgcggctgatgccccacctggccacagccctggccctgacctttgtgagccgctatgctggggccctgctggatgaagatgtgttccagggcaaggagctggtgaacagccgcagcctgcaggccctggtggccggcctgaaggcctacagcacctgggagaacatccgctgcctgcaggactgcagagaatgtactggaggcatggtggtgggccgggagctgctggcccagtacaccaagcagtatgaggagaagcccctgtttggcctgctgcagaactgggccgagagcgtgggggacaagctgcggaccagcttcctggccttcaacatggacacagtggatgacctggccttcctgctgaaggctgtgaagttccgggagcgggtgctgcagaggggcctggtggcccgcatctactacaaggtgaagaccaagaaggaggacttcttccacgcctggaacagctgcctgcaccacgtggccagcctgagcctggcccacacccaccgggtgaccctggagcagttcagcctggccgtgaagagctgcccagaccaggaggaccagaccctgctgatgaagttctgcctgctgtatggcaccaagctggtgttccaggagcgggcctggtacctggagcacaagtacctgacccccatggccagcacccgcatccggaaccagctgctggacctgtgtgacagcgtgaaggatgatgcccggcgggtcatcagcaccttcaacatcccccacacctacctgcacgcccccatcgccggcatcagcaaccccagggctgcctgggccttctacccagcccccctgcagccccggccccgggaggaggcccggagcagaagacccaagctgggcgccaagctgtag

SEQ ID NO: 20992 - DNA, 1443 bp, Artificial Sequence
  Description of Artificial Sequence: Synthetic coding sequence
atggccgagctgcagatgctgctggaggaggagatccctgggggccggcgggccctgtttgacagctacaccaacctggagcgggtggccgactactgtgagaacaactacatccagagcgctgacaagcagagggccctggaggagaccaaggcctacaccacccagagcctggcctctgtggcctacctgatcaacaccctggccaacaacgtgctgcagatgctggacatccaggccagccagctgcggaggatggagagcagcatcaaccacatcagccagacagtggacatccacaaggagaaggtggcccggcgggagatcggcatcctgaccaccaacaagaacaccagcaggacccacaagatcatcgccccagccaacctggagaggcctgtgcgctacatcaggaagcccatcgactacaccatcctggatgacattggacatggagtgaagtggctgctgcgcttcaaggtgtccacccagaacatgaagatgggcggcctgcccaggaccaccccacccacccagaagccacccagcccccccatgtctgggaagggcaccctgggccgccacagcccctaccgcaccctggagcctgtgcggccccctgtggtgcccaatgactatgtgcccagccccaccaggaacatggcccccagccagcagagccctgtgaggacagcctctgtgaaccagaggaacagaacctacagcagcagcggcagcagcggcggcagccaccccagcagccgcagcagcagccgggagaacagcggcagcggctctgtgggcgtgcccatcgctgtgcccacccccagcccccccagcgtcttcccagatgctgctgctggaggagcccagaccctggctgatggcttcaccagccccaccccacctgtggtgagcagcaccccacccaccggccaccctgtgcagttctacagcatgaacagacctgccagccgccacaccccacccaccatcggcggcagcctgccctacagaagacctccttccatcaccagccagaccagcctgcagaaccagatgaatggaggccccttctacagccagaaccctgtgtctgacaccccacctcctcctcctcctgtggaggagcctgtgtttgatgagagccccccacctcctcctcctccagaagattatgaggaggaggaggccgctgtggtggagtacagcgacccctatgcagaggaggaccccccctgggcccccaggagctacctggagaaggtggtggccatctatgactacaccaaggacaaggaggatgagctgtccttccaggagggcgccatcatctacgtgatcaagaagaatgatgatggctggtatgagggcgtgatgaatggagtgacaggcctcttccctggcaactacgtggagagcatcatgcactacagcgagtag

SEQ ID NO: 20993 - DNA, 3102 bp, Artificial Sequence
  Description of Artificial Sequence: Synthetic coding sequence
atggatgaggaggagaaccactacgtgtcccagctgcgggaggtgtacagcagctgtgacaccaccggcaccggcttcctggaccggcaggagctgacccagctgtgcctgaagctgcacctggagcagcagctgcctgtgctgctgcagaccctgctgggcaatgaccactttgcccgggtgaactttgaggagttcaaggagggctttgtggccgtgctgagcagcaatgctggggtgcggcccagtgatgaggacagcagcagcctggagagcgctgccagcagcgccatcccccccaagtatgtgaatggcagcaagtggtatggaagaagaagcaggcctgagctgtgtgatgctgccacagaggccaggagagtgcctgagcagcagacccaggccagcctgaagagccacctgtggaggtctgccagcctggagagcgtggagagccccaagagtgatgaggaggccgagagcaccaaggaggcccagaatgagctgtttgaggcccagggccagctgcagacctgggacagtgaagattttggcagcccccagaagagctgcagccccagctttgacaccccagagagccagatccggggcgtgtgggaggagctgggcgtgggcagcagcggccacctgtctgagcaggagctggccgtggtgtgccagagcgtgggcctgcagggcctggagaaggaggagctggaggacctcttcaacaagctggaccaggatggagatggcaaggtgtccctggaggagttccagctgggcctcttcagccatgagcccgccctgctgctggagagcagcaccagggtgaagcccagcaaggcctggagccactaccaggtgcctgaggagagcggctgccacaccaccaccaccagcagcctggtgtccctgtgcagcagcctgcggctcttcagcagcattgatgatggcagcggctttgccttcccagaccaggtgctggccatgtggacccaggagggcatccagaatggccgggagatcctgcagagcctggacttctctgtggatgagaaggtgaacctgctggagctgacctgggccctggacaatgagctgatgacagtggacagcgctgtgcagcaggccgccctggcctgctaccaccaggagctgagctaccagcagggccaggtggagcagctggcccgggagcgggacaaggcccggcaggacctggagcgggcagagaagaggaacctggagtttgtgaaggagatggatgactgccacagcaccctggagcagctgacagagaagaagatcaagcacctggagcagggctaccgggagcggctgagcctgctgcggtctgaggtggaggccgagcgggagctgttctgggagcaggcccaccggcagagagctgccctggagtgggatgtgggccgcctgcaggccgaggaggccggcctgcgggagaagctgaccctggccctgaaggagaacagccggctgcagaaggagatcgtggaggtggtggagaagctgagtgacagcgagcggctggccctgaagctgcagaaggacctggagtttgtgctgaaggacaagctggagccccagagcgctgagctgctggcccaggaggagagatttgctgctgtgctgaaggagtatgagctgaagtgccgggacctgcaggacagaaatgatgagctgcaggccgagctggagggcctgtgggcccggctgcccaagaacagacacagccccagctggagcccagatggaagaagacggcagctgcccggcctgggccctgctggcatctccttcctgggcaacagcgcccctgtgtccattgaaacagagctgatgatggagcaggtgaaggagcactaccaggacctgcggacccagctggagaccaaggtgaactactatgagcgggagattgctgccctgaagaggaactttgagaaggagaggaaggacatggagcaggcccggcggcgggaggtgtctgtgctggagggccagaaggctgacctggaggagctgcacgagaagagccaggaggtgatctggggcctgcaggagcagctgcaggacacagcccggggccctgagcctgagcagatgggcctggccccctgctgcacccaggccctgtgtggcctggccctgcggcaccacagccacctgcagcagatccggctggagttccaccggctgtctgaggagaacaccctgctgaagaatgacctgggccgggtgcggcaggagctggaggccgctgagagcacccatgatgcccagaggaaggagattgaggtgctgaagaaggacaaggagaaggcctgcagcgagatggaggtgctgaaccggcagaaccagaactacaaggaccagctgagccagctgaatgtgcgggtgctgcagctgggccaggaggccagcacccaccaggcccagaatgaggagcaccgggtgaccatccagatgctgacccagagcctggaggaggtggtgcgcagcggccagcagcagagcgaccagatccagaagctgcgggtggagctggagtgcctgaaccaggagcaccagagcctgcagctgccctggagcgagctgacccagaccctggaggagagccaggaccaggtgcagggcgcccacctgcggctgcggcaggcccaggcccagcacctgcaggaggtgcggctggtgccccaggacagagtggccgagctgcaccggctgctgagcctgcagggcgagcaggcccggcggcggctggatgcccagcgggaggagcacgagaagcagctgaaggccacagaggagcgggtggaggaggccgagatgatcctgaagaacatggagatgctgctgcaggagaaggtggacaagctgaaggagcagtttgagaagaacaccaagagtgacctgctgctgaaggagctgtatgtggagaatgcccacctggtgcgggccctgcaggccacagaggagaagcagagaggagctgagaagcagagccggctgctggaggagaaggtgcgggccctgaacaagctggtgagccgcatcgccccagctgccctgtctgtgtag

SEQ ID NO: 20994 - DNA, 627 bp, Artificial Sequence
  Description of Artificial Sequence: Synthetic coding sequence
tgctgcggctgcagcggcggctgcggcagcggctgcggcggccggggcagcggctgcggcggctgcggcagcggctgcggcggctgcggcagcggctgcggcggctgcggcagcggctgcggcggctgcggcggctgcggcagcggctgtgccggctgcggcggctgcaagggcggctgcggcagctgtggcggcagcaagaggggctgtgtgtcctgtggggtgtccaaaggagcctgtggcagctgtggcggcagcaaaggaggctgcggcagctgtggcggcagcaaaggaggctgcggcagctgtggcggcagcaaaggaggctgcggcagctgtggcggcagcaaaggaggctgcggcagctatggctgcagccagagcagctgctgcaagccctgctgctgcagcagcggctgcggcagcagctgctgccagagcagctgctgcaagccctactgctgccagagcagctgctgcaagccctactgctgccagagcagctgctgcaagccctgcagctgcttcagcggctgcggcagcagctgctgccagagcagctgctacaagccctgctgctgccagagcagctgctgcgtgcctgtgtgctgccagtgcaagatctag

SEQ ID NO: 20995 - DNA, 642 bp, Artificial Sequence
  Description of Artificial Sequence: Synthetic coding sequence
atggccggcagccctgagctggtggtgctggaccccccctgggacaaggagctggccgccggcacagagagccaggccctggtgtctgccaccccccgggaggacttccgggtgcgctgcaccagcaagagagctgtgacagagatgctgcagctgtgtggccgctttgtgcagaagctgggagatgccctgcctgaggagatccgggagcccgccctgagagatgcccagtggacctttgagagcgctgtgcaggagaacatcagcatcaatggccaggcctggcaggaggccagtgacaactgcttcatggacagcgacatcaaggtgctggaggaccagtttgatgagatcatcgtggacatcgccaccaagaggaagcagtaccccaggaagatcctggagtgtgtgatcaagaccatcaaggccaagcaggagatcctgaagcagtaccaccctgtggtgcaccccctggacctgaagtatgaccctgaccctgtgctgaatggaaatgccttcaacttcagccccttcaacatgatgctggccgtggacctgagctacatggtgttcatcaccagcagccccagctatggcaagtttgagatgcagaggggcaacagcagcaagggggaccagtag

SEQ ID NO: 20996 - DNA, 3720 bp, Artificial Sequence
  Description of Artificial Sequence: Synthetic coding sequence
atgaccatctggcagatgcagaagcaggcccagaggggcagccctgcccggacccacagcatgatgagcctgtctgtgcggccccagaggcggctgctgagcgcccgggtgaacagaagccagagctttgctggggtgctgggcagccatgagcggggccccaggagcttccctgtgttcagccccccaggcccccccaggaagcccccagccctgagccgggtgtccaggatgttttctgtggcccaccctgctgccaaggtgccccagcctgagcggctggacctggtgtacacagccctgaagaggggcctgacagcctacctggaggtgcaccagcaggagcaggagaagctgcagggccagatccgggagagcaagaggaacagccggctgggcttcctgtatgacctggacaagcaggtgaagagcattgagcgcttcctgcggcggctggagttccacgccagcaagattgatgagctgtatgaggcctactgtgtgcagaggcggctgagagatggagcctacaacatggtgcgggcctacaccaccggcagccctggcagccgggaggcccgggacagcctggccgaggccacccggggccaccgggagtacacagagagcatgtgcctgctggagagcgagctggaggcccagctgggggagttccacctgaggatgaagggcctggccggctttgcccggctgtgtgtgggggaccagtatgagatctgcatgaagtatggccggcagcgctggaagctgcggggcagaattgagggcagcggcaagcaggtgtgggacagcgaggagaccatcttcctgcccctgctgacagagttcctgagcatcaaggtgacagagctgaagggcctggccaaccacgtggtggtgggctctgtgtcctgtgagaccaaggacctgtttgctgccctgccccaggtggtggccgtggacatcaatgacctgggcaccatcaagctgagcctggaggtgacctggagcccctttgacaaggatgaccagcccagcgctgccagctctgtgaacaaggccagcacagtgaccaagcgcttcagcacctacagccagagccccccagacacccccagcctgcgggagcaggccttctacaacatgctgcggcggcaggaggagctggagaatggaacagcctggagcctgagcagcgagagcagtgatgacagcagcagcccccagctgtctggaacagcccggcacagccctgccccccggcccctggtgcagcagcctgagcccctgcccatccaggtggccttcagaagacctgagacccccagcagcggccccctggatgaggagggcgctgtggcccctgtgctggccaatggacatgccccctacagcaggaccctgagccacatcagcgaggcctctgtggatgctgccctggccgaggcctctgtggaggccgtgggccctgagagcctggcctggggccccagcccccccacccacccagcccccacccatggagagcaccccagccctgtgcccccagccctggaccccggccacagcgccaccagcagcaccctgggcaccaccggctctgtgcccaccagcacagatcctgcccccagcgcccacctggacagcgtgcacaagagcacagacagcggccccagcgagctgcccggccccacccacaccaccaccggcagcacctacagcgccatcaccaccacccacagcgcccccagccccctgacccacaccaccaccggcagcacccacaagcccatcatcagcaccctgaccaccaccggccccaccctgaacatcatcggccctgtgcagaccaccaccagccccacccacaccatgcccagccccacccacaccacagccagccccacccacaccagcaccagccccacccacacccccaccagccccacccacaagacctccatgagcccccccaccaccaccagccccacccccagcggcatgggcctggtgcagacagccaccagccccacccaccccaccaccagccccacccaccccaccaccagccccatcctgatcaacgtgagccccagcaccagcctggagctggccaccctgagcagccccagcaagcacagcgaccccaccctgcctggaacagacagcctgccctgcagcccccctgtgagcaacagctacacccaggccgaccccatggcccccaggaccccccaccccagccctgcccacagcagcaggaagcccctgaccagccctgccccagaccccagcgagagcacagtgcagagcctgagccccacccccagcccccccaccccagccccccagcacagcgacctgtgcctggccatggctgtgcagacccctgtgcccacagctgctgggggcagcggggacaggagcctggaggaggccctgggcgccctgatggccgccctggatgactaccggggccagtttcctgagctgcagggcctggagcaggaggtgacccggctggagagcctgctgatgcagaggcagggcctgaccaggagccgggccagcagcctgagcatcaccgtggagcacgccctggagagcttctccttcctgaatgaagatgaagatgaagataatgatgtgcctggggaccggccccccagcagccctgaggccggggctgaagattccattgacagccccagcgcccggcccctgagcacaggctgcccagccctggatgctgccctggtgcgccacctgtaccactgcagccggctgctgctgaagctgggcaccttcggccccctgcgctgccaggaggcctgggccctggagcggctgctgcgggaggcccgggtgctggaggccgtgtgtgagttcagccgccgctgggagatcccagccagcagcgcccaggaggtggtgcagttcagcgccagcaggcctggcttcctgaccttctgggaccagtgcacagagcggctgagctgcttcctgtgccctgtggagcgggtgctgctgaccttctgcaaccagtacggggcccggctgagcctgcggcagcccggcctggccgaggccgtgtgtgtgaagttcctggaggatgccctgggccagaagctgccccggcggccccagcccggccctggagagcagctgactgtgttccagttctggagctttgtggagaccctggacagccccaccatggaggcctacgtgacagaaacagctgaggaggtgctgctggtgaggaacctgaacagtgatgaccaggccgtggtgctgaaggccctgcggctggcccctgagggccgcctgcggagagatggcctgcgggccctgagcagcctgctggtgcacggcaacaacaaggtgatggctgctgtgtccacccagctgcggagcctgagcctgggccccaccttccgggagcgggccctgctgtgcttcctggaccagctggaggatgaagatgtgcagaccagggtggccggctgcctggccctgggctgcatcaaggcccctgagggcatcgagcccctggtgtacctgtgccagacagacacagaagctgtgcgggaggccgcccggcagagcctgcagcagtgtggggaggagggccagagcgcccaccggcggctggaggagagcctggatgccctgccccgcatctttggacctggctccatggccagcacagccttctag

SEQ ID NO: 20997 - DNA, 732 bp, Artificial Sequence
  Description of Artificial Sequence: Synthetic coding sequence
atggtgacagattatggagccttcatcaagatccctggctgcaggaagcagggcctggtgcacaggacccacatgagcagctgccgggtggacaagcccagcgagatcgtggatgtgggggacaaggtgtgggtgaagctgattggccgggagatgaagaatgaccgcatcaaggtgtccctgtccatgaaggtggtgaaccagggcaccgggaaggacctggaccccaacaacgtcatcatcgagcaggaggagaggagaagaagaagcttccaggactacacaggccagaagatcaccctggaggccgtgctgaacaccacctgcaagaagtgtggctgcaagggccgggtgaagcccctgcccttcccccgcttcagcccctgtggctggaccctcttctggaagaaggaggccgcccagtgccactttgccaaggactgcttcatgcagcccggcggcaccaagtacagcctcatcccagatgaggaggaggagaaggaggaggccaagtctgctgagtttgagaagccagaccccaccaggaaccccagcaggaagaggaagaaggagaagaagaagaagaagcaccgggacaggaagagcagtgacagcgacagcagtgacagcgagagtgacaccgggaagagggcccggcacaccagcaaggacagcaaggccgccaagaagaagaagaagaagaagaagcacaagaagaagcacaaggagtag

SEQ ID NO: 20998 - DNA, 330 bp, Artificial Sequence
  Description of Artificial Sequence: Synthetic coding sequence
atggaggagatcccagcccaggaggccgccggcagcccccgggtgcagttccagagcctggagacccagagtgaatgtctgagccctgagccccagtttgtgcaggacacagacatggagcagggcctgaccggcggcttccccatcagcaagccagatggcatcagccagctggagcaggacctgcaggtgtttgacctggagaccaagacccgggaggtgctgagagatgactgcagtgatggagagacccgggaggagaacaagctgctgatccccaagcagaagatcagcgaggaggtgcacagctacaaggtgcgggtgggctag

SEQ ID NO: 20999 - DNA, 4134 bp, Artificial Sequence
  Description of Artificial Sequence: Synthetic coding sequence
atgagcctggagcgggagctgcggcagctgagcaaggccaaggccaaggcccagagagctggccagaggcgggaggaggccgccctgtgccaccagctgggggagctgctggccggccacggccgctatgcagaggccctggagcagcactggcaggagctgcagctgcgggagcgggcagatgaccccctgggctgtgctgtggcccacaggaagattggagagcggctggccgagatggaggactacccagctgccctgcagcaccagcaccagtacctggagctggcccacagcctgaggaaccacacagagctgcagagggcctgggccaccatcggccgcacccacctggacatctatgaccactgccagagcagagatgccctgctgcaggcccaggccgcctttgagaagagcctggccatcgtggatgaggagctggagggcaccctggcccagggcgagctgaatgagatgaggacccggctgtacctgaacctgggcctgacctttgagagcctgcagcagacagccctgtgcaatgactacttcaggaagagcatcttcctggccgagcagaaccacctgtatgaagatctcttccgggcccgctacaacctgggcaccatccactggagggctggccagcacagccaggccatgcgctgcctggagggcgcccgggagtgtgcccacaccatgaggaagcgcttcatggagagcgagtgctgcgtggtgattgcccaggtgctgcaggacctgggggacttcctggccgccaagagggccctgaagaaggcctaccgcctgggcagccagaagcctgtgcagagagctgccatctgccagaacctgcagcacgtgctggccgtggtgcggctgcagcagcagctggaggaggccgagggccgggacccccagggcgccatggtgatctgtgagcagctgggggacctcttcagcaaggccggggacttccccagggctgctgaggcctaccagaagcagctgcgctttgctgagctgctggacaggcctggagctgagcgggccatcatccacgtgtccctggccaccaccctgggggacatgaaggaccaccacggggctgtgcgccactatgaggaggagctgcggctgcggtctggaaatgtgctggaggaggccaagacctggctgaacatcgccctgagccgggaggaggccggagatgcctatgagctgctggccccctgcttccagaaggccctgagctgtgcccagcaggcccagaggccccagctgcagaggcaggtgctgcagcacctgcacacagtgcagctgcggctgcagccccaggaggcccctgagacagagacccggctgcgggagctgtctgtggctgaagatgaagatgaggaggaggaggccgaggaggccgccgccacagctgagagcgaggccctggaggccggggaggtggagctgtctgagggggaggatgacacagatggcctgaccccccagctggaggaggatgaggagctgcagggccacctgggccgcaggaagggcagcaagtggaacagaagaaatgacatgggagagaccctgctgcaccgggcctgcatcgagggccagctgcggcgggtgcaggacctggtgcggcagggccaccccctgaacccccgggactactgcggctggacccccctgcacgaggcctgcaactacggccacctggagatcgtgcgcttcctgctggaccacggggctgctgtggatgatcctgggggccagggctgtgagggcatcacccccctgcatgatgccctgaactgtggccactttgaggtggccgagctgctgctggagcggggggcctctgtgaccctgcggaccaggaaggccagcgcccgctggaggcgctgcagcagcggcaagctgtacagaagagacctggacctggagacccggcagaaggcccgggccatggagatgctgctgcaggccgccgccagcggccaggacccccacagcagccaggccttccacacccccagcagcctgctgtttgatcctgagaccagcccccccctgagcccctgcccagagccccccagcaacagcacccggctgcctgaggccagccaggcccacgtgcgggtgtccccaggccaggccgccccagccatggcccggccccggcgcagccgccacggccctgccagcagcagcagcagcagcgagggggaggacagcgctggccctgcccggcccagccagaagaggccccgctgcagcgccacagcccagagggtggccgcctggaccccaggccctgccagcaaccgggaggccgccacagccagcaccagcagagctgcctaccaggccgccatccggggcgtgggcagcgcccagagccggctgggccctggccccccccggggccacagcaaggccctggccccccaggccgccctgatccctgaggaggagtgcctggccggggactggctggagctggacatgcccctgaccaggagcagaagaccccggccccggggcaccggggacaacagaagacccagcagcaccagcggcagtgacagcgaggagagccggccccgggcccgggccaagcaggtgcggctgacctgcatgcagagctgcagcgcccctgtgaatgccggccccagcagcctggccagcgagcccccaggcagccccagcaccccccgggtgtctgagcccagcggggacagcagcgctgctggccagcccctgggccctgcccctcctccacccatccgggtgcgggtgcaggtgcaggaccacctgttcctgatccctgtgccccacagcagtgacacccacagcgtggcctggctggccgagcaggccgcccagcgctactaccagacctgtggcctgctgccccggctgaccctgaggaaggagggcgccctgctggccccccaggacctgatcccagatgtgctgcagagcaatgatgaggtgctggccgaggtgacctcctgggacctgccccccctgacagaccgctacagaagagcctgccagagcctgggccagggcgagcaccagcaggtgctgcaggccgtggagctgcagggcctgggcctgtccttcagcgcctgcagcctggccctggaccaggcccagctgacccccctgctgcgggccctgaagctgcacacagccctgcgggagctgcggctggccggcaaccggctgggggacaagtgtgtggccgagctggtggccgccctgggcaccatgcccagcctggccctgctggacctgagcagcaaccacctgggccctgagggcctgcggcagctggccatgggcctgcccggccaggccaccctgcagagcctggaggagctggacctgtccatgaaccccctgggagatggctgcggccagagcctggccagcctgctgcacgcctgccccctgctgagcaccctgcggctgcaggcctgtggcttcggccccagcttcttcctgagccaccagacagccctgggcagcgccttccaggatgctgagcacctgaagaccctgagcctgagctacaatgccctgggcgccccagccctggcccggaccctgcagagcctgcctgctggcaccctgctgcacctggagctgagctctgtggccgccgggaaaggagacagcgacctgatggagcctgtgttccgctacctggccaaggagggctgtgccctggcccacctgaccctgagcgccaaccacctgggggacaaggctgtgcgggacctgtgccgctgcctgagcctgtgccccagcctcatcagcctggacctgagcgccaaccctgagatcagctgtgccagcctggaggagctgctgagcaccctgcagaagaggccccagggcctgtccttcctgggcctgagcggctgtgctgtgcagggccccctgggcctgggcctgtgggacaagattgctgcccagctgcgggagctgcagctgtgcagccggcggctgtgtgccgaggacagagatgccctgcggcagctgcagcccagcaggcctggccctggagaatgtaccctggaccacggcagcaagctgttcttccggcggctgtag

SEQ ID NO: 21000 - DNA, 675 bp, Artificial Sequence
  Description of Artificial Sequence: Synthetic coding sequence
atgcccaccctcttcaagggcgtgtggggcgtggtggagcacagccgggccctgggccgcttctgcccagcctgcctgcccagcggcccccacctgcacacccagcctgccctgggcacagctgagatgaccctgctgagcagccagagcagcagcctggtggcccccagcggctctgtgtctgcagaaaatcctgagcagaggatgctggagaagagggccaaggtgattgaggagctgctgcagacagagcgggactacatccgggacctggagatgtgcatcgagcgcatcatggtgcccatgcagcaggcccaggtgcccaacatcgactttgagggcctgtttggaaacatgcagatggtgatcaaggtgtccaagcagctgctggccgccctggagatcagtgatgctgtgggccctgtgttcctgggccacagagatgagctggagggcacctacaagatctactgccagaaccatgatgaggccatcgccctgctggagatctatgagaaggatgagaagatccagaagcacctgcaggacagcctggccgacctgaagagcctgtacaatgagtggggctgcaccaactacatcaacctgggcagcttcctgatcaagcctgtgcagagggtgatgagataccccctgctgctgatggagctgtag

SEQ ID NO: 21001 - DNA, 354 bp, Artificial Sequence
  Description of Artificial Sequence: Synthetic coding sequence
gtgtgtggggactacctgctgagcaggatggatgtgaccagctgcatctcctacagaaactttgccagctgcatgggagacagccggctgctgaacaaggtggatgcctacatccaggagcacctgctgcagatcagcgaggaggaggagttcctgaagctgccccggctgaagctggaggtgatgctggaggacaacgtgtgcctgcccagcaatggcaagctgtacaccaaggtgatcaactgggtgcagaggagcatctgggagaatggagacagcctggaggagctgatggaggaggtgtccttcaaggtgaatggcatccagcccttcctgaagatcatcctgctgtag

SEQ ID NO: 21002 - DNA, 285 bp, Artificial Sequence
  Description of Artificial Sequence: Synthetic coding sequence
atgctgtgctggggctactggagcctgggccagcccggcatcagcaccaacctgcagggcatcgtggccgagccccaggtgtgtggcttcatcagtgacagatctgtgaaggaggtggcctgtggcggcaaccacagcgtcttcctgctggaggatggagaggtgtacacctgtggcctgaacaccaagggccagctgggccacgagcgggagggcaacaagccagagcagatcggggccctggccgaccagcacatcatccacgtggcctgtggggagagctag

SEQ ID NO: 21003 - DNA, 747 bp, Artificial Sequence; identical to SEQ ID NO: 20797
  Description of Artificial Sequence: Synthetic coding sequence

SEQ ID NO: 21004 - DNA, 2814 bp, Artificial Sequence
  Description of Artificial Sequence: Synthetic coding sequence
atggagccagacatcatccgcatgtacagcagcagccccccacccctggacaacggggctgaagatgatgatgatgatgaatttggagaatttggaggcttcagcgaggtgagccccagcggcgtgggctttgtggactttgacaccccagactacacccggcccaaggaggagtttgtgcccagcaaccacttcatgcccatccacgagttctctgaaaatgtggacagcctgaccagcttcaagagcatcaagaatggaaatgacaaggacatcacagctgagctgagcgcccctgtgaagggccagagtgatgtgctgctgagcaccaccagcaaggagatcatcagcagcgagatgctggccaccagcattgatggcatggagaggcctggcaacctgaacaaggtggtggagcagaggcagaatgtgggcaccctggagagcttcagccctggggacttccgcaccaacatgaatgtggtgcaccagaacaagcagctggagagctgcaatggagagaagccaccctgcctggagatcctgaccaacggctttgctgtgctggagaccgtgaacccccagggcacagatgacctggacaacgtggccgacagcaaaggaaggaagcccctgagcacccacagcacagagtacaacctggacagcgtgcccagccctgctgaggagtttgctgactttgccaccttcagcaagaaggagcgcatccagctggaggagattgaatgtgctgtgctgaatgaccgggaggccctgaccatccgggagaacaacaagatcaacagagtgaatgagctgaacagcgtgaaggaggtggccctgggccgcagcctggacaacaagggggacacagatggagaggaccaggtgtgtgtgtctgagatcagcatcgtgaccaacagaggcttctctgtggagaagcagggcctgcccaccctgcagcaggatgagttcctgcagagcggcgtgcagagcaaggcctggagcctggtggacagcgctgacaacagcgaggccatccggcgggagcagtgcaagacagaggagaagctggacctgctgaccagcaaatgtgcccacctgtgcatggacagcgtgaagaccagtgatgatgaggtgggcagccccaaggaggagagcaggaagttcaccaacttccagagccccaacatcgaccccacagaagaaaatgacctggatgacagcctgtctgtgaagaatggagacagcagcaatgactttgtgacctgcaatgacatcaatgaagatgactttggagactttggagactttggcagcgccagcggcagcaccccaccatttgtgacaggcacccaggacagcatgtctgatgccacctttgaggagagcagcgagcacttcccccacttcagcgagcctggagatgactttggagaatttggagacatcaatgctgtgtcctgccaggaggagaccatcctgaccaagagtgacctgaagcagaccagtgacaacctgtctgaggagtgccagctggccaggaagagcagcggcaccggcacagagcctgtggccaagctgaagaatggccaggagggggagatcggccactttgattctgtgcccaacatccaggatgactgcaatggcttccaggacagtgatgactttgctgacttcagcagcgctggccccagccaggtggtggactggaatgcctttgaagatgagcagaaggacagctgctcctgggccgccttcggggaccagcaggccacagagagccaccacaggaaggaggcctggcagagccacaggacagatgagaacatcgacaccccaggcacccccaagacccacagcgtgcccagcgccaccagcaaaggagctgtggccagcggccacctgcaggagagcgccacctctgtgcagacagccctgctgaaccggctggagcgcatctttgaggcctgcttccccagcatcctggtgcctgatgctgaggaggaggtgaccagcctgaagcacctgctggagaccagcaccctgcccatcaagacccgggaggccctgcctgagagcggggagctgctggatgtgtggacagagctgcaggacatccatgatgcccacggcctgcgctaccagtggggcggcagccacagcaacaagaagctgctgagcagcctgggcatcgacaccaggaacatcctcttcaccggcaacaagaagcagcctgtgattgtgcccatgtatgctgctggcctgggcatgctggagcccaccaaggagcccctgaagcccctgtctgctgctgagaagatcgccagcatcggccagacagccaccatgagcccagacatgaacacctgcaccagtgaccagttccaggagagcctgccccctgtgcagtttgactggagcagcagcggcctgaccaaccccctggatgccagcggcggcagcaccctgctgaacctggacttctttggacctgtggatgacagcagcagcagcagcagcaccaccatccctggggtggaccctgagctgtatgagctgaccaccagcaagctggagatcagcaccagcagcctgaaggtgacagatgcctttgcccggctgatgagcacagtggagaagaccagcaccagcaccagcaggaagcccaagcgggaggagcacctgtctgaggaggccatcaaggtgattgctggcctgcctgacctgaccttcatgcacgccaaggtgctgatgtttcctgccaccctgacccccagcaccagcagccaggagaaggcagatggatag

SEQ ID NO: 21005 - DNA, 114 bp, Artificial Sequence
  Description of Artificial Sequence: Synthetic coding sequence
atggccagcgaggacatcgccaagctggccgagaccctggccaagacccaggtggccggcggccagctgtccttcaagggcaagagcctgaagctgaacacagctgaggactag

SEQ ID NO: 21006 - DNA, 309 bp, Artificial Sequence
  Description of Artificial Sequence: Synthetic coding sequence
atgcagaccagcagcagccgctctgtgcacctgtctgagtggcagaagaactactttgccatcaccagcggcatctgcaccggccccaaggcagatgcctaccgggcccagatcctgcgcatccagtatgcctgggccaacagcgagatcagccaggtgtgtgccaccaagctgttcaagaagtatgcagagaagtacagcgccatcatcgacagcgacaacgtggagagcggcctgaacaactatgcagagaacatcctgaccctggccggcagccagcagacagacagcgacaagtggcagagctag

SEQ ID NO: 21007 - DNA, 474 bp, Artificial Sequence; identical to SEQ ID NO: 20844
  Description of Artificial Sequence: Synthetic coding sequence

SEQ ID NO: 21008 - DNA, 348 bp, Artificial Sequence
  Description of Artificial Sequence: Synthetic coding sequence
atggccggggcccccaccgtgtccctgcctgagctgcggagcctgctggccagcggccgggcccggctgtttgatgtgcgcagccgggaggaggccgccgccggcaccatccctggggccctgaacatccctgtgtctgagctggagagcgccctgcagatggagcctgctgccttccaggccctgtacagcgctgagaagcccaagctggaggatgagcacctggtgttcttctgccagatgggcaagaggggcctgcaggccacccagctggcccggagcctgggctacaccggggccagaaattatgctggggcctaccgggagtggctggagaaggagagctag

SEQ ID NO: 21009 - DNA, 4767 bp, Artificial Sequence; identical to SEQ ID NO: 19038
  Description of Artificial Sequence: Synthetic coding sequence

SEQ ID NO: 21010 - DNA, 381 bp, Artificial Sequence
  Description of Artificial Sequence: Synthetic coding sequence
atggctgctgccactggagaccccggcctgagcaagctgcagtttgcccccttcagcagcgccctggatgtgggcttctggcatgagctgacccagaagaagctgaatgagtaccgcctggatgaggcccccaaggacatcaagggctactactacaatggagacagcgctggcctgcctgcccggctgaccctggagttcagcgcctttgacatgtctgcccccaccccagcccgctgctgcccagccatcggcaccctgtacaacaccaacaccctggagagcttcaagacagctgacaagaagctgctgctggagcaggccgccaatgagatctgggagagcatcaagagcggcacagccctggagaaccctgtgtag

SEQ ID NO: 21011 - DNA, 1434 bp, Artificial Sequence
  Description of Artificial Sequence: Synthetic coding sequence
atggctgatggccaggtggccgagctgctgctgcggcggctggaggccagtgatggcggcctggacagcgctgagctggccgctgagctgggcatggagcaccaggccgtggtgggcgctgtgaagagcctgcaggccctgggggaggtgattgaagctgagctgcggagcaccaagcactgggagctgacagctgagggggaggagatcgcccgggagggcagccatgaggcccgggtcttccgcagcatccccccagagggcctggcccagagcgagctgatgaggctgcccagcggcaaggtgggcttcagcaaggccatgagcaacaagtggatccgggtggacaagtctgctgctgatggccccagggtcttccgggtggtggacagcatggaggatgaggtgcagaggcggctgcagctggtgcggggcggccaggccgagaagctgggggagaaggagaggtctgagctgaggaagaggaagctgctggccgaggtgggctcctggagggaccggcccttcaagccctacaacttcctggcccacggcgtgctgcctgacagcggccacctgcaccccctgctgaaggtgcgcagccagttccggcagatcttcctggagatgggcttcacagagatgcccacagacaacttcatcgagagcagcttctggaactttgatgccctcttccagccccagcagcacccagcccgggaccagcacgacaccttcttcctgcgggaccctgctgaggccctgcagctgcccatggactatgtgcagagggtgaagaggacccacagccagggcggctacggcagccagggctacaagtacaactggaagctggatgaggccaggaagaacctgctgcggacccacaccaccagcgccagcgcccgggccctgtaccgcctggcccagaagaagcccttcacccctgtgaagtacttcagcattgacagagtcttcagaaatgagaccctggatgccacccacctggccgagttccaccagatcgagggcgtggtggccgaccacggcctgaccctgggccacctgatgggcgtgctgcgggagttcttcaccaagctgggcatcacccagctgcgcttcaagccagcctacaacccctacacagagcccagcatggaggtgttctcctaccaccagggcctgaagaagtgggtggaggtgggcaacagcggggtcttccggcctgagatgctgctgcccatgggcctgcctgaaaatgtgtctgtcatcgcctggggcctgagcctggagcggcccaccatgatcaagtatggcatcaacaacatccgggagctggtgggccacaaggtgaacctgcagatggtgtatgacagccccctgtgccgcctggatgctgagccccggcccccacccacccaggaggccgcctag

SEQ ID NO: 21012 - DNA, 3195 bp, Artificial Sequence
  Description of Artificial Sequence: Synthetic coding sequence
atgcctgtgcaggccgcccagtggacagagttcctgagctgccccatctgctacaatgaatttgatgaaaatgtgcacaagcccatcagcctgggctgcagccacacagtgtgcaagacctgcctgaacaagctgcacaggaaggcctgcccctttgaccagacagccatcaacacagacattgatgtgctgcctgtgaactttgccctgctgcagctggtgggcgcccaggtgcctgaccaccagagcatcaagctgagcaacctgggggagaacaagcactatgaggtggccaagaagtgtgtggaggacctggccctgtacctgaagcccctgagcggcggcaagggcgtggccagcctgaaccagagcgccctgagccggcccatgcagaggaagctggtgaccctggtgaactgccagctggtggaggaggagggccgggtgcgggccatgagagctgcccggagcctgggggagaggacagtgacagagctgatcctgcagcaccagaacccccagcagctgagcgccaacctgtgggccgctgtgcgggcccggggctgccagttcctgggccctgccatgcaggaggaggccctgaagctggtgctgctggccctggaggatggcagcgccctgagcaggaaggtgctggtgctgtttgtggtgcagaggctggagccccgcttcccccaggccagcaagaccagcattggacatgtggtgcagctgctgtaccgggccagctgcttcaaggtgaccaagagagatgaggacagcagcctgatgcagctgaaggaggagttccgctcctatgaggccctgcggcgggagcatgatgcccagatcgtgcacatcgccatggaggccggcctgcgcatcagccctgagcagtggagcagcctgctgtatggagacctggcccacaagagccacatgcagagcatcatcgacaagctgcagagccctgagagctttgccaagtctgtgcaggagctgaccatcgtgctgcagaggactggagaccctgccaacctgaaccggctgcggccccacctggagctgctggccaacatcgaccccaacccagatgctgtgagccccacctgggagcagctggagaatgccatggtggccgtgaagacagtggtgcacggcctggtggacttcatccagaactacagcaggaagggccacgagaccccccagccccagcccaacagcaagtacaagacctccatgtgccgggacctgcggcagcagggcggctgcccccggggcaccaactgcacctttgcccacagccaggaggagctggagaagtaccgcctgaggaacaagaagatcaatgccaccgtgaggaccttccccctgctgaacaaggtgggcgtgaacaacacagtgaccaccacagctggaaatgtcatcagcgtcatcggcagcacagagaccaccgggaagatcgtgcccagcaccaacggcatcagcaatgctgagaacagcgtgtcccagctgatcagccgcagcacagacagcaccctgcgggccctggagaccgtgaagaaggtgggcaaggtgggcgccaacggccagaatgctgctggccccagcgctgacagcgtgacagagaacaagattggcagcccccccaagacccctgtgtccaatgtggccgccaccagcgctggccccagcaatgtgggcacagagctgaacagcgtgccccagaagagcagccccttcctgaccagggtgcctgtgtacccaccccacagcgagaacatccagtacttccaggaccccaggacccagatcccctttgaggtgccccagtacccccagacaggctactacccacctccacccaccgtgcctgctggggtggccccctgtgtgcccaggtttgtgcgcagcaacaacgtgcctgagagcagcctgcccccagcctccatgccctatgctgaccactacagcaccttcagcccccgggacaggatgaacagcagcccctaccagcccccaccaccccagccctacggccctgtgccccctgtgcccagcggcatgtatgcccctgtgtatgacagccgccgcatctggaggcctcccatgtaccagagagatgacatcatccgcagcaacagcctgccccccatggatgtgatgcacagctctgtgtaccagaccagcctgcgggagcgctacaacagcctggatggctactacagcgtggcctgccagcccccatctgagcccaggaccaccgtgcccctgccccgggagccctgtggccacctgaagaccagctgtgaggagcagatccggaggaagccagaccagtgggcccagtaccacacccagaaggcccccctggtgagcagcaccctgcctgtggccacccagagccccaccccacccagccccctcttctctgtggacttccgggctgacttcagcgagagcgtgtctggcaccaagtttgaggaggaccacctgagccactacagcccctggagctgtggcaccatcggcagctgcatcaatgccattgattctgagcccaaggatgtgattgccaacagcaatgctgtgctgatggacctggacagcggagatgtgaagagaagagtgcacctgtttgagacccagaggaggaccaaggaggaggaccccatcatccccttcagtgatggccccatcatcagcaagtggggcgccatcagccgcagcagcaggacaggctaccacaccacagatcctgtgcaggccacagccagccagggcagcgccaccaagcccatctctgtgtctgactatgtgccctacgtgaatgctgtggacagccgctggagcagctatggaaatgaggccaccagcagcgcccactacgtggagcgggaccgcttcatcgtgacagacctgagcggccacaggaagcacagcagcactggagacctgctgagcctggagctgcagcaggccaagagcaacagcctgctgctgcagcgggaggccaatgccctggccatgcagcagaagtggaacagcctggatgagggccgccacctgaccctgaacctgctgagcaaggagattgagctgagaaatggagaggtgaagaagctgaacctgagcgccagctgcctgatgtacctgttctctgctgctgcctcctggctgtaccactactag

SEQ ID NO: 21013 - DNA, 1548 bp, Artificial Sequence
  Description of Artificial Sequence: Synthetic coding sequence
tgagctgggggcagccccagcgtggtggactacttccccagcgaggacttctaccgctgtggctactgcaagaatgaaagtggcagccgcagcaatggcatgtgggcccacagcatgacagtgcaggactaccaggacctgattgaccggggctggaggagaagtggcaagtatgtgtacaagcctgtgatgaaccagacctgctgcccccagtacaccatccgctgccggcccctgcagttccagcccagcaagagccacaagaaggtgctgaagaagatgctgaagttcctggccaagggggaggtgcccaagggcagctgtgaagatgagcccatggacagcaccatggatgatgctgtggccggggactttgccctgatcaacaagctggacatccagtgtgacctgaagaccctgagtgatgacatcaaggagagcctggagagcgagggcaagaacagcaagaaggaggagccccaggagctgctgcagagccaggactttgtgggggagaagctgggcagcggggagcccagccacagcgtgaaggtgcacacagtgcccaagccaggaaaaggagctgacctgagcaagccaccctgcaggaaggccaaggagatcaggaaggagaggaagaggctgaagctgatgcagcagaacccagctggggagctggagggcttccaggcccagggccacccccccagcctcttcccccccaaggccaagagcaaccagcccaagagcctggaggacctgatctttgagagcctgcctgaaaatgccagccacaagctggaggtgcgggtggtgcgcagcagcccccccagcagccagttcaaggccaccctgctggagagctaccaggtgtacaagcgctaccagatggtgatccacaagaaccccccagacacccccacagagagccagttcacccgcttcctgtgcagcagccccctggaggccgagaccccacccaacggccctgactgtggctacggcagcttccaccagcagtactggctggatggcaagatcatcgctgtgggcgtgattgacatcctgcccaactgtgtgtcctctgtgtacctgtactatgaccctgactacagcttcctgagcctgggcgtgtacagcgccctgcgggagatcgccttcacccggcagctgcacgagaagaccagccagctgagctactactacatgggcttctacatccacagctgccccaagatgaagtacaagggccagtaccggcccagcgacctgctgtgcccagagacctacgtgtgggtgcccatcgagcagtgcctgcccagcctggagaacagcaagtactgccgcttcaaccaggaccctgaggccgtggatgaagatagaagcacagagccagaccggctgcaggtgttccacaagagggccatcatgccctatggagtgtacaagaagcagcagaaggaccccagcgaggaggccgctgtgctgcagtatgccagcctggtgggccagaagtgcagcgagaggatgctgctcttcaggaactag

SEQ ID NO: 21014 - DNA, 225 bp, Artificial Sequence
  Description of Artificial Sequence: Synthetic coding sequence
atggccatggcccccagccccagcctggtgcaggtgtacaccagccctgctgctgtggccgtgtgggagtggcaggacggcctgggcacctggcacccctacagcgccaccgtgtgcagcttcatcgagcagcagtttgtgcagcagaagggccagcgcttcggcctgggcagcctggcccacagcatccccctgggccaggccgaccccagcctggccccctag

SEQ ID NO: 21015 - DNA, 594 bp, Artificial Sequence
  Description of Artificial Sequence: Synthetic coding sequence
atggccgccttccgggacatcgaggaggtgtcccagggcctgctgagcctgctgggcgccaacagagctgaggcccagcagaggcggctgctgggcagacatgagcaggtggtggagcggctgctggagacccaggatggagctgagaagcagctgcgggagatcctgaccatggagaaggaggtggcccagagcctgctgaatgccaaggagcaggtgcaccagggcggcgtggagctgcagcagctggaggccggcctgcaggaggccggggaggaggacacccggctgaaggccagcctgctgcagctgacccgggagctggaggagctgaaggagattgaggccgacctggagcggcaggagaaggaggtggatgaggacaccaccgtgaccatccccagcgctgtgtatgtggcccagctgtaccaccaggtgtccaagattgagtgggactatgaatgtgagcccggcatggtgaagggcatccaccacggccccagcgtggcccagcccatccacctggacagcacccagctgagcaggaagttcatcagtgactacctgtggagcctggtggacacagagtggtag

SEQ ID NO: 21016 - DNA, 2271 bp, Artificial Sequence; identical to SEQ ID NO: 19884
  Description of Artificial Sequence: Synthetic coding sequence

SEQ ID NO: 21017 - DNA, 1941 bp, Artificial Sequence
  Description of Artificial Sequence: Synthetic coding sequence
gcccagggctctgtgtccttcaatgatgtgacagtggacttcacccaggaggagtggcagcacctggaccacgcccagaagaccctgtacatggatgtgatgctggagaactactgccacctgatctctgtgggctgccacatgaccaagccagatgtgatcctgaagctggagcggggggaggagccctggaccagctttgctggccacacctgcctggaggagaactggaaggccgaggacttcctggtgaagttcaaggagcaccaggagaagtacagccgctctgtggtgtccatcaaccacaagaagctggtgaaggagaagagcaagatctatgagaagaccttcaccctgggcaagaaccctgtgaacagcaagaacctgcccccagaatatgacacccacggccgcatcctgaagaatgtgtctgagctgatcatcagcaacctgaacccagccaggaagaggctgtctgagtacaacggctacggcaagagcctgctgagcaccaagcaggagaccacccaccctgaggtgaagagccacaaccagagcgcccgggccttcagccacaatgaggtgctgatgcagtaccagaagacagagaccccagcccagagctttggctacaatgactgtgagaagagcttcctgcagaggggcggcctcatcacccacagccggccctacaagggggagaaccccagcgtgtacaacaagaagagaagagccaccaacatcgagaagaagcacacctgcaatgaatgtgggaagagcttctgcaggaagtctgtgctgatcctgcaccagggcatccacagcgaggagaagccctaccagtgccaccagtgtggaaatgccttccggaggaagagctacctgattgaccaccagaggacccacactggagagaagccctttgtgtgcaatgaatgtgggaagagcttccggctgaagacagccctgacagaccaccagaggacccacactggagagaagagctatgaatgtctgcagtgcagaaatgccttccggctgaagagccacctgatccgccaccagaggacccacactggagagaagccctatgaatgtaatgactgtgggaagagcttccggcagaagaccaccctgagcctgcaccagaggatccacactggagagaagccctacatctgcaaggaatgtgggaagagcttccaccagaaggccaacctgactgtgcaccagaggacccacactggagagaagccctacatctgcaatgaatgtgggaagagcttcagccagaagaccaccctggccctgcacgagaagacccacaatgaggagaagccctacatctgcagtgaatgtgggaagagcttccggcagaagaccaccctggtggcccaccagaggacccacactggagagaagagctatgaatgtccccactgcggcaaggccttcaggatgaagagctacctgattgaccaccacaggacccacactggagagaagccctatgaatgtaatgaatgtgggaagagcttcagccagaagaccaacctgaacctgcaccagaggatccacactggagagaagccctacgtgtgcaatgaatgtgggaagagcttccggcagaaggccaccctgactgtgcaccagaagatccacacaggccagaagagctatgaatgtccccagtgtgggaaggccttcagcaggaagagctacctgatccaccaccagaggacccacactggagagaagccctacaagtgcagtgaatgtgggaagtgcttccggcagaagaccaacctgattgtgcaccagaggacccacactggagagaagccctacgtgtgcaatgaatgtgggaagagcttctcctacaagaggaacctgattgtgcaccagaggacccacaagggagaaaatattgagatgcagtag

SEQ ID NO: 21018 - DNA, 594 bp, Artificial Sequence
  Description of Artificial Sequence: Synthetic coding sequence
atgggcggcaggaagcgggagaggaaggctgctgtggaggaggacaccagcctgtctgagagcgagggcccccggcagccagatggagatgaggaggagagcacagccctgagcatcaatgaggagatgcagaggatgctgaaccagctgcgggagtatgactttgaagatgactgtgacagcctgacctgggaggagacagaggagaccctgctgctgtgggaggacttcagcggctacgccatggctgctgctgaggcccagggcgagcaggaggacagcctggagaaggtgatcaaggacacagagagcctcttcaagacccgggagaaggagtaccaggagaccatcgaccagatcgagctggagctggccacagccaagaatgacatgaacagacacctgcacgagtacatggagatgtgcagcatgaagaggggcctggatgtgcagatggagacctgccggcggctcatcacccagagcggggacaggaagagccctgccttcaccgctgtgcccctgagtgaccccccaccccggcaggcccggctgcggacccccatcgccatgagccacctgacagccccctag

SEQ ID NO: 21019 - DNA, 423 bp, Artificial Sequence
  Description of Artificial Sequence: Synthetic coding sequence
atggccatggcccccagccccagcctggtgcaggtgtacaccagccctgctgctgtggccgtgtgggagtggcaggacggcctgggcacctggcacccctacagcgccaccgtgtgcagcttcatcgagcagcagtttgtgcagcagaagggccagcgcttcggcctgggcagcctggcccacagcatccccctgggccaggccgaccccagcctggccccctacatcatcgacctgcccagctggacccagttccggcaggacaccggcaccatgagagctgtgcggcggcacctgttcccccagcacagcgcccctggccggggcgtggtgtgggagtggctgagtgatgatggctcctggacagcctatgaggcctctgtgtgtgactacctggagcagcaggtggcccggggcaactag

SEQ ID NO: 21020 - DNA, 3237 bp, Artificial Sequence
  Description of Artificial Sequence: Synthetic coding sequence
gtgtgcatgcacccccacaacgtgctgagtgatgtggtgaactacaccctgtggctgatggagtgcagccacgccagcggctgctgccacgccaccatgttcttcagcatctgcttctccttccgggctgtgctggagctgtttgacagatatgatggcctgcggcggctggtgaacctgatcagcaccctggagatcctgaacctggaggaccagggcgccctgctgagtgatgatgagatctttgccagccggcagacaggcaagcacacctgcatggccctgaggaagtactttgaggcccacctggccatcaagctggagcaggtgaagcagagcctgcagaggacagaaggaggcatcctggtgcacccccagcccccctacaaggcctgcagctacacccatgagcagatcgtggagatgatggagttcctgattgaatatggccctgcccagctgtactgggagcctgctgaggtgttcctgaagctgagctgtgtgcagctgctgctgcagctgatcagcatcgcctgcaactggaagacctactatgccagaaatgacacagtgcgctttgccctggatgtgctggccatcctgactgtggtgcccaagatccagctgcagctggccgagagcgtggatgtgctggatgaagctggcagcacagtgtccacagtgggcatcagcatcatcctgggcgtggccgagggggagttcttcatccatgatgctgagatccagaagagcgccctgcagatcatcatcaactgtgtgtgtggccctgacaaccgcatcagcagcatcggcaagttcatcagcggcacccccaggaggaagctgccccagaaccccaagagcagcgagcacaccctggccaagatgtggaatgtggtgcagagcaacaacggcatcaaggtgctgctgagcctgctgagcatcaagatgcccatcacagatgctgaccagatccgggccctggcctgcaaggccctggtgggcctgagccgcagcagcacagtgcggcagatcatcagcaagctgcccctcttcagcagctgccagatccagcagctgatgaaggagcctgtgctgcaggacaagagaagtgaccacgtgaagttctgcaagtatgctgctgagctgattgaaagagtgtctgggaagcccctgctgattggaacagatgtgtccctggcccggctgcagaaggcagatgtggtggcccagagccgcatctccttccctgagaaggagctgctgctgctgatccggaaccacctgatcagcaagggcctgggggagacagccaccgtgctgaccaaggaggccgacctgcccatgacagctgccagccacagcagcgccttcacccctgtgacagctgctgccagccctgtgtccctgcccaggaccccccgcatcgccaacggcatcgccacccggctgggcagccacgccgctgtgggcgccagcgcccccagcgcccccacagcccacccccagccccggcccccccagggccccctggccctgcccggccccagctatgccggcaacagccccctgattggccgcatctccttcatccgggagcggcccagcccctgcaatggaaggaagatccgggtgctgcggcagaagagtgaccacggggcctacagccagagccctgccatcaagaagcagctggacagacacctgcccagcccccccaccctggacagcatcatcacagagtacctgcgggagcagcacgcccgctgcaagaaccctgtggccacctgcccccccttcagcctcttcaccccccaccagtgcccagagcccaagcagaggcggcaggcccccatcaacttcaccagccggctgaacagaagagccagcttccccaagtatggaggagtggatggcggctgctttgacagacacctgatcttcagccgcttccggcccatctctgtgttccgggaggccaatgaagatgaaagtggcttcacctgctgtgccttcagcgcccgggagcgcttcctgatgctgggcacctgcaccggccagctgaagctgtacaacgtgttttctggccaggaggaggccagctacaactgccacaacagcgccatcacccacctggagcccagcagagatggcagcctgctgctgaccagcgccacctggagccagcccctgagcgccctgtggggcatgaagtctgtgtttgacatgaagcacagcttcacagaggaccactacgtggagttcagcaagcacagccaggacagagtcatcggcaccaagggggacatcgcccacatctatgacatccagacaggcaacaagctgctgaccctcttcaacccagacctggccaacaactacaagaggaactgtgccaccttcaaccccacagatgacctggtgctgaatgatggagtgctgtgggatgtgcgcagcgcccaggccatccacaagtttgacaagttcaacatgaacatcagcggggtcttccaccccaacggcctggaggtgatcatcaacacagagatctgggacctgcggaccttccacctgctgcacacagtgcctgccctggaccagtgccgggtggtgttcaaccacactggaacagtgatgtacggggccatgctgcaggctgatgatgaagatgacctgatggaggagaggatgaagagccccttcggcagcagcttccgcaccttcaatgccacagactacaagcccatcgccaccattgatgtgaagaggaacatctttgacctgtgcacagacaccaaggactgctacctggccgtgattgagaaccagggctccatggatgccctgaacatggacacagtgtgccgcctgtatgaggtgggccggcagaggctggctgaagatgaagatgaggaggaggaccaggaggaggaggagcaggaggaggaggatgatgatgaagatgatgatgacacagatgacctggatgagctggacacagaccagctgctggaggccgagctggaggaggatgacaacaatgaaaatgctggagaagatggagacaatgacttcagccccagtgatgaggagctggccaacctgctggaggagggggaggatggagaagatgaagattctgatgctgatgaggaggtggagctgatcctgggggacacagacagcagtgacaacagcgacctggaggatgacatcatcctgagcctgaatgaatag

SEQ ID NO: 21021 - DNA, 447 bp, Artificial Sequence
  Description of Artificial Sequence: Synthetic coding sequence
atgctgagtgatggctgcggcagcgaggagaagatctctgtgcccagctgctacggcggcattggagcccctgtgtcccggcaggtgcctgccagccatgattctgagctgatggccttcatgaccaggaagctgtgggacctggagcagcaggtgaaggcccagacagatgagatcctgagcaaggaccagaagattgctgccctggaggacctggtgcagaccctgcggccccaccctgctgaggccaccctgcagaggcaggaggagctggagaccatgtgtgtgcagctgcagaggcaggtgcgggagatggagcgcttcctgagtgactatggcctgcagtgggtgggggagcccatggaccaggaggacagcgagagcaagacagtgtctgagcacggggagcgggactggatgacagccaagaagttctggaagccctag

SEQ ID NO: 21022 - DNA, 1755 bp, Artificial Sequence
  Description of Artificial Sequence: Synthetic coding sequence
atgagcctgcccccagagaaggccagcgagctgaagcagctgatccaccagcagctgagcaagatggatgtgcacggccgcatccgggagatcctggccgagaccatccgggaggagctggccccagaccagcagcacctgagcacagaggacctgatcaaggccctgcggcggcggggcatcattgatgatgtgatgaaggagctgaactttgtgacagattctgtggagcaggagctgcccagcagccccaagcagcccatctgctttgaccggcagagcaccctgaagaagagtgatggcaccaggatggctgacagcaccaccatgctgagcatcagtgaccccatccacatggtgctgatcaagacagacatctttggagagaccaccctggtggccagctacttcctggagtggaggtctgtgctgggctctgaaaatggagtgaccagcctgactgtggagctgatgggcgtgggcacagagagcaaggtgtctgtgggcatcctgaacatcaagctggagatgtacccacccctgaaccagaccctgagccaggaggtggtgaacacccagctggccctggagcggcagaagacagctgagaaggagcggctcttcctggtgtatgccaagcagtggtggagggagtacctgcagatccggcccagccacaacagccggctggtgaagatctttgcccaggatgaaaatggcatcaacagacctgtgtgcagctatgtgaagcccctgcgggccggccgcctgctggacaccccccggcaggccgccaggtttgtgaatgtgctgggctatgagcgggcccctgtgattggaggcggcggcaagcaggagcagtggtgcaccctgctggccttcctgtgcagaaataaaggagactgtgaagatcatgccaacctgctgtgcagcctgctgctgggctacggcctggaggcctttgtgtgtgtgggcaccaaggccaagggcgtgccccacgcctgggtgatgacctgtggcacagatggagccatcaccttctgggagagcctgaccggccaccgctacatccacaagcccaccaacccagatgagccccctgtggccgagcagcccaagcccctgtacccctaccgcaccatcggctgtgtgttcaaccaccagatgttcctgggcaactgccagcccagtgatgctgtggagacctgtgtgtttgacctgaatgatgagagcaagtggaagcccatgtctgaggaggccatcaagtctgtgtgtgcccctggggccaccaccagcctgccccccttcccccccctgtgtgccagcaccattgatgcctctgtgaccagcaatgaaattgagatgcagctgcggctgctggtgtctgagcacaggaaggacctgggcctgaccaccgtgtgggaggaccagctgagctacctgctgagccctgccctggccagctatgaatttgagaggaccaccagcatctctgctggaaatgaggagttccaggatgccatcagaagagctgtgcctgatggccacaccttcaagggcttccccatccactttgtgtacagaaatgcccggcgggcctttgccacctgcctgcggagccccttctgtgaggagatcatctgctgccgcggggaccaggtgcggctggccgtgcgggtgcgggtcttcacctacccagagagcgcctgtgctgtgtggatcatgtttgcctgcaagtacagatctgtgctgtag

SEQ ID NO: 21023 - DNA, 4515 bp, Artificial Sequence
  Description of Artificial Sequence: Synthetic coding sequence
atggtgtctgagagtgacttcagcaaggatgtggccgtgcaggtgctgcccctggacaagattgaggagaacaacaagcagaaggccaatgacatcttcatcagccagtacaccatgggccagaaggatgccctgaggacagtgctgaagcagaatgtgtccctgtgcctgaccggctggagcgaccacagcggggtcatcaccacccactgcagcctgtacctgctgcggctgatgaggagcagccacctgagcctgcccagctcctgggactaccgggcccagagcatgcctgtgttcaaggaggtgaaggtgcacctgctggaggatgctggcatcgagaaggatgctgtgacccaggagacccgcatcagccccagcggcattgattctgccaccaccgtggccgccgccacagctgctgccatcgccacagctgcccccctcatcaaggtgcagagcgacctggaggccaaggtgaacagcgtgacagagctgctgagcaagctgcaggagacagacaagcacctgcagagggtgacagagcagcagaccagcatccagaggaagcaggagaagctgcactgccacgaccacgagaagcagatgaatgtgttcatggagcagcacatccgccacctggagaagctgcagcagcagcagattgacatccagacccacttcatctctgctgccctgaagaccagcagcttccagcctgtgtccatgcccagcagcagagctgtggagaagtacagcgtgaagccagagcaccccaacctgggcagctgcaaccccagcctgtacaacacctttgccagcaagcaggcccccctgaaggaggtggaggacaccagctttgacaagcagaagagccccctggagaccccagcccccaggagatttgcccctgtgcctgtgtccagagatgatgagctgagcaagcgggagaacctgctggaggagaaggagaacatggaggtgtcctgccacagaggaaatgtgcggctgctggagcagatcctgaacaacaatgacagcctgaccaggaagtctgagagcagcaacaccaccagcctgaccaggagcaagattggctggaccccagagaagaccaaccgcttccccagctgtgaggagctggagaccaccaaggtgaccatgcagaagagtgatgatgtgctgcatgacctgggccagaaggagaaggagaccaacagcatggtgcagcccaaggagagcctgtccatgctgaagctgcctgacctgccccagaacagcgtgaagctgcagaccaccaacaccaccaggtctgtgctgaaggatgctgagaagatcctgcggggcgtgcagaacaacaagaaggtgctggaggagaacctggaggccatcatccgggccaaggatggagctgccatgtacagcctcatcaatgccctgagcaccaaccgggagatgtctgagaagatccgcatcaggaagacagtggatgagtggatcaagaccatctctgctgagatccaggatgagctgagcaggacagattatgagcagaagagatttgaccagaagaaccagaggaccaagaagggccagaacatgaccaaggacatccgcaccaacacccaggacaagacagtgaacaagagcgtcatccccaggaagcacagccagaagcagatcgaggagcacttcaggaacctgcccatgaggggcatgcctgccagcagcctgcagaaggagaggaaggagggcctgctgaaggccaccaccgtcatccaggatgaggactacatgctgcaggtgtatggcaagcctgtgtaccagggccacaggagcaccctgaagaagggcccctacctgcgcttcaacagccccagccccaagagccggccccagaggcccaaggtgattgaaagagtgaagggcaccaaggtgaagagcatccgcacccagacagacttctacgccaccaagcccaagaagatggacagcaagatgaagcacagcgtgcctgtgctgccccacggggaccagcagtacctgttcagccccagccgggagatgcccaccttcagcggcaccctggagggccacctgatccccatggccatcctgctgggccagacccagagcaacagcgacaccatgcccccagctggggtgattgtgtccaagccccaccctgtgacagtgaccaccagcatcccccccagcagcaggaaggtggagactggagtgaagaagcccaacatcgccatcgtggagatgaagtctgagaagaaggaccccccccagctgactgtgcaggtgctgcccagcgtggacatcgacagcatcagcaacagcagcgcagatgtgctgagccccctgagcagccccaaggaggccagcctgccccctgtgcagacctggatcaagaccccagagatcatgaaggtggatgaggaggaggtgaagtttcctggcaccaactttgatgagatcattgatgtgatccaggaggaggagaagtgtgatgagatcccagattctgagcccatcctggagttcaacagatctgtgaaggctgacagcaccaagtacaatggaccacccttcccccctgtggccagcaccttccagcccacagctgacatcctggacaaggtgattgaaaggaaggagaccctggagaacagcctcatccagtgggtggagcaggagatcatgagccgcatcatcagcggcctcttccctgtgcagcagcagatcgcccccagcatctctgtgtctgtgtctgagaccagcgagcccctgaccagtgacatcgtggagggcaccagcagcggggccctgcagctgtttgtggatgctggggtgcctgtgaacagcaatgtcatcaagcactttgtgaatgaggccctggccgagaccatcgctgtgatgctgggggaccgggaggccaagaagcagggccctgtggccaccggggtgtctggagatgccagcaccaatgagacctacctgcctgcccgggtgtgcacccccctgcccaccccccagcccaccccaccctgcagccccagcagccctgccaaggaatgtgtgctggtgaagaccccagacagcagcccctgtgacagcgaccatgacatggccttccctgtgaaggagatctgtgccgagaagggagatgacatgcctgccatcatgctggtgaacacccccaccgtgacccccaccaccaccccacctcctgctgctgctgtgttcacccccaccctgagtgacatcagcattgacaagctgaaggtgagcagccctgagctgcccaagccctggggagatggagacctgcccctggaggaggagaaccccaacagcccccaggaggagctgcacccccgggccatcgtgatgtctgtggccaaggatgaggagcctgagagcatggacttccctgcccagcccccacctcctgagcctgtgcccttcatgcccttccctgctggcaccaaggcccccagccccagccagatgcctggcagtgacagcagcaccctggagagcaccctgtctgtgacagtgacagaaacagagaccctggacaagcccatcagcgagggggagatcctcttcagctgtggccagaagctggcccccaagatcctggaggacatcggcctgtacctgaccaacctgaatgacagcctgagcagcaccctgcatgatgctgtggagatggaggatgacccccccagcgagggccaggtgatccgcatgagccacaagaagttccacgcagatgccatcctgagctttgccaagcagaaccaggagagcgctgtgtcccagcaggccgtgtaccacagcgaggacctggagaacagcgtgggggagctgtctgagggccagaggccccagctgacagctgctgctgagaacatcctgatgggccacagcctgtacatgcagccccctgtgaccaacacccagagcctggaccagcagtgtgaccccaagcccctgagccggcagtttgacacagtgtctggcagcatctatgaggacagctgtgccagccacggccccatgagcctgggggagctggagctggagcccaacagcaagctggtgctgcccaccaccctgctgacagcccaggagaatgatgtgaacctgcctgtggccgctgaggacttcagccagtaccagctgaagcagaaccaggatgtgaagcaggtggagcacaagcccagccagagctacctgcgggtgaggaacaagagtgacatcgcccccagccagcagcaggtgtcccctggggacatggacaggacccagatcgagctgaacccctacctgacctgtgtgttcagcggcggcaaggctgtgcccctgagcgccagccagatgcccccagccaagatgtctgtgatgctgcccagcgtgaacctggaggactgcagccagagcctgagcctgagcaccatgcaggaggacatggagagcagtggagctgacaccttctag

SEQ ID NO: 21024 - DNA, 2271 bp, Artificial Sequence
  Description of Artificial Sequence: Synthetic coding sequence
atggtggcccctgtgctggagaccagccacgtgttctgctgccccaacagagtgcggggcgtgctgaactggagcagcggcccccggggcctgctggccttcggcaccagctgcagcgtggtgctgtatgaccccctgaagagggtggtggtgaccaacctgaatggccacacagcccgggtgaactgcatccagtggatctgcaagcaggacggcagccccagcacagagctggtgtctgggggcagtgacaaccaggtgatccactgggagattgaggacaaccagctgctgaaggctgtgcacctgcagggccacgagggccctgtgtatgctgtgcatgctgtgtaccagaggaggaccagtgaccctgccctgtgcaccctcatcgtgtctgctgctgctgacagcgctgtgcggctgtggagcaagaagggccctgagggccgggacctcttcctggccagctgcagccaggactgcctgatccgcatctggaagctgtacatcaagagcaccagcctggagacccaggatgatgacaacatccggctgaaggagaacaccttcaccattgaaaatgaatctgtgaagatcgcctttgctgtgaccctggagaccgtgctggccggccacgagaactgggtgaatgctgtgcactggcagcctgtgttctacaaggatggagtgctgcagcagcctgtgcggctgctgagcgcctccatggacaagaccatgatcctgtgggccccagatgaggagagcggcgtgtggctggagcaggtgcgggtgggggaggtgggcggcaacaccctgggcttctatgactgccagttcaatgaagatggctccatgatcatcgcccacgccttccacggggccctgcacctgtggaagcagaacacagtgaacccccgggagtggaccccagagatcgtcatcagcggccactttgatggagtgcaggacctggtgtgggaccctgagggggagttcatcatcaccgtgggcacagaccagaccacccggctgtttgccccctggaagaggaaggaccagagccaggtgacctggcatgaaattgcccggccccagatccacggctatgacctgaagtgcctggccatgatcaaccgcttccagtttgtgtctggagcagatgagaaggtgctgcgggtcttcagcgcccccaggaactttgtggagaacttctgtgccatcaccggccagagcctgaaccacgtgctgtgcaaccaggacagcgacctgcctgagggcgccaccgtgcctgccctgggcctgagcaacaaggctgtgttccagggcgacatcgccagccagcccagtgatgaggaggagctgctgaccagcacaggctttgagtaccagcaggtggccttccagcccagcatcctgacagagcccccaacagaggaccacctgctgcagaacaccctgtggccagaggtgcagaagctgtatggccacggctatgagatcttctgtgtgacctgcaacagcagcaagaccctgctggccagcgcctgcaaggccgccaagaaggagcacgccgccatcatcctgtggaacaccacctcctggaagcaggtgcagaacctggtgttccacagcctgactgtgacccagatggccttcagccccaatgagaagttcctgctggccgtgtcccgggacaggacctggagcctgtggaagaagcaggacaccatcagccctgagtttgagcctgtgttcagcctgtttgccttcaccaacaagatcacctctgtgcacagccgcatcatctggagctgtgactggagcccagacagcaagtacttcttcaccggcagccgggacaagaaggtggtggtgtggggagaatgtgacagcacagatgactgcatcgagcacaacatcggcccctgcagctctgtgctggatgtgggcggcgctgtgacagctgtgtctgtgtgccctgtgctgcaccccagccagcgctacgtggtggccgtgggcctggagtgtgggaagatctgcctgtacacctggaagaagacagaccaggtgcctgagatcaatgactggacccactgtgtggagaccagccagagccagagccacaccctggccatcaggaagctgtgctggaagaactgcagcggcaagacagagcagaaggaggccgagggcgctgagtggctgcactttgccagctgtggggaggaccacacagtgaagatccaccgggtgaacaagtgtgccctgtag

SEQ ID NO: 21025 - DNA, 345 bp, Artificial Sequence
  Description of Artificial Sequence: Synthetic coding sequence
atgcaggagatcaaccagaacctggccgaggaggccggcctgaacatcacccacatctgcctgcccccagacagcagcgaggccgagatcattgatgagatcctgaagatcaatgaagacaccagggtgcacggcctggccctgcagatcagcgagaacctcttcagcaacaaggtgctgaatgccctgaagccagagaaggatgtggatggagtgacagacatcaacctgggcaagctggtgagaggagatgcccatgaatgttttgtgtcccctgtggccaaggccgtcatcgagctgctggagaagagcggcgtgaacctggatggcaagaagatcctgtag

SEQ ID NO: 21026 - DNA, 747 bp, Artificial Sequence; identical to SEQ ID NO: 20797
  Description of Artificial Sequence: Synthetic coding sequence

SEQ ID NO: 21027 - DNA, 1461 bp, Artificial Sequence; identical to SEQ ID NO: 18684
  Description of Artificial Sequence: Synthetic coding sequence

SEQ ID NO: 21028 - DNA, 1710 bp, Artificial Sequence
  Description of Artificial Sequence: Synthetic coding sequence
atggccctgctgtctgagggcctggatgaggtgcctgctgcctgcctgagcccctgtggcccccccaaccccacagagctgttcagcgagagccggcggctggccctggaggagctggtggccggcggccctgaggcctttgctgccttcctgcggcgggagcggctggcccgcttcctgaacccagatgaggtgcacgccatcctgcgggctgctgagaggcctggagaggagggcgctgctgctgctgctgctgctgaagattcttttggcagcagccatgactgcagcagcggcacctacttccctgagcagagcgacctggagccccccctgctggagctgggctggccagccttctaccagggcgctggggagggcggcccctacggctgcaaggatgccctgcggcagcagctgcggagcgcccgggaggtgattgctgtggtgatggatgtgttcacagacatcgacatcttccgggacctgcaggagatctgcaggaagcagggcgtggccgtgtacatcctgctggaccaggccctgctgagccagttcctggacatgtgcatggacctgaaggtgcaccctgagcaggagaagctgatgacagtgaggaccatcactggaaacatctactatgcccggagcggcaccaagatcatcggcaaggtgcatgagaagttcaccctgattgatggcatccgggtggccaccggcagctacagcttcacctggacagatggcaagctgaacagcagcaacctggtgatcctgagcggccaggtggtggagcactttgacctggagttccgcatcctgtatgcccagagcaagcccatcagccccaagctgctgagccacttccagagcagcaacaagtttgaccacctgaccaacaggaagccccagagcaaggagctgaccctgggcaacctgctgaggatgaggctggcccggctgagcagcacccccaggaaggctgacctggaccctgagatgcctgctgagggcaaggccgagaggaagccccatgactgtgagagcagcacagtgtctgaggaggactacttcagcagccacagagatgagctgcagagcaggaaggccattgatgctgccacccagacagagcctggagaggagatgcctggcctgtctgtgtctgaggtgggcacccagaccagcatcaccacagcctgtgccggcacccagacagctgtgatcacccgcatcgccagcagccagaccaccatctggagccgcagcaccaccacccagacagacatggatgagaacatcctcttcccccggggcacccagagcacagagggcagccctgtgtccaagatgtctgtgagccgcagcagcagcctgaagagcagcagctctgtgagcagccagggctctgtggccagcagcacaggcagccctgccagcatccgcaccacagacttccacaaccctggctaccccaagtacctgggcaccccccacctggagctgtacctgagtgacagcctgaggaacctgaacaaggagcggcagttccactttgctggcatccgcagccggctgaaccacatgctggccatgctgagcaggaggaccctcttcacagagaaccacctgggcctgcacagcggcaacttcagccgggtgaacctgctggccgtgagagatgtggccctgtaccccagctaccagtag

SEQ ID NO: 21029 - DNA, 1224 bp, Artificial Sequence
  Description of Artificial Sequence: Synthetic coding sequence
atggtgctcttcagtgacagcagcctgccccactggcagcagcagcccccccagcctgcccctcctcctcctctcttcccccggcagcagcaggtgcaggtgaacaagggccgggtgaactgccacccccgctgccgctacatcaagaccaagccctgccaccagctgagccaccaggtgtgggtgcagcagaagcccagccaccggctgctgagcctgcagctgagccccagccccaagcccagccccagcccccagctgagcctgaagttccggctgagcctgaagttccggcccaagcagctgttccaccccatgagcctgctgaagcacaacccccccacccacagccaccccagccccaagctgcagcagagccagccccagagcaatgtgcagggccagagccctgtgcgggtgcagagccccagccagacccgcatccggcccagcacccccagccagctgagccctggccagcagagccaggtgcagaccaccaccagccagcccatccccatccagccccacaccagcctgcagatccccagccagggccagccccagagccagccccaggtggtgatgaagcacaatgctgtgattgagcacctgaagcagaagaagtccatgaccccagctgagcgggaggagaaccagaggatgattgtgtgcaaccaggtgatgaagtacatcctggacaagattgacaaggaggagaagcaggccgccaagaagaggaagcgggaggagagcgtggagcagaagaggagcaagcagaatgccaccaagctgagcgccctgctcttcaagcacaaggagcagctgcgggcagagatcctgaagaagagggccctgctggacaaggacctgcagatcgaggtgcaggaggagctgaagagggacctgaagatcaagaaggagaaggacctgatgcagctggcccaggccacagctgtggccgccccctgcccccctgtgaccccagcccccccagcccccccagcccccccacccagccccccacctcctcctgctgtgcagcacacaggcctgctgagcacccccaccctgcctgctgccagccagaagaggaagcgggaggaggagaaggacagcagcagcaagagcaagaagaagaagatgatcagcaccaccagcaaggagaccaagaaggacaccaagctgtactgcatctgcaagaccccctatgatgagagctag

SEQ ID NO: 21030 - DNA, 480 bp, Artificial Sequence; identical to SEQ ID NO: 20848
  Description of Artificial Sequence: Synthetic coding sequence

SEQ ID NO: 21031 - DNA, 309 bp, Artificial Sequence
  Description of Artificial Sequence: Synthetic coding sequence
atgaatgaggccgagatcgtggatgtggccctgggcatcctgattgagagcaggaagcaggagaaggcctgtgagcagcctgccctggccggggctgacaaccctgagcacagccccccctgcagcgtgagcccccacaccagcagcggcagcagcagcgaggaggaggacagcggcaagcaggccctggcccctggcctgagccccagccagaggcctgggggcagcagcagcgcctgcagccgcagccctgaggaggaggaggaggaggatgtgctgaagtatgtgcgggagatcttcttctcctag

SEQ ID NO: 21032 - DNA, 345 bp, Artificial Sequence
  Description of Artificial Sequence: Synthetic coding sequence
atgcagtttggagagctgctggccgctgtgaggaaggcccaggccaacgtgatgctgttcctggaggagaaggagcaggccgccctgagccaggccaacggcatcaaggcccacctggagtacagatctgctgagatggagaagagcaagcaggagctggagaccatggccgccatcagcaacacagtgcagttcctggagaggtccatgaccagcgagctgaagtgcctgcccctcttcagcgccaacatcggcctgcccaacctgagccctgcccctggcaacagcagcagcaacatgtgcatgaccagccgcagcaccaggacccagcacaccagcatctag

SEQ ID NO: 21033 - DNA, 579 bp, Artificial Sequence; identical to SEQ ID NO: 18812
  Description of Artificial Sequence: Synthetic coding sequence

SEQ ID NO: 21034 - DNA, 888 bp, Artificial Sequence
  Description of Artificial Sequence: Synthetic coding sequence
atgaagcagtatggcctgggccccaatggaggcatcgtgaccagcctgaacctgtttgccaccaggtttgaccaggtgatgaagttcatcgagaaggcccagaacatgagcaaatatgtgctgattgacaccccaggccagatcgaggtgttcacctggagcgccagcggcaccatcatcacagaggccctggccagcagcttccccaccgtggtgatctacgtgatggacaccagccgcagcaccaaccctgtgaccttcatgagcaacatgctgtatgcctgcagcatcctgtacaagaccaagctgcccttcatcgtggtgatgaacaagacagacatcatcgaccacagctttgctgtggagtggatgcaggactttgaggccttccaggatgccctgaaccaggagaccacctacgtgagcaacctgaccaggtccatgagcctggtgctggatgagttctacagcagcctgcgggtggtgggcgtgtctgctgtgctgggcaccggcctggatgagctgtttgtgcaggtgaccagcgctgctgaggagtatgaaagagagtacagaccagaatatgaaaggctgaagaagagcctggccaatgctgagagccagcagcagcgggagcagctggagcggctgaggaaggacatgggctctgtggccctggatgctggaacagccaaggacagcctgagccctgtgctgcaccccagcgacctgatcctgacccggggcaccctggatgaagaagatgaggaggccgacagcgacacagatgacatcgaccaccgggtgacagaggagagccatgaggagcccgccttccagaacttcatgcaggagagcatggcccagtactggaagaggaacaacaagtag

SEQ ID NO: 21035 - DNA, 1212 bp, Artificial Sequence
  Description of Artificial Sequence: Synthetic coding sequence
atgcccagcgctgaggccaagctgaagaagaacagatgtgccaactgctttgactgccccggctgcatgcacaccctgagcacccgggccaccagcatcagcacccagctgcctgatgatcctgccaagaccaccatgaagaaggcctactacctggcctgtggcttctgccgctggaccagcagagatgtgggcatggctgacaagtctgtggccagcggcggctggcaggagcctgagaacccccacacccagaggatgaacaagctgattgagtactaccagcagctggcccagaaggagaaggtggagcgggacaggaagaagctggccaggagaagaaactacatgcccctggccttcagtgacaagtatggcctgggcacccggctgcagaggccccgggccggggccagcatcagcaccctggccggcctgagcctgaaggagggggaggaccagaaggagatcaagattgaaccagcccaggccgtggatgaggtggagcccctgcctgaggactactacaccaggcctgtgaacctgacagaggtgaccaccctgcagcagaggctgctgcagcctgacttccagcctgtgtgtgccagccagctgtaccccaggcacaagcacctgctgatcaagaggagcctgcgctgcaggaaatgtgagcacaacctgagcaagccagagttcaaccccaccagcatcaagttcaagatccagctggtggccgtgaactacatccctgaggtgcgcatcatgagcatccccaacctgcgctacatgaaggagagccaggtgctgctgaccctgaccaaccctgtggagaacctgacccacgtgaccctgtttgaatgtgaggagggggaccctgatgacatcaacagcacagccaaggtggtggtgccccccaaggagctggtgctggccggcaaggatgctgctgctgaatatgatgagctggccgagccccaggacttccaggatgatcctgacatcatcgccttcaggaaggccaacaaggtgggcatcttcatcaaggtgaccccccagcgggaggagggggaggtgacagtgtgcttcaagatgaagcatgacttcaagaacctggccgcccccatccggcccatcgaggagagtgaccagggcacagaggtgatctggctgacccagcacgtggagctgagcctgggccccctgctgccctag

SEQ ID NO: 21036 - DNA, 1674 bp, Artificial Sequence; identical to SEQ ID NO: 19224
  Description of Artificial Sequence: Synthetic coding sequence

SEQ ID NO: 21037 - DNA, 462 bp, Artificial Sequence
  Description of Artificial Sequence: Synthetic coding sequence
atggccgagcaggagcagaggaagatccccctggtgcctgagaacctgctgaagaagaggaaggcctaccaggccctgaaggccacccaggccaagcaggccctgctggccaagaaggagcagaagaagggcaagggcctgcgcttcaagaggctggagagcttcctgcatgacagctggaggcagaagagggacaaggtgcggctgcggcggctggaggtgaagccccacgccctggagctgcctgacaagcacagcctggcctttgtggtgagaattgaaagaattgatggagtgtccctgctggtgcagaggaccatcgcccggctgcggctgaagaagatcttctctggagtgtttgtgaaggtgaccccccagaacctgaagatgctgagaattgtggagccctacgtgacctggggcgaggtgtggaggcacctgctgggccggccccacagctag

SEQ ID NO: 21038 - DNA, 2070 bp, Artificial Sequence
  Description of Artificial Sequence: Synthetic coding sequence
atgattgacagcgtgaagctgcggcgggacagcgctgctgacttcttcagccactatgagtacctgtgtgccctgcagaacagcgtgcccctgcctgctgtgcgggcctgcctgcgggagggcgtgctggacttcaatgctgaccggctgcggggcgtggactgggcccccctgctgagcaccctgaagatcaacaaggacctgcccctggtgtccatcaagagcttcttccagccctggctgggggacaccggcagtgacatgaacaagttctgccgcagccgggtgcctgccatccgctacaaggatgtgaccttccagctgtgcaaggccctgaagggctgcctgagcatcagctctgtgctgaagaacctggagctgaatggcctcatcctgcgggagcgggacctgaccatcctggccaagggcctgaacaagagcgccagcctggtgcacctgagcctggccaactgccccatcggagatggcggcctggagatcatctgccagggcatcaagagcagcatcaccctgaagacagtgaacttcaccggctgcaacctgacctggcagggcgctgaccacatggccaagatcctgaagtaccagaccatgagaagacatgaggagacctgggccgagagcctgcgctacagaagaccagacctggactgcatggccggcctgcggcgcatcaccctgaactgcaacaccctcatcggggacctgggcgcctgtgcctttgctgacagcctgtctgaggacctgtggctgcgggccctggacctgcagcagtgtggcctgaccaatgaaggagccaaggccctgctggaggccctggagaccaacaccaccctggtggtgctggacatcaggaagaaccccctgattgaccacagcatgatgaaggccgtcatcaagaaggtgctgcagaatggccgcagcgccaagtctgagtaccagtggatcaccagccccagcgtgaaggagcccagcaagacagccaagcagaagaggaggaccatcatcctgggcagcggccacaagggcaaggccaccatccgcatcggcctggccaccaagaagcctgtgagcagcggcaggaagcacagcctgggcaaggagtactatgccccagcccccctgcccccaggagtgtctggcttcctgccctggaggacagctgagcgggccaagaggcaccggggcttccccctcatcaagacccgggacatctgcaaccagctgcagcagcccggcttccctgtgacagtgacagtggagagccccagcagcagcgaggtggaggaggtggatgacagcagcgagagcgtgcatgaggtgcctgagaagaccagcattgagcaggaggccctgcaggagaagctggaggagtgcctgaagcagctgaaggaggagagggtcatccggctgaaggtggacaagagggtgtctgagctggagcatgaaaatgcccagctgaggaacatcaacttcagcctgtctgaggccctgcacgcccagagcctgaccaacatgatcctggatgatgaaggagtgctgggcagcattgaaaattccttccagaagttccacgccttcctggacctgctgaaggatgctggcctgggccagctggccaccatggccggcatcgaccagagcgacttccagctgctgggccacccccagatgaccagcacagtgagcaacccccccaaggaggagaagaaggccctggaggatgagaagccagagcccaagcagaatgccctgggccagatgcagaacatccagttccagaagatcactggagatgcccgcatccccctgcccctggacagcttccctgtgcctgtgtccaccccagagggcctgggcaccagcagcaacaacctgggcgtgcctgccacagagcagaggcaggagagctttgagggcttcatcgccaggatgtgcagccccagcccagatgccaccagcggcaccggcagccagaggaaggaggaggagctgagcaggaacagccgcagcagcagcgagaagaagaccaagacagagagccactag

SEQ ID NO: 21039 - DNA, 915 bp, Artificial Sequence
  Description of Artificial Sequence: Synthetic coding sequence
atgaacttcagcgaggtgttcaagctgagcagcctgctgtgcaagttctccccagatggcaagtacctggccagctgtgtgcagtaccgcctggtggtgagagatgtgaacaccctgcagatcctgcagctgtacacctgcctggaccagatccagcacatcgagtggagcgctgacagcctcttcatcctgtgtgccatgtacaagaggggcctggtgcaggtgtggagcctggagcagcctgagtggcactgcaagattgatgagggcagcgctggcctggtggccagctgctggagcccagatggccgccacatcctgaacaccacagagttccacctgcgcatcaccgtgtggagcctgtgcaccaagtctgtgtcctacatcaagtaccccaaggcctgcctgcagggcatcaccttcaccagagatggccgctacatggccctggccgagcggcgggactgcaaggactatgtgtccatctttgtgtgcagcgactggcagctgctgcggcactttgacacagacacccaggacctgaccggcatcgagtgggccccaaatggctgtgtgctggccgtgtgggacacctgcctggaggtgcgcatcctgaaccacgtgacctggaagatgatcacagaatttggccaccctgctgccatcaatgaccccaagatcgtggtgtacaaggaggccgagaagagcccccagctgggcctgggctgcctgtccttccccccacccagggctggagctggccccctgcccagcagcgagagcaaatatgaaattgcctctgtgcctgtgtccctgcagaccctgaagcctgtgacagaccgggccaaccccaagattggcatcggcatgctggccttctccccagacagctacttcctggccaccagaaattag

SEQ ID NO: 21040 - DNA, 483 bp, Artificial Sequence
  Description of Artificial Sequence: Synthetic coding sequence
atgaaggaggtgggccggccccgggaggtgcggggccggcctgggaagagccgcatccagaaggagctggccgacatcaccctggaccccccacccaactgcagcgctggccccaagggggacaacatctatgagtggaggagcaccatcctgggccccccaggctctgtgtatgagggcggcgtcttcttcctggacatcaccttcaccccagagtaccccttcaagccacccaaggtgaccttccgcacccgcatctaccactgcaacatcaacagccagggcgtcatctgcctggacatcctgaaggacaactggagccctgccctgaccatcagcaaggtgctgctgagcatctgcagcctgctgacagactgcaacccagctgaccccctggtgggcagcatcgccacccagtacatgaccaacagagctgagcatgacaggatggcccggcagtggaccaagagatatgccacctag

SEQ ID NO: 21041 - DNA, 516 bp, Artificial Sequence
  Description of Artificial Sequence: Synthetic coding sequence
atgagcagtggaaatgccaagattggccacccagcccccaacttcaaggccacagctgtgatgccagatggccagttcaaggacatcagcctgagtgactacaagggcaagtatgtggtgttcttcttctaccccctggacttcacctttgtgtgccccacagagatcatcgccttcagtgacagagctgaggagttcaagaagctgaactgccaggtgattggagcctctgtggacagccacttctgccacctggcctgggtgaacacccccaagaagcagggcggcctgggccccatgaacatccccctggtgtctgaccccaagaggaccatcgcccaggactatggagtgctgaaggcagatgagggcatctccttccggggcctcttcatcattgatgacaagggcatcctgcggcagatcaccgtgaatgacctgcctgtgggccgctctgtggatgagaccctgcggctggtgcaggccttccagttcacagacaagcatggagagtag

SEQ ID NO: 21042 - DNA, 603 bp, Artificial Sequence
  Description of Artificial Sequence: Synthetic coding sequence
gtgctgatctttgcctgcctggtgcccggcttccctgctgtgatgagcagccggggcccctgcaccctggagaccctcatcaaccccagccccagcgtggctgatgtgaagatctacccagaggagatcacccccctgctgcctgccatctctggagagaagattgctgaggaccagacctgcttcttcctgcagatcctgctgaagtacatggtgatccaggccgccagcctggagtggaagaacaaggagaaccaggacaccggcttcaagttcctgttcaccctcttcaggaagtactacctgccccacctgttccccagcttcaccaagctgaccaacatctacaagcctgtgctggacatcccccacctgcggcccaagcctgtgtacatcaccaccacccgggacaatgaaaacatctacagcaccaagatcccctacatggccgcccgggtggtgttcatcaagtggatcgtgaccttcttcctggagaagaagtacctgacagccacccagaacaccaagaatggagtggatgtgctgcccaagatcatccaggtgtgccaccccagcagcttctacctgctgatgctggtgtag

SEQ ID NO: 21043 - DNA, 576 bp, Artificial Sequence
  Description of Artificial Sequence: Synthetic coding sequence
atgagcagcaccctgggcaagctgagcaaccaggtggaggagaccctgcccctgctgaagaagcccctgaagagggccatcaccaccctgatggccggcatcctgcggctggtggtgcagtggcccccaggccgcctgcagacagtgaccaagggcgtggagagcctcatctgcacagactggatccgccacaagttcaccaggagccgcatccctgagaaggtgttccaggccagcccagaagatcatgagaagtatggaggagacccccagaacccccacaagctgcacatcgtgacccgcatcaagagcaccaggagaagaccctactgggagaaggacatcatcaagatgctgggcctggagaaggcccacaccccccaggtgcacaagaacatccccagcgtgaatgccaagctgaaggtggtgaagcacctgatccgcatcaagcccctgaagctgccccagggcctgcctgctgaggagaacatgagcaacacctgcctgaagagcactggagagctggtggtgcagtggcacctgaagcctgtggagcagaaggcccacgagagctag

SEQ ID NO: 21044 - DNA, 483 bp, Artificial Sequence; identical to SEQ ID NO: 20009
  Description of Artificial Sequence: Synthetic coding sequence

SEQ ID NO: 21045 - DNA, 321 bp, Artificial Sequence
  Description of Artificial Sequence: Synthetic coding sequence
accttcctggagcagagcaagacccgcttcaacaagaactacaagggcatgagcctgagcaagatcaccaccaccgtgggcctgaacatcggcaccgtggatgtgggcaaggcccggctgatgttctgggacctgggcggccaggaggagctgcagagcctgtgggacaaggacaagaccaagtgtggggacctgggcaccctgcacagcagcaaggtgtctgccagcttccggctgcgggacctggccgctgaccaccacaggacccagaagtggcagaggccagatgtgggcacagctggctggctgcccctgccctag

SEQ ID NO: 21046 - DNA, 1524 bp, Artificial Sequence
  Description of Artificial Sequence: Synthetic coding sequence
atggccgagctgcagatgctgctggaggaggagatccctgggggccggcgggccctgtttgacagctacaccaacctggagcgggtggccgactactgtgagaacaactacatccagagcgctgacaagcagagggccctggaggagaccaaggcctacaccacccagagcctggcctctgtggcctacctgatcaacaccctggccaacaacgtgctgcagatgctggacatccaggccagccagctgcggaggatggagagcagcatcaaccacatcagccagacagtggacatccacaaggagaaggtggcccggcgggagatcggcatcctgaccaccaacaagaacaccagcaggacccacaagatcatcgccccagccaacctggagaggcctgtgcgctacatcaggaagcccatcgactacaccatcctggatgacattggacatggagtgaaggtgtccacccagaacatgaagatgggcggcctgcccaggaccaccccacccacccagaagccacccagcccccccatgtctgggaagggcaccctgggccgccacagcccctaccgcaccctggagcctgtgcggccccctgtggtgcccaatgactatgtgcccagccccaccaggaacatggcccccagccagcagagccctgtgaggacagcctctgtgaaccagaggaacagaacctacagcagcagcggcagcagcggcggcagccaccccagcagccgcagcagcagccgggagaacagcggcagcggctctgtgggcgtgcccatcgctgtgcccacccccagcccccccagcgtcttccctgccccagctggcagcgctggcaccccacccctgcctgccaccagcgccagcgccccagcccccctggtgcctgccaccgtgcccagcagcacagccccagatgctgctgctgggggcgcccagaccctggctgatggcttcaccagccccaccccacctgtggtgagcagcaccccacccaccggccaccctgtgcagttctacagcatgaacagacctgccagccgccacaccccacccaccatcggcggcagcctgccctaccgccggccccccagcatcaccagccagaccagcctgcagaaccagatgaatggaggccccttctacagccagaaccctgtgtctgacaccccacctcctcctcctcctgtggaggagcctgtgtttgatgagagccccccacctcctcctcctcctgaggactatgaggaggaggaggccgctgtggtggagtacagcgacccctatgcagaagaagatcctccctgggcccccaggagctacctggagaaggtggtggccatctatgactacaccaaggacaaggaggatgagctgtccttccaggagggcgccatcatctacgtgatcaagaagaatgatgatggctggtatgaaggagtgatgaatggagtgacaggcctcttccctggcaactacgtggagagcatcatgcactacagcgagtag

SEQ ID NO: 21047 - DNA, 303 bp, Artificial Sequence
  Description of Artificial Sequence: Synthetic coding sequence
atggccagcgctggcacccagcactacagcatcggcctgcggcagaagaacagcttcaagcagagcggccccagcggcaccgtgcctgccaccccacctgagaagcccagcgagggccgggtgtggccccaggcccaccagcaggtgaagcccatctggaagctggagaagaagcaggtggagaccctgtctgctggcctgggccctggcctgctgggcgtgcccccccagcctgcctacttcttctgccccagcaccctgtgcagcagcggcaccacagctgtgattgctggccacagctag

SEQ ID NO: 21048 - DNA, 1212 bp, Artificial Sequence
  Description of Artificial Sequence: Synthetic coding sequence
atggccagcgccctgcggcccccccgggtgcccaagcccaagggcgtgctgcccagccactactatgagagcttcctggagaagaagggcccctgtgaccgggactacaagaagttctgggccggcctgcagggcctgaccatctacttctacaacagcaacagagacttccagcacgtggagaagctgaacctgggcgcctttgagaagctgacagatgagatcccctggggcagcagccgggaccccggcacccacttcagcctcatcctgcgggaccaggagatcaagttcaaggtggagaccctggagtgccgggagatgtggaagggcttcatcctgactgtggtggagctgcgggtgcccacagacctgaccctgctgcccggccacctgtacatgatgtctgaggtgctggccaaggaggaggcccggcgggccctggagacccccagctgcttcctgaaggtgtcccggctggaggcccagctgctgctggagcgctacccagaatgtggcaacctgctgctgcggcccagcggagatggagcagatggagtgtctgtgaccacccggcagatgcacaacggcacccacgtggtgcgccactacaaggtgaagcgggagggccccaagtatgtgattgatgtggagcagcccttcagctgcaccagcctggatgctgtggtgaactactttgtgagccacaccaagaaggccctggtgcccttcctgctggatgaggactatgagaaggtgctgggctacgtggaggccgacaaggaaaatggagaaaatgtgtgggtggcccccagcgcccctggccctggccctgccccctgcaccggcggccccaagcccctgagccctgccagcagccaggacaagctgccccccctgccccccctgcccaaccaggaggagaactacgtgacccccatcggagatggccctgctgtggactatgagaaccaggatgtggccagcagctcctggcctgtgatcctgaagcccaagaagctgcccaagcccccagccaagctgcccaagccccctgtgggccccaagccagagcccaaggtgttcaatggaggcctgggcaggaagctgcctgtgagcagcgcccagcccctcttccccacagctggcctggccgacatgacagctgagctgcagaagaagctggagaagaggcgggccctggagcactag

SEQ ID NO: 21049 - DNA, 1551 bp, Artificial Sequence
  Description of Artificial Sequence: Synthetic coding sequence
atgctgcggcggggcagccaggccctgcggcgcttcagcacaggccgggtgtacttcaagaacaagctgaagctggccctgattggccagagcctgtttggccaggaggtgtacagccacctgaggaaggagggccaccgggtggtgggcgtcttcaccgtgcctgacaaggatggcaaggctgaccccctggccctggccgctgagaaggatggcacccctgtgttcaagctgcccaagtggagggtgaagggcaagaccatcaaggaggtggccgaggcctacagatctgtgggcgctgagctgaatgtgctgcccttctgcacccagttcatccccatggacatcatcgacagccccaagcacggcagcatcatctaccaccccagcatcctgcccaggcacagaggagccagcgccatcaactggaccctcatcatgggagacaagaaggccggcttctctgtgttctgggcagatgatggcctggacaccggccccatcctgctgcagaggagctgtgatgtggagcccaatgacacagtggatgccctgtacaaccgcttcctgtttcctgagggcatcaaggccatggtggaggccgtgcagctgattgctgatggcaaggccccccgcatcccccagcctgaggagggcgccacctatgagggcatccagaagaaggaaaatgctgagatctcctgggaccagagcgctgaggtgctgcacaactggatccggggccatgacaaggtgcctggggcctggacagagatcaatggccagatggtgaccttctacggcagcaccctgctgaacagctctgtgcccccaggagagcccctggagatcaagggggccaagaagccaggcctggtgaccaagaatggcctggtgctgtttggaaatgatggcaaggccctgactgtgaggaacctgcagtttgaagatggcaagatgatcccagccagccagtacttcagcactggagagacctctgtggtggagctgacagctgaggaggtgaaggtggccgagaccatcaaggtgatctgggccggcatcctgagcaatgtgcccatcatcgaggacagcacagacttcttcaagagcggggccagctccatggatgtggcccggctggtggaggagatccggcagaagtgtggcggcctgcagctgcagaatgaagatgtgtacatggccaccaagtttgagggcttcatccagaaggtggtgaggaagctgcggggggaggaccaggaggtggagctggtggtggactacatcagcaaggaggtgaatgagatcatggtgaagatgccctaccagtgcttcatcaatggccagttcacagatgctgatgatggcaagacctatgacaccatcaaccccacagatggcagcaccatctgcaaggtgtcctatgccagcctggctgatgtggacaaggctgtggccgccgccaaggatgcctttgaaaatggagagtggggccgcatgaatgcccgggagcggggccgcctgatgtacagcatgaggatgaactag

SEQ ID NO: 21050 - DNA, 1581 bp, Artificial Sequence
  Description of Artificial Sequence: Synthetic coding sequence
atggaggagatcccagcccaggaggccgccggcagcccccgggtgcagttccagagcctggagacccagagtgaatgtctgagccctgagccccagtttgtgcaggacacagacatggagcagggcctgaccggcggcttccccatcagcaagccagatggcatcagccagctggagcaggacctgcaggtgtttgacctggagaccaagacccgggaggtgctgagagatgactgcagtgatggagagacccgggaggagaacaagctgctgatccccaagcagaagatcagcgaggaggtgcacagctacaaggtgcgggtgggccgcctgaagcatgacatcacccaggtgcctgagacccgggaggtgtacaagtctgaggaccggctggagcggctgcaggagatcctgaggaagttcctgtacctggagcgggagttccggcagatcaccatcagcaaggagaccttcaccagcgagaagaacaatgaatgtcatgagcctgagaagagcttcagcctggacagcaccattgatgctgaccagagggtgctgcgcatccagaacacagatgacaatgacaagtatgacatgtccttcaaccagaacagcgccagcggcaagcatgagcacctgaacctgacagaggacttccagagcagcgagtgcaaggagagcctgatggacctgagccacctgaacaagtgggagagcatccccaacacagagaagagctacaagtgtgatgtgtgtgggaagatcttccaccagagcagcgccctgaccaggcaccagaggatccacacccgggagaagccctacaagtgcaaggaatgtgagaagagcttcagccagagcagcagcctgagccgccacaagaggatccacacccgggagaagccctacaagtgtgaggccagtgacaagagctgtgaggccagtgacaagagctgcagccccagcagcggcatcatccagcacaagaagatccacacccgggccaagagctacaagtgcagcagctgtgagagggtcttcagccgctctgtgcacctgacccagcaccagaagatccacaaggagatgccctgcaagtgcaccgtgtgtggcagtgacttctgccacaccagctacctgctggagcaccagagggtgcaccacgaggagaaggcctatgaatatgatgaatatggcctggcctacatcaagcagcagggcatccacttccgggagaagccctacacctgcagtgaatgtgggaaggacttccggctgaacagccacctgatccagcaccagaggatccacactggagagaaggcccacgagtgcaatgaatgtgggaaggccttcagccagaccagctgcctgatccagcaccacaagatgcacaggaaggagaagagctatgagtgcaatgaatatgagggcagcttcagccacagcagtgacctgatcctgcagcaggaggtgctgacccggcagaaggcctttgactgtgatgtgtgggagaagaacagcagccagagggcccacctggtgcagcaccagagcatccacaccaaggagaacagctag

SEQ ID NO: 21051 - DNA, 603 bp, Artificial Sequence; identical to SEQ ID NO: 21042
  Description of Artificial Sequence: Synthetic coding sequence

SEQ ID NO: 21052 - DNA, 540 bp, Artificial Sequence
  Description of Artificial Sequence: Synthetic coding sequence
aacatcaagccaggagagggcctgggcatgtacatcaagagcacctatgatggcctgcacgtgatcaccggcaccacagaaaatgtgggctggcagctgaagaacctggtgaagaagctgcgggagaaccccactggagtggtgctgctgctgaagaagaggcccaccggcagcttcaacttcaccccagcccccctgaagaacctgcgctggaagccacccctggtgcagaccagccccccaccagccaccacccagagccctgagagcaccatggacaccagcctgaagaaggagaagagcgccatcctggacctgtacatccccccacctcctgctgtgccctacagccccagagatgaaaatggcagctttgtgtatggaggcagcagcaagtgcaagcagcccctgcccggccccaagggcagcgagagccccaacagcttcctggaccaggagagcagaagaagacgcttcaccatcgctgacagcgaccagctgcccggctacagcgtggagaccaacatcctgcccacctag

SEQ ID NO: 21053 - DNA, 1368 bp, Artificial Sequence
  Description of Artificial Sequence: Synthetic coding sequence
atgatgggcgcccccaacctgattgctgacagcatggagtatggcctgagctacagcgtcatctcctacctgaagaagctgagccagcaggccaagattgaaagtgacagagtgattggctctgtgggcaagaaggtggtgcaggagaccggcatcaaggtgcgcagccgcagccacggcctgtccatggcctacaggaaggacttccagcagctgctgcagggcatcagtgaagatgtgccccaccggctgctggacctgaacatgaaggagtacacaggcttccaggtggccctgctgaacaaggacctgaagccccagaccttcagaaatgcctatgacatccccaggaggaacctgctggaccacctgaccaggatgaggagcaacctgctgaagagcacccggcgcttcctgaagggccaggatgaggaccaggtgcacagcgtgcccatcgcccagatgggcaactaccaggagtacctgaagcaggtgcccagccccctgcgggagctggaccctgaccagccccggcggctgcacacctttggaaaccccttcaagctggacaagaagggcatgatgattgatgaagcagatgaatttgtggccggcccccagaacaagcacaagaggcctggagagcccaacatgcagggcatccccaagagaagacgctgcatgagccccctgctgcggggccggcagcagaaccctgtggtgaacaaccacatcggcggcaagggccccccagcccccaccacccaggcccagcctgacctgatcaagcccctgcccctgcacaagatcagcgagaccaccaatgacagcatcatccatgatgtggtggagaaccacgtggccgaccagctgagcagtgacatcaccccaaatgccatggacacagagttcagcgccagcagccctgccagcctgctggagcggcccaccaaccacatggaggccctgggccatgaccacctgggcaccaatgacctgactgtgggcggcttcctggagaaccacgaggagccccgggacaaggagcagtgtgccgaggagaacatcccagccagcagcctgaacaagggcaagaagctgatgcactgccgcagccatgaggaggtgaacacagagctgaaggcccagatcatgaaggagatcaggaagccaggcaggaaatatgagcgcatcttcaccctgctgaagcacgtgcagggcagcctgcagaccaggctcatcttcctgcagaatgtcatcaaggaggccagccgcttcaagaagaggatgctgattgagcagctggagaacttcctggatgagatccaccggcgggccaaccagatcaaccacatcaacagcaactag

SEQ ID NO: 21054 - DNA, 1467 bp, Artificial Sequence
  Description of Artificial Sequence: Synthetic coding sequence
ctggactgtggcccccggctgcctgtggaggtgggccccagcctgagcagccccagcagcggctgtggggagggcagcatctctgtgggagaaaatgtgtctgatgtggcccccacccagccctggtggcccaacacccctggggacagcgtgtctgaggagctgggccctggccgcagcggggacacagaggacctgagccccaactggcccctgaacagccaggaggacacagctgcccagagcagccctggccgcggggaggaggccgaggccagcgctgctgaggcccagggcggggagcaggcctacctggccggcctggccggccagtaccacctggagcgctacccagacagctatgaatccatgtctgagccccccatcgcccacctgctgcggcctgtgctgccccgggcctttgccttccctgtggacccccaggtgcagagcgctgctgatgaaacagctgtgcagctgtctgagctgctgaccctgcctgtgctgatgaagaggagcatcacagcccccctggccgcccacatcagcctggtgaacaaggctgctgtggactacttctttgtggagctgcacctggaggcccactatgaggccctgcggcacttcctgctgatggaggatggagaatttgcccagagcctgagtgacctgctgtttgagaagctgggcgccggccagaccccaggagagctgctgaaccccctggtgctgaacagcgtgctgagcaaggccctgcagtgcagcctgcatggagacaccccccacgccagcaacctgagcctggccctgaagtacctgcctgaggtgtttgccccaaatgccccagatgtgctgagctgcctggagctgcgctacaaggtggactggcccctgaacatcgtcatcacagagggctgtgtgtccaagtacagcggggtcttctccttcctgctgcagctgaagctgatgatgtgggccctgaaggatgtgtgcttccacctgaagaggacagtgcccagcgctgctgctgtgcaggccagagatgctgccttccgggagggccaccctggcctgcaccggcagcctgaccctgcccggcacctggtgcgggtgcagggccaggtgggccaccggggccggcctggaggagaccctgcctgtgccaggagagtgcctgcccagggccgcctgcaggccgcccctgtgatgaatgtcatccacagcatcttcagcctggtgctgaagttccgcagccagctgatcagccaggcctggggccccccaggcggccccagaggagctgagcaccccaactttgccctgatgcagcagagctacaacaccttcaagtactacagccacttcctgttcaaggtggtgaccaagctggtgaacagaggctaccagccccacctggaggacttcctgctgcgcatcaacttcaacaactactaccaggatgcctag

SEQ ID NO: 21055 - DNA, 3819 bp, Artificial Sequence
  Description of Artificial Sequence: Synthetic coding sequence
atggccaatgacagccctgccaagagcctggtggacatcgacctgagcagcctgcgggaccctgctggcatctttgagctggtggaggtggtgggcaatggcacctacggccaggtgtacaagggccgccacgtgaagacaggccagctggccgccatcaaggtgatggatgtgacagaagatgaggaggaggagatcaagctggagatcaacatgctgaagaagtacagccaccacaggaacatcgccacctactacggggccttcatcaagaagagccccccaggccatgatgaccagctgtggctggtgatggagttctgtggggccggcagcatcacagacctggtgaagaacaccaagggcaacaccctgaaggaggactggatcgcctacatcagccgggagatcctgcggggcctggcccacctgcacatccaccacgtgatccaccgggacatcaagggccagaatgtgctgctgacagaaaatgctgaggtgaagctggtggactttggagtgtctgcccagctggacagaacagtgggcagaagaaacaccttcatcggcaccccctactggatggcccctgaggtgattgcctgtgatgagaacccagatgccacctatgactacagaagtgacctgtggagctgtggcatcacagccatcgagatggccgagggcgccccacccctgtgtgacatgcaccccatgagggccctcttcctgatccccagaaatcctccaccccggctgaagagcaagaagtggagcaagaagttcttctccttcatcgagggctgcctggtgaagaactacatgcagaggcccagcacagagcagctgctgaagcaccccttcatccgggaccagcccaatgaaaggcaggtgcgcatccagctgaaggaccacatcgacaggaccaggaagaagagaggagagaaggatgaaacagaatatgagtacagcggcagcgaggaggaggaggaggaggtgcctgagcaggagggggagcccagcagcatcgtgaatgtgcctggagagagcaccctgcggcgggacttcctgcggctgcagcaggagaacaaggagaggtctgaggccctgcggcggcagcagctgctgcaggagcagcagctgcgggagcaggaggagtacaagaggcagctgctggccgagcggcagaagagaattgagcagcagaaggagcagaggcggcggctggaggagcagcagaggcgggagcgggaggcccggcggcagcaggagcgggagcagaggagaagagagcaggaggagaagaggcggctggaggagctggagaggaggaggaaggaggaggaggagcggcggcgggcagaggaggagaagagaagagtggagcgggagcaggagtacatccggcggcagctggaggaggagcagaggcacctggaggtgctgcagcagcagctgctgcaggagcaggccatgctgctgcatgaccaccggcggccccacccccagcacagccagcagcccccaccaccccagcaggagaggagcaagcccagcttccacgcccctgagcccaaggcccactatgagcctgctgaccgggcccgggaggtggaggaccgcttcaggaagaccaaccacagcagccctgaggcccagagcaagcagacaggccgggtgctggagccccctgtgcccagccgctctgagagcttcagcaatggaaattctgagagcgtgcacccagccctgcagaggcctgctgagccccaggtgcctgtgaggaccaccagccgcagccctgtgctgagcagaagagacagccccctgcagggcagcggccagcagaacagccaggccggccagaggaacagcaccagcattgagccccggctgctgtgggagcgggtggagaagctggtgccccggcccggcagcggcagcagcagcggcagcagcaacagcggcagccagcccggcagccaccctggcagccagagcggcagcggggagcgcttccgggtgcgcagcagcagcaagtctgagggcagccccagccagaggctggagaatgctgtgaagaagccagaggacaagaaggaggtgttccggcccctgaagccagctgacctgacagccctggccaaggagctgcgggctgtggaggatgtgcggcccccccacaaggtgacagactacagcagcagcagcgaggagagcggcaccacagatgaggaggatgatgatgtggagcaggagggcgcagatgagagcaccagcggccctgaggacaccagggctgccagcagcctgaacctgagcaatggagaaacagagagcgtgaagaccatgattgtgcatgatgatgtggagagcgagcccgccatgacccccagcaaggagggcaccctgattgtgcggcagagcacagtggaccagaagagggccagccaccacgagagcaatggatttgctggccgcatccacctgctgcctgacctgctgcagcagagccacagcagcagcaccagcagcaccagcagcagccccagcagcagccagcccacccccaccatgagcccccagaccccccaggacaagctgacagccaatgagacccagagcgccagcagcaccctgcagaagcacaagagcagcagcagcttcacccccttcatcgacccccggctgctgcagatcagccccagcagcggcaccaccgtgacctctgtggtgggcttcagctgtgatggcatgaggcctgaggccatccggcaggaccccaccaggaaaggatctgtggtgaatgtgaaccccaccaacacccggccccagagcgacaccccagagatcaggaagtacaagaagcgcttcaacagcgagatcctgtgtgccgccctgtggggcgtgaacctgctggtgggcacagagagcggcctgatgctgctggacaggagcggccagggcaaggtgtaccccctcatcaacagaagacgcttccagcagatggatgtgctggagggcctgaatgtgctggtgaccatcagcggcaagaaggacaagctgcgggtgtactacctgtcctggctgaggaacaagatcctgcacaatgaccctgaggtggagaagaagcagggctggaccaccgtgggggacctggagggctgtgtgcactacaaggtggtgaagtatgaaagaatcaagttcctggtgattgccctgaagagctctgtggaggtgtatgcctgggcccccaagccctaccacaagttcatggccttcaagagctttggagagctggtgcacaagcccctgctggtggacctgactgtggaggagggccagaggctgaaggtgatctacggcagctgtgccggcttccacgctgtggatgtggacagcggctctgtgtatgacatctacctgcccacccacatccagtgcagcatcaagccccacgccatcatcatcctgcccaacacagatggcatggagctgctggtgtgctatgaagatgagggcgtgtatgtgaacacctacggccgcatcaccaaggatgtggtgctgcagtggggcgagatgcccacctctgtggcctacatccgcagcaaccagaccatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgtacttcatgaccctgggccgcaccagcctgctgtcctggtag

SEQ ID NO: 21056 - DNA, 363 bp, Artificial Sequence
  Description of Artificial Sequence: Synthetic coding sequence
gccctgcagatcagcgagaacctcttcagcaacaaggtgctgaatgccctgaagccagagaaggatgtggatggagtgacagacatcaacctgggcaagctggtgagaggagatgcccatgaatgttttgtgtcccctgtggccaaggccgtcatcgagctgctggagaagtctgtgggcgtgaacctggatggcaagaagatcctggtggtgggcgcccacggcagcctggaggccgccctgcagtgcctcttccagaggaagggctccatgaccatgagcatccagtggaagacccggcagctgcagagcaagacagagagccgctctgtgacccggctggagtgcagaagagtcatctag

SEQ ID NO: 21057 - DNA, 1866 bp, Artificial Sequence
  Description of Artificial Sequence: Synthetic coding sequence
atggtgtccatcctgagcagctttgagagccggctgatgaagctggagaacagcatcatccctgtgcacaagcagacagagaacctgcagaggctgcaggagaatgtggagaagaccctgagctgcctggaccacgtgatctcctactaccacgtggccagtgacacagagaagatcatccgggagggccccaccggccgcctggaggagtacctgggctccatggccaagatccagaaggctgtggagtacttccaggacaacagcccagacagccctgagctgaacaaggtgaagctgctgtttgagcggggcaaggaggccctggagagcgagttccgcagcctgatgaccaggcacagcaaggtggtgtcccctgtgctgatcctggacctgatctctggagatgatgacctggaggcccaggaggatgtgaccctggagcacctgcctgagagcgtgctgcaggatgtgatccgcatcagccgctggctggtggagtatggcaggaaccaggacttcatgaatgtgtactaccagatccgcagcagccagctggacaggagcatcaagggcctgaaggagcacttccacaagagcagcagcagcagcggcgtgccctacagccctgccatccccaacaagaggaaggacacccccaccaagaagcctgtgaagaggcctggcaccatcaggaaggcccagaacctgctgaagcagtacagccagcacggcctggatggcaagaagggcggcagcaacctgatccccctggagggcagagatgacatgctggatgtggagacagatgcctacatccactgtgtgtctgcctttgtgaagctggcccagagcgagtaccagctgctggccgacatcatccctgagcaccaccagaagaagacctttgacagcctcatccaggatgccctggatggcctgatgctggagggagaaaatattgtgtctgctgccaggaaggccatcgtgagacatgacttcagcacagtgctgactgtgttccccatcctgcggcacctgaagcagaccaagccagagtttgaccaggtgctgcagggcacagctgccagcaccaagaacaagctgcccggcctcatcacctccatggagaccatcggggccaaggccctggaggactttgctgacaacatcaagaatgaccctgacaaggagtacaacatgcccaaggatggcaccgtgcatgagctgaccagcaatgccatcctcttcctgcagcagctgctggacttccaggagacagctggggccatgctggccagccagggcaaggtgctgggcaacctgcagctgaacctgctgagcaagagcaaggtgtatgaggaccctgccctgagcgccatcttcctgcacaacaactacaactacatcctgaagagcctggagaagtctgagctgatccagctggtggccgtgacccagaagacagctgagaggagctaccgggagcacatcgagcagcagatccagacctaccagaggtcctggctgaaggtgacagactacatcgccgagaagaacctgcccgtcttccagcccggggtgaagctgcgggacaaggagcggcagatcatcaaggagcgcttcaagggcttcaatgatggcctggaggagctgtgcaagatccagaaggcctgggccatcccagacacagagcagagggaccgcatccggcaggcccagaagaccatcgtgaaggagacctacggggccttcctgcagaagtttggatctgtgcccttcaccaagaaccctgagaagtacatcaagtatggagtggagcaggtgggggacatgattgaccggctgtttgacaccagcgcctag

SEQ ID NO: 21058 - DNA, 1344 bp, Artificial Sequence
  Description of Artificial Sequence: Synthetic coding sequence
atggacttcctgctgggcaaccccttcagcagccctgtgggccagagaattgagaaggccacagatggcagcctgcagagcgaggactgggccctgaacatggagatctgtgacatcatcaatgaaacagaggagggccccaaggatgccctgcgggctgtgaagaagagaattgtgggcaacaagaacttccacgaggtgatgctggccctgactgtgctggagacctgtgtgaagaactgtggccaccgcttccacgtgctggtggccagccaggactttgtggagagcgtgctggtgaggaccatcctgcccaagaacaacccccccaccatcgtgcatgacaaggtgctgaacctgatccagacagtgttcaacagcgagacccagagcggccaggacagcgtgggcacagacagcagccagcaggaggacagcggccagcacgccgcccccctgcctgccccacccatcctgagcggggacacccccatcgcccccaccccagagcagatcggcaagctgcggtctgagctggagatggtgtctggaaatgtgcgggtgatgtctgagatgctgacagagctggtgcccacccaggccgagcctgctgacctggagctgctgcaggagctgaacagaacctgccgggccatgcagcagagggtgctggagctgatcccccagatcgccaatgagcagctgacagaggagctgctgattgtgaatgacaacctgaacaacgtgttcctgcggcatgaaagatttgagcgcttcagaacaggccagaccaccaaggcccccagcgaggccgagcctgctgctgacctgattgacatgggccctgaccctgctgccactggaaacctgagcagccagctggccggcatgaacctgggcagcagctctgtgcgggccggcctgcagagcctggaggccagcggccgcctggaggatgaatttgacatgtttgccctgacccggggcagcagcctggccgaccagaggaaggaggtgaagtatgaggccccccaggccacagatggcctggccggggccctggatgcccggcagcagagcactggagccatccctgtgacccaggcctgcctgatggaggacatcgagcagtggctgagcacagatgtgggcaatgatgctgaggagcccaagggcgtgaccagcgaggagtttgacaagttcctggaggagcgggccaaggctgctgaccggctgcccaacctgagcagccccagcgctgagggccccccaggcccccccagcggccctgcccccaggaagaagacccaggagaaggatgatgacatgctgtttgccctgtag

SEQ ID NO: 21059 - DNA, 2103 bp, Artificial Sequence
  Description of Artificial Sequence: Synthetic coding sequence
atggccaccatgatcccccctgtgaagctgaagtggctggagcacctgaacagctcctggatcacagaagattctgagagcatcgccacccgggagggcgtggccgtgctgtacagcaagctggtgagcaacaaggaggtggtgcccctgccccagcaggtgctgtgcctgaagggcccccagctgcctgactttgagcgggagagcctgagcagtgatgagcaggaccactacctggatgccctgctgagcagccagctggccctggccaagatggtgtgcagcgacagcccctttgctggggccctgaggaagaggctgctggtgctgcagagggtcttctacgccctgagcaacaagtaccatgacaagggcaaggtgaagcagcagcagcacagccctgagagcagcagcggcagcgcagatgtgcacagcgtgtctgagcggcccaggagcagcacagatgccctgattgagatgggcgtgaggacaggcctgagcctgctgtttgccctgctgcggcagagctggatgatgcctgtgtctggccctggcctgagcctgtgcaatgatgtgatccacacagccatcgaggtggtgagcagcctgccccccctgagcctggccaatgaaagcaagatcccccccatgggcctggactgcctgagccaggtgaccaccttcctgaagggcgtgaccatccccaacagcggggctgacaccctgggccggcggctggccagcgagctgctgctgggcctggccgcccagaggggcagcctgcgctacctgctggagtggattgagatggccctgggcgccagcgctgtggtgcacaccatggagaagggcaagctgctgagcagccaggagggcatgatcagctttgactgcttcatgaccatcctgatgcagatgagaagaagcctcatcagcgagaaccaggacagcgcagatgtggacccccaggagcacagcttcaccaggaccattgatgaggaggccgagatggaggagcaggccgagcgggaccgggaggagggccaccctgagccagaagatgaggaggaggagcgggagcacgaggtgatgacagctgggaagatcttccagtgcttcctgagcgcccgggaggtggcccggagccgggaccgggacaggatgaacagcggggccggcagcggggcccgggcagatgatcctccaccccagagccagcaggagaggagagtgtccacagacctgcctgagggccaggatgtgtacacagctgcctgcaacagcgtcatccaccgctgtgccctgctgatcctgggcgtgtcccctgtgattgatgagctgcagaagaggcgggaggagggccagctgcagcagcccagcaccagcgccagcgagggcggcggcctgatgaccaggtctgagagcctgacagctgagagccggctggtgcacaccagccccaactaccgcctcatcaagagccgctctgagagtgacctgagccagcctgagagtgatgaggagggctacgccctgtctggaagaagaaatgtggacctggacctggccgccagccacaggaagaggggccccatgcacagccagctggagagcctgagtgacagctgggcccggctgaagcacagccgggactggctgtgcaacagcagctacagctttgaaagtgactttgacctgaccaagagcctgggcgtgcacaccctgattgaaaatgtggtgtcctttgtgtctggagatgtgggcaatgcccctggcttcaaggagcctgaggagagcatgagcaccagcccccaggccagcatcatcgccatggagcagcagcagctgcgggcagagctgcggctggaggccctgcaccagatcctggtgctgctgagcggcatggaggagaagggcagcatcagcctggccggcagccggctgagcagcggcttccagagcagcaccctgctgacctctgtgcggctgcagttcctggccggctgcttcggcctgggcaccgtgggccacactggaggaaaaggagagagcggccgcctgcaccactaccaggacggcatccgggccgcccggggctactag

SEQ ID NO: 21060 - DNA, 537 bp, Artificial Sequence
  Description of Artificial Sequence: Synthetic coding sequence
atggctgacagagctgctgctgagcgggcctgcaaggaccccaaccccatcattgatggcaggaaggccaacgtgaacctggcctacctgggcgccaagccccgcatcatgcagcccggctttgcctttggagtgcagcagctgcacccagccctgatccagaggcccttcggcatcccagcccactacgtgtacccccaggcctttgtgcagcccggggtggtgatcccccacgtgcagcccacagctgctgctgccagcaccaccccctacatcgactacacaggagctgcctatgcccagtacagcgctgctgctgctgctgctgctgctgctgctgcctatgaccagtacccctatgctgccagccctgctgctgctggctacgtgacagctgggggctacggctatgctgtgcagcagcccatcacagctgctgcccctggaacagctgctgctgctgctgctgctgctgctgctgctgctgccttcggccagtaccagccccagcagctgcagacagacaggatgcagtag

SEQ ID NO: 21061 - DNA, 579 bp, Artificial Sequence; identical to SEQ ID NO: 20257
  Description of Artificial Sequence: Synthetic coding sequence

SEQ ID NO: 21062 - DNA, 555 bp, Artificial Sequence
  Description of Artificial Sequence: Synthetic coding sequence
atgaacagaagccagcccggcctgctgaggacagatcctgtgcctgaggagggagaagatgtggccgccaccatcagcgccacagagaccctgtctgaggaggagcaggaggagctgcggcgggagctggccaaggtggaggaggagatccagaccctgagccaggtgctggccgccaaggagaagcacctggccgagatcaagaggaagctgggcatcaacagcctgcaggagctgaagcagaacatcgccaagggctggcaggatgtgacagccaccagcgcctacaagaagaccagcgagaccctgagccaggccggccagaaggccagcgctgccttcagctctgtgggcagcgtcatcaccaagaagctggaggatgtgaagaacagccccaccttcaagagctttgaggagaaggtggagaacctgaagagcaaggtgggcggcaccaagccagctggaggagactttggagaggtgctgaacagcgctgccaatgccagcgccaccaccacagagcccctgcctgagaagacccaggagagcctgtag

SEQ ID NO: 21063 - DNA, 1620 bp, Artificial Sequence; identical to SEQ ID NO: 19050
  Description of Artificial Sequence: Synthetic coding sequence

SEQ ID NO: 21064 - DNA, 612 bp, Artificial Sequence
  Description of Artificial Sequence: Synthetic coding sequence
atggagccccccatggagcccagcggcggggagcaggagcccggggctgtgcgcttcctggacctgccctgggaggatgtgctgctgccccacgtgctgaacagagtgcccctgcggcagctgctgcggctgcagagggtgtcccgggccttccgcagcctggtgcagctgcacctggccggcctgcggagatttgatgctgcccaggtgggcccccagatccccagggctgccctggcccggctgctgagagatgctgagggcctgcaggagctggccctggccccctgccacgagtggctgagtgatgaggacctggtgcctgtgctggccaggaacccccagctgcggtctgtggccctgggcggctgcggccagctgagcagaagagccctgggcgccctggccgagggctgcccccggctgcagaggctgagcctggcccactgtgactgggtggatggcctggccctgcggggcctggccgaccgctgcccagccctggaggagctggacctgacagcctgccggcagctgaaggatgaggccatcgtgtacctggcccagaggagaggagctggcctgcggagcctgagcctggccgtgaactag

SEQ ID NO: 21065 - DNA, 1824 bp, Artificial Sequence
  Description of Artificial Sequence: Synthetic coding sequence
atggcccggggcctgggcaaggccagcggcttccctgctggccccagcggggctgagctgcctgccagcggcagaagaagaggccccctcatcagcctcttccctgctgtgctggccagcgaggccgccatgagctacccagcagatgattatgaaagtgaagctgcctatgacccctatgcctaccccagcgactatgacatgcacactggagaccccaagcaggacctggcctatgagcggcagtatgagcagcagacctaccaggtgattcctgaggtgatcaagaacttcatccagtacttccacaagacagtgtctgacctgattgaccagaaggtgtatgagctgcaggccagccgggtgtccagtgatgtgattgaccagaaggtgtatgagatccaggacatctatgaaaattcctggaccaagctgacagagcgcttcttcaagaacaccccctggccagaggccgaggccatcgccccccaggtgggcaatgatgctgtgttcctgatcctgtacaaggagctgtactaccgccacatctatgccaaggtgtctgggggccccagcctggagcagagatttgagagctactacaactactgcaacctcttcaactacatcctgaatgctgatggccctgcccccctggagctgcccaaccagtggctgtgggacatcattgatgagttcatctaccagttccagagcttcagccagtaccgctgcaagacagccaagaagtctgaggaggagattgacttcctgcggagcaaccccaagatctggaatgtgcacagcgtgctgaatgtgctgcacagcctggtggacaagagcaacatcaaccggcagctggaggtgtacaccagcggcggggaccctgagagcgtggccggggagtatggccgccacagcctgtacaagatgctgggctacttcagcctggtgggcctgctgcggctgcacagcctgctgggggactactaccaggccatcaaggtgctggagaacatcgagctgaacaagaagtccatgtacagccgggtgcctgagtgccaggtgaccacctactactacgtgggctttgcctacctgatgatgaggcgctaccaggatgccatccgggtgtttgccaacatcctgctgtacatccagaggaccaagtccatgttccagaggaccacctacaagtatgagatgatcaacaagcagaatgagcagatgcacgccctgctggccatcgccctgaccatgtaccccatgagaattgatgagagcatccacctgcagctgcgggagaagtatggagacaagatgctgaggatgcagaagggggacccccaggtgtatgaggagctgttctcctacagctgccccaagttcctgagccctgtggtgcccaactatgacaacgtgcaccccaactaccacaaggagcccttcctgcagcagctgaaggtgttcagtgatgaggtgcagcagcaggcccagctgagcaccatccgctccttcctgaagctgtacaccaccatgcctgtggccaagctggccggcttcctggacctgacagagcaggagttccgcatccagctgctggtgttcaagcacaagatgaagaacctggtgtggaccagcggcatcagcgccctggatggagagttccagagcgccagcgaggtggacttctacatcgacaaggacatgatccacatcgctgacaccaaggtggcccggcgctacggggacttcttcatccggcagatccacaagtttgaggagctgaacagaaccctgaagaagatgggccagaggccctag

SEQ ID NO: 21066 - DNA, 1308 bp, Artificial Sequence
  Description of Artificial Sequence: Synthetic coding sequence
atggccgccagcagcctggagcagaagctgagccggctggaggccaagctgaagcaggagaaccgggaggcccggaggagaattgacctgaacctggacatcagcccccagaggccccggcccatcatcgtcatcaccctgagccctgccccagcccccagccagagagctgccctgcagctgcccctggccaatgatggcggcagccgcagccccagcagcgagagcagcccccagcaccccaccccaccagcccggcccaggcacatgctgggcctgcccagcaccctcttcacccccaggtccatggagagcattgaaattgaccagaagctgcaggagatcatgaagcagacaggctacctgaccatcggcggccagcgctaccaggccgagatcaatgacctggagaacctgggggagatgggcagcggcacctgtggccaggtgtggaagatgaggttcaggaagacaggccacgtgattgctgtgaagcagatgaggaggagcggcaacaaggaggagaacaagaggatcctgatggacctggatgtggtgctgaagagccatgactgcccctacatcgtgcagtgcttcggcaccttcatcaccaacacagatgtgttcatcgccatggagctgatgggcacctgtgccgagaagctgaagaagaggatgcagggccccatccctgagcgcatcctgggcaagatgacagtggccatcgtgaaggccctgtactacctgaaggagaagcatggagtcatccacagagatgtgaagcccagcaacatcctgctggatgagcggggccagatcaagctgtgtgactttggcatcagcggccgcctggtggacagcaaggccaagaccaggtctgctggctgtgccgcctacatggcccctgagagaattgatcctccagaccccaccaagccagactatgacatccgggcagatgtgtggagcctgggcatcagcctggtggagctggccaccggccagttcccctacaagaactgcaagacagactttgaggtgctgaccaaggtgctgcaggaggagccccccctgctgcccggccacatgggcttcagcggggacttccagagctttgtgaaggactgcctgaccaaggaccacaggaagaggcccaagtacaacaagctgctggagcacagcttcatcaagagatatgagaccctggaggtggatgtggcctcctggttcaaggatgtgatggccaagacagagagccccaggaccagcggcgtgctgagccagccccacctgcccttcttcagatag

SEQ ID NO: 21067 - DNA, 3006 bp, Artificial Sequence
  Description of Artificial Sequence: Synthetic coding sequence
atggccagcagccccctgcccggccccaatgacatcctgctggccagccccagcagcgccttccagcctgacaccctgagccagcccaggcctggccacgccaacctgaagcccaaccaggtgggccaggtgatcctgtatggcatccccatcgtgtccctggtgattgatggccaggagcggctgtgcctggcccagatcagcaacaccctgctgaagaacttctcctacaatgagatccacaacagaagagtggccctgggcatcacctgtgtgcagtgcacccctgtgcagctggagatcctgcggcgggccggggccatgcccatcagcagcagaagatgtggcatgatcaccaagcgggaggccgagcggctgtgcaagagcttcctgggagaaaatcggccccccaagctgcctgacaactttgcctttgatgtgtcccatgaatgtgcctggggctgccggggcagcttcatcccagcccgctacaacagcagccgggccaagtgcatcaagtgcagctactgcaacatgtacttcagccccaacaagttcatcttccacagccacaggaccccagatgccaagtacacccagccagatgctgccaacttcaacagctggaggaggcacctgaagctgacagacaagagcccccaggatgagctggtgtttgcctgggaggatgtgaaggccatgttcaacggcggcagcaggaagagggccctgccccagcccggggcccacccagcctgccaccccctgagctctgtgaaggctgctgctgtggccgctgctgctgctgtggccggcggcggcggcctgctgggcccccacctgctgggcgcccctcctcctcctcctcctcctcctccacccctggccgagctggccggggcccctcatgcccaccacaagaggcccaggtttgatgatgatgatgacagcctgcaggaggccgctgtggtggccgccgccagcctgtctgctgctgctgccagcctgtctgtggccgccgccagcggcggggccggcactggaggcggcggggccggcggcggctgtgtggccggcgtgggcgtgggcgctggggccggggccggggccggggccggggccaagggccccaggagctaccctgtgattcctgtgcccagcaagggcagctttggaggagtgctgcagaagtttcctggctgcggcggcctcttcccccacccctacaccttccctgctgctgctgctgccttcagcctgtgccacaagaaggaggatgctggagctgctgctgaggccctgggcggggccggggccggcggggccggggccgcccccaaggccggcctgagcggcctcttctggccagctggcaggaaggatgccttctacccacccttctgcatgttctggccacccaggacccctgggggcctgcctgtgcccacctacctgcagcccccaccccagcccccatctgccctgggctgtgccctgggggagagccctgccctgctgcggcaggccttcctggacctggccgagcccggcggggccgccggcagcgctgaggccgcccctcctcctggccagcccccccaggtggtggccaacggccctggcagcggccccccacctcctgctgggggcgccggcagcagagatgccctgtttgagagccccccaggcggcagcggcggggactgcagcgctggcagcaccccacctgctgacagcgtggccgctgctggagctggagctgctgctgctggcagcggccctgctggcagccgggtgcctgccccccaccacccccacctgctggagggcaggaaggccggcggcggcagctaccaccacagcagcgccttccggcctgtgggcggcaaggatgatgctgagagcctggccaagctgcacggggccagcgctggggccccccacagcgcccagacccacccccaccaccaccaccacccccaccaccaccaccaccaccaccaccccccccagccccccagccccctgctgctgctgcccccccagccagatgagcccggcagcgagcggcaccacccagcccctcctcctcctcctcctcctcctcctcctccacccctggcccagcacccccaccaccggggcctgctgagccctgggggcaccagctgctgctaccccagcgaggacagcagtgaagatgaagatgatgaggaggaggagcaggaggtggatgtggagggccacaagcccccagagggggaggaggaggaggagggccgggaccctgatgatgatgaggaggaggatgaggagacagaggtgctgctgggggaccccctggtgggcggcggccgcttcctgcagggccggggccccagcgagaagggcagcagccgggaccgggccccagctgtggccggggccttccccctgggcctgaacagcagccggctgctgcaggaggatggcaagctgggggaccccggcagtgacctgcccccacctcctcctccacccctggccccccagaaggccagcggcggcggcagcagcagccctggcagccctgtgcaccaccccagcctggaggagcagcccagctacaaggacagccagaagaccaaggagaacaaccaggtgattgtgtccaccaaggatgacaacagcttcagtgacaagaacaaggagcacagcttcttcatcacagacagtgatgccagcggcggggacttctggagggagaggtctggagagcacacccaggagaccaacagcccccacagcctgaagaaggatgtggagaacatgggcaaggaggagctgcagaaggtgctgtttgagcagattgacctgcggcggcggctggagcaggagttccaggtgctgaagggcaacaccagcttccctgtgttcaacaacttccaggaccagatgaagcgggagctggcctaccgggaggagatggtgcagcagctgcagatcgtgtcctgcatcagcacctag

SEQ ID NO: 21068 - DNA, 198 bp, Artificial Sequence
  Description of Artificial Sequence: Synthetic coding sequence
atggccatggcccccagccccagcctggtgcaggtgtacaccagccctgctgctgtggccgtgtgggagtggcaggacggcctgggcacctggcacccctacagcgccaccgtgtgcagcttcatcgagcagcagtttgtgcagcagaagggccagcgcttcggcctgggcagcctggcccacagcatccccctgtag

SEQ ID NO: 21069 - DNA, 1041 bp, Artificial Sequence
  Description of Artificial Sequence: Synthetic coding sequence
atgatcagcaggcctgcctggctgtggggcgctgagatgggcgccaatgagcacggcgtgtgcatcgccaatgaggccatcaacacccgggagcctgctgctgagattgaggccctgctgggcatggacctggtgcggctgggcctggagcggggggagacagccaaggaggccctggatgtgattgtgtccctgctggaggagcacggccagggcggcaactactttgaagatgccaacagctgccacagcttccagagcgcctacctgattgtggacagagatgaggcctgggtgctggagaccatcggcaagtactgggccgctgagaaggtgacagaaggagtgcgctgcatctgcagccagctgagcctgaccaccaagatggatgctgagcaccctgagctgcggagctatgcccagagccagggctggtggacaggagagggggagttcaacttcagcgaggtgttcagccctgtggaggaccacctggactgtggggccggcaaggacagcctggagaagcaggaggagagcatcaccgtgcagaccatgatgaacaccctgcgggacaaggccagcggcgtgtgcattgattctgagttcttcctgaccacagccagcggcgtgtctgtgctgccccagaacagaagcagcccctgcatccactacttcaccggcaccccagaccccagccgcagcatcttcaagcccttcatctttgtggatgatgtgaagctggtgcccaagacccagagcccctgctttggagatgatgatcctgccaagaaggagccccgcttccaggagaagccagacagaagacatgagctgtacaaggcccacgagtgggcccgggccatcatcgagagtgaccaggagcagggcaggaagctgcggagcaccatgctggagctggagaagcagggcctggaggccatggaggagatcctgaccagcagcgagcccctggaccctgctgaggtgggggacctcttctatgactgtgtggacacagagatcaagttcttcaagtag

SEQ ID NO: 21070 - DNA, 1620 bp, Artificial Sequence; identical to SEQ ID NO: 19050
  Description of Artificial Sequence: Synthetic coding sequence

SEQ ID NO: 21071 - DNA, 390 bp, Artificial Sequence; identical to SEQ ID NO: 19988
  Description of Artificial Sequence: Synthetic coding sequence

SEQ ID NO: 21072 - DNA, 1740 bp, Artificial Sequence
  Description of Artificial Sequence: Synthetic coding sequence
atgtctgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagagatcggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcagagcgctgccaaccctgagacccccaacagcaccatcagccgggaggccagcacccagagcagcagcgctgctgccagccagggctgggtgctgcctgagggcaagatcgtgcccaacacagtgtttgtgggcggcattgatgccaggatggatgaaacagaaattggcagctgcttcggccgctatggctctgtgaaggaggtgaagatcatcaccaacagaactggagtgtccaagggctacggctttgtgtcctttgtgaatgatgtggatgtgcagaagatcgtgggcagccagatccacttccacggcaagaagctgaagctgggccctgccatcaggaagcagaagctgtgtgcccggcacgtgcagccccggcccctggtggtgaaccccccacctccaccccagttccagaatgtgtggaggaaccccaacacagagacctacctgcagccccagatcacccccaaccctgtgacccagcacgtgcaggcctacagcgcctacccccacagccctggccaggtgatcaccggctgccagctgctggtgtacaactaccaggagtaccccacctacccagattctgccttccaggtgaccaccggctaccagctgcctgtgtacaactaccagcccttccctgcctaccccaggagccccttccaggtgacagctggctaccagctgcctgtgtacaactaccaggccttccctgcctaccccaacagccccttccaggtggccaccggctaccagtttcctgtgtacaactaccagcccttccctgcctaccccagcagccccttccaggtgacagctggctaccagctgcctgtgtacaactaccaggccttccctgcctaccccaacagccccttccaggtggccaccggctaccagtttcctgtgtacaactaccaggccttccctgcctaccccaacagccctgtgcaggtgaccaccggctaccagctgcctgtgtacaactaccaggccttccctgcctaccccagcagccccttccaggtgaccaccggctaccagctgcctgtgtacaactaccaggccttccctgcctaccccaacagcgctgtgcaggtgaccaccggctaccagttccacgtgtacaactaccagatgccaccccagtgccctgtgggggagcagaggaggaacctgtggacagaggcctacaagtggtggtacctggtgtgcctgatccagaggcgggactag

SEQ ID NO: 21073 - DNA, 831 bp, Artificial Sequence
  Description of Artificial Sequence: Synthetic coding sequence
atgtatgcctcctggaccaaggcctgccggggcctggaggagctgatcaacctgacccggctgaatgtgtcctacaaccacattgatgacctgagcggcctcatccccctgcacggcatcaagcacaagctgcgctacatcgacctgcacagcaacagaattgacagcatccaccacctgctgcagtgcatggtgggcctgcacttcctgaccaacctgatcctggagaaggatggagatgacaaccctgtgtgccgcctgcccggctaccgggccgtcatcctgcagaccctgccccagctgcgcatcctggactgcaagaacatctttggagagcctgtgaacctgacagagatcaacagcagccagctgcagtgcctggagggcctgctggacaacctggtgtccagtgacagccccctgaacatcagtgaagatgagatcatcgacaggatgcctgtgatcacagcccccattgatgagctggtgcccctggagcagtttgccagcacccccagtgatgctgtgctgaccagcttcatgtctgtgtgccagagcagcgagcctgagaagaacaaccatgaaaatgacctgcagaatgagatcaagctgcagaagctggatgaccagatcctgcagctgctgaatgagaccagcaacagcattgacaacgtgctggagaaggacccccggcccaagagggacacagacatcaccagcgagagtgactatggcaacagcaggaagaatggagagaccaagaaggctgctgctggcagcacagacaagacagacccccggggcggcacccagagcttcagctgcaggtag

SEQ ID NO: 21074 - DNA, 1995 bp, Artificial Sequence
  Description of Artificial Sequence: Synthetic coding sequence
atgggagatgatggcagccccccagccaagaagatgatcacagacatccacgccaacgggaagaccatcaacaaggtgcccaccgtgaagaaggagcacctggatgattatggagaggcccctgtggagacagatggagagcacgtgaagaggacctgcacctctgtgcctgagaccctgcacctgaaccccagcctgaagcacaccctggcccagttccacctgagcagccagagcagcctgggcggccctgctgccttcagcgcccggcacagccaggagagcatgagccccaccgtcttcctgcccctgcccagcccccaggtgctgcccggccccctgctgatccccagcgacagcagcacagagctgacccagacagtgctggagggggagagcatcagctgcttccaggtgggcggggagaagaggctgtgcctgccccaggtgctgaacagcgtgctgcgggagttcaccctgcagcagatcaacacagtgtgtgatgagctgtacatctactgcagccgctgcaccagtgaccagctgcacatcctgaaggtgctgggcatcctgcccttcaatgcccccagctgtggcctcatcaccctgacagatgcccagaggctgtgcaatgccctgctgcggcccaggaccttcccccagaatggatctgtgctgcctgccaagagcagcctggcccagctgaaggagaccggcagcgcctttgaggtggagcatgaatgtctgggcaagtgccagggcctgtttgccccccagttctacgtgcagccagatgccccctgcatccagtgcctggagtgctgcggcatgtttgccccccagacctttgtgatgcacagccacaggagcccagacaagaggacctgccactggggctttgagagcgccaagtggcactgctacctgcacgtgaaccagaagtacctgggcaccccagaggagaagaagctgaagatcatcctggaggagatgaaggagaagttctccatgaggtctgggaagaggaaccagagcaagacagatgcccccagcggcatggagctgcagagctggtaccctgtgatcaagcaggagggggaccacgtgtcccagacccacagcttcctgcaccccagctactacctgtacatgtgtgacaaggtggtggcccccaacgtgtccctgaccagcgctgtgtcccagagcaaggagctgaccaagacagaggccagcaagagcatcagccggcagagcgagaaggcccacagcagcggcaagctgcagaagacagtgtcctacccagatgtgtccctggaggagcaggagaagatggacctgaagaccagccgggagctgtgcagccggctggatgccagcatcagcaacaacagcaccagcaagaggaagtctgagagcgccacctgcaacctggtgcgggacatcaacaaggtgggcatcggcctggtggccgccgccagcagccccctgctggtgaaggatgtgatctgtgaagatgacaagggcaagatcatggaggaggtgatgaggacctacctgaagcagcaggagaagctgaacctgatcctgcagaagaagcagcagctgcagatggaggtgaagatgctgagcagcagcaagtccatgaaggagctgacagaggagcagcagaacctgcagaaggagctggagagcctgcagaatgaacatgcccagaggatggaggagttctacgtggagcagaaggacctggagaagaagctggagcagatcatgaagcagaagtgcacctgtgacagcaacctggagaaggacaaggaggccgagtatgccggccagctggccgagctgcggcagaggctggaccatgctgaggccgaccggcaggagctgcaggatgagctgcggcaggagcgggaggcccggcagaagctggagatgatgatcaaggagctgaagctgcagatcctgaagagcagcaagacagccaaggagtag

SEQ ID NO: 21075 - DNA, 1068 bp, Artificial Sequence
  Description of Artificial Sequence: Synthetic coding sequence
atgggcagaagagacctggtgtctgggggcagcaatgaaggaaatggcaaggaggactgggccatgaagacagtgtccctgcgctggaccaagctgccccctgtgaagagcgccatccggggccaggcccctgtggtgccctacatgagatatggccacagcacagtgctgattgatgacacagtgctgctgtggggcggcagaaatgacacagaaggagcctgcaatgtgctgtatgcctttgatgtgaacacccacaagtggttcaccccccgggtgtctggcaccgtgcctggggccagagatggccacagcgcctgtgtgctgggcaagatcatgtacatctttggaggctatgagcagcaggccgactgcttcagcaatgacatccacaagctggacaccagcaccatgacctggaccctcatctgcaccaagggcagccctgcccgctggagggacttccacagcgccaccatgctgggcagccacatgtatgtgtttggaggccgggctgacagatttggccccttccacagcaacaatgagatctactgcaaccgcatccgggtgtttgacaccaggacagaggcctggctggactgcccccccacccctgtgctgcctgagggccgccgcagccacagcgccttcggctacaatggagagctgtacatctttggaggctacaatgcccggctgaacagacacttccatgacctgtggaagttcaaccctgtgtccttcacctggaagaagattgagcccaagggcaagggcccctgcccccggcggcggcagtgctgctgcatcgtgggggacaagatcgtgctgtttggaggcaccagccccagccctgaggagggcctgggagatgaatttgacctgattgaccacagcgacctgcacatcctggacttcagccccagcctgaagaccctgtgcaagctggccgtcatccagtacaacctggaccagagctgcctgccccatgacatccgctgggagctgaatgccatgaccaccaacagcaacatcagccggcccatcgtgagcagccacggctag

SEQ ID NO: 21076 - DNA, 1245 bp, Artificial Sequence; identical to SEQ ID NO: 18327
  Description of Artificial Sequence: Synthetic coding sequence

SEQ ID NO: 21077 - DNA, 1200 bp, Artificial Sequence
  Description of Artificial Sequence: Synthetic coding sequence
atggccactggagacctgaagaggagcctgaggaacctggagcaggtgctgcggctgctgaactacccagaggaggtggactgtgtgggcctcatcaagggggaccctgctgccagcctgcccatcatctcctacagcttcaccagctacagcccctacgtgacagagctgatcatggagagcaatgtggagctgattgccaagaatgacctgcgcttcattgatgctgtgtacaagctgctgcgggaccagttcaactacaagcccatcctgaccaagaagcagttcatccagtgtggctttgctgagtggaagatccagatcgtgtgtgacatcctgaactgtgtgatgaagaagcacaaggagctgagcagcctgcagaagatccccagccagcagaggaagaagatcagcagcggcaagtctgagccccccctgggcaatgagaagatctctgctgaggccgtgggcgtggacatcagcggccgcttcatgaccagcggcaagaagaaggctgtggtgatccgccacctgtacaatgaagataatgtggacatcagcgaggacaccctgagccccatcacagatgtgaatgaggccgtggatgtgtctgacctgaatgccacagagatcaagatgcctgaggtgaaggtgcctgagatcaaggccgagcagcaggatgtgaatgtgaaccctgagatcacagccctgcagaccatgctggccgagtgccaggagaacctgaagaagctgaccagcattgagaagaggctggactgcctggagcagaagatgaagggcaaggtgatggtggatgagaacacctggaccaacctgctgagccgggtgaccctgctggagacagagatgctgctgagcaagaagaatgatgagttcatcgagttcaatgaggtgtctgaagattatgccagctgcagcgacatggacctgctgaacccccacaggaagtctgaggtggagaggcctgccagcatccccctgagcagcggctacagcacagccagcagtgacagcaccccccgggccagcacagtgaactactgcggcctgaatgagatcagcgagaacttccctgcctggagcgccaccagcagctgcagcagcctgtcctggctgctgcggggccacaccagctacctgagcagccagagctttgcctggcccctgagctgtgtgtag

SEQ ID NO: 21078 - DNA, 1317 bp, Artificial Sequence
  Description of Artificial Sequence: Synthetic coding sequence
tgatgtgccggggctgagcggccccggcggcggggccgcctgtgggacagcagcggcgtgccccagaggcagaagaggcctggcccctggaggacccagacccaggagcagatgagcagagatgtgtgcatccacacctggccctgcacctactacctggagcccaagaggcgctgggtgacaggccagctgagcctgaccagcctgagcctgcgcttcatgacagacagcactggagagatcctggtgtccttccccctgagcagcatcgtggagatcaagaaggaggccagccacttcatcttcagcagcatcaccatcctggagaagggccacgccaagcactggttcagcagcctgcggcccagcagaaatgtggtgttcagcatcatcgagcacttctggagggagctgctgctgagccagcctggagctgtggctgatgcctctgtgcccaggaccagaggagaggagctgaccggcctgatggccggcagccagaagaggctggaggacacagcccgggtgctgcaccaccagggccagcagctggacagcgtgatgaggggcctggacaagatggagagtgacctggaggtggccgaccggctgctgacagagctggagagccctgcctggtggcccttcagcagcaagctgtggaagaccccacctgagaccaagcccagagaagatgtgtccatgaccagctgtgagccctttgggaaggagggcatcctgatcaagatcccagctgtgatcagccacaggacagagagccacgtgaagccaggccgcctgactgtgctggtgtctggcctggagatccatgacagcagcagcctgctgatgcacagatttgagcgggaggatgtggatgacatcaaggtgcacagcccctatgagatcagcatccggcagcgcttcatcggcaagccagacatggcctaccgcctcatcagcgccaagatgcctgaggtgatccccatcctggaggtgcagttcagcaagaagatggagctgctggaggatgccctggtgctgcggagcgcccggaccagcagccctgctgagaagagctgcagcgtgtggcacgccgccagcggcctgatgggccgcaccctgcaccgggagcccccagctggggaccaggagggcacagccctgcacctgcagaccagcctgcctgccctgtctgaggccgacacccaggagctgacccagggcttccggcccatgagcctgagcacccagacagtgctggtgatgctgtgcagcgagagcgctggggccctgtggaggcagaggctgtcctag

SEQ ID NO: 21079 - DNA, 711 bp, Artificial Sequence
  Description of Artificial Sequence: Synthetic coding sequence
atgacaggctatgaggcccggctcatcaccttcggcacctggatgtacagcgtgaacaaggagcagctggcccgggccggcttctacgccatcggccaggaggacaaggtgcagtgcttccactgcggcggcggcctggccaactggaagcccaaggaggacccctgggagcagcacgccaagtggtacccaggctgcaagtacctgctggaggagaagggccacgagtacatcaacaacatccacctgaccaggagcctggagggcgccctggtgcagaccaccaagaagacccccagcctgaccaagaggatcagtgacaccatcttccccaaccccatgctgcaggaggccatccgcatgggctttgacttcaaggatgtgaagaagatcatggaggagcgcatccagaccagcggcagcaactacaagaccctggaggtgctggtggccgacctggtgtctgcccagaaggacaccacagaaaatgagctgaaccagaccagcctgcagcgggagatcagccctgaggagcccctgcggcggctgcaggaggagaagctgtgcaagatctgcatggacagacacatcgctgtggtgttcatcccctgtggccacctggtgacctgcaagcagtgtgccgaggccgtggaccgctgccccatgtgcagcgctgtgattgacttcaagcagagggtcttcatgtcctag

SEQ ID NO: 21080 - DNA, 285 bp, Artificial Sequence
  Description of Artificial Sequence: Synthetic coding sequence
atgaaccccaccaaccccttcagcggccagcagcccagcgccttcagcgccagcagcagcaatgtgggcaccctgcccagcaagccacccttccgcttcggccagcccagcctgtttggccagaacagcaccctgagcggcaagagcagcggcttcagccaggtgtcctccttccctgccagcagcggcgtgagccacagcagctctgtgcagaccctgggcttcacccagaccagctctgtgggccccttcagcggcctggagcacaccagcacctttgtgtag

SEQ ID NO: 21081 - DNA, 723 bp, Artificial Sequence
  Description of Artificial Sequence: Synthetic coding sequence
atggccatcgtgcagaccctgcctgtgcccctggagcccgcccctgaggccgccacagccccccaggcccctgtgatgggctctgtgagcagcctcatcagcggccggccctgccctgggggccctgccccacccaggcaccacggccccccaggccccaccttcttccggcagcaggacggcctgctgcggggcggctatgaggcccaggagcccctgtgcccagctgtgccccccaggaaggctgtgcctgtgaccagcttcacctacatcaatgaagacttcagaacagagagcccccccagccccagcagtgatgtggaggatgcccgggagcagagggcccacaatgcccacctgcggggccccccacccaagctgatccctgtgtctgggaagctggagaagaacatggagaagatcctgatccggcccacagccttcaagcctgtgctgcccaagcccaggggggcccccagcctgcccagcttcatgggcccccgggccaccggcctgagcggcagccagggcagcctgacccagctgtttggaggccctgccagcagcagcagcagcagcagcagcagcagcgctgctgacaagcccctggccttcagcggctgggccagcggctgccccagcggcaccctgagtgacagcggcaggaacagcctgagcagcctgcccacctacagcactggaggagctgagcccaccacctag

SEQ ID NO: 21082 - DNA, 1317 bp, Artificial Sequence; identical to SEQ ID NO: 18931
  Description of Artificial Sequence: Synthetic coding sequence

SEQ ID NO: 21083 - DNA, 678 bp, Artificial Sequence
  Description of Artificial Sequence: Synthetic coding sequence
atggaggaggaggagatgaatgatggcagccagatggtgcgcagccaggagagcctgaccttccaggatgtggccgtggacttcacccgggaggagtgggaccagctgtacccagcccagaagaacctgtacagagatgtgatgctggagaactacagaaacctggtggccctgggctaccagctgtgcaagccagaggtgattgcccagctggagctggaggaggagtgggtgattgagcgggacagcctgctggacacccaccctggggaccagagccacgtgatgtctgtggtgcgcagctctgtgcacgcccgctggatcgtgggcaaggtgattggcaccaagatgcagaagacagccaaggtgcgggtgacccggctggtgctggacccctacctgctgaagtacttcaacaagaggaagacctactttgcccatgatgccctgcagcagtgcaccgtgggggacatcgtgctgctgcgggccctgcctgtgccccgggccaagcacgtgaagcatgagctggccgagatcgtgttcaaggtgggcaaggtgattgatcctgtgacaggcaagccctgtgccggcaccacctacctggagagccccctgagcagcgagaccacccagctgagcaagaacctggaggagctgaacatcagcagcgcccagtag

SEQ ID NO: 21084 - DNA, 753 bp, Artificial Sequence
  Description of Artificial Sequence: Synthetic coding sequence
atgaccaccaagaacctggagaccaaggtgacagtgaccagcagccccatcagaggagctggagatggcatggagacagaggagccccccaagtctgtggaggtgaccagcggcgtgcagagcaggaagcaccacagcctgcagagcccctggaagaaggctgtgcccagcgagagccctggggtgctgcagctgggcaagatgctgacagagaaggccatggaggtgaaggctgtgcgcatcctggtgcccaaggccgccatcacccatgacatccccaacaagaacaccaaggtgaagagcctgggccaccacaagggggagttcctgggccagagcgagggcgtgattgagcccaacaaggagctgtctgaggtgaagaatgtgctggagaagctgaagaacagcgagcggcggctgctgcaggacaaggagggcctgagcaaccagctgcgggtgcagacagaggtgaaccgggagctgaagaagctgctggtggcctctgtgggagatgacctgcagtaccactttgagcggctggcccgggagaagaaccagctgatcctggagaatgaggccctgggcaggaacacagcccagctgtctgagcagctggagaggatgagcatccagtgtgatgtgtggaggagcaagttcctggccagccgggtgatggctgatgagctgaccaacagccgggccgccctgcagaggcagaacagagatgcccacggggccatccaggacctgtag

SEQ ID NO: 21085 - DNA, 387 bp, Artificial Sequence
  Description of Artificial Sequence: Synthetic coding sequence
atgctgtgctggggctactggagcctgggccagcccggcatcagcaccaacctgcagggcatcgtggccgagccccaggtgtgtggcttcatcagtgacagatctgtgaaggaggtggcctgtggcggcaaccacagcgtcttcctgctggaggatggagaggtgtacacctgtggcctgaacaccaagggccagctgggccacgagcgggagggcaacaagccagagcagatcggggccctggccgaccagcacatcatccacgtggcctgtggggagagccacagcctggccctgagtgaccggggccagctgttctcctggggcgccggcagtgatggccagctgggcctgatgaccacagaggacagcgtggccgtgccctag

SEQ ID NO: 21086 - DNA, 1617 bp, Artificial Sequence
  Description of Artificial Sequence: Synthetic coding sequence
atggatgtggacaaggagctgggcatggagagcgtgaaggccggggccagcggcaagccagagatgaggctgggcacccaggaggagaccagtgaaggagatgccaatgaaagcagcctgctggtgctgagcagcaatgtgcccctgctggccctggagttcctggagatcgcccaggccaaggagaaggccttcctgcccatggtgagccacaccttccacatgaggacagaggagagtgatgccagccaggagggagatgacctgcccaagagcagcgccaacaccagccaccccaagcaggatgacagccccaagagcagcgaggagaccatccagcccaaggagggggacatccccaaggcccctgaggagaccatccagagcaagaaggaggacctgcccaagagcagcgagaaggccatccagcccaaggagagcaacatccccaagagcagcgccaagcccatccagcccaagctgggcaacatccccaaggcctctgtgaagcccagccagcccaaggagggggacatccccaaggcccctgaggagaccatccagagcaagaaggaggacctgcccaagagcagcgaggaggccatccagcccaaggagggggacatccccaagagcagcgccaagcccatccagcccaagctgggcaacatcgccaagacctctgtgaagcccagccagcccaaggagagtgacatccccaagagccctgaggagaccatccagcccaaggagggggacatccccaagagcagcgccaagcccatccagcccaagctgggcaacatccccaaggcctctgtgaagcccagccagcccaaggagggggacatcagcaagagccctgaggaggccatccagcccaaggagggggacctgcccaagagcctggaggaggccatccagcccaaggagggggacatccccaagagcctggaggaggccatccagcccaaggagggggacatccccaagagccctgaggagaccatccagcccaagaagggggacatccccaagagccctgaggaggccatccagcccaaggagggggacatccccaagagccccaagcaggccatccagcccaaggagggggacatccccaagagcctggaggaggccatcccccccaaggagattgacatccccaagagccctgaggagaccatccagcccaaggaggatgacagccccaagagcctggaggaggccacccccagcaaggagggggacatcctgaagccagaggaggagaccatggagttccctgagggggacaaggtgaaggtgatcctgagcaaggaggactttgaggccagcctgaaggaggccggggagcggctggtggccgtggacttcagcgccacctggtgtggcccctgcaggaccatccggcccttcttccacgccctgtctgtgaagcatgaagatgtggtgttcctggaggtggatgctgacaactgtgaggaggtggtgagagaatgtgccatcatgtgtgtgcccaccttccagttctacaagaaggaggagaaggtggatgagctgtgtggggccctgaaggagaagctggaggccgtgattgctgagctgaagtag

SEQ ID NO: 21087 - DNA, 153 bp, Artificial Sequence
  Description of Artificial Sequence: Synthetic coding sequence
atggccagcgaggagctgcagaaggacctggaggaggtgaaggtgctgctggagaaggccaccaggaagagggtgagagatgccctgacagctgagaagagcaagattgaaacagagatcaagaacaagatgcagcagaagagccagaagtag

SEQ ID NO: 21088 - DNA, 1527 bp, Artificial Sequence; identical to SEQ ID NO: 18911
  Description of Artificial Sequence: Synthetic coding sequence

SEQ ID NO: 21089 - DNA, 3846 bp, Artificial Sequence
  Description of Artificial Sequence: Synthetic coding sequence
atgaccttctacagctggatcccctaccaccggcaggcccccctgaaccaccggcgggtgtgcagcgctgagggcgccggcagccctggccctgccctggacccccgctggctgcccacagaggcccacctgctggaggcccaccggctgctgctgcagagcgtgctgtgtgaccggccccgggagagcatccagctgcacttccggctgtccatggccagccagctgcaggtgttcagccccccatctgtgagcagcagcgccttctgcagcgccaagaagctgaagattgagcccagcggctgggatgtgtctggccagagcagcaatgacaagtactacacccacagcaagaccctgcctgccacccagggccaggccaacagcagccaccaggtggccaacttcaacatcccagcctatgaccagggcctgctgctgcctgccccagctgtggagcacatcgtggtgacagctgctgacagcagcggcagcgctgccaccagcaccttccagagcagccagaccctgacccacaggagcaatgtgtccctgctggagccctaccagaagtgtggcctgaagaggaagtctgaggaggtggacagcaatggatctgtgcagatcatcgaggagcacccccccctgatgctgcagaacagaacagtggtgggcgctgctgccaccaccaccaccgtgaccaccaagagcagcagcagcagtggagagggggactaccagctggtgcagcacgagatcctgtgcagcatgaccaacagctatgaggtgctggagttcctgggccggggcaccttcggccaggtggccaagtgctggaagaggagcaccaaggagatcgtggccatcaagatcctgaagaaccaccccagctatgcccggcagggccagatcgaggtgtccatcctgagccggctgagcagtgaaaatgctgatgagtacaactttgtgcgctcctatgagtgcttccagcacaagaaccacacctgcctggtgtttgagatgctggagcagaacctgtatgacttcctgaagcagaacaagttcagccccctgcccctgaagtacatccggcccatcctgcagcaggtggccacagccctgatgaagctgaagagcctgggcctcatccatgctgacctgaagccagagaacatcatgctggtggaccctgtgcggcagccctacagagtgaaggtgattgactttggaagtgccagccacgtgtccaaggctgtgtgcagcacctacctgcagagccgctactaccgggcccctgagatcatcctgggcctgcccttctgtgaggccatcgacatgtggagcctgggctgtgtgattgctgagctgttcctgggctggcccctgtacccaggggcctctgaatatgaccagatccgctacatcagccagacccagggcctgcctgctgagtacctgctgtctgctggcaccaagaccacccgcttcttcaacagagaccccaacctgggctaccccctgtggaggctgaagaccccagaggagcacgagctggagaccggcatcaagagcaaggaggccaggaagtacatcttcaactgcctggatgacatggcccaggtgaacatgagcacagacctggagggcacagacatgctggccgagaaggctgacagaagagagtacatcgacctgctgaagaagatgctgaccattgatgctgacaagaggatcacccccctgaagaccctgaaccaccagtttgtgaccatgacccacctgctggacttcccccacagcaaccacgtgaagagctgcttccagaacatggagatctgcaagagaagagtgcacatgtatgacacagtgtcccagatcaagagccccttcaccacccacgtggcccccaacaccagcaccaacctgaccatgtccttcagcaaccagctgaacacagtgcacaaccaggcctctgtgctggccagcagcagcacagctgctgctgccaccctgagcctggccaacagtgatgtgtccctgctgaactaccagagcgccctgtaccccagcagcgctgcccctgtgcctggggtggcccagcagggcgtgtccctgcagcccggcaccacccagatctgcacccagacagaccccttccagcagaccttcatcgtgtgccccccagccttccagacaggcctgcaggccaccaccaagcacagcggcttccctgtgaggatggacaatgctgtgcccatcgtgccccaggccccagctgcccagcccctgcagatccagagcggcgtgctgacccagggcagctgcacccccctgatggtggccaccctgcacccccaggtggccaccatcaccccccagtatgctgtgcccttcaccctgagctgtgccgccggccgcccagccctggtggagcagacagctgctgtgctgcaggcctggccaggcggcacccagcagatcctgctgcccagcacctggcagcagctgcccggggtggccctgcacaacagcgtgcagcccacagccatgatccctgaggccatgggcagcggccagcagctggccgactggagaaatgcccacagccacggcaaccagtacagcaccatcatgcagcagcccagcctgctgaccaaccacgtgaccctggccacagcccagcccctgaatgtgggcgtggcccacgtggtgcggcagcagcagagcagcagcctgcccagcaagaagaacaagcagagcgcccctgtgagcagcaagagcagcctggatgtgctgcccagccaggtgtacagcctggtgggcagcagccccctgcggaccaccagcagctacaacagcctggtgcctgtgcaggaccagcaccagcccatcatcatcccagacacccccagcccccctgtgtctgtcatcaccatccgcagtgacacagatgaggaggaggacaacaagtacaagcccagcagcagcggcctgaagcccaggagcaatgtcatctcctatgtgacagtgaatgacagcccagacagcgacagcagcctgagcagcccctacagcacagacaccctgagcgccctgcggggcaacagcggctctgtgctggagggccctggccgggtggtggctgatggcaccggcaccaggaccatcatcgtgccccccctgaagacccagctgggggactgcaccgtggccacccaggccagcggcctgctgagcaacaagaccaagcctgtggcctctgtgtctggccagagcagcggctgctgcatcacccccaccggctaccgggcccagagaggaggcaccagcgctgcccagcccctgaacctgagccagaaccagcagagcagcgctgcccccaccagccaggagaggagcagcaacccagccccccggcggcagcaggcctttgtggcccccctgagccaggccccctacaccttccagcacggcagccccctgcacagcacaggccacccccacctggccccagccccagcccacctgcccagccaggcccacctgtacacctacgccgcccccaccagcgctgctgccctgggcagcaccagcagcatcgcccacctgttcagcccccagggcagcagcagacatgctgctgcctacaccacccaccccagcaccctggtgcaccaggtgcctgtgtctgtgggccccagcctgctgaccagcgcctctgtggccccagcccagtaccagcaccagtttgccacccagagctacatcggcagcagccggggcagcaccatctacacaggctaccccctgagccccaccaagatcagccagtacagctacctgtag

SEQ ID NO: 21090 - DNA, 1071 bp, Artificial Sequence; identical to SEQ ID NO: 19927
  Description of Artificial Sequence: Synthetic coding sequence

SEQ ID NO: 21091 - DNA, 2748 bp, Artificial Sequence
  Description of Artificial Sequence: Synthetic coding sequence
atgcagggcccagatgcccccctgctgctgagcgcccgggagctgggccctggaagaagaggcagcgcctcctggtaccggcaggagggcggcgctgtgtgcaactggctgaggaagccccagcccctggagcccaggaccagcttccccagcgccaggagaagtgagttccggcccccccggcggctgccctgggccggccctgccagcgcccagagcgaggagggccacgccggcggccgctgccaggccggcagccctgccccagcccggcggctgagcggggccttcaagaccctggtgcccggcacccacgcccagggcgccagtgacacccaccccctgggccccccccacacccctgtgctggaccccagcccccaggacggcttccctgtgctgtggaggggcagcagcaaggccagccacatgaaccggctgagaaatgccaagatctacgtggagagagctgtgaagcagaagaagatcttcaccatccagggctgctaccctgtgatccgctgcctgctgcggcggcggggctgggtggagaagaagatggtgcacaggagcggccccaccctgctgcccccccagaaggacctggacagcagcgccatgggagacagcgacaccacagaagatgaagatgaagatgaagatgaggagttccagcccagccagctgtttgattttgatgacctgctgaagtttgatgacctggatggcacccacgccctgatggtgggcctgtgcctgaacctgaggaacctgccctggtttgatgaggtggatgccaacagcttcttcccccgctgctactgcctgggcgcagaagatgacaagaaggccttcatcgaggacttctggctgacagctgccagaaatgtgctgaagctggtggtgaagtctgagtggaagagctaccccatccaggccgtggaggaggaggccagcggggacaagcagcccaagaagcaggagaagaaccctgtgctggtgtccccagagtttgtggatgaggccctgtgtgcctgtgaggagtacctgagcaacctggcccacatggacatcgacaaggacctggaggcccccctgtacctgaccccagagggctggagcctcttcctgcagcgctactaccaggtggtgcatgaaggagctgagctgcggcacctggacacccaggtgcagagatgtgaggacatcctgcagcagctgcaggccgtggtgccccagattgacatggagggggacaggaacatctggatcgtgaagccaggggccaagagccggggccggggcatcatgtgcatggaccacctggaggagatgctgaagctggtgaatggaaatcctgtggtgatgaaggatggcaagtgggtggtgcagaagtacatcgagcggcccctgctgatcttcggcaccaagtttgacctgcggcagtggttcctggtgacagactggaaccccctgactgtgtggttctacagagacagctacatccgcttcagcacccagcccttcagcctgaagaacctggacaacagcgtgcacctgtgcaacaacagcatccagaagcacctggagaacagctgccaccgccaccccctgctgcccccagacaacatgtggagcagccagcgcttccaggcccacctgcaggagatgggcgccccaaatgcctggagcaccatcatcgtgcccggcatgaaggatgctgtgattcatgccctgcagaccagccaggacacagtgcagtgcaggaaggccagctttgagctgtatggagctgactttgtgtttggagaggacttccagccctggctgattgagatcaatgccagccccaccatggcccccagcacagctgtgacagcccggctgtgtgccggcgtgcaggccgacaccctgcgggtggtgattgacaggatgctggacaggaactgtgacaccggggcctttgagctgatctacaagcagcctgctgtggaggtgccccagtatgtgggcatccggctgctggtggagggcttcaccatcaagaagcccatggccatgtgccacaggaggatgggcgtgcggcctgctgtgcccctgctgacccagaggggcagcggggaggcccggcaccacttccccagcctgcacaccaaggcccagctgcccagcccccacgtgctgcggcaccagggccaggtgctgcggcggcagcacagcaagctggtgggcaccaaggccctgagcaccaccgggaaggccctgcggaccctgcccacagccaaggtgttcatcagcctgccccccaacctggacttcaaggtggcccccagcatcctgaagcccaggaaggccccagccctgctgtgcctgcggggcccccagctggaggtgccctgctgcctgtgccccctgaagtctgagcagttcctggcccctgtgggccgcagccggcccaaggccaacagcaggccagactgtgacaagcccagggctgaggcctgccccatgaagaggctgagccccctgaagcccctgcccctggtgggcaccttccagaggagaagaggcctgggggacatgaagctgggcaagcccctgctgcgcttccccacagccctggtgctggaccccacccccaacaagaagaagcaggtgaagtacctgggcctggacagcattgctgtgggcggcagccgggtggatggagcccggccctgcaccccaggcagcacagcccgggcctag

SEQ ID NO: 21092 - DNA, 2463 bp, Artificial Sequence
  Description of Artificial Sequence: Synthetic coding sequence
atgaggatcagcagctgcagtgatgagagcagcaacagcaacagcagcaggaagagtgacaaccacagccctgctgtggtgaccaccaccgtgagcagcaagaagcagcccagcgtgctggtgaccttccccaaggaggagaggaagtctgtgtctgggaaggccagcatcaagctgtctgagaccatcagcgagggcaccagcaacagcctgagcacctgcaccaagagcggccccagccccctgagcagccccaacgggaagctgactgtggccagccccaagaggggccagaagcgggaggagggctggaaggaggtggtgagaagaagcaagaaggtgtctgtgcccagcaccgtcatcagccgggtgattggccggggcggctgcaacatcaatgccatccgggagttcaccggggcccacattgatattgacaagcagaaggacaagacaggagaccgcatcatcaccatccggggcggcacagagagcacccggcaggccacccagctgatcaatgccctgatcaaggaccctgacaaggagattgatgagctgatccccaagaaccggctgaagagcagcagcgccaacagcaagattggcagcagcgcccccaccaccacagctgccaacaccagcctgatgggcatcaagatgaccaccgtggccctgagcagcaccagccagacagccacagccctgactgtgcctgccatcagcagcgccagcacccacaagaccatcaagaaccctgtgaacaacgtgcggcccggcttccctgtgtccctgcccctggcctaccccccaccccagtttgcccacgccctgctggccgcccagaccttccagcagatccggcccccccggctgcccatgacccactttggaggcaccttccccccagcccagagcacctggggccccttccctgtgcggcccctgagccctgcccgggccaccaacagccccaagccccacatggtgcccaggcacagcaaccagaacagcagcggcagccaggtgaacagcgctggcagcctgaccagcagccccaccaccaccaccagcagcagcgccagcacagtgcccggcaccagcaccaacggcagccccagcagccccagcgtgcggcggcagctgtttgtgacagtggtgaagaccagcaatgccaccaccaccaccgtgaccaccacagccagcaacaacaacacagcccccaccaatgccacctaccccatgcccacagccaaggagcactaccctgtgagcagccccagcagccccagccccccagcccagcccggcggcgtgtccaggaacagccccctggactgtggcagcgccagccccaacaaggtggccagcagcagcgagcaggaggccggcagcccccctgtggtggagaccaccaacacccggccccccaacagcagcagcagcagcggcagcagcagcgcccacagcaaccagcagcagcccccaggctctgtgtcccaggagcccaggcctcccctgcagcagagccaggtgcccccacctgaggtgaggatgacagtgccccccctggccaccagcagcgcccctgtggccgtgcccagcacagcccctgtgacctaccccatgccccagacccccatgggctgcccccagcccacccccaagatggagaccccagccatccggcccccacctcatggcaccacagccccccacaagaacagcgcctctgtgcagaacagctctgtggccgtgctgtctgtgaaccacatcaagaggccccacagcgtgcccagctctgtgcagctgcccagcaccctgagcacccagagcgcctgccagaacagcgtgcacccagccaacaagcccatcgcccccaacttcagcgcccccctgcccttcggccccttcagcaccctgtttgagaacagccccaccagcgcccacgccttctggggcggctctgtggtgagcagccagagcaccccagagagcatgctgagcggcaagagcagctacctgcccaacagcgaccccctgcaccagagcgacaccagcaaggcccctggcttccggccccccctgcagaggcctgcccccagccccagcggcatcgtgaacatggacagcccctacggctctgtgacccccagcagcacccacctgggcaactttgccagcaacatcagcggcggccagatgtatggccctggggcccccctgggcggggccccagctgctgccaacttcaaccggcagcacttcagccccctgagcctgctgaccccctgcagcagcgccagcaatgacagcagcgcccagagcgtgtcctctggagtgcgggcccccagccctgcccccagctctgtgcccctgggcagcgagaagcccagcaatgtgtcccaggacatcgtggccagcggccccctgaagggcctggtggccatcaagaccaagtag

SEQ ID NO: 21093 - DNA, 6033 bp, Artificial Sequence
  Description of Artificial Sequence: Synthetic coding sequence
atggagaaggccaccgtgcctgtggccgccgccacagctgctgagggggagggcagccccccagctgtggccgctgtggccggccccccagctgctgctgaggtgggcggcggcgtgggcggcagcagccgggcccggagcgccagcagcccccggggcatggtgcgggtgtgtgacctgctgctgaagaagaagccaccccagcagcagcaccacaaggccaagaggaacagaacctgccggccccccagcagcagcgagagcagcagtgacagcgacaacagcggcggcggcggcggcggcggcggcggcggcggcggcggcggcggcaccagcagcaacaacagcgaggaggaggaggatgatgatgatgaggaggaggaggtgtctgaggtggagagcttcatcctggaccaggatgacctggagaaccccatgctggagacagccagcaagctgctgctgagcggcacagcagatggagctgacctgaggacagtggaccctgagacccaggcccggctggaggccctgctggaggccgccggcatcggcaagctgagcacagcagatggcaaggcctttgctgaccctgaggtgctgcggcggctgaccagctctgtgtcctgtgccctggatgaagctgctgctgccctgaccaggatgagagctgagagcacagccaatgccggccagagcgacaacagaagcctggccgaggcctgcagtgaaggagatgtgaatgctgtgaggaagctgctgattgagggccgctctgtgaatgagcacacagaggagggggagagcctgctgtgcctggcctgcagcgctggctactatgagctggcccaggtgctgctggccatgcacgccaacgtggaggaccggggcatcaagggggacatcacccccctgatggccgccgccaacggcggccacgtgaagatcgtgaagctgctgctggcccacaaggcagatgtgaatgcccagagcagcactggaaacacagccctgacctacgcctgtgccggcggctacgtggatgtggtgaaggtgctgctggagagcggggccagcattgaggaccacaatgaaaatggccacacccccctgatggaggccggcagcgctggccacgtggaggtggcccggctgctgctggagaatggagctggcatcaacacccacagcaatgagttcaaggagagcgccctgaccctggcctgctacaagggccacctggagatggtgcgcttcctgctggaggccggggctgaccaggagcacaagacagatgagatgcacacagccctgatggaggcctgcatggatggccacgtggaggtggcccggctgctgctggacagcggggcccaggtgaacatgcctgctgacagctttgagagccccctgaccctggccgcctgtggcggccacgtggagctggccgccctgctgattgagcggggggccagcctggaggaggtgaatgatgagggctacacccccctgatggaggccgcccgggagggccacgaggagatggtggccctgctgctgggccagggcgccaacatcaatgcccagacagaggagacccaggagacagccctgaccctggcctgctgcggcggcttcctggaggtggccgacttcctgatcaaggccggggctgacatcgagctgggctgcagcacccccctgatggaggccgcccaggagggccacctggagctggtgaagtacctgctggccgccggggccaacgtgcacgccaccacagccaccggggacacagccctgacctacgcctgtgaaaatggccacacagatgtggctgatgtgctgctgcaggccggggctgacctggagcatgaaagtgaaggaggccgcacccccctgatgaaggccgcccgggccggccacgtgtgcaccgtgcagttcctgatcagcaagggggccaacgtgaacagaaccacagccaacaatgaccacacagtgctgagcctggcctgtgccggcggccacctggccgtggtggagctgctgctggcccacggggctgaccccacccaccggctgaaggatggcagcaccatgctgattgaggccgccaagggcggccacacctctgtggtgtgctacctgctggactaccccaacaacctgctgagcgcccctcctccagatgtgacccagctgaccccacccagccatgacctgaacagagccccccgggtgcctgtgcaggccctgcccatggtggtgcccccccaggagccagacaagcccccagccaacgtggccaccaccctgcccatccggaacaaggccgccagcaagcagaagagcagcagccacctgcctgccaacagccaggatgtgcagggctacatcaccaaccagagccctgagagcatcgtggaggaggcccagggcaagctgacagagctggagcagaggatcaaggaggccatcgagaagaatgcccagctgcagagcctggagctggcccacgccgaccagctgaccaaggagaagattgaggagctgaacaagacccgggaggagcagatccagaagaagcagaagatcctggaggagctgcagaaggtggagcgggagctgcagctgaagacccagcagcagctgaagaagcagtacctggaggtgaaggcccagaggatccagctgcagcagcagcagcagcagagctgccagcacctgggcctgctgacccctgtgggcgtgggggagcagctgtctgagggggactatgcccggctgcagcaggtggaccctgtgctgctgaaggatgagccccagcagacagctgcccagatgggctttgcccccatccagcccctggccatgccccaggccctgcccctggccgccggccccctgcccccaggcagcatcgccaacctgacagagctgcaggtgctgagcagcctgctgcagccctgcttcctgagcaccctgcccctcatcctgatgcaccggctgcgggtcatcatgacccggcccaagagcagcagcaccagcgagagcggggacagcgacaacatgaggatcagcagctgcagtgatgagagcagcaacagcaacagcagcaggaagagtgacaaccacagccctgctgtggtgaccaccaccgtgagcagcaagaagcagcccagcgtgctggtgaccttccccaaggaggagaggaagtctgtgtctgggaaggccagcatcaagctgtctgagaccatcagcgagggcaccagcaacagcctgagcacctgcaccaagagcggccccagccccctgagcagccccaacgggaagctgactgtggccagccccaagaggggccagaagcgggaggagggctggaaggaggtggtgcggcgcagcaagaaggtgtctgtgcccagcaccgtcatcagcagggtcatcggccggggcggctgcaacatcaatgccatccgggagttcaccggggcccacatcgacatcgacaagcagaaggacaagacaggagaccgcatcatcaccatccggggcggcacagagagcacccggcaggccacccagctgatcaatgccctgatcaaggaccctgacaaggagattgatgagctgatccccaagaaccggctgaagagcagcagcgccaacagcaagattggcagcagcgcccccaccaccacagctgccaacaccagcctgatgggcatcaagatgaccaccgtggccctgagcagcaccagccagacagccacagccctgactgtgcctgccatcagcagcgccagcacccacaagaccatcaagaaccctgtgaacaacgtgcggcccggcttccctgtgtccctgcccctggcctaccccccaccccagtttgcccacgccctgctggccgcccagaccttccagcagatccggcccccccggctgcccatgacccactttggaggcaccttccccccagcccagagcacctggggccccttccctgtgcggcccctgagccctgcccgggccaccaacagccccaagccccacatggtgcccaggcacagcaaccagaacagcagcggcagccaggtgaacagcgctggcagcctgaccagcagccccaccaccaccaccagcagcagcgccagcacagtgcccggcaccagcaccaacggcagccccagcagccccagcgtgcggcggcagctgtttgtgacagtggtgaagaccagcaatgccaccaccaccaccgtgaccaccacagccagcaacaacaacacagcccccaccaatgccacctaccccatgcccacagccaaggagcactaccctgtgagcagccccagcagccccagccccccagcccagcctggaggagtgtccaggaacagccccctggactgtggcagcgccagccccaacaaggtggccagcagcagcgagcaggaggccggcagcccccctgtggtggagaccaccaacaccaggcctcccaacagcagcagcagcagcggcagcagcagcgcccacagcaaccagcagcagcccccaggctctgtgtcccaggagccccggccccccctgcagcagagccaggtgcccccacctgaggtgaggatgacagtgccccccctggccaccagcagcgcccctgtggccgtgcccagcacagcccctgtgacctaccccatgccccagacccccatgggctgcccccagcccacccccaagatggagaccccagccatccggcccccaccccacggcaccacagccccccacaagaacagcgcctctgtgcagaacagctctgtggccgtgctgtctgtgaaccacatcaagaggccccacagcgtgcccagctctgtgcagctgcccagcaccctgagcacccagagcgcctgccagaacagcgtgcacccagccaacaagcccatcgcccccaacttcagcgcccccctgcccttcggccccttcagcaccctgtttgagaacagccccaccagcgcccacgccttctggggcggctctgtggtgagcagccagagcaccccagagagcatgctgagcggcaagagcagctacctgcccaacagcgaccccctgcaccagagcgacaccagcaaggcccctggcttccggccccccctgcagaggcctgcccccagccccagcggcatcgtgaacatggacagcccctacggctctgtgacccccagcagcacccacctgggcaactttgccagcaacatcagcggcggccagatgtatggccctggggcccccctgggcggggccccagctgctgccaacttcaaccggcagcacttcagccccctgagcctgctgaccccctgcagcagcgccagcaatgacagcagcgcccagagcgtgagcagcggcgtgcgggcccccagccctgcccccagctctgtgcccctgggcagcgagaagcccagcaatgtgtcccaggacaggaaggtgcctgtgcccatcggcacagagaggtctgcccgcatccggcagacaggcaccagcgcccccagcgtgattggcagcaacctgagcacctctgtgggccacagcggcatctggagctttgagggcatcggcggcaaccaggacaaggtggactggtgcaaccctggcatgggcaaccccatgatccaccggcccatgtctgaccccggggtcttcagccagcaccaggccatggagcgggacagcacaggcatcgtgacccccagcggcaccttccaccagcacgtgcctgctggctacatggacttccccaaggtgggcggcatgcccttctctgtgtatggaaatgccatgatcccccctgtggcccccatcccagatggagctgggggccccatcttcaacggcccccacgccgctgaccccagctggaacagcctcatcaagatggtgagcagcagcacagaaaataatggcccccagacagtgtggacaggcccctgggccccccacatgaacagcgtgcacatgaaccagctgggctag

SEQ ID NO: 21094 - DNA, 1446 bp, Artificial Sequence
  Description of Artificial Sequence: Synthetic coding sequence
atggccagcgctgcctctgtgaccagcctggctgatgaggtgaactgccccatctgccagggcaccctgcgggagcctgtgaccatcgactgtggccacaacttctgccgggcctgcctgacccgctactgtgagatccctggccctgacctggaggagagccccacctgccccctgtgcaaggagcccttccggcccggcagcttccggcccaactggcagctggccaacgtggtggagaacatcgagcggctgcagctggtgtccaccctgggcctgggggaggaggatgtgtgccaggagcacggggagaagatctacttcttctgtgaagatgatgagatgcagctgtgtgtggtgtgccgggaggccggggagcacgccacccacaccatgaggttcctggaggatgctgctgccccctaccgggagcagatccacaagtgcctgaagtgcctgaggaaggagcgggaggagatccaggagatccagagccgggagaacaagaggatgcaggtgctgctgacccaggtgtccaccaagaggcagcaggtgatcagcgagtttgcccacctgaggaagttcctggaggagcagcagagcatcctgctggcccagctggagagccaggatggagacatcctgcggcagagagatgaatttgacctgctggtggccggggagatctgccgcttcagcgccctgattgaggagctggaggagaagaatgaaagacctgcccgggagctgctgacagacatccgcagcaccctcatccgctgtgagaccaggaaatgtaggaagcctgtggccgtgtccccagagctgggccagaggatccgggacttcccccagcaggccctgcccctgcagcgggagatgaagatgttcctggagaagctgtgctttgagctggactatgagcccgcccacatcagcctggacccccagaccagccaccccaagctgctgctgtctgaggaccaccagagggcccagttctcctacaagtggcagaacagcccagacaacccccagagatttgaccgggccacctgtgtgctggcccacacaggcatcactggaggccgccacacctgggtggtgtccattgacctggcccatggaggcagctgcaccgtgggcgtggtgtctgaagatgtgcagaggaaaggagagctgcggctgcggcctgaggagggcgtgtgggccgtgcggctggcctggggctttgtgtctgccctgggcagcttccccacccggctgaccctgaaggagcagccccggcaggtgcgggtgtccctggactatgaggtgggctgggtgaccttcaccaatgctgtgacccgggagcccatctacaccttcaccgccagcttcaccaggaaggtgatccccttcttcggcctgtggggccggggcagcagcttcagcctgagcagctag

SEQ ID NO: 21095 - DNA, 1566 bp, Artificial Sequence
  Description of Artificial Sequence: Synthetic coding sequence
atgcccagcccccagctgctggtgctgtttggcagccagacaggaacagcccaggatgtgtctgagcggctgggccgggaggccaggagaagaaggctgggctgccgggtgcaggccctggacagctaccctgtggtgaacctgatcaatgagcccctggtgatctttgtgtgtgccaccaccggccagggcgaccccccagacaacatgaagaacttctggaggttcatcttcaggaagaacctgcccagcacagccctgtgccagatggactttgctgtgctgggcctgggggacagcagctatgccaagttcaactttgtggccaagaagctgcaccggcggctgctgcagctgggcggcagcgccctgctgcctgtgtgcctgggagatgaccagcacgagctgggcctgcccagcaagttcaccctgctcttcctgcaggaggcccccagcactggaagtgagggccagagggtggcccaccctggcagccaggagccccccagcgagagcaagcccttcctggcccccatgatcagcaaccagagggtgacaggccccagccacttccaggatgtgcggctgattgaatttgacatcctgggcagcggcatcagctttgctgctggagatgtggtgctgatccagcccagcaacagcgctgcccacgtgcagcgcttctgccaggtgctgggcctggaccctgaccagctgttcatgctgcagccccgggagccagatgtgagcagccccacccggctgccccagccctgcagcatgaggcacctggtgagccactacctggacatcgcctctgtgccccggcgctccttctttgagctgctggcctgcctgagcctgcacgagctggagcgggagaagctgctggagttcagcagcgcccagggccaggaggagctgtttgagtactgcaaccggcccaggaggaccatcctggaggtgctgtgtgacttcccccacacagctgctgccatccccccagactacctgctggacctgatccctgtgatccggccccgggccttcagcatcgccagcagcctgctgacccaccccagccggctgcagatcctggtggccgtggtgcagttccagacccggctgaaggagccccggcggggcctgtgcagctcctggctggccagcctggaccccggccagggccctgtgcgggtgcccctgtgggtgcggcccggcagcctggccttccctgagaccccagacacccctgtgatcatggtgggccctggcaccggggtggcccccttccgggccgccatccaggagcgggtggcccagggccagacaggcaacttcctgttcttcggctgccgctggagggaccaggacttctactgggaggccgagtggcaggagctggagaagagggactgcctgaccctcatcccagccttcagccgggagcaggagcagaaggtgtatgtgcagcaccggctgcgggagctgggcagcctggtgtgggagctgctggaccggcaggccacccccagcccctgccagaggaccagcaggaagccctag

SEQ ID NO: 21096 - DNA, 753 bp, Artificial Sequence
  Description of Artificial Sequence: Synthetic coding sequence
tgacagcccagccctgtggagccccggggccccttctacttctgccgcctgctgctggatgacctgggcatgaacagctgggacaggaggaagaacttccacctgctgaagaagaacagcaagctgctgcgggagctgaagaacctggacagccggcagtgccgggagacccacaagattgctgtgttctacatcgccgagggccaggaggacaagtgcagcatcctgagcaatgaaagaggcagccaggcctatgaggactttgtggccggcctgggctgggaggtggacctgagcacccactgcggcttcatgggcggcctgcagagaaatggcagcacaggccagacagccccctactatgccaccagcacagtggaggtgatcttccacgtgtccaccaggatgcccagcgacagtgatgacagcctgaccaagaagctgcggcacctgggcaatgatgaggtgcacatcgtgtggagcgagcacagccgggactaccgccggggcatcatccccacagcctttggagatgtgtccatcatcatctaccccatgaagaaccacatgttcttcatcgccatcaccaagaagccagaggtgcccttcttcggccccctgtttgatggagccatcgtgtctgggaagctgctgcccagcctggtgtgtgccacctgcatcaatgccagcagagctgtgaagtgcctgatccccctgtaccagagcctgtacctgtttgccctgaatgtgtag

SEQ ID NO: 21097 - DNA, 345 bp, Artificial Sequence
  Description of Artificial Sequence: Synthetic coding sequence
atggtgctgatcctgggccgccgcctgaaccgggaggacctgggcgtgcgggacagccctgccaccaagaggaaggtgtttgagatggaccccaagagcctgactggacatgagttctttgacttcagcagcggcagcagccatgctgagaacatcctgcagatcttcaatgagttccgggacagccgcctcttcacagatgtgatcatctgtgtggagggcaaggagttcccctgccacagagctgtgctgagcgcctgcagcagctacttccgggccatgttctgcaatgaccaccgggagagccgggagatgctggtggagatcaatggcatcctggcctag

SEQ ID NO: 21098 - DNA, 1830 bp, Artificial Sequence
  Description of Artificial Sequence: Synthetic coding sequence
atggccagcctgagccgggccctgcgggtggccgccgcccacccccggcagagccccacccggggcatgggcccctgcaacctgagcagcgctgctggccccacagctgagaagtctgtgccctaccagaggaccctgaaggagggccagggcacctctgtggtggcccagggccccagccggcccctgcccagcacagccaacgtggtggtgattggaggcggcagcctgggctgccagaccctgtaccacctggccaagctgggcatgtctggagctgtgctgctggagcgggagcggctgaccagcggcaccacctggcacacagctggcctgctgtggcagctgcggcccagtgatgtggaggtggagctgctggcccacacccggcgggtggtgtcccgggagctggaggaggagaccggcctgcacacaggctggatccagaatggaggcctcttcatcgccagcaaccggcagaggctggatgagtacaagaggctgatgagcctgggcaaggcctatggagtggagagccacgtgctgagccctgctgagaccaagaccctgtaccccctgatgaatgtggatgacctgtatggcaccctgtatgtgccccatgatggcaccatggaccctgctggcacctgcaccaccctggcccgggccgccagcgcccggggggcccaggtgattgagaactgccctgtgacaggcatccgggtgtggacagatgactttggagtgcggcgggtggccggcgtggagacccagcacggcagcatccagaccccctgtgtggtgaactgtgccggcgtgtgggccagcgctgtgggccgcatggccggcgtgaaggtgcccctggtggccatgcaccacgcctacgtggtgacagaaagaattgagggcatccagaacatgcccaacgtgcgggaccatgatgcctctgtgtacctgcggctgcagggagatgccctgtctgtgggcggctatgaggccaaccccatcttctgggaggaggtgtctgacaagtttgccttcggcctgtttgacctggactgggaggtgttcacccagcacattgaaggagccatcaacagagtgcctgtgctggagaagacaggcatcaagagcacagtgtgtggccctgagagcttcaccccagaccacaagcccctgatgggagaggcccctgagctgcggggcttcttcctgggctgcggcttcaacagcgctggcatgatgctgggcggcggctgcggccaggagctggcccactggatcatccacggccggcctgagaaggacatgcacggctatgacatccgccgcttccaccacagcctgacagaccacccccgctggatccgggagaggagccatgagagctatgccaagaactacagcgtggtgttcccccatgatgagcccctggccggcaggaacatgaggcgggaccccctgcacgaggagctgctgggccagggctgtgtgttccaggagagacatggctgggagcggcccggctggttccacccccggggccctgcccctgtgctggagtatgactactatggagcctacggcagccgggcccacgaggactatgcctacagaaggctgctggctgatgagtacacctttgccttccccccccaccacgacaccatcaagaaggagtgcctggcctgcagaggagctgctgctgtgtttgacatgagctactttgggaagttctacctggtgggcctggatgccaggaaggctgctgactggctgttcagcgcagatgtgtccaggcctcctggcctgcaccgggtgcacgtgtag

SEQ ID NO: 21099 - DNA, 129 bp, Artificial Sequence
  Description of Artificial Sequence: Synthetic coding sequence
atggacaacatgagcccccggctgcgggccttcctgtctgagcccatcggggagaaggatgtgtgctgggtggatggcatcagccatgagctggccatcaacctggtgaccaagggcatcaacaagtag

SEQ ID NO: 21100 - DNA, 3120 bp, Artificial Sequence
  Description of Artificial Sequence: Synthetic coding sequence
atggtgagcagcgcccagatgggcttcaacctgcaggccctgctggagcagctgagccaggatgagctgagcaagttcaagtacctgatcaccaccttcagcctggcccacgagctgcagaagatcccccacaaggagatggccagcctgcaggtgtttgagaagatgcacaggatggacctgtctgagcgggccaaggatgaggtgcgggaggccgccctgaagagcttcaacaagaggaagcccctgagcctgggcatcaccaggaaggagaggcctcccctggatgtggatgagatgctggagcgcttcaagacagaggcccaggccttcacagagaccaagggaaatgtcatctgcctgggcaaggaggtgttcaagggcaagaagccagacaaggacaaccgctgccgctacatcctgaagaccaagttccgggagatgtggaagtcctggccaggggacagcaaggaggtgcaggtgatggccgagcgctacaagatgctgatccccttcagcaacccccgggtgctgcccggccccttctcctacacagtggtgctgtatggccctgctggcctgggcaagaccaccctggcccagaagctgatgctggactgggccgaggacaacctgatccacaagttcaagtatgccttctacctgagctgccgggagctgagccggctgggcccctgcagctttgctgagctggtgttccgggactggccagagctgcaggatgacatcccccacatcctggcccaggccaggaagatcctgtttgtgattgatggctttgatgagctgggcgccgcccctggggccctgattgaggacatctgtggggactgggagaagaagaagcctgtgcctgtgctgctgggcagcctgctgaacagagtgatgctgcccaaggccgccctgctggtgaccacccggccccgggccctgcgggacctgcgcatcctggccgaggagcccatctacatccgggtggagggcttcctggaggaggacagaagagcctacttcctgcggcactttggagatgaggaccaggccatgagggcctttgagctgatgaggagcaatgctgccctcttccagctgggcagcgccccagctgtgtgctggatcgtgtgcaccaccctgaagctgcagatggagaagggagaagatcctgtgcccacctgcctgaccaggacaggcctcttcctgcgcttcctgtgcagccgcttcccccagggcgcccagctgcggggggccctgcggaccctgagcctgctggccgcccagggcctgtgggcccagacctctgtgctgcaccgggaggacctggagcggctgggcgtgcaggagagtgacctgcggctcttcctggatggagacatcctgcggcaggacagagtgtccaagggctgctacagcttcatccacctgtccttccagcagttcctgacagccctcttctacaccctggagaaggaggaggaggaggacagagatggccacacctgggacattggagatgtgcagaagctgctgtctggagtggagcggctgagaaatccagacctgatccaggccggctactacagctttggcctggccaatgagaagagggccaaggagctggaggccaccttcggctgcaggatgagcccagacatcaagcaggagctgctgcgctgtgacatcagctgcaagggcggccacagcacagtgacagacctgcaggagctgctgggctgcctgtatgagagccaggaggaggagctggtgaaggaggtgatggcccagttcaaggagatcagcctgcacctgaatgctgtggatgtggtgcccagcagcttctgtgtgaagcactgcaggaacctgcagaagatgagcctgcaggtgatcaaggagaacctgcctgaaaatgtgacagccagcgagagtgatgctgaggtggagaggagccaggatgaccagcacatgctgcccttctggacagacctgtgcagcatcttcggcagcaacaaggacctgatgggcctggccatcaatgacagcttcctgagcgccagcctggtgcgcatcctgtgtgagcagatcgccagtgacacctgccacctgcagagggtggtgttcaagaacatcagccctgcagatgcccacaggaacctgtgcctggccctgcggggccacaagacagtgacctacctgaccctgcagggcaatgaccaggatgacatgtttcctgccctgtgtgaggtgctgcggcaccctgagtgcaacctgcgctacctgggcctggtgtcctgcagcgccaccacccagcagtgggccgacctgagcctggccctggaggtgaaccagagcctgacctgtgtgaacctgagtgacaatgagctgctggatgagggcgccaagctgctgtacaccaccctgcggcaccccaagtgcttcctgcagaggctgagcctggagaactgccacctgacagaggccaactgcaaggacctggccgctgtgctggtggtgtcccgggagctgacccacctgtgcctggccaagaaccccatcggcaacacaggagtgaagttcctgtgtgagggcctgcgctacccagagtgcaagctgcagaccctggtgctgtggaactgtgacatcaccagtgatggctgctgtgacctgaccaagctgctgcaggagaagagcagcctgctgtgcctggacctgggcctgaaccacatcggcgtgaagggcatgaagttcctgtgtgaggccctgaggaagcccctgtgcaacctgcgctgcctgtggctgtggggctgcagcatcccccccttcagctgtgaggacctgtgcagcgccctgagctgcaaccagagcctggtgaccctggacctgggccagaaccccctgggcagcagcggcgtgaagatgctgtttgagaccctgacctgcagcagcggcaccctgcggaccctgcggctgaagattgatgacttcaatgatgagctgaacaagctgctggaggagattgaggagaagaacccccagctgatcatcgacacagagaagcaccacccctgggccgagcggcccagcagccatgacttcatgatctag

SEQ ID NO: 21101 - DNA, 1899 bp, Artificial Sequence; identical to SEQ ID NO: 18887
  Description of Artificial Sequence: Synthetic coding sequence

SEQ ID NO: 21102 - DNA, 189 bp, Artificial Sequence
  Description of Artificial Sequence: Synthetic coding sequence
atgagcatcagcagtgatgaggtgaacttcctggtgtaccgctacctgcaggagagcggcttcagccacagcgccttcaccttcggcatcgagagccacatcagccagagcaacatcaacggggccctggtgcccccagctgccctgatcagcatcatccagaagggcctgcagtatgtggaggcctag

SEQ ID NO: 21103 - DNA, 417 bp, Artificial Sequence
  Description of Artificial Sequence: Synthetic coding sequence
atggagcccagcgcccagcagctgcagctggccgccagcctgcctgccaacctgagcaacttctgccagggcagcgagatgcccaccaccagcaggcctgccctggatgtgaagggcggcaccagccctgccaaggaggatgccaaccaggagatgagctctgtggcctacagcaacctggccgtgaaggacaggaaggctgtggccatcctgcactacccaggagtggccagcaatggcaccaaggccagcggggcccccaccagcagcagcggcagccccatcggcagccccaccaccaccccacccaccaagccacccagcttcaacctgcacccagccccccacctgctggcctccatgcacctgcagaagctgaacagccagtaccagggcatggctgctgccaccccctag

SEQ ID NO: 21104 - DNA, 1473 bp, Artificial Sequence; identical to SEQ ID NO: 18917
  Description of Artificial Sequence: Synthetic coding sequence

SEQ ID NO: 21105 - DNA, 357 bp, Artificial Sequence
  Description of Artificial Sequence: Synthetic coding sequence
atggccagcagcgcccgggagcacctgctgtttgtgagaagaagaaacccccagatgagatacaccctgagccctgagaacctgcagagcctggccgcccagagctccatgcctgagaacatgaccctgcagagggccaacagcgacacagacctggtgaccagcgagagccgcagcagcctgacagcctccatgtatgagtacaccctgggccaggcccagaacctgatcatcttctgggacatcaaggaggaggtggaccccagcgactggattggcctgtaccacattgatgagaacagccctgccaacttctgggacagcaagaacagaggagtgacaggcacccagaagtag

SEQ ID NO: 21106 - DNA, 1620 bp, Artificial Sequence; identical to SEQ ID NO: 19050
  Description of Artificial Sequence: Synthetic coding sequence

SEQ ID NO: 21107 - DNA, 270 bp, Artificial Sequence; identical to SEQ ID NO: 20498
  Description of Artificial Sequence: Synthetic coding sequence

SEQ ID NO: 21108 - DNA, 909 bp, Artificial Sequence; identical to SEQ ID NO: 18366
  Description of Artificial Sequence: Synthetic coding sequence

SEQ ID NO: 21109 - DNA, 1521 bp, Artificial Sequence
  Description of Artificial Sequence: Synthetic coding sequence
atgtctgtgctgagccctggggacctgaagcccaagaggggcagcccccaccggggcagcctggacagaacagatgccagcacagacctggccatgaggtcctggcccagcgagctgggcagcaggacctgcagcaccagcgccaccaccacagcccccagcaacagcacccccatcgcccggcaccctggccgcaccaagggctacaacagtgatgacaacctgtgtgagcccagcctggagtttgaggtgcccaaccaccggcagtatgtgtcccggcccagcagcctggagagcagcaggaacaccagcagcaacagcagccccctgaacctgaagggcagcagcgagcagctgcacggccgctctgagagcttcagcagtgaagatctcatccccagccgggacctggccaccctgccccgggaggccagcaccccaggaagaaatgccctgggcagacatgagtaccccctgcccagaaatggccccctgccccaggagggcgcccagaagaggggcacagccccaccctacgtgggcgtgcggccctgcagcgccagccccagcagcgagatggtgaccctggaggagttcctggaggagagcaacagaagcagccccacccatgacacccccagctgcagagatgacctgctgagtgactacttcaggaaggccagtgaccccccagccatcggcggccagcccggccccccagccaagaaggagggcgccaagatgcccaccaactttgtggcccccaccgtgaagatggccgcccccaccagcgagggccggcccctgaagccaggccagtatgtgaagcccaacttccggctgacagaggccgaggcccctccttctgtggccccccggcaggcccagcccccccagagcctgagcctgggccggccccggcaggcccctgaggccctgggcggccgggagaccggcagccacaccctgcagagccctgccccacccagcagccacagcctggcccgggagaggacccccctggtgggcaaggccggcagcagctgccagggccctggccccaggagccggcccctggacacccggcgcttcagcctggccccacccaaggaggagcggctggcccccctgcaccagagcgccacagccccagccatcgccacagctggagctggagctgctgctgctggcagcggcagcaacagccagctgctgcacttctccccagctgctgccccagctgcccggaccaagcccaaggccccacccaggtctggagaggtggccaccatcacccctgtgcgggccggcctgagcctgtctgaaggagatggagtgcccggccagggctgcagcgagggcctgcctgccaagagccctggccgcagcccagacctggccccccacctgggccgggccctggaggactgcagccggggctctgtgtccaagagcagccctgccagccctgagcccggcggggacccccagacagtgtggtatgaatatggctgtgtgtag

SEQ ID NO: 21110 - DNA, 678 bp, Artificial Sequence
  Description of Artificial Sequence: Synthetic coding sequence
atggcccagacagtgcccccctgtgagctgccctgcaaggagtatgatgtggccagaaatactggagcctacaccagcagcggcctggccacagccagcttccgcaccagcaagtacctgctggaggagtggttccagaactgctacgcccgctaccaccaggcctttgctgaccgggaccagagcgagcggcagagacatgagagccagcagctggccacagagacccaggccctggcccagaggacccagcaggacagcaccaggacagtgggggagcggctgcaggacacccacagctggaagtctgagctgcagcgggagatggaggccctggccgctgagaccaacctgctgctggcccagaagcagaggctggagcgggccctggatgccacagaggtgcccttcagcatcaccacagacaacctgcagtgccgggagcggcgggagcaccccaacctggtgcgggaccacgtggagacagagctgctgaaggccctgcccccagccctgagccagtgcctgaagaacagctgcagcagcaggaagctgagcgccaggaacaagggcacctgccagctgatggagaccctgactgtgcacggggaggccaaccctggcatcgagggccgccgcacccgggccctggcccacaaggaggtgcccagcggctag

SEQ ID NO: 21111 - DNA, 309 bp, Artificial Sequence
  Description of Artificial Sequence: Synthetic coding sequence
atggccaatgacagccctgccaagagcctggtggacatcgacctgagcagcctgcgggaccctgctggcatctttgagctggtggaggtggtgggcaatggcacctacggccaggtgtacaagggccgccacgtgaagacaggccagctggccgccatcaaggtgatggatgtgacagaagatgaggaggaggagatcaagctggagatcaacatgctgaagaagtacagccaccacaggaacatcgccacctactacggggccttcatcaagaagagccccccaggccatgatgaccagctgtggtag

SEQ ID NO: 21112 - DNA, 369 bp, Artificial Sequence
  Description of Artificial Sequence: Synthetic coding sequence
atggccaccagcgcccccctgcggagcctggaggaggaggtgacctgcagcatctgcctggactacctgcgggaccctgtgaccatcgactgtggccacgtgttctgccgcagctgcaccacagatgtgcggcccatcagcggcagcaggcctgtgtgccccctgtgcaagaagcccttcaagaaggagaacatccggcctgtgtggcagctggccagcctggtggagaacatcgagcggctgaaggtggacaagggccggcagcctggagaggtgacccgggagcagcaggatgccaagctgtgtgagcggcaccgggagaagctgcactactactgtgaagatgatggcaagctgctgtgtgtgtag

SEQ ID NO: 21113 - DNA, 312 bp, Artificial Sequence
  Description of Artificial Sequence: Synthetic coding sequence
atgtctgggggcctgctgaaggccctgcggagtgacagctatgtggagctgagccagtacagagaccagcacttccggggggacaatgaggagcaggagaagctgctgaagaagagctatgcagaaaatgccatgagatacatcaatggcacccggctggatgaccgcatcatcagaacagactgggatgctggcttcaaggagggccggcagtatggccggggccgcagcggcggccaggtgagagatgagtaccggcaggactatgatgctggccggggcggctacggcaagctggcccagaaccagtag

SEQ ID NO: 21114 - DNA, 894 bp, Artificial Sequence
  Description of Artificial Sequence: Synthetic coding sequence
atgtggcccttccccagccgcagcctcttccccccacccacccaggcctggctgcagacagtgtccagtgaccctgaggcccagggctggggcgcctggaatgagaccaaggagatcctgggccctgagggcggggagggcaaggaggagaaggaggaggaggaggatgctgaggaggaccaggatggagatgctggcttcctgctgagcctgctggagcaggagaacctggctgaatgtcccctgcctgaccaggagctggaggccatcaagatgaaggtgtgtgccatggagcaggccgagggcaccccccggcccccaggagtgcagcagcaggccgaggaggaggagggcacagctgctggccagctgctgagccctgagaccgtgggctgccccctgagcggcaccccagaggagaaggtggaggccgaccacaggtctgtgtatgtgggcaacctgtgcctgcaccgggtgtgccaccagggcctgcgggccggcagaagaggagctggccctgagcccctgcccggccctggccaccagggcgctgctgagaagaaccagctgccctgggaccagctgcaccggccccggggccccagcaggaccccccggctgcagggcggcaccctgcccccccagaggcctcctggccaggccccagcccagaccaccagggctgagcccggcccctggaagatcctgaccatggtgttcaccgtgctgaagggccgcccagactttgaaagaggagctggggcctggatccgcagcaagcccctggtgctgcaccctggggccggggccggcagcggggccggggcccggcctgaggagcggggcgtgcagagcagccactggccacccctgggcggcggcatggcccagtag

SEQ ID NO: 21115 - DNA, 1059 bp, Artificial Sequence; identical to SEQ ID NO: 20256
  Description of Artificial Sequence: Synthetic coding sequence

SEQ ID NO: 21116 - DNA, 363 bp, Artificial Sequence
  Description of Artificial Sequence: Synthetic coding sequence
atggagctggacctcttcctgggcctggatgatgtgttcccccggctgctgcacggcctgctgcaccgggccttcagcgtcttcctgttcaacacagagaacaagctgctgctgcagcagaggagtgatgccaagatcaccttccctggctgcttcaccaacacctgctgcagccaccccctgagcaacccagctgagctggaggagagtgatgccctgggcgtgcggcgggccgcccagaggcggctgaaggccgagctgggcatccccctggaggaggtgaccagcagccccacccagccctacaagctgaagcccaagcacaccatcaagcgcttcctgatcaagttcctgaacagctag

SEQ ID NO: 21117 - DNA, 339 bp, Artificial Sequence
  Description of Artificial Sequence: Synthetic coding sequence
atggaggagatcccagcccaggaggccgccggcagcccccgggtgcagttccagagcctggagacccagagtgaatgtctgagccctgagccccagtttgtgcaggacacagacatggagcagggcctgaccggcggcttccccatcagcaagccagatggcatcagccagctggagcaggacctgcaggtgtttgacctggagaccaagacccgggaggtgctgagagatgactgcagtgatggagagacccgggaggagaacaagctgctgatccccaagcagaagatcagcgaggaggtgcacagctacaaggtgcgggtgggccgcctgaagtag

SEQ ID NO: 21118 - DNA, 1818 bp, Artificial Sequence
  Description of Artificial Sequence: Synthetic coding sequence
atgtctgagatcctgaagcagaaggacacagagcccaccaacttcaaggtggccgccggcaccctggatgccagcaccaagatctatgctgtgcgggtggatgctgtgcatgctgatgtgtacagagtgctgggcggcctgggcaaggatgcccccagcctggaggaggtggagggccacgtggctgatggcagcgccacagagatgggcaccaccaagaaggctgtgaagcccaagaagaagcacctgcacaggaccatcgagcagaacatcaacaacctgaatgtgtctgaggccgacagaaaatgtgaaattgaccccatgttccagaagacagctgccagctttgatgagtgcagcacagctggggtcttcctgagcaccctgcactgccaggactacagaagtgagctgctcttccccagtgatgtgcagaccctgagcactggagagcccctggagctgcctgagctgggctgtgtggagatgacagacctgaaggcccccctgcagcagtgtgctgaagatcggcagatctgccccagcctggccggcttccagttcacccagtgggacagcgagacccacaatgaatctgtgtctgccctggtggacaagttcaagaagaatgaccaggtgtttgacatcaatgctgaggtggatgaaagtgactgtggggacttcccagatggcagcctgggagatgactttgatgccaatgatgagccagaccacacagctgtgggggaccacgaggagttccgctcctggaaggagccctgccaggtgcagagctgccaggaggagatgatcagcctgggagatggagacatccgcaccatgtgccccctgctgtccatgaagccaggagagtacagctacttcagccccaggaccatgtccatgtgggccggccctgaccactggaggttccggcccaggaggaagcaggatgcccccagccagagcgagaacaagaagaagagcaccaagaaggactttgaaattgactttgaagatgacatcgactttgatgtgtacttcaggaagaccaaggccgccaccatcctgaccaagagcaccctggagaaccagaactggagggccaccaccctgcccacagacttcaactacaacgtggacaccctggtgcagctgcacctgaagccaggcacccggctgctgaagatggcccagggccaccgggtggagacagagcactatgaggagattgaggactatgactacaacaaccccaatgacaccagcaacttctgccccggcctgcaggccgctgacagtgatgatgaggacctggatgacctgtttgtgggccctgtgggcaacagcgacctgagcccctacccctgccacccccccaagacagcccagcagaatggagacaccccagaggcccagggcctggacatcaccacctacggggagagcaacctggtggccgagccccagaaggtgaacaagattgagatccactacgccaagacagccaagaagatggacatgaagaagctgaagcagagcatgtggagcctgctgacagccctgagcggcaaggaggctgatgctgaggccaaccaccgggaggccggcaaggaggccgccctggccgaggtggctgatgagaagatgctgagcggcctgaccaaggacctgcagaggagcctgccccctgtgatggcccagaacctgagcatccccctggcctttgcctgcctgctgcacctggccaatgagaagaacctgaagctggagggcacagaggacctgagtgatgtgctggtgcggcagggcgactag

SEQ ID NO: 21119 - DNA, 2253 bp, Artificial Sequence
  Description of Artificial Sequence: Synthetic coding sequence
atgagcagcagccctgtgaatgtgaagaagctgaaggtgtctgagctgaaggaggagctgaagaagaggcggctgagtgacaagggcctgaaggccgagctgatggagcggctgcaggccgccctggatgatgaggaggccggcggccgcccagccatggagcctggaaatggagatgaccagggcttccaggagggagaagatgagctgggagatgaggaggagggcgctggagatgaaaatggacatggagagcagcagccccagcccccagccacccagcagcagcagccccagcagcagagaggagctgccaaggaggccgccggcaagagcagcggccccaccagcctgtttgctgtgacagtggcccctcctggggcccggcagggccagcagcaggccggcggcaagaagaaggccgagggcggcggcggcggcggccggcctggggccccagctgctggagatggcaagacagagcagaagggcggggacaagaagaggggcgtgaagaggccccgggaggaccacggccggggctactttgagtacatcgaggagaacaagtacagccgggccaagagcccccagccccctgtggaggaggaggatgagcactttgatgacacagtggtgtgcctggacacctacaactgtgacctgcacttcaagatcagccgggaccggctgagcgccagcagcctgaccatggagagctttgccttcctgtgggccggcggccgggccagctatggagtgtccaagggcaaggtgtgctttgagatgaaggtgacagagaagatccctgtgcgccacctgtacaccaaggacatcgacatccacgaggtgcgcatcggctggagcctgaccaccagcggcatgctgctgggggaggaggagttctcctatggctacagcctgaagggcatcaagacctgcaactgtgaaacagaagattatggagagaagtttgatgaaaatgatgtgatcacctgctttgccaactttgaaagtgatgaggtggagctgtcctatgccaagaatggccaggacctgggcgtggccttcaagatcagcaaggaggtgctggccggccggcccctcttcccccacgtgctgtgccacaactgtgctgtggagttcaactttggccagaaggagaagccctacttccccatccctgaggagtacaccttcatccagaatgtgcccctggaggacagagtgcggggccccaagggccctgaggagaagaaggactgtgaggtggtgatgatgattggcctgcctggagctgggaagaccacctgggtgaccaagcatgctgctgaaaatcctgggaagtacaacatcctgggcaccaacaccatcatggacaagatgatggtggccggcttcaagaagcagatggctgacaccgggaagctgaacaccctgctgcagagggccccccagtgcctgggcaagttcatcgagattgctgccaggaagaagaggaacttcatcctggaccagaccaacgtgtctgctgctgcccagaggaggaagatgtgcctgtttgctggcttccagaggaaggctgtggtggtgtgccccaaggatgaggactacaagcagaggacccagaagaaggccgaggtggagggcaaggacctgcctgagcacgctgtgctgaagatgaagggcaacttcaccctgcctgaggtggccgagtgctttgatgagatcacctacgtggagctgcagaaggaggaggcccagaagctgctggagcagtacaaggaggagagcaagaaggccctgcccccagagaagaagcagaacacaggcagcaagaagagcaacaagaacaagagcggcaagaaccagttcaacagaggaggcggccaccggggccggggcggcttcaacatgagaggaggcaacttccggggcggggcccctggcaacagaggaggctacaacagaagaggcaacatgccccagagaggaggcggcggcggcggcagcggcggcatcggctacccctacccccgggcccctgtgtttcctggccggggcagctacagcaacagaggcaactacaacagaggaggcatgcccaacagaggcaactacaaccagaacttccggggccggggcaacaacagaggctacaagaaccagagccagggctacaaccagtggcagcagggccagttctggggccagaagccctggagccagcactaccaccagggctactactag

SEQ ID NO: 21120 - DNA, 804 bp, Artificial Sequence
  Description of Artificial Sequence: Synthetic coding sequence
atgtgggaccagaggctggtgaagctggccctgctgcagcacctgcgggccttctacggcatcaaggtgaagggcgtgcggggccagtgtgacagaagaagacatgaaacagctgccacagagatcggcggcaagatctttggagtgcccttcaatgccctgccccacagcgctgtgcctgaatatggccacatccccagcttcctggtggatgcctgcaccagcctggaggagcacatccacacagagggcctcttcaggaagagcggcagcgtcatccggctgaaggccctgaagaacaaggtggaccacggggagggctgcctgagcagcgccccaccctgtgacattgctggcctgctgaagcagttcttccgggagctgcctgagcccatcctgcctgctgacctgcacgaggccctgctgaaggcccagcagctgggcacagaggagaagaacaaggccatcctgctgctgagctgcctgctggccgaccacacagtgcacgtgctgcgctacttcttcaacttcctgagaaatgtgtccctgcggagcagcgagaacaagatggacagcagcaacctggccgtcatctttgcccccaacctgctgcagaccagcgagggccacgagaagatgagcagcaatgctgagaagaagggcgtgtaccagaccctgtcctggaagcgctaccagccctgctgggtgctgatggtgtctgtgctgctgcaccactggaaggccctgaagaaggtgaacatgaagctgctggtgaacatccgggagcgggaggacaacgtgtag

SEQ ID NO: 21121 - DNA, 600 bp, Artificial Sequence
  Description of Artificial Sequence: Synthetic coding sequence
atgccccacaagattggatttgtggtggtgagcagcagcggccatgaagatggcttcagcgcccgggagctgatgattcatgcccccaccgtgtctggctggaggagccccagctatgtgtccctgtgtgacaatgagaagacaggctgcaaggcccgggagctgaagtctgtgtatgtggatgctgtgggccagttcctgaagctgatcttccaccagaaccacgtgaacaagtacaacatctacaaccaggtggccctggtggccatcaacatcattggagaccctgctgacttcagtgatgagagcaacacagccagccgggagaagctgattgaccactacctgggccacaacagtgaagatcctgccctggagggcacctacgccaggaagagtgactacatcagccccctggatgacctggcctttgacatgtaccaggaccctgaggtggcccagatcatcaggaagctggatgagaggaagcgggaggccgtgcagaaggagagatatgactatgccaagaagctgaagcaggccatcgctgacctgcagaaggtgggggagcggctgggccgctatgaggtggagaagtag

SEQ ID NO: 21122 - DNA, 471 bp, Artificial Sequence
  Description of Artificial Sequence: Synthetic coding sequence
atgacagaggacagccagaggaacttccgctctgtgtactatgagaaggtgggcttccggggcgtggaggagaagaagagcctggagatcctgctgaaggatgaccggctggacacagagaagctgtgcaccttcagccagcgcttccccctgcccagcatgtaccgggccctggtgtggaaggtgctgctgggcatcctgcccccccaccacgagagccacgccaaggtgatgatgtacaggaaggagcagtacctggatgtgctgcacgccctgaaggtggtgcgctttgtgtctgatgccaccccccaggccgaggtgtacctgaggatgtaccagctggagagcggcaagctgcccaggagccccagcttccccctggagccagatgatgaggtgttcctggccatcgccaaggccatggaggagatggtggaggacagcgtggactgctactggatcaccaggtag

SEQ ID NO: 21123 - DNA, 2730 bp, Artificial Sequence
  Description of Artificial Sequence: Synthetic coding sequence
atgatcagacatgctggggccccagcccggggggaccccaccggccctgtgcctgtggtgggcaagggggaggaggaggaggaggaggatggcatgaggctgtgcctgcctgccaaccccaagaactgcctgccccacagaagaggcatcagcatcctggagaagctgatcaagacctgccctgtgtggctgcagctgagcctgggccaggccgaggtggcccgcatcctgcaccgggtggtggccggcatgttcctggtgcggcgggacagcagcagcaagcagctggtgctgtgtgtgcacttccccagcctgaatgaatcttctgctgaggtgctggagtacaccatcaaggaggagaagagcatcctgtacctggagggcagcgccctggtgtttgaggacatcttccgcctcatcgccttctactgtgtgtcccgggacctgctgcccttcaccctgcggctgccccaggccatcctggaggccagcagcttcacagacctggagaccatcgccaacctgggcctgggcttctgggacagcagcctgaaccccccccaggagcggggcaagccagctgagcccccccgggaccgggcccctggcttccccctggtgagcagcctgcggcccacagcccatgatgccaactgtgcctgtgaaattgagctgtctgtgggcaatgaccggctgtggtttgtgaaccccatcttcatcgaggactgcagcagcgccctgcccacagaccagccccccctgggcaactgcccagcccggcccctgccccccaccagtgatgccaccagccccaccagccgctgggccccccggcggcccccacctcctcctcctgtgctgcccctgcagccctgcagccctgcccagcccccacccctgcctgccaagaagaacctgcccacagccccacccaggagaagagtgtctgagcgggtgtccctggaggaccagagccctggcatggctgctgagggggaccagctgagcctgcccccccagggcaccagtgatggccctgaggacaccccccgggagagcacagagcagggccaggacacagaggtgaaggccagtgacccccacagcatgcctgagctgcccaggacagccaagcagccccctgtgcccccacccaggaagaagaggatcagccggcagctggccagcaccctgcctgcccccctggagaatgctgagctgtgcacccaggccatggccctggagacccccaccccaggccccccccgggagggccagagccctgccagccaggccggcacccagcaccccccagcccaggccacagcccacagccagagcagccctgagttcaagggcagcctggccagcctgagtgacagcctgggcgtgtctgtgatggccacagaccaggacagctacagcaccagcagcacagaggaggagctggagcagttcagcagccccagcgtgaagaagaagcccagcatgatcctgggcaaggcccggcaccggctgagctttgccagcttcagctccatgttccacgccttcctgagcaacaacaggaagctgtacaagaaggtggtggagctggcccaggacaagggcagctacttcggcagcctggtgcaggactacaaggtgtacagcctggagatgatggcccggcagaccagcagcacagagatgctgcaggagatccgcaccatgatgacccagctgaagagctacctgctgcagagcacagagctgaaggccctggtggaccctgccctgcacagcgaggaggagctggaggccatcgtggagagcgccctgtacaagtgtgtgctgaagcccctgaaggaggccatcaacagctgcctgcaccagatccacagcaaggatggcagcctgcagcagctgaaggagaaccagctggtgatcctggccaccaccaccacagacctgggcgtgaccacctctgtgcctgaggtgcccatgatggagaagatcctgcagaagttcacctccatgcacaaggcctacagccctgagaagaagatcagcatcctgctgaagacctgcaagctgatctatgacagcatggccctgggcaaccctgggaagccctacggggctgatgacttcctgcctgtgctgatgtatgtgctggcccggagcaacctgacagagatgctgctgaatgtggagtacatgatggagctgatggaccctgccctgcagctgggggagggcagctactacctgaccaccacctatggagccctggagcacatcaagagctatgacaagatcaccgtgacccggcagctgtctgtggaggtgcaggacagcatccaccgctgggagaggaggaggaccctgaacaaggcccgggccagccgcagctctgtgcaggacttcatctgtgtgtcctacctggagcctgagcagcaggcccggaccctggccagcagagctgacacccaggcccaggccctgtgtgcccagtgtgccgagaagtttgctgtggagcggccccaggcccaccggctgtttgtgctggtggatggccgctgcttccagctggctgatgatgccctgccccactgcatcaagggctacctgctgcggtctgagcccaagagggacttccactttgtgtaccggcccctggatggcggcggcggcggcggcggcggcagccccccctgcctggtggtgcgggagcccaacttcctgtag

SEQ ID NO: 21124 - DNA, 1728 bp, Artificial Sequence
  Description of Artificial Sequence: Synthetic coding sequence
atgagcagtgatgaggagaagtacagcctgcctgtggtgcagaatgacagcagccggggcagctctgtgagcagcaacctgcaggaggagtatgaggagctgctgcactacgccatcgtgacccccaacatcgagccctgtgccagccagagcagccaccccaagggggagctggtgcctgatgtgcgcatcagcaccatccatgacatcctgcacagccagggcaacaacagcgaggtgcgggagacagccatcgaggtgggcaagggctgtgacttccacatcagcagccacagcaagacagatgagagcagccctgtgctgagccccaggaagcccagccaccctgtgatggacttcttcagcagccacctgctggccgacagcagcagccctgccaccaacagcagccacacagatgcccacgagatcctggtgtctgacttcctggtgtctgatgagaacctgcagaagatggagaatgtgctggacctgtggagcagcggcctgaagaccaacatcatcagcgagctgagcaagtggaggctgaacttcatcgactggcacaggatggagatgaggaaggagaaggagaagcatgctgcccacctgaagcagctgtgcaaccagatcaatgagctgaaggagctgcagaagacctttgagatcagcattggaaggaaggatgaagtcatcagcagcctgagccacgccatcggcaagcagaaggagaagattgagctgatgaggaccttcttccactggagaattggacatgtgcgggcccggcaggatgtgtatgagggcaagctggccgaccagtactaccagaggaccctgctgaagaaggtgtggaaggtgtggaggtctgtggtgcagaagcagtggaaggatgtggtggagcgggcctgccaggcccgggcagaggaggtgtgcatccagatcagcaatgactatgaggccaaggtggccatgctgagcggggccctggagaatgccaaggccgagatccagaggatgcagcacgagaaggagcactttgaggacagcatgaagaaggccttcatgaggggcgtgtgtgccctgaacctggaggccatgaccatcttccagaacagaaatgatgctggcatcgacagcaccaacaacaagaaggaggagtatggccctggggtgcagggcaaggagcacagcgcccacctggaccccagcgccccacccatgcccctgcctgtgaccagccccctgctgcccagccccccagctgctgtgggcggggccagcgccacagctgtgcccagcgctgcctccatgaccagcaccagggctgccagcgccagctctgtgcacgtgcctgtgtctgccctgggcgccggcagcgctgccacagctgccagcgaggagatgtatgtgccccgggtggtgaccagcgcccagcagaaggccggccgcaccatcacagcccgcatcaccggccgctgtgactttgccagcaagaaccgcatcagcagcagcctggccatcatgggcgtgtccccacccatgagctctgtggtggtggagaagcaccaccctgtgacagtgcagaccatcccccaggccacagctgccaagtaccccaggaccatccaccctgagagcagcaccagcgccagccgcagcctgggcaccaggtctgcccacacccagagcctgacctctgtgcacagcatcaaggtggtggactag

SEQ ID NO: 21125 - DNA, 2091 bp, Artificial Sequence
  Description of Artificial Sequence: Synthetic coding sequence
atggccaactacagaaacaccagcgagatccccctggtgctggtgggcacccaggatgccatcagcagcgccaacccccgggtgattgatgatgcccgggccaggaagctgagcaatgacctgaagcgctgcacctactatgagacctgtgccacctacggcctgaatgtggagagggtcttccaggatgtggcccagaagatcgtggccaccaggaagaagcagcagctgagcatcggcccctgcaagagcctgcccaacagccccagccacagctctgtgtgcagcgcccaggtgtctgctgtgcacatcagccagaccagcaatggaggcggcagcctgagtgactacagcagctctgtgcccagcacccccagcaccagccagaaggagctgagaattgatgtgcccccaacagccaacacccccacccctgtgaggaagcagagcaagaggaggagcaacctcttcaccagcaggaaaggaagtgaccctgacaaggagaagaagggcctggagagcagagctgacagcatcggcagcggccgggccatccccatcaagcagggcatgctgctgaagaggtctgggaagagcctgaacaaggagtggaagaagaagtatgtgaccctgtgtgacaacggggtgctgacctaccaccccagcctgcatgactacatgcagaatgtgcacggcaaggagattgacctgctgcggaccaccgtgaaggtgcctgggaagaggcctccccgggccaccagcgcctgtgcccccatcagcagccccaagaccaacggcctgagcaaggacatgagcagcctgcacatcagccccaacagcggaaatgtgaccagcgccagcggcagccagatggccagcggcatcagcctggtgtccttcaacagcaggccagatggcatgcaccagaggagctacagcgtgagcagcgctgaccagtggagcgaggccaccgtcatcgccaacagcgccatcagcagtgacaccggcctgggggacagcgtgtgcagcagccccagcatcagcagcaccaccagccccaagctggaccccccacccagcccccacgccaacaggaagaagcacaggaggaagaagagcaccagcaacttcaaggcagatggcctgtctggaacagctgaggagcaggaggagaactttgagttcatcatcgtgtccctgaccggccagacctggcactttgaggccaccacctatgaggagagagatgcctgggtgcaggccatcgagagccagatcctggccagcctgcagagctgtgagagcagcaagaacaagagccggctgaccagccagagcgaggccatggccctgcagagcatccggaacatgaggggcaacagccactgtgtggactgtgagacccagaaccccaactgggccagcctgaacctgggcgccctgatgtgcattgaatgttctggcatccacaggaacctgggcacccacctgagccgggtgcgcagcctggacctggatgactggcctgtggagctgatcaaggtgatgagcagcattggaaatgagctggccaacagcgtgtgggaggagagcagccagggccgcaccaagcccagcgtggacagcacccgggaggagaaggagcgctggatccgggccaagtatgagcagaagctgttcctggcccccctgccctgcacagagctgagcctgggccagcacctgctgcgggccacagcagatgaggacctgaggacagccatcctgctgctggcccacggcagcagagatgaggtgaatgagacctgtggggagggagatggccgcacagccctgcacctggcctgcaggaaaggaaatgtggtgctggcccagctgctgatctggtacggcgtggatgtgacagccagagatgcccacggcaacacagccctggcctatgcccggcaggccagcagccaggagtgcattgatgtgctgctgcagtatggctgcccagatgaaagatttgtgctgatggccacccccaacctgagcagaagaaacaacaacagaaacaacagcagcggccgggtgcccaccatcatctag

SEQ ID NO: 21126 - DNA, 270 bp, Artificial Sequence; identical to SEQ ID NO: 20498
  Description of Artificial Sequence: Synthetic coding sequence

SEQ ID NO: 21127 - DNA, 1785 bp, Artificial Sequence
  Description of Artificial Sequence: Synthetic coding sequence
atgacagacacccggcggcgggtgaaggtgtacaccctgaatgaagatcggcagtgggatgaccggggcaccggccacgtgagcagcggctacgtggagcggctgaagggcatgagcctgctggtgcgggcagagagtgatggcagcctgctgctggagagcaagatcaaccccaacacagcctaccagaagcagcaggaggatgagaagttcctgacagacctgtttgcccagctgacagatgaggccacagatgaggagaagaggcaggagctggtgaacttcctgaaggagttctgtgccttcagccagaccctgcagccccagaacagagatgccttcttcaagaccctgagcaacatgggcatcctgcctgccctggaggtgatcctgggcatggatgacacccaggtgcgctctgctgccacagacatcttctcctacctggtggagtacaaccccagcatggtgcgggagtttgtgatgcaggaggcccagcagaatgatgatgtgtccaagaagctgacagagcagaagatcaccagcaaggacatcctgctgatcaacctgatcatcgagcacatgatctgtgacacagatcctgagctgggcggcgctgtgcagctgatgggcctgctgcggaccctggtggaccctgagaacatgctggccacagccaacaagacagagaagacagagttcctgggcttcttctacaagcactgcatgcacgtgctgacagcccccctgctggccaacaccacagaggacaagcccagcaaggatgacttccagacagcccagctgctggccctggtgctggagctgctgaccttctgtgtggagcaccacacctaccacatcaagaactacatcatcaacaaggacatcctgcggcgggtgctggtgctgatggccagcaagcacgccttcctggccctgtgtgccctgcgcttcaagaggaagatcatcggcctgaaggatgagttctacaaccgctacatcatgaagagcttcctgtttgagcctgtggtgaaggccttcctgaacaacggcagccgctacaacctgatgaacagcgccatcatcgagatgtttgagttcatccgggtggaggacatcaagagcctgacagcccacgtgattgagaactactggaaggccctggaggatgtggactatgtgcagaccttcaagggcctgaagctgcgctttgagcagcagcgggagcggcaggacaaccccaagctggacagcatgaggagcatcctgaggaaccaccgctacagaagagatgcccggaccctggaggatgaggaggagatgtggttcaacacagatgaagatgacatggaggatggagaggccgtggtgagccccagcgacaagaccaagaatgatgatgacatcatggaccccatcagcaagttcatggagaggaagaagctgaaggagagcgaggagaaggaggtgctgctgaagaccaacctgagcggccggcagagccccagcttcaagctgagcctgagcagcggcaccaagaccaacctgaccagccagagcagcaccaccaacctgcccggcagccctggcagccctggcagccctggcagccctggcagccctggctctgtgcccaagaacaccagccagacagctgccatcaccaccaagggcggcctggtgggcctggtggactacccagatgatgatgaagatgatgatgaagatgaggacaaggaggacaccctgcccctgagcaagaaggccaagtttgacagctag

SEQ ID NO: 21128 - DNA, 522 bp, Artificial Sequence
  Description of Artificial Sequence: Synthetic coding sequence
atgttcacagaaggagaggagatgtacctgcagggcagcacagtgtggcacccagactgcaagcagagcaccaagacagaggagaagctgcggcccaccaggaccagcagcgagagcatctacagccggcccggcagcagcatccctggcagccctggccacaccatctatgccaaggtggacaatgagatcctggactacaaggacctggccgccatccccaaggtgaaggccatctatgacatcgagaggccagacctgatcacctatgagcccttctacaccagcggctatgatgacaagcaggagcggcagagcctgggggagagccccaggaccctgagccccaccccatctgctgagggctaccaggatgtgcgggacaggatgatccacaggagcaccagccagggcagcatcaacagccctgtgtacagccgccacagctacacccccaccaccagccgcagcccccagcacttccacaggccagaccagggcatcaacatctacaggaagtag

SEQ ID NO: 21129 - DNA, 1620 bp, Artificial Sequence; identical to SEQ ID NO: 19050
  Description of Artificial Sequence: Synthetic coding sequence

SEQ ID NO: 21130 - DNA, 2112 bp, Artificial Sequence
  Description of Artificial Sequence: Synthetic coding sequence
atgttccgctatgagagcctggaggactgccccctggatgaagatgaagatgccttccagggcctgggggaggaggatgaggagattgaccagttcaatgatgacacctttggaagtggagctgtggatgatgactggcaggaggcccacgagcggctggccgagctggaggagaagctgcctgtggccgtgaatgagcagacaggaaatggagagagagatgagatggacctgctgggggaccacgaggagaacctggccgagcggctgagcaagatggtgattgaaaatgagctggaggaccctgccatcatgagagctgtgcagaccaggcctgtgctgcagccccagcccggcagcctgaacagcagcatctgggatggcagcgaggtgctgcggcgcatccggggccccctgctggcccaggagatgcccaccgtgtctgtgctggagtatgccctgccccagaggcctccccagggcccagaagatgaccgggacctgtctgagcgggccctgcccaggaggagcaccagccccatcatcggcagcccccctgtgcgggctgtgcccatcggcaccccacccaagcagatggctgtgcccagcttcacccagcagatcctgtgccccaagcctgtgcacgtgcggccccccatgccaccccgctacccagccccctacggggagaggatgagccccaaccagctgtgcagcgtgcccctgcagcccggccgcatgagccccagccagtttgcccgggtgcccggctttgtgggcagccccctggccgccatgaaccccaagctgctgcagggccgggtgggccagatgctgcccccagcccctggcttccgggccttcttcagcgccccacccagcgccaccccaccaccccagcagcaccccccaggccctggcccccacctgcagaacctgcggagccaggcccccatgttccggccagacaccacccacctgcacccccagcaccggcggctgctgcaccagaggcagcagcagaacagaagccagcacaggaacctgaatggagctggggaccggggcagccacaggagcagccaccaggaccacctgaggaaggacccctatgccaacctgatgctgcagcgggagaaggactgggtgtccaagatccagatgatgcagctgcagagcacagacccctacctggatgacttctactaccagaactactttgagaagctggagaagctgtctgctgctgaggagatccagggagatggccccaagaaggagaggaccaagctgatcaccccccaggtggccaagctggagcacgcctacaagcctgtgcagtttgagggcagcctgggcaagctgactgtgtcctctgtgaacaaccccaggaagatgattgatgctgtggtgaccagccgctcagaagatgatgagaccaaggagaagcaggtgcgggacaagaggaggaagaccctggtgatcatcgagaagacctacagcctgctgctggatgtggaggactatgaaagacgctacctgctgagcctggaggaggagaggcctgccctgatggatgacaggaagcacaagatctgcagcatgtatgacaacctgcggggcaagctgcccggccaggagcggcccagtgatgaccactttgtgcagatcatgtgcatcaggaagggcaagaggatggtggcccgcatcctgcccttcctgagcacagagcaggccgctgacatcctgatgaccacagccaggaacctgcccttcctgatcaagaaggatgcccaggatgaggtgctgccctgcctgctgagccccttcagcctgctgctgtaccacctgcccagcgtgtccatcaccagcctgctgcggcagctgatgaacctgcccagcagtgaccctgccacagagagcacccagaacaaccagtggacagaggtgatgttcatggccacccgggagctgctgcgcatcccccaggccgccctggccaagcccatcagcatccccaccaacctggtgtccctcttcagccgctacgtggaccggcagaagctgaacctgctggagaccaagctgcagctggtgcagggcatcagatag

SEQ ID NO: 21131 - DNA, 957 bp, Artificial Sequence
  Description of Artificial Sequence: Synthetic coding sequence
atgtctgcccacaacagaggaacagagctggacctgtcctggatcagcaagatccaggtgaaccaccctgctgtgctgcggcgggcagagcagatccaggccaggagaacagtgaagaaggagtggcaggccgcctggctgctgaaggctgtgaccttcatcgacctgaccaccctgtctggagatgacaccagcagcaacatccagaggctgtgctacaaggccaagtaccccatccgggaggacctgctgaaggccctgaacatgcatgacaagggcatcaccacagctgctgtgtgtgtgtacccagcccgggtgtgtgatgctgtgaaggccctgaaggccgccggctgcaacatccctgtggcctctgtggccgccggcttccctgctggccagacccacctgaagacccggctggaggagatccggctggccgtggaggatggagccacagaaattgatgtggtgatcaacagaagcctggtgctgaccggccagtgggaggccctgtatgatgagatccggcagttcaggaaggcctgtggggaggcccacctgaagaccatcctggccactggagagctgggcaccctgaccaacgtgtacaaggcctccatgattgccatgatggccggcagtgacttcatcaagaccagcacaggcaaggagaccgtgaatgccaccttccctgtggccatcgtgatgctgcgggccatccgggacttcttctggaagacaggcaacaagattggcttcaagccagctgggggcatccgcagcgccaaggacagcctggcctggctgagcctggtgaaggaggagctgggagatgagtggctgaagccagagctgttccgcatcggggccagcaccctgctgagtgacatcgagcggcagatctaccaccacgtgacaggccgctatgctgcctaccatgacctgcccatgtcctag

SEQ ID NO: 21132 - DNA, 1188 bp, Artificial Sequence; identical to SEQ ID NO: 20054
  Description of Artificial Sequence: Synthetic coding sequence

SEQ ID NO: 21133 - DNA, 3288 bp, Artificial Sequence
  Description of Artificial Sequence: Synthetic coding sequence
atggccgagggcgccgccggcagagaagatcctgcccccccagatgctgctggaggagaagatgacccccgggtgggcccagatgctgctggggactgtgtgacagctgccagcggcggccgcatgagggacagaagaagtggagtggccctgcccggggctgctggcaccccagctgacagcgaggccggcctgctggaggccgcccgggccaccccccggcgcagcagcatcatcaaggaccccagcaaccagaagtgtggcggcaggaagaagacagtgtccttcagctccatgcccagcgagaagaagatcagcagcgccaatgactgcatctccttcatgcaggccggctgtgagctgaagaaggtgcggcccaacagccgcatctacaaccgcttcttcaccctggacacagacctgcaggccctgcgctgggagcccagcaagaaggacctggagaaggccaagctggacatcagcgccatcaaggagatccggctgggcaagaacacagagaccttcaggaacaacggcctggccgaccagatctgtgaggactgtgccttcagcatcctgcacggggagaactatgagagcctggacctggtggccaacagcgcagatgtggccaacatctgggtgtctggcctgcgctacctggtgagccgcagcaagcagcccctggacttcatggagggcaaccagaacaccccccgcttcatgtggctgaagacagtgtttgaggccgcagatgtggatggaaatggcatcatgctggaggacacctctgtggagctgatcaagcagctgaaccccaccctgaaggaggccaagatccggctgaagttcaaggagatccagaagagcaaggagaagctgaccaccagggtgacagaggaggagttctgtgaggccttctgtgagctgtgcaccaggcctgaggtgtacttcctgctggtgcagatcagcaagaacaaggagtacctggatgccaatgacctgatgctgttcctggaggccgagcagggcgtgacccacatcacagaggacatctgcctggacatcatccgccgctatgagctgtctgaggagggccggcagaagggcttcctggccattgatggcttcacccagtacctgctgagcagtgaatgtgacatctttgatcctgagcagaagaaggtggcccaggacatgacccagcccctgagccactactacatcaatgccagccacaacacctacctgattgaggaccagttccggggccctgctgacatcaatggctacatccgggccctgaagatgggctgccgctctgtggagctggatgtgtctgatggcagtgacaatgagcccatcctgtgcaacagaaacaacatgaccacccacgtgtccttccgcagcgtcatcgaggtgatcaacaagtttgcctttgtggccagcgagtaccccctcatcctgtgcctgggcaaccactgcagcctgccccagcagaaggtgatggcccagcagatgaagaaggtgtttggaaacaagctgtacacagaggcccccctgcccagcgagagctacctgcccagccctgagaagctgaagaggatgatcatcgtgaagggcaagaagctgcccagcgaccctgatgtgctggagggggaggtgacagatgaagatgaggaggccgagatgagcaggaggatgtctgtggactacaatggagagcagaagcagatccggctgtgccgggagctgagtgacctggtgtccatctgcaagtctgtgcagtacagagactttgagctgtccatgaagagccagaactactgggagatgtgcagcttcagcgagacagaggccagcagaattgccaatgagtacccagaagattttgtgaactacaacaagaagttcctgagccgcatctaccccagcgccatgagaattgacagcagcaacctgaacccccaggacttctggaactgtggctgccagatcgtggccatgaacttccagaccccaggccccatgatggacctgcacacaggctggttcctgcagaatggaggctgcggctacgtgctgcggcccagcatcatgagagatgaggtgtcctacttcagcgccaacaccaagggcatcctgcccggggtgagccccctggccctgcacatcaagatcatcagcggccagaacttccccaagcccaagggggcctgtgccaagggagatgtgattgacccctacgtgtgcatcgagatccacggcatcccagctgactgcagcgagcagaggaccaagacagtgcagcagaacagcgacaaccccatctttgatgagacctttgagttccaggtgaacctgcctgagctggccatgatccgctttgtggtgctggatgatgactacatcggagatgagttcatcggccagtacaccatcccctttgaatgtctgcagcccggctacagacatgtgcccctgcggagctttgtgggggacatcatggagcacgtgaccctgtttgtgcacatcgccatcaccaacagaagtggcggcggcaaggcccagaagaggagcctgtctgtgaggatgggcaagaaggtgcgggagtacaccatgctgaggaacatcggcctgaagaccattgatgacatcttcaagattgctgtgcaccccctgcgggaggccatcgacatgagggagaacatgcagaatgccatcgtgtccatcaaggagctgtgtggcctgccccccatcgccagcctgaagcagtgcctgctgaccctgagcagccgcctcatcaccagtgacaacacccccagcgtgtccctggtgatgaaggacagcttcccctacctggagcccctgggcgccatcccagatgtgcagaagaagatgctgacagcctatgacctgatgatccaggagagccgcttcctgattgagatggctgacacagtgcaggagaagatcgtgcagtgccagaaggccggcatggagttccacgaggagctgcacaacctgggcgccaaggagggcctgaagggcaggaagctgaacaaggccacagagagctttgcctggaacatcaccgtgctgaagggccagggcgacctgctgaagaatgccaagaatgaggccatcgagaacatgaagcagatccagctggcctgcctgagctgtggcctgagcaaggcccccagcagcagcgctgaggccaagagcaagaggagcctggaggccatcgaggagaaggagagcagtgaagaaaatggcaagctgtag

SEQ ID NO: 21134 - DNA, 543 bp, Artificial Sequence
  Description of Artificial Sequence: Synthetic coding sequence
atggagcagcccaagggcgtggactggacagtcatcatcctgacctgccagtacaaggacagcgtgcaggtgttccagcgggagctggaggtgcggcagaagcgggagcagatcccagctggcaccctgctgctggccgtggaggaccctgagaagagggtgggcagcggcggggccaccctgaatgccctgctggtggccgctgagcacctgagcgcccgggccggcttcaccggccgggacttcccctttgatgactgtggccgggccttcacctgcctgcctgtggagaaccctgaggcccctgtggaggccctggtgtgcaacctggactgcctgctggacatcatgacctaccgcctgggccctggcagccccccaggagtgtgggtgtgcagcacagacatgctgctgtctgtgcctgccaaccctggagagcctgagaccacctgggactgcctgcccagcagccagccccagcaggaggccagcagcgccctgctggcccacccagccagcggccctgcccccctgccctactag

SEQ ID NO: 21135 - DNA, 429 bp, Artificial Sequence
  Description of Artificial Sequence: Synthetic coding sequence
atgaatgaggtggtgcacaccagccccaccatcggcagcaatgtggaggagatcgtcatcaacaacacccgcttcctgatgtgggacatcggcggccaggagagcctgcggagctcctggaacacctactacaccaacacagaatttgtgattgtggtggtggacagcacagaccgggagcgcatctctgtgacccgggaggagctgtacaagatgctggcccacgaggacctgaggaaggccggcctgctgatctttgccaacaagcaggatgtgaaggagtgcatgacagtggccgagatcagccagttcctgaagctgaccagcatcaaggaccaccagtggcacatccaggcctgctgtgccctgaccggggagggcctgtgccagggcctggagtggatgatgagccggctgaagatcagatag

SEQ ID NO: 21136 - DNA, 342 bp, Artificial Sequence
  Description of Artificial Sequence: Synthetic coding sequence
atggagggcgtgctgtacaagtggaccaactacctgagcggctggcagccccgctggttcctgctgtgtggcggcatcctgagctactatgacagcccagaagatgcctggaagggctgcaagggcagcatccagatggctgtgtgtgagatccaggtgcacagcgtggacaacaccaggatggacctgatcatccctggagagcagtacttctacctgaaggcccggtctgtggccgagcggcagcgctggctggtggccctgggcagcgccaaggcctgcctgacagacagcaggacccagaaggagaagggcaacctgctgaagaccctgaagacctag

SEQ ID NO: 21137 - DNA, 1119 bp, Artificial Sequence
  Description of Artificial Sequence: Synthetic coding sequence
atggccagcaaccacaagagcagcgctgcccggcctgtgtcccggggcggcgtgggcctgaccggccggccccccagcggcatccggcccctgagcggcaacatccgggtggccacagccatgcctcctggaacagcccggcccggcagccggggctgccccatcggcactggaggagtgctgagcagccagatcaaggtggcccacaggcctgtgacccagcagggcctgaccggcatgaagacaggcaccaagggcccccagaggcagatcctggacaagagctactacctgggcctgctgcggagcaagatcagcgagctgaccacagaggtgaacaagctgcagaagggcatcgagatgtacaaccaggagaacagcgtgtacctgtcctatgagaagagagctgagaccctggccgtggagatcaaggagctgcagggccagctggccgactacaacatgctggtggacaagctgaacaccaacacagagatggaggaggtgatgaatgactacaacatgctgaaggcccagaatgaccgggagacccagagcctggatgtgatcttcacagagcggcaggccaaggagaagcagatccgctctgtggaggaggagattgagcaggagaagcaggccacagatgacatcatcaagaacatgagctttgagaaccaggtgaagtacctggagatgaagaccaccaatgagaagctgctgcaggagctggacaccctgcagcagcagctggacagccagaacatgaagaaggagagcctggaggccgagatcgcccacagccaggtgaagcaggaggccgtgctgctgcacgagaagctgtatgagctggagagccaccgggaccagatgattgctgaggacaagagcatcggcagccccatggaggagcgggagaagctgctgaagcagatcaaggatgacaaccaggagatcgcctccatggagcggcagctgacagacaccaaggagaagatcaaccagttcatcgaggagatccggcagctggacatggacctggaggagcaccaggaccccaccaactacggctggaagatcctggagaagaacacaggcagcttcaagaagcaggtgtag

SEQ ID NO: 21138 - DNA, 345 bp, Artificial Sequence; identical to SEQ ID NO: 20878
  Description of Artificial Sequence: Synthetic coding sequence

SEQ ID NO: 21139 - DNA, 327 bp, Artificial Sequence
  Description of Artificial Sequence: Synthetic coding sequence
atggccatggcccccagccccagcctggtgcaggtgtacaccagccctgctgctgtggccgtgtgggagtggcaggacggcctgggcacctggcacccctacagcgccaccgtgtgcagcttcatcgagcagcagtttgtgcagcagaagggccagcgcttcggcctgggcagcctggcccacagcatccccctgggccaggccgaccccagcctggccccctacatcatcgacctgcccagctggacccagttccggcaggacaccggcaccatgagagctgtgcggcggcacctgttcccccagcacagcgcccctggccgctag

SEQ ID NO: 21140 - DNA, 549 bp, Artificial Sequence
  Description of Artificial Sequence: Synthetic coding sequence
atgagggagtgcatcagcatccacgtgggccaggccggcgtgcagattggaaatgcctgctgggagctgtactgcctggagcacggcatccagccagatggccagatgcccagcgacaagaccatcggcggcggagatgacagcttcaacaccttcttcagcgagaccggggccggcaagcacgtgcccagggctgtgtttgtggacctggagcccaccgtgattgactggtgccccaccggcttcaaggtgggcatcaactaccagccccccaccgtggtgcctggaggagacctggccaaggtgcagagagctgtgtgcatgctgagcaacaccacagccatcgccgaggcctgggcccggctggaccacaagtttgacctgatgtatgccaagagggcctttgtgcactggtacgtgggggagggcatggaggagggggagttcagcgaggcccgggaggacatggccgccctggagaaggactatgaggaggtgggcgtggacagcgtggagggggagggggaggaggagggggaggagtactag

SEQ ID NO: 21141 - DNA, 483 bp, Artificial Sequence; identical to SEQ ID NO: 20009
  Description of Artificial Sequence: Synthetic coding sequence

SEQ ID NO: 21142 - DNA, 3483 bp, Artificial Sequence
  Description of Artificial Sequence: Synthetic coding sequence
atggcctgcagaagacgctactttgtggagggggaggcccccagcagcgagaccggcaccagcctggacagccccagcgcctacccccagggccccctggtgcccggcagcagcctgagcccagaccactatgagcacacctctgtgggcgcctacggcctgtacagcggccccccaggccagcagcagaggacccggcggcccaagctgcagcacagcaccagcatcctgaggaagcaggccgaggaggaggccatcaagaggagccgcagcctgtctgagagctatgagctgagcagtgacctgcaggacaagcaggtggagatgctggagaggaaatatggaggccgcctggtgaccaggcatgctgcccggaccatccagacagccttccggcagtaccagatgaacaagaactttgagcggctgcggagctccatgtctgaaaataggatgagccgccgcatcgtgctgagcaacatgaggatgcagttctcctttgagggccctgagaaggtgcacagcagctactttgagggcaagcaggtgtctgtgaccaatgatggcagccagctgggcgccctggtgtccccagaatgtggggacctgtctgagcccaccaccctgaagagccctgcccccagcagtgactttgctgatgccatcacagagctggaggatgccttcagccggcaggtgaagagcctggccgagagcattgatgatgccctgaactgccgcagcctgcacacagaggaggccccagccctggatgctgcccgggcccgggacacagagccccagacagccctgcacggcatggaccacaggaagctggatgagatgacagccagctacagtgatgtgaccctgtacattgatgaggaggagctgagcccccccctgcccctgagccaggccggggaccggcccagcagcacagaaagtgacctgcggctgcgggccggcggggccgccccagactactgggccctggcccacaaggaggacaaggctgacacagacaccagctgccgcagcacccccagcctggagcggcaggagcagaggctgcgggtggagcacctgcccctgctgaccatcgagccccccagcgacagctctgtggacctgagtgacagaagtgagcggggcagcctgaagaggcagagcgcctatgaaagaagcctgggcggccagcagggcagccccaagcacggcccccacagcggggcccccaagagcctgccccgggaggagcctgagctgcggcccaggcctccccggcccctggacagccacctggccatcaatggcagcgccaaccggcagagcaagtctgagagtgactacagtgatggagacaatgacagcatcaacagcaccagcaacagcaatgacaccatcaactgcagcagcgagagcagcagccgggacagcctgcgggagcagaccctgagcaagcagacctaccacaaggaggccaggaacagctgggacagccctgccttcagcaatgatgtgatcaggaagaggcactaccgcatcggcctgaacctcttcaacaagaagccagagaagggcgtgcagtacctgattgagcggggctttgtgcctgacacccctgtgggcgtggcccacttcctgctgcagaggaagggcctgagccggcagatgattggagagttcctgggcaaccggcagaagcagttcaacagagatgtgctggactgtgtggtggatgagatggacttcagcaccatggagctggatgaggccctgaggaagttccaggcccacatccgggtgcagggcgaggcccagaaggtggagcggctcatcgaggccttcagccagcgctactgcatctgcaaccctggggtggtgcggcagttcagaaatccagacaccatcttcatcctggcctttgccatcatcctgctgaacacagacatgtacagccccaacgtgaagccagagaggaagatgaagctggaggacttcatcaagaacctgcggggcgtggatgatggagaggacatcccccgggagatgctgatgggcatctatgaaagaatcaggaagcgggagctgaagaccaatgaagaccacgtgtcccaggtgcagaaggtggagaagctgattgtgggcaagaagcccatcggcagcctgcaccctggcctgggctgtgtgctgagcctgccccaccggcggctggtgtgctactgccgcctgtttgaggtgcctgaccccaacaagccccagaagctgggcctgcaccagcgggagatcttcctgttcaatgacctgctggtggtgaccaagatcttccagaagaagaagaacagcgtgacctacagcttccggcagagcttcagcctgtatggcatgcaggtgctgctgtttgagaaccagtactacccaaatggcatccggctgaccagctctgtgcctggagctgacatcaaggtgctgatcaacttcaatgcccccaacccccaggacaggaagaagttcacagatgacctgcgggagagcattgctgaggtgcaggagatggagaagcaccgcatcgagagcgagctggagaagcagaagggcgtggtgcggcccagcatgagccagtgcagcagcctgaagaaggagagcggaaatggcaccctgagccgggcctgcctggatgacagctatgccagcggggagggcctgaagaggtctgccctgagcagcagcctgcgggacctgtctgaggccggcaagagaggaagaagaagcagcgctggcagcctggagagcaatgtggagggcagcatcatcagcagcccccacatgagaagaagagccaccagcaccagagaatgtcccagccggccccaccagaccatgcccaacagcagcagcctgctgggcagcctgtttggcagcaagaggggcaagcccccaccccaggcccacctgcccagcgccccagccctggccaccccaccacccaccggcggccctgccagcctggccgccctgtgtggctggcccccacctggggcccccagaggagctgctgctggaagacatgcccgggccagccaccctgtgctgccccatgctgagcccagccctgtgccccccagccccccacctccacccaccccagcccacccagcccggacccctgtgcccccccggcccccctggggcccccccagcctgcggggcccctgcccccggcccccagctgctgccctgggccccaggggggcccacagcgccccaccctgggccgccccctgcccagctgccccccaccagcagcagggccagacccagaggcaccagcacaactgtgtggacagcctgggccggggcccccggctgcctgagaccccagcccaccacacaggccacgcccggggcagccctgctgcccaccagacccggggcacctctgtggccatcagccccctgtgccccagccggcccaactag

SEQ ID NO: 21143 - DNA, 378 bp, Artificial Sequence
  Description of Artificial Sequence: Synthetic coding sequence
atgaagaaggagcacgtgctgcactgccagttcagcgcctggtaccccttcttccggggcgtgaccatcaagagcgtcatcctgcccctgccccagaatgtgaaggactacctgctggatgatggcaccctggtggtgtctggaagagatgacccccccacccacagccagcctgacagtgatgatgaggccgaggagatccagtggagcgatgatgaaaatacagccaccctgacagatgcctactggatcgccatgaacagcagcctgaagtgcaagaccctgagtgacatcttcctgctcttcaagagcagtgacttcatcacccgggacttcacccagcccttcatccactgcacagatgacagcccagactag

SEQ ID NO: 21144 - DNA, 414 bp, Artificial Sequence; identical to SEQ ID NO: 20774
  Description of Artificial Sequence: Synthetic coding sequence

SEQ ID NO: 21145 - DNA, 3222 bp, Artificial Sequence
  Description of Artificial Sequence: Synthetic coding sequence
atggaggagaggaagcatgagaccatgaacccagcccacgtgctgtttgacagatttgtgcaggccaccacctgcaagggcaccctgaaggccttccaggagctgtgtgaccacctggagctgaagcccaaggactaccgctccttctaccacaagctgaagagcaagctgaactactggaaggccaaggccctgtgggccaagctggacaagaggggcagccacaaggactacaagaagggcaaggcctgcaccaacaccaagtgcctgatcatcggggccggcccctgtggcctgaggacagccatcgacctgagcctgctgggcgccaaggtggtggtgattgagaagagagatgccttcagcagaaataatgtgctgcacctgtggcccttcaccatccatgacctgcggggcctgggcgccaagaagttctacggcaagttctgtgccggggccatcgaccacatcagcatccggcagctgcagctgatcctgctgaaggtggccctgatcctgggcatcgagatccacgtgaatgtggagttccagggcctcatccagcccccagaggaccaggagaatgaaagaattggctggagggccctggtgcaccccaagacccaccctgtgtctgaatatgaatttgaggtgatcattggaggagatggaagaagaaacaccctggagggcttccggaggaaggagttccggggcaagctggccatcgccatcacagccaacttcatcaacagaaacaccacagctgaggccaaggtggaggagatcagcggcgtggccttcatcttcaaccagaagttcttccaggagctgcgggaggccaccggcatcgacctggagaacatcgtgtactacaaggatgacacccactactttgtgatgacagccaagaagcagagcctgctggacaagggcgtcatcctgcatgactatgctgacacagagctgctgctgagccgggagaatgtggaccaggaggccctgctgtcctatgcccgggaggccgctgacttcagcacccagcagcagctgcccagcctggactttgccatcaaccactacggccagccagatgtggccatgtttgacttcacctgcatgtatgcctctgaaaatgctgccctggtgcgggagcagaatggccaccagctgctggtggccctggtgggggacagcctgctggagcccttctggcccatgggcactggaattgcccggggcttcctggccgccatggattctgcctggatggtgcgctcctggagcctgggcaccagccccctggaggtgctggccgagcgggagagcatctaccgcctgctgccccagaccaccccagaaaatgtgtccaagaacttcagccagtacagcattgatcctgtgacccgctaccccaacatcaacgtgaacttcctgcggcccagccaggtgcgccacctgtatgacaccggggagaccaaggacatccacctggagatggagagcctggtgaacagcaggaccacccccaagctgaccagaaatgaatctgtggcccggagcagcaagctgctgggctggtgccagaggcagacagatggctacgccggcgtgaatgtgacagacctgaccatgtcctggaagagcggcctggccctgtgtgccatcatccaccgctacagaccagacctgattgactttgacagcctggatgagcagaatgtggagaagaacaaccagctggcctttgatattgctgagaaggagctgggcatcagccccatcatgaccgggaaggagatggcctctgtgggggagccagacaagctgtccatggtgatgtacctgacccagttctatgagatgttcaaggacagcctgcccagcagtgacaccctggacctgaatgctgaggagaaggctgtgctgattgccagcaccaggagccccatctccttcctgagcaagctgggccagaccatcagcaggaagaggagccccaaggacaagaaggagaaggacctggatggagctgggaagaggaggaagaccagccagagcgaggaggaggaggccccccggggccacagaggagagcggcccaccctggtgtccaccctgacagacaggaggatggatgtggccgtgggcaaccagaacaaggtgaagtacatggccacccagctgctggccaagtttgaagaaaatgccccagcccagagcatcggcatccggcggcagcagcgggagaaggagtgcagcaggacctgccccaagaaggtgatcaccctgagccccccacccaccccaccaccctgccgggcccacggcggccagcagacctacagagacctggatgctgacaacagaggcaagcagagcccccaccacgagaggcctgagcctgagcccccccggcgcttctttgtggaccagtgggagctgagcctgagcctgcggagcagcgcccggcctgccagccccagcagtgacagcctgcggcagaagtacatcaagatgtacacaggaggagtgagcagcctggccgagcagatcgccaaccagctgcagaggaaggagcagcccaaggccctgctggacaagaaggagctgggctccatgaagaaggagttcccccagaacctgggcggcagtgacacctgctacttctgccagaagagggtgtatgtgatggagcggctgtctgctgagggcaagttcttccacaggagctgcttcaagtgtgagtactgtgccaccaccctgcggctgagcgcctatgcctatgacattgaagatggcaagttctactgcaagccccactactgctaccgcctgagcggctacgcccagaggaagaggcctgctgtggcccccctgagcggcaaggaggccaagggccccctgcaggatggagccaccacagatgccaacggccgggccaatgctgtggccagcagcacagagaggaccccaggcagcctgaccagcctgtttggctgggtggcccggcacagcctgggcctgtgtgacaaggccaagggcatgagccagcacctgcagagcaacatcagcagctttggccagcaggtggcccagaaccccctggacagcttcttcatgtgccagctgctggcctttggagtgcccttcctgtatggcctgtctgaggtgctggtgcagatccggggggagttccactggcaggccgtggcccagtag

SEQ ID NO: 21146 - DNA, 543 bp, Artificial Sequence
  Description of Artificial Sequence: Synthetic coding sequence
atgttcctgagctgtggcagcctgcaccagaggggccctgagacagatggcaccgtcttccgcatccacaccaaggccgagggcttcatggatgtggacatccccctggagctggtgttccacctgcctgtgaactaccccagctgcctgcccggcatcagcatcaacagcgagcagctgacccgggcccagtgtgtgacagtgaaggagaacctgctggagcaggccgagagcctgctgtctgagcccatggtgcatgagctggtgctgtggatccagcagaacctgcggcacatcctgagccagcctgagactggaagtggcagcgagaagtgcaccttcagcaccagcaccaccatggatgatggcctgtggatcaccctgctgcacctggaccacatgagggccaagaccaagtatgtgaagatcgtggagaagtgggccagtgacctgcggctgaccggccgcctgatgttcatgggcaagatcatcctgatcctgctgcagggcgacaggaacaacctgaaggtgcccaagagctag

SEQ ID NO: 21147 - DNA, 1521 bp, Artificial Sequence
  Description of Artificial Sequence: Synthetic coding sequence
atgaagagaagatctgtgaccatgacagatggcctgacagctgacaaggtgaccaggagtgatggctgccccaccagcaccagcctgccccggccccgggacagcatccgcagctgtgccctgtccatggaccagatcccagacctgcacagccccatgagccccatcagcgagagccccagcagccctgcctacagcacagtgaccagggtgcatgctgccccagctgcccccagcgccacagccctgcctgccagccctgtggcccggcgcagcagcgagccccagctgtgccccggcagcgcccccaagacccacggggagagtgacaagggcccccacaccagccccagccacaccctgggcaaggccagccccagccccagcctgagcagctacagcgaccctgacagcggccactactgccagctgcagccccctgtgcggggcagccgggagtgggccgccacagagaccagcagccagcaggcccggagctatggagagcggctgaaggagctgtctgaaaatggagcccctgagggggactggggcaagaccttcaccgtgcccatcgtggaggtgaccagcagcttcaacccagccaccttccagagcctgctgatcccccgggacaaccggcccctggaggtgggcctgctgaggaaggtgaaggagctgctggccgaggtggatgcccggaccctggcccggcacgtgaccaaggtggactgcctggtggcccgcatcctgggcgtgaccaaggagatgcagaccctgatgggcgtgcgctggggcatggagctgctgaccctgccccacggccggcagctgcggctggacctgctggagcgcttccacaccatgagcatcatgctggccgtggacatcctgggctgcaccggcagcgctgaggagcgggccgccctgctgcacaagaccatccagctggccgctgagctgcggggcaccatgggcaacatgttctcctttgctgctgtgatgggcgccctggacatggcccagatcagccggctggagcagacctgggtgaccctgcggcagaggcacacagagggcgccatcctgtatgagaagaagctgaagcccttcctgaagagcctgaatgaaggcaaggagggcccccccctgagcaacaccaccttcccccacgtgctgcccctcatcaccctgctggagtgtgacagcgcccctcctgagggccctgagccctggggcagcacagaacatggagtggaggtggtgctggcccacctggaggccgccaggacagtggcccaccacggcggcctgtaccacaccaatgctgaggtgaagctgcagggcttccaggcccggcctgagctgctggaggtgttcagcacagagttccagatgaggctgctgtggggcagccagggcgccagcagcagccaggccaggagatatgagaagtttgacaaggtgctgacagccctgagccacaagctggagcctgctgtgcgcagcagcgagctgtag

SEQ ID NO: 21148 - DNA, 369 bp, Artificial Sequence; identical to SEQ ID NO: 21112
  Description of Artificial Sequence: Synthetic coding sequence

SEQ ID NO: 21149 - DNA, 369 bp, Artificial Sequence
  Description of Artificial Sequence: Synthetic coding sequence
atgcctgagatcaacaccaaccacctggacaagcagcaggtgcagctgctggccgagatgtgcatcctgattgatgaaaatgacaacaagattggagctgagaccaagaagaactgccacctgaatgaaaatattgagaagggcctgctgcaccgggccttctctgtgttcctgttcaacacagagaacaagctgctgctgcagcagaggagtgatgccaagatcaccttccctggctgcttcaccaacacctgctgcagccaccccctgagcaacccagctgagctggaggagagtgatgccctgggcgtgagaagagctgcccagaggcggctgaaggccgagctgggcatccccctggaggagtag

SEQ ID NO: 21150 - DNA, 408 bp, Artificial Sequence; identical to SEQ ID NO: 20517
  Description of Artificial Sequence: Synthetic coding sequence

SEQ ID NO: 21151 - DNA, 3282 bp, Artificial Sequence
  Description of Artificial Sequence: Synthetic coding sequence
atgggcactggagacttcatctgcatctccatgactggaggagccccctggggcttccggctgcagggcggcaaggagcagaagcagcccctgcaggtggccaagatccggaaccagagcaaggccagcggcagcggcctgtgtgaaggagatgaggtggtgtccatcaatggaaacccctgtgccgacctgacctacccagaggtgatcaagctgatggagagcatcacagacagcctgcagatgctgatcaagaggcccagcagcggcatcagcgaggccctgatcagtgaaaatgaaaacaagaacctggagcacctgacccatggaggctacgtggagagcaccaccctgcagatccggcctgccaccaagacccagtgcacagagttcttcctggcccctgtgaagacagaggtgcccctggccgagaaccagaggagcggccctgactgtgccggcagcctgaaggaggagaccggccccagctaccagagggccccccagatgccagacagccagaggggccgggtggccgaggagctgatcctgcgggagaaggtggaggccgtgcagcccggccctgtggtggagctgcagctgagcctgagccaggagcggcacaagggggccagcggccccctggtggccctgcctggagctgagaagagcaagagcccagaccctgaccccaacctgagccatgaccgcatcgtgcacatcaacagcatccccaccaatgagaaggctgaccccttcctgcggagcagcaagatcatccagatcagcagcggccgggagctgcgggtcatccaggagagcgaggccggagatgctggcctgccccgggtggaggtgatcctggactgcagcgaccggcagaagacagagggctgccgcctgcaggccggcaaggaatgtgtggacagccctgtggagggcggccagagcgaggccccacccagcctggtgtcctttgctgtgagcagcgagggcacagagcagggcgaggaccccaggtctgagaaggaccacagccggccccacaagcaccgggcccggcatgcccggctgcggcgctctgagagcctgtctgagaagcaggtgaaggaggccaagagcaagtgcaagagcatcgccctgctgctgacagatgcccccaaccccaacagcaagggcgtgctgatgttcaagaagagaagaagaagagccaggaagtacaccctggtgtcctatggcaccggggagctggagcgggaggctgatgaggaggaggagggggacaaggaggacacctgtgaggtggccttcctgggcgccagcgagagcgaggtggatgaggagctgctgagtgatgtggatgacaacacccaggtggtgaactttgactgggacagcggcctggtggacatcgagaagaagctgaacagaggagacaagatggagatgctgcctgacaccaccgggaagggggccctgatgtttgccaagaggcgggagaggatggaccagatcacagcccagaaggaggaggacaaggtgggcggcacccccagccgggagcaggatgctgcccagacagatggcctgcggaccaccaccagctaccagaggaaggaggaggagagcgtgaggacccagagctctgtgtccaagagctacatcgaggtgagccacggcctgggccacgtgccccagcagaatggcttcagcggcaccagcgagacagccaacatccagaggatggtgcccatgaacagaacagccaagcccttccctggctctgtgaaccagcctgccacccccttcagccccaccaggaacatgaccagccccatcgctgacttccctgcccccccaccctacagcgctgtgaccccacctccagatgccttcagcagaggagtgagcagccccatcgccggccctgcccagcccccaccctggccccagcctgccccctggagccagcctgccttctatgacagcagcgagagaattgccagcagagatgagcgcatctctgtgcctgccaagaggacaggcatcctgcaggaggccaagagaagaagcaccaccaagcccatgttcaccttcaaggagcccaaggtgagccccaaccctgagctgctgagcctgctgcagaacagcgagggcaagaggggcactggagctggaggagacagcggccctgaggaggactacctgagcctgggcgctgaggcctgcaacttcatgcagagcagcagcgccaagcagaagaccccacctcctgtggcccccaagccagctgtgaagagcagcagcagccagcctgtgacccctgtgtcccctgtgtggagccctggggtggcccccacccagcccccagccttccccaccagcaaccccagcaaaggaacagtggtgagcagcatcaagatcgcccagcccagctaccccccagcccggcctgccagcaccctgaatgtggccggccccttcaagggcccccaggccgctgtggccagccagaactacacccccaagcccaccgtgtccacccccaccgtgaatgctgtgcagcccggggctgtgggccccagcaatgagctgcccggcatgagcggccgcggggcccagctgtttgccaagaggcagagcaggatggagaagtatgtggtggacagcgacacagtgcaggcccatgctgcccgggcccagagccccacccccagcctgcctgcctcctggaagtacagcagcaatgtgcgggcccctcctcctgtggcctacaaccccatccacagccccagctaccccctggccgccctgaagagccagcccagcgctgcccagcccagcaagatgggcaagaagaagggcaagaagcccctgaatgccctggatgtgatgaagcaccagccctaccagctgaatgccagcctcttcaccttccagcccccagatgccaaggatggcctgccccagaagagctctgtgaaggtgaacagcgccctggccatgaagcaggccctgccccccaggcctgtgaatgctgccagccccaccaacgtgcaggccagctctgtgtacagcgtgcctgcctacaccagccccccatccttctttgctgaggccagcagccctgtgtctgccagccctgtgcctgtgggcatccccaccagccccaagcaggagagcgccagcagcagctactttgtggccccccggcccaagttcagcgccaagaagtctggagtgaccatccaggtgtggaagcccagcgtggtggaggagtag

SEQ ID NO: 21152 - DNA, 600 bp, Artificial Sequence
  Description of Artificial Sequence: Synthetic coding sequence
atggccatcgtgcagaccctgcctgtgcccctggagcccgcccctgaggccgccacagccccccaggcccctgtgatgggctctgtgagcagcctcatcagcggccggccctgccctgggggccctgccccacccaggcaccacggccccccaggccccaccttcttccggcagcaggacggcctgctgcggggcggctatgaggcccaggagcccctgtgcccagctgtgccccccaggaaggctgtgcctgtgaccagcttcacctacatcaatgaagacttcagaacagagagcccccccagccccagcagtgatgtggaggatgcccgggagcagagggcccacaatgcccacctgcggggccccccacccaagctgatccctgtgtctgggaagctggagaagaacatggagaagatcctgatccggcccacagccttcaagcctgtgctgcccaagcccaggggggcccccagcctgcccagcttcatgggcccccgggccaccggcctgagcggcagccagggcagcctgacccagctgtttggaggccctgccagcagcagcagcagcagcagcagcagcagcgctgcctag

SEQ ID NO: 21153 - DNA, 612 bp, Artificial Sequence
  Description of Artificial Sequence: Synthetic coding sequence
atgcccagcaccccagccagcaccatcagcgcccgggaggagctggtgcagagaattcctgaggccagcctgaacttccagaaggtgcccccaggcagcctgaacagccgggactttgaccagaacatgaatgacagctgtgaagatgccctggccaacaagacccggcccaggaaccgggaggaggtgatctttgacaacctgatgctgaaccctgtgtcccagctgagccaggccatccgggagaacacagagcacctggccgagaagatgaagatcctcttccagaacacaggccgggcctgggaggacctggaggcccgcatcaatgcagaaaatgaggtgcccatcctgaagaccagcaacaaggagatcagcagcatcctgaaggagctgcggcgggtgcagaagcagctggaggtgatcaatgccatcgtggaccccagcggcagcctggacctgctgctgcccaccctgagcagctttgtgcccccacctccagcctttgcctgggagctggtgctggtgtgccgggccagcagaagagtgcactgcacctttgtgctgcgctggagctgtggctgcctgtctgaaaatggctacttcatctag

SEQ ID NO: 21154 - DNA, 321 bp, Artificial Sequence
  Description of Artificial Sequence: Synthetic coding sequence
tgacccaccaccagcaggcctgccctggatgtgaagggcggcaccagccctgccaaggaggatgccaaccaggagatgagctctgtggcctacagcaacctggccgtgaaggacaggaaggctgtggccatcctgcactacccaggagtggccagcaatggcaccaagagccctgccatcatcgacagcgaccctgtggatgaggaggtgctgatgagcctggtggtggagctgggcctggaccgggccaatgagctgcctgagctgtggctgggccagaatgaatttgacttcaccgctgacttccccagcagctgctag

SEQ ID NO: 21155 - DNA, 456 bp, Artificial Sequence
  Description of Artificial Sequence: Synthetic coding sequence
atggccgccttccgggacatcgaggaggtgtcccagggcctgctgagcctgctgggcgccaacagagctgaggcccagcagaggcggctgctgggcagacatgagcaggtggtggagcggctgctggagacccaggatggagctgagaagcagctgcgggagatcctgaccatggagaaggaggtggcccagagcctgctgaatgccaaggagcaggagcggcaggagaaggaggtggatgaggacaccaccgtgaccatccccagcgctgtgtatgtggcccagctgtaccaccaggtgtccaagattgagtgggactatgaatgtgagcccggcatggtgaagggcatccaccacggccccagcgtggcccagcccatccacctggacagcacccagctgagcaggaagttcatcagtgactacctgtggagcctggtggacacagagtggtag

SEQ ID NO: 21156 - DNA, 444 bp, Artificial Sequence
  Description of Artificial Sequence: Synthetic coding sequence
atgctgcgctgtggccagatgatctttgcccaggccctggtgtgccgccacctgggccgggactggcgctggacccagaggaagaggcagcctgacagctacttctctgtgctgaatgccttcatcgacaggaaggacagctactacagcatccaccagatcgcccagatgggcgtgggggagggcaagagcatcggccagtggtacggccccaacacagtggcccaggtgctgaagaagctggccgtgtttgacacctggagcagcctggccgtgcacatcgccatggacaacacagtggtgatggaggagatccggcggctgtgcaggacctctgtgccctgtgccggggccacagccttccctgctgacagcgacagacactgcaatggcttccctgctggagctgaggtgaccaaccggcccagcccctggaggccctag

SEQ ID NO: 21157 - DNA, 1482 bp, Artificial Sequence
  Description of Artificial Sequence: Synthetic coding sequence
atggagaagtatgagaacctgggcctggtgggggagggcagctatggcatggtgatgaagtgcaggaacaaggacaccggcagaattgtggccatcaagaagttcctggagagtgatgatgacaagatggtgaagaagatcgccatgagggagatcaagctgctgaagcagctgcggcatgagaacctggtgaacctgctggaggtgtgcaagaagaagaagcgctggtacctggtgtttgaatttgtggaccacaccatcctggatgacctggagctgttccccaacggcctggactaccaggtggtgcagaagtacctgttccagatcatcaatggcatcggcttctgccacagccacaacatcatccaccgggacatcaagccagagaacatcctggtgtcccagagcggcgtggtgaagctgtgtgactttggatttgcccggaccctggccgcccctggagaggtgtacacagattatgtggccacccgctggtaccgggcccctgagctgctggtgggagatgtgaagtatggcaaggctgtggatgtgtgggccatcggctgcctggtgacagagatgttcatgggagagcccctcttccctggggacagcgacatcgaccagctgtaccacatcatgatgtgcctgggcaacctgatccccaggcaccaggagctgttcaacaagaaccctgtgtttgctggggtgcggctgcctgagatcaaggagcgggagcccctggagcggcgctaccccaagctgtctgaggtggtgattgacctggccaagaagtgcctgcacatcgaccctgacaagaggcccttctgtgccgagctgctgcaccacgacttcttccagatggatggctttgctgagcgcttcagccaggagctgcagctgaaggtgcagaaggatgccagaaatgtgtccctgagcaagaagagccagaacaggaagaaggagaaggagaaggatgacagcctggtggaggagaggaagaccctggtggtgcaggacaccaatgctgaccccaagatcaaggactacaagctgttcaagatcaagggcagcaagattgatggagagaaggccgagaagggcaacagagccagcaatgccagctgcctgcatgacagcaggaccagccacaacaagatcgtgcccagcaccagcctgaaggactgcagcaatgtgtctgtggaccacaccaggaaccccagcgtggccatcccccccctgacccacaacctgtctgctgtggcccccagcatcaacagcggcatgggcacagagaccatccccatccagggctacagagtggatgagaagaccaagaagtgcagcatcccctttgtgaagcccaacagacacagccccagcggcatctacaacatcaacgtgaccaccctggtgtctggcccccccctgagtgatgacagcggggctgacctgccccagatggagcaccagcactag

SEQ ID NO: 21158 - DNA, 6189 bp, Artificial Sequence
  Description of Artificial Sequence: Synthetic coding sequence
atggatggctgcctggacacagagacccccaccgtgtccatccaggagaatgtggatgtggccagcctgaagcccatcagtgacagcggcatcaacttcacagatgccatctggagccccacctgtgagaggaggacctgtgagtgccacgagagcattgagaagaacaaggacaagacagacctgccccagagcgtggtgtaccagaatgaggagggccgctgggtgacagacctggcctactacaccagcttcaacagcaagcagaacctgaatgtgtccctgagtgatgagatgaatgaagacttccgcagcggcagcgaggcctttgacctgattgcccaggatgaggaggagttcaacaaggagcaccagttcatccagcccagctttggctacttcatccgcagccctgagaagcgggagcccatcgccctgatcaggaagagtgatgtgtcccggggcaacctggagaaggagatggcccacctgaaccacgacctgtacagcggggacctgaatgagcagagccaggcccagctgtctgagggcagcatcaccctgcaggtggaggccgtggagagcaccagccaggtggatgaaaatgatgtgaccctgacagctgacaagggcaagacagaggacaccttcttcatgagcaacaagccccagcgctacaaggacaagctgcctgattctggggacagcatgctgcgcatcagcaccatcgccagcgccatcgccgaggcctctgtgaacacagaccccagccagctggccgccatgatcaaggccctgagcaacaagacccgggacaagaccttccaggaggatgagaagcagaaggactacagccacgtgcgccacttcctgcccaatgacctggagaagagcaatggcagcaatgccctggacatggagaagtacctgaagaagacagaggtgagccgctatgagagcgccctggagaacttcagccgggcctccatgtctgacacctgggacctgagcctgcccaaggagcagaccacccaggacatccaccctgtggacctgagcgccacctctgtgtctgtgcgggcccctgaggagaacacagctgccatcgtgtatgtggagaatggagagagcgagaaccaggagagcttccgcaccatcaacagcagcaacagcgtgaccaaccgggagaacaacagcgctgtggtggatgtgaagacctgcagcattgacaacaagctgcaggatgtgggcaatgatgagaaggccaccagcatcagcacccccagcgacagctacagctctgtgaggaacccccgcatcaccagcctgtgcctgctgaaggactgtgaggagatccgggacaaccgggagaaccagaggcagaatgaatgtgtgtctgagatcagcaacagcgagaagcacgtgacctttgagaaccaccgcatcgtgagccccaagaacagcgacctgaagaacaccagccctgagcacggcggccggggctctgaagatgagcaggagagcttccggcccagcaccagccccctgagccacagcagccccagcgagatcagcggcaccagcagcagcggctgtgccctggagagctttggatctgctgcccagcagcagcagcccccctgtgagcaggagctgagccccctggtgtgcagccctgctggggtgtcccggctgacctacgtgtctgagcctgagagcagctaccccaccacagccacagatgatgccctggaggacaggaagagtgacatcaccagcgagctgagcaccaccatcatccagggcagccctgctgccctggaggagcgggccatggagaagctgcgggagaaggtgcccttccagaacagaggcaagggcaccctgagcagcatcatccagaacaacagcgacaccaggaaggccacagagaccaccagcctgagcagcaagccagaatatgtgaagccagacttccgctggagcaaggaccccagcagcaagagcggcaacctgctggagaccagcgaggtgggctggaccagcaaccctgaggagctggaccccatccggctggccctgctgggcaagagcggcctgagctgccaggtgggcagcgccaccagccaccctgtgtcctgccaggagcccattgatgaggaccagaggatcagccccaaggacaagagcacagctggccgggagttcagcggccaggtgagccaccagaccaccagcgagaaccagtgcacccccatccccagcagcacagtgcacagctctgtggccgacatgcagaacatgcctgctgctgtgcacgccctgctgacccagcccagcctgtctgctgccccctttgcccagcgctacctgggcaccctgcccagcacaggcagcaccaccctgccccagtgccacgccggaaatgccaccgtgtgtggcttcagcggcggcctgccctacccagctgtggccggggagcctgtgcagaacagcgtggccgtgggcatctgcctgggcagcaacatcggcagcggctggatgggcaccagcagcctgtgcaacccctacagcaacaccctgaaccagaacctgctgagcaccaccaagcccttccctgtgcccagcgtgggcaccaactgtggcatcgagccctgggacagcggcgtgaccagcggcctgggctctgtgcgggtgcctgaggagctgaagctgccccacgcctgctgcgtgggcatcgccagccagaccctgctgtctgtgctgaaccccacagaccgctggctgcaggtgtccattggagtgctgagcatctctgtgaatggagagaaggtggacctgagcacctaccgctgcctggtgttcaagaacaaggccatcatccggccccacgccacagaggagatcaaggtgctcttcatccccagcagccctggggtcttccgctgcaccttctctgtggcctcctggccctgcagcacagatgctgagaccatcgtgcaggccgaggccctggccagcacagtgaccctgacagccatcgccgagagccctgtgattgaggtggagacagagaagaaggatgtgctggactttggagacctgacctatggaggctggaaggccctgcccctgaagctgatcaacagaacccacgccaccgtgcccatccgcctcatcatcaatgccaatgctgtggcctggcgctgcttcaccttcagcaaggagagcgtgcgggcccctgtggaggtggccccctgtgctgatgtggtgacccggctggccggccccagcgtggtgaaccacatgatgcctgccagctatgatggccaggaccctgagttcctgatgatctgggtgctcttccacagccccaagaagcagatcagcagcagtgacatcctggacagcgctgaggagttcagcgccaaggtggacatcgaggtggacagccccaaccccacccctgtgctgcggtctgtgtccctgcgggcccgggccggcatcgcccgcatccacgccccccgggacctgcagaccatgcacttcctggccaaggtggccagcagcaggaagcagcacctgcccctgaagaatgccggcaacatcgaggtgtacctggacatcaaggtgcctgagcagggcagccacttctctgtggaccccaagaacctgctgctgaagccaggagaggagcatgaagtcatcgtgtccttcacccccaaggaccctgaggcctgtgaggagcgcatcctgaagatctttgtgcagcccttcggcccccagtatgaggtggtgctgaagggggaggtgatcagcagcggcagcaagcccctgagccctggcccctgcctggacatccccagcatcctgagcaacaagcagttcctggcctggggcggcgtgcccctgggccgcacccagctgcagaagctggccctgaggaacaacagcgccagcaccacccagcacctgcggctgctgatccggggccaggaccaggactgcttccagctgcagaacacctttggaagtgagcagaggctgaccagcaactgtgagatccgcatccaccccaaggaggacatcttcatctctgtgctgtttgcccccacccggctgagctgcatgctggcccggctggagatcaagcagctgggcaacagaagccagcccggcatcaagttcaccatccccctgagcggctatggaggcaccagcaacctgatcctggagggcgtgaagaagctgagtgacagctacatggtgacagtgaatggcctggtgcctgggaaggagagcaagatcgtgttttctgtgaggaacacaggcagcagagctgcctttgtgaaggctgtgggcttcaaggacagccagaagaaggtgctgctggaccccaaggtgctgcgcatcttcccagacaagtttgtgctgaaggagaggacccaggagaatgtgaccctcatctacaaccccagcgaccggggcatcaacaacaagacagccacagagctgagcacagtgtacctgtttggaggagatgagatcagccggcagcagtaccgccgggccctgctgcacaagccagagatgatcaagcagatcctgcctgagcacagcgtgctgcagaacatcaactttgtggaggccttccaggatgagctgctggtgacagaggtgtatgacctgccccagaggcccaatgatgtgcagctgttctacggctccatgtgcaagatcatcctgtctgtgattggagagttccgggactgcatcagcagccgggagttcctgcagcccagcagcaaggccagcctggagagcaccagtgacctgggcgccagcggcaagcacggcggcaatgtgtccctggatgtgctgcctgtgaagggcccccagggcagccccctgctgagcagagctgcccggccccccctggaccagctggccagcgaggagccctggacagtgctgcctgagcacctgatcctggtggcccccagcccctgtgacatggccaagacaggccgcttccagatcgtgaacaacagcgtgcggctgctgcgctttgagctgtgctggccagcccactgcctgactgtgaccccccagcacggctgtgtggcccctgagagcaagctgcagatcctggtgagccccaacagcagcctgagcaccaagcagagcatgttcccctggagcggcctcatctacatccactgtgatgatggccagaagaagatcgtgaaggtgcagatccgggaggacctgacccaggtggagctgctgacccggctgaccagcaagcccttcggcatcctgagccctgtgtctgagcccagcgtgagccacctggtgaagcccatgaccaagccacccagcaccaaggtggagatccggaacaagagcatcaccttccccaccacagagcctggagagaccagcgagagctgcctggagctggagaaccacggcaccacagatgtgaagtggcacctgagcagcctggccccaccctacgtgaagggcgtggatgaaagtggagatgtgttccgggccacctacgccgccttccgctgcagccccatcagcggcctgctggagagccacggcatccagaaggtgtccatcaccttcctgccccggggccgcggggactatgcccagttctgggatgtggagtgccaccccctgaaggagccccacatgaagcacaccctgcgcttccagctgagcggccagagcattgaagcagaaaatgaaccagaaaatgcctgcctgagcacagacagcctcatcaagattgaccacctggtgaagccccggcggcaggccgtgtctgaggccagcgcccgcatccctgagcagctggatgtgacagcccggggcgtgtatgccccagaagatgtgtaccgcttccggcccacctctgtgggggagagcaggaccctgaaggtgaacctgaggaacaacagcttcatcacccacagcctgaagttcctgagcccccgggagcccttctacgtgaagcacagcaagtacagcctgcgggcccagcactacatcaacatgcctgtgcagttcaagcccaagtctgctgggaagtttgaggccctgctggtgatccagacagatgagggcaagagcatcgccatccggctgattggagaggccctgggcaagaactag

SEQ ID NO: 21159 - DNA, 1545 bp, Artificial Sequence
  Description of Artificial Sequence: Synthetic coding sequence
atgagcatcagcagtgatgaggtgaacttcctggtgtaccgctacctgcaggagagcggcttcagccacagcgccttcaccttcggcatcgagagccacatcagccagagcaacatcaacggggccctggtgcccccagctgccctgatcagcatcatccagaagggcctgcagtatgtggaggccgaggtgtccatcaatgaagatggcaccctgtttgatggccggcccatcgagagcctgagcctgattgatgctgtgatgccagatgtggtgcagacccggcagcaggcctacagagacaagctggcccagcagcaggccgctgctgctgctgctgctgctgctgctgccagccagcagggcagcgccaagaatggagagaacacagccaacggggaggagaatggagcccacaccatcgccaacaaccacacagacatgatggaggtggatggagatgtggagatcccccccaacaaggctgtggtgctgcggggccacgagagcgaggtgttcatctgtgcctggaaccctgtgtctgacctgctggccagcggcagcggggacagcacagcccgcatctggaacctgtctgagaacagcaccagcggcagcacccagctggtgctgcggcactgcatccgggagggcggccaggatgtgcccagcaacaaggatgtgaccagcctggactggaacagcgagggcaccctgctggccaccggcagctatgatggctttgcccgcatctggaccaaggatggcaacctggccagcaccctgggccagcacaagggccccatctttgccctgaagtggaacaagaagggcaacttcatcctgtctgctggggtggacaagaccaccatcatctgggatgcccacactggagaggccaagcagcagttccccttccacagcgccccagccctggatgtggactggcagagcaacaacacctttgccagctgcagcacagacatgtgcatccacgtgtgcaagctgggccaggaccggcccatcaagaccttccagggccacaccaatgaggtgaatgccatcaagtgggaccccaccggcaacctgctggccagctgcagtgatgacatgaccctgaagatctggagcatgaagcaggacaactgtgtgcatgacctgcaggcccacaacaaggagatctacaccatcaagtggagccccaccggccctggcaccaacaaccccaatgccaacctgatgctggccagcgccagctttgacagcacagtgcggctgtgggatgtggaccggggcatctgcatccacaccctgaccaagcaccaggagcctgtgtacagcgtggccttctccccagatggccgctacctggccagcggcagctttgacaagtgtgtgcacatctggaacacccagacaggagccctggtgcacagctaccggggcactggaggcatctttgaggtgtgctggaatgctgctggggacaaggtgggcgccagcgccagtgatggctctgtgtgtgtgctggacctgaggaagtag

SEQ ID NO: 21160 - DNA, 2034 bp, Artificial Sequence
  Description of Artificial Sequence: Synthetic coding sequence
atggaggagaccatgaagctggccaccatggaggacacagtggagtactgcctcttcctgatcccagatgagagccgggacagcgacaagcacaaggagatcctgcagaagtacatcgagcgcatcatcaccaggtttgcccccatgctggtgccctacatctggcagaaccagcccttcaacctgaagtacaagccaggcaagggcggcgtgcctgcccacatgtttggagtgaccaagtttggagacaacattgaagatgagtggttcatcgtgtatgtgatcaagcagatcaccaaggagttccctgagctggtggccagaattgaggacaatgatggagagttcctgctgattgaagctgctgacttcctgcccaagtggctggaccctgagaacagcaccaacagagtcttcttctgccacggggagctgtgcatcatcccagcccccaggaagagcggggctgagagctggctgcccaccaccccacccaccatcccccaggccctgaacatcatcacagcccacagcgagaagatcctggccagcgagagcatccgggctgctgtgaacagacgcatccggggctacccagagaagatccaggccagcctgcaccgggcccactgcttcctgcctgctggcatcgtggccgtgctgaagcagaggccccggctggtggccgctgctgtgcaggccttctacctgcgggaccccatcgacctgcgggcctgcagggtcttcaagaccttcctgcctgagacccgcatcatgacctctgtgaccttcaccaagtgcctgtatgcccagctggtgcagcagagatttgtgcctgacagaagaagtggctaccgcctgcccccacccagcgacccccagtaccgggcccacgagctgggcatgaagctggcccacggctttgagatcctgtgcagcaagtgcagcccccacttcagtgactgcaagaagagcctggtgacagccagccccctgtgggccagcttcctggagagcctgaagaagaatgactacttcaagggcctcatcgagggcagcgcccagtaccgggagcggctggagatggccgagaactacttccagctgtctgtggactggccagagcggctggaggtgcagtggagggaccccggcctgctgcaggcccctcctcctggcttcacccccttcatctgcctgagcctgctgagcacctgggacaacagcagcctggccatgagccctggagaggagatcctgaccctgctgcagaccatcccctttgatattgaggacctgaagaaggaggccgccaacctgcccccagaagatgatgaccagtggctggacctgagcccagaccagctggaccagctgctgcaggaggccgtgggcaagaaggagagcgagagcgtgtccaaggaggagaaggagcagaactatgacctgacagaggtgtctgagagcatgaaggccttcatcagcaaggtgtccacccacaagggagctgagctgccccgggagcccagcgaggcccccatcacctttgatgctgacagcttcctgaactactttgacaagatcctgggcccccggcccaatgaaagtgacagtgatgacctggatgatgaggactttgaatgtctggacagtgatgatgacctggactttgagacccatgagcccggggaggaggccagcctgaagggcaccctggacaacctgaagagctacatggcccagatggaccaggagctggcccacacctgcatcagcaagagcttcaccaccaggaaccaggtggagcctgtgtcccagaccacagacaacaacagtgatgaagaagattctggaactggagagagcgtgatggcccctgtggatgtggacctgaacctggtgagcaacatcctggagagctacagcagccaggccggcctggccggccctgccagcaacctgctgcagagcatgggcgtgcagctgcctgacaacacagaccaccggcccaccagcaagcccaccaagaactag

SEQ ID NO: 21161 - DNA, 1821 bp, Artificial Sequence
  Description of Artificial Sequence: Synthetic coding sequence
atggaggagagccccctgagccgggcccccagcagaggaggagtgaacttcctgaatgtggcccggacctacatccccaacaccaaggtggagtgccactacaccctgcccccaggcaccatgcccagcgccagtgactggattggcatcttcaaggtggaggccgcctgtgtgcgggactaccacacctttgtgtggagctctgtgcctgagagcaccacagatggcagccccatccacacctctgtgcagttccaggagccccggcccatggatgagctggtgaccctggaggaggctgatggcggcagtgacatcctgctggtggtgcccaaggccaccgtgctgcagaaccagctggatgagagccagcaggagagaaatgacctgatgcagctgaagctgcagctggagggccaggtgacagagctgcggagccgggtgcaggagctggagcgggccctggccacagcccggcaggagcacacagagctgatggagcagtacaagggcatcagccgcagccacggggagatcacagaggagcgggacatcctgagccggcagcagggcgaccacgtggcccgcatcctggagctggaggatgacatccagaccatcagcgagaaggtgctgaccaaggaggtggagctggaccggctgcgggacacagtgaaggccctgacccgggagcaggagaagctgctgggccagctgaaggaggtgcaggccgacaaggagcagagcgaggccgagctggagcccctgaaggagcagctgcggggggcccaggagctggccgccagcagccagcagaaggccaccctgctgggggaggagctggccagcgctgctgctgcccgggacaggaccatcgccgagctgcacaggagccggctggaggtggccgaggtgaatggccgcctggccgagctgggcctgcacctgaaggaggagaagtgccagtggagcaaggagcgggccggcctgctgcagagcgtggaggccgagaaggacaagatcctgaagctgtctgctgagatcctgcggctggagaaggctgtgcaggaggagaggacccagaaccaggtgttcaagacagagctggcccgggagaaggacagcagcctggtgcagctgtctgagagcaagcgggagctgacagagctgcggagcgccctgcgggtgctgcagaaggagaaggagcagctgcaggaggagaagcaggagctgctggagtacatgaggaagctggaggcccggctggagaaggtggctgatgagaagtggaatgaagatgccaccacagaagatgaggaggccgctgtgggcctgagctgcccagctgccctgacagacagtgaagatgagagccctgaggacatgaggctgcccccctacggcctgtgtgagcggggggaccccggcagcagccctgctggcccccgggaggccagccccctggtggtgatcagccagcctgcccccatcagcccccacctgagcggccctgctgaggacagcagcagtgacagcgaggctgaagatgagaagtctgtgctgatggctgctgtgcagagcggcggggaggaggccaacctgctgctgcctgagctgggcagcgccttctatgacatggccagcggcttcaccgtgggcaccctgtctgagaccagcactggaggccctgccacccccacctggaaggagtgccccatctgcaaggagcgcttccctgctgagagtgacaaggatgccctggaggaccacatggatggccacttcttcttcagcacccaggaccccttcacctttgaatag

SEQ ID NO: 21162 - DNA, 2997 bp, Artificial Sequence
  Description of Artificial Sequence: Synthetic coding sequence
atgaacagaagaaggaagttcctgctggcctctgtgctggccctgcagaacagcagcttcatctaccccagctgccagaagtgcttcagccgcatcatcctggtgtccaagaggagcaactgccccaagtgtggcagcactggagagagcggaaatgccaactaccgctacaagctgagcctgaaggtggccgagagcaacaagctgtttgtgatcaccgtgtttggcagctgcctggacaccttcttcggcctgacagccaccggcctgcaccgctacatccaggaccccaacaagatccctgagaccctggacaatgacaccacccagaacctgctgaccaaggctgtggagacctgctttgtgggccagagcttcatcttcggcgtgaccaactttgagaaccagcccggccagggcagtgatgccagcaacttcctgcagcagtgcagcgaccacaagaggaaggccaaggccctggtggcctgccagatcgtgctgcctgaccccggcattgctggcttcaccgtcatcgactacttccaccagctgctgcagaccttcaacttcaggaagctgcagtgtgacagccaggcccccaacaaccacctgctggccctggaccacagcaacagcgacctgagcagcatctacaccagtgacagcaccagtgacttcttcaagagctgcagcaaggacaccttcagcaagttctggcagcccagcctggagttcacctgcatcgtgtcccagctgacagacaatgatgacttcagcgccagcgagcagagcaaggccttcggcaccctgcagcagaacaggaagagcatcagcattgctgaggccaccggcagcagcagctgccacgaccccatccaggacagctggagcctggtgtcctacatggacaagaagagcacagctgagaagctgggcaaggagctgggcctgcaggccaaggagctgtctgctgtgcacagcagccaccacgagattggagtgaatgacagcaacctcttcagcctggagatgagggagcccctggagagcagcaacaccaagagcttccacagcgctgtggagatcaagaacagaagccagcacgagctgccctgcttccagcaccacggcatcgacacccccaccagcctgcagaagaggtctgcctgctgcccccccagcctgctgcggctggaggagacagccagcagcagccaggatggagacccccagatctgggatgacctgcccttcagcgagagcctgaacaagttcctggccgtgctggagagcgagattgctgtgacccaggctgatgtgagcagcaggaagcaccacgtggacaatgacatcgacaagttccacgccgaccacagccggctgtctgtgaccccccagaggaccactggagccctgcacaccccacccatcgccctgcggagcagccaggtgattgtgaaggccaactgcagcaaggatgacttcctgttcaactgcaagggcaacctgagccccagcgtggagaaggagagccagcctgacaacaaggtggaggccgtgtctgtgaaccacaacggccgggacatgtctgagtacttcctgcccaacccctacctgagcgccctgagcagcagcagcaaggacctggagaccatcgtgaccctgaagaagaccatccgcatcagcccccaccgggagagtgaccacagcagcctgaacaacaagtacctgaatggctgtggggagatctctgtgtctgagatgaatgagaagctgaccaccctgtgctacaggaagtacaatgatgtgtctgacctgtgcaagctggagaacaagcagtactgccgctggagcaagaaccaggatgacagcttcaccatctgcaggaagctgacctaccccctggagaccctgtgcaacagccccaacagaagcaccaacaccctgaaggagatgccctggggccacatcaacaacaacgtgacccagagctacagcatcggctatgagggcagctatgatgccagcgctgacctgtttgatgacatcgccaaggagatggacatcgccacagagatcaccaagaagagccaggacatcctgctgaagtggggcaccagcctggccgagagccaccccagcgagagtgacttcagcctgcggagcctgtctgaggacttcatccagcccagccagaagctgagcctgcagagcctgagtgacagccgccacagcaggacctgcagccccaccccccacttccagagcgacagcgagtacaactttgagaacagccaggactttgtgccctgcagccagagcacccccatcagcggcttccaccagacccgcatccacggcatcaacagagccttcaagaagcctgtgttctacagcgacctggatggcaactatgagaagatccgcatcttcccagaaaatgacaagcagcaggccagccccagctgccccaagaacatcaagacccccagccagaagatccgcagccccatcgtgtctggagtgtcccagccagatgtgttcaaccactacccctttgctgaatgtcatgaaacagacagtgatgagtgggtgccccccaccacccagaagatcttccccagcgacatgctgggcttccagggcatcggcctgggcaagtgcctggccgcctaccacttcccagaccagcaggagctgcccaggaagaagctgaagcacatccggcagggcaccaacaagggcctcatcaagaagaagctgaagaacatgctggccgctgtggtgaccaagaagaagacccacaagtacaactgcaagagcagcggctggatcagcaaatgtcctgacatccaggtgctggccgccccccagctgcaccccatcctgggccctgacagctgcagcgaggtgaagtgctgcctgcccttcagcgagaagggcccccccagcgtgtgtgagaccaggtctgcctggagccctgagctgttctcctag

SEQ ID NO: 21163 - DNA, 471 bp, Artificial Sequence
  Description of Artificial Sequence: Synthetic coding sequence
atggctgacagccctgggggctacaaggaatgtggcaccaatgaaggcccccaggaggatgaaaatggcagcagcgccagcggcagcagcaaggtgcggcagctgtggagcgaggacagctgtgagagcggcaagctgcctgccaccaggacagtgtactgcatgaatgaggccgagatcgtggatgtggccctgggcatcctgattgagagcaggaagcaggagaaggcctgtgagcagcctgccctggccggggctgacaaccctgagcacagccccccctgcagcgtgagcccccacaccagcagcggcagcagcagcgaggaggaggacagcggcaagcaggccctggcccctggcctgagccccagccagaggcctgggggcagcagcagcgcctgcagccgcagccctgaggaggaggaggaggaggatgtgctgaagtatgtgcgggagatcttcttctcctag

SEQ ID NO: 21164 - DNA, 1377 bp, Artificial Sequence
  Description of Artificial Sequence: Synthetic coding sequence
atggccgagctgcagatgctgctggaggaggagatccctgggggccggcgggccctgtttgacagctacaccaacctggagcgggtggccgactactgtgagaacaactacatccagagcgctgacaagcagagggccctggaggagaccaaggcctacaccacccagagcctggcctctgtggcctacctgatcaacaccctggccaacaacgtgctgcagatgctggacatccaggccagccagctgcggaggatggagagcagcatcaaccacatcagccagacagtggacatccacaaggagaaggtggcccggcgggagatcggcatcctgaccaccaacaagaacaccagcaggacccacaagatcatcgccccagccaacctggagaggcctgtgcgctacatcaggaagcccatcgactacaccatcctggatgacattggacatggagtgaaggtgtccacccagaacatgaagatgggcggcctgcccaggaccaccccacccacccagaagccacccagcccccccatgtctgggaagggcaccctgggcagcagcggcagcagcggcggcagccaccccagcagccgcagcagcagcagagaaaattctggcagcggctctgtgggcgtgcccatcgctgtgcccacccccagccccccatctgtgtttcctgccccagctggcagcgctggcaccccacccctgcctgccaccagcgccagcgccccagcccccctggtgcctgccaccgtgcccagcagcacagccccagatgctgctgctggaggagcccagaccctggctgatggcttcaccagccccaccccacctgtggtgagcagcaccccacccaccggccaccctgtgcagttctacagcatgaacagacctgccagccgccacaccccacccaccatcggcggcagcctgccctacagaagacctccttccatcaccagccagaccagcctgcagaaccagatgaatggaggccccttctacagccagaaccctgtgtctgacaccccacctcctcctcctcctgtggaggagcctgtgtttgatgagagccccccacctcctcctcctccagaagattatgaggaggaggaggccgctgtggtggagtacagcgacccctatgcagaggaggaccccccctgggcccccaggagctacctggagaaggtggtggccatctatgactacaccaaggacaaggaggatgagctgtccttccaggagggcgccatcatctacgtgatcaagaagaatgatgatggctggtatgagggcgtgatgaatggagtgacaggcctcttccctggcaactacgtggagagcatcatgcactacagcgagtag

SEQ ID NO: 21165 - DNA, 5223 bp, Artificial Sequence
  Description of Artificial Sequence: Synthetic coding sequence
tgaaaaatctacccagaggagatcacccccctgctgcctgccatcagcggggagaagattgctgaggaccagacctgcttcttcctgcagatcctgctgaagtacatggtgatccaggccgccagcctggagtggaagaacaaggagaaccaggacaccggcttcaagttcctgttcaccctcttcaggaagtactacctgccccacctgttccccagcttcaccaagctgaccaacatctacaagcctgtgctggacatcccccacctgcggcccaagcctgtgtacatcaccaccacccgggacaatgaaaacatctacagcaccaagatcccctacatggccgcccgggtggtgttcatcaagtggatcgtgaccttcttcctggagaagaagtacctgacagccacccagaacaccaagaatggagtggatgtgctgcccaagatcatccagacagtgggcggcggcgctgtgcaggagcgggcccctgagctggatggcggcggccccacagagcaggacaagagccacagcaacagcagcaccctgagtgaccggcggctgagcaacagcagcctgtgcagcattgaggaggagcacaggatggtgtatgagatggtgcagaggatcctgctgagcacccggggctacgtgaactttgtgaatgaggtgttccaccaggccttcctgctgcccagctgtgaaattgctgtgaccaggaaggtggtgcaggtgtacaggaagtggatcctgcaggacaagcctgtgttcatggaggagccagacaggaaggatgtggcccaggaggatgctgagaagctgggcttcagcgagacagacagcaaggaggccagcagcgagagcagcggccacaagaggagcagctcctggggccgcacctacagcttcaccagcgccatgagccggggctgtgtgacagaggaggagaacaccaacgtgaaggccggcgtgcaggccctgctgcaggtgttcctgaccaacagcgccaacatcttcctgctggagccctgtgccgaggtgcctgtgctgctgaaggagcaggtggatgcctgcaaggctgtgctgatcatcttccggaggatgatcatggagctgaccatgaacaagaagacctgggagcagatgctgcagatcctgctgcgcatcacagaagctgtgatgcagaagcccaaggacaagcagatcaaggacctgtttgcccagagcctggccggcctgctcttccgcaccctgatggtggcctggatccgggccaacctgtgtgtgtacatcagccgggagctgtgggatgacttcctgggcgtgctgagcagcctgacagagtgggaggagctgatcaatgagtgggccaacatcatggacagcctgacagctgtgctggccaggacagtgtatggagtggagatgaccaacctgcccctggacaagctgtctgagcagaaggagaagaagcagaggggcaagggctgtgtgctggacccccagaagggcaccaccgtgggccgctccttcagcctgtcctggaggagccacccagatgtgacagagcccatgaggttccgcagcgccaccaccagcggggcccctggggtggagaaggccagaaatattgtgcggcagaaggccacagaggtggaggagtgccagcagagtgaaaatgccccagctgctggcagcggccacctgactgtgggccagcagcagcaggtgctgcggagcagcagcaccagtgacatccctgagcccctgtgcagcgacagcagccagggccagaaggccgagaacacccagaacagcagcagcagcgagccccagcccatccaggagaacaagggccacgtgaagcgggagcacgagggcatcaccatcctggtgcggcgcagcagcagccctgctgagctggacctgaaggatgacctgcagcagacccagggcaagtgccgggagcggcagaagtctgagagcaccaacagcgacaccaccctgggctgcaccaatgaggccgagctgtccatgggcccctggcagacctgtgaggaggaccctgagctgaacacccccacagatgtggtggctgatgctgatgcccggcactggctgcagctgagccccacagatgccagcaacctgacagacagcagtgaatgtctgacagatgactgcagcatcatcgccggcggcagcctgaccggctggcacccagacagcgctgctgtgctgtggaggagagtgctgggcatcctgggagatgtgaacaacatccagagccccaagatccacgcccgggtcttctgctacctgtatgagctgtggtacaagctggccaagatccgggacaacctggccatcagcctggacaaccagagcagccccagcccccctgtgctgatcccccccctgaggatgtttgcctcctggctgttcaaggccgccaccctgcccaatgagtacaaggagggcaagctgcaggcctaccgcctcatctgtgccatgatgacccggcggcaggatgtgctgcccaacagcgacttcctggtgcacttctacctggtgatgcacctgggcctgaccagcgaggaccaggacatcctgaacaccatcatccgccactgccccccacgcttcttcagcctgggcttccctggcttctccatgctggtgggggacttcatcacagctgctgcccgggtgctgagcacagacatcctgacagcccccaggtctgaggccgtgacagtgctgggcagcctggtgtgcttccccaacacctaccaggagatccccctgctgcagagcgtgcctgaggtgaatgaggccatcactggaacagaagatgtgaagcactacctgatcaacatcctgctgaagaatgccacagaggagcccaatgaatatgcccgctgcatcgctgtgtgcagcctgggcgtgtggatctgtgaggagctggcccagtgcaccagccacccccaggtgaaggaggccatcaacgtcatcggcgtgaccctgaagttccccaacaagatcgtggcccaggtggcctgtgatgtgctgcagctgctggtgtcctactgggagaagctgcagatgtttgagaccagcctgcccaggaagatggccgagatcctggtggccaccgtggccttcctgctgcccagcgctgagtacagctctgtggagacagacaagaagttcatcgtgtccctgctgctgtgcctgctggactggtgcatggccctgcctgtgtctgtgctgctgcaccctgtgtccacagctgtgctggaggagcagcacagcgcccgggcccccctgctggactacatctacagagtgctgcactgctgcgtgtgtggcagcagcacctacacccagcagagccactacatcctgaccctggccgacctgagcagcacagattatgaccccttcctgcccctggccaacgtgaagagcagcgagcctgtgcagtaccacagcagcgctgagctgggcaacctgctgactgtggaggaggagaagaagaggaggagcctggagctgatccccctgacagccaggatggtgatggcccacctggtgaaccacctgggccactaccccctgagcggcggccctgccatcctgcacagcctggtgtctgaaaatcatgacaatgcccacgtggagggcagcgagctgagctttgaggtgttccgcagccccaacctgcagctgtttgtgttcaatgacagcaccctcatctcctacctgcagacccccacagagggccctgtgggcggcagccctgtgggcagcctgagtgatgtgcgggtgattgtgcgggacatcagcggcaagtacagctgggatggcaaggtgctgtatggccccctggagggctgcctggccccaaatggaagaaaccccagcttcctgatcagctcctggcaccgggacaccttcggcccccagaaggacagcagccaggtggaggagggagatgatgtgctggacaagctgctggagaacatcggccacaccagccctgagtgcctgctgcccagccagctgaacctgaatgagcccagcctgaccccctgtggcatgaactatgaccaggagaaggagatcatcgaggtgatcctgcggcagaatgcccaggaggatgagtacatccagagccacaactttgattctgccatgaaggtgaccagccagggccagcccagccctgtggagccccggggccccttctacttctgccgcctgctgctggatgacctgggcatgaacagctgggacaggaggaagaacttccacctgctgaagaagaacagcaagctgctgcgggagctgaagaacctggacagccggcagtgccgggagacccacaagattgctgtgttctacatcgccgagggccaggaggacaagtgcagcatcctgagcaatgaaagaggcagccaggcctatgaggactttgtggccggcctgggctgggaggtggacctgagcacccactgcggcttcatgggcggcctgcagagaaatggcagcacaggccagacagccccctactatgccaccagcacagtggaggtgatcttccacgtgtccaccaggatgcccagcgacagtgatgacagcctgaccaagaagctgcggcacctgggcaatgatgaggtgcacatcgtgtggagcgagcacagccgggactaccgccggggcatcatccccacagcctttggagatgtgtccatcatcatctaccccatgaagaaccacatgttcttcatcgccatcaccaagaagccagaggtgcccttcttcggccccctgtttgatggagccatcgtgtctgggaagctgctgcccagcctggtgtgtgccacctgcatcaatgccagcagagctgtgaagtgcctgatccccctgtaccagagcttctatgaggagcgggccctgtacctggaggccatcatccagaaccaccgggaggtgatgacctttgaagattttgctgcccaggtgttcagccccagccccagctacagcctgtctggaactggagccctggccagcagcctgtctgctgacctggaggagcccctgtctgaggaggagacagagcaccccctgctgcccctgccccgggccaccaagccccgcatcagcaggaagttccgctgctgcaccagcgccctgagccgcagcagccactag

SEQ ID NO: 21166 - DNA, 1836 bp, Artificial Sequence
  Description of Artificial Sequence: Synthetic coding sequence
atgccccacctggacatgaagacccacgtgtgccccagcgtggagggccccaagaagaagggcggcatcacctgcttctgctgcggcggccccttccgggctgctgacaggagcaagaccaggagccccaagctgagccacagcccccagccccccagcctgggggaccctgtggagcacctgtctgagaccagcgctgacagcctggaggccatgtctgaaggagatgcccccacccccttcagccggggcagcaggacccgggccagcctgcctgtggtgcgcagcaccaaccagaccaaggagaggagcctgggcgtgctgtacctgcagtatggagatgagaccaagcagctgaggatgcccaatgagatcaccagcgctgacaccatccgggccctgtttgtgtctgccttcccccagcagctgaccatgaagatgctggagagccccagcgtggccatctacatcaaggatgagagcagaaatgtgtactatgagctgaatgatgtgaggaacatccaggacaggagcctgctgaaggtgtacaacaaggaccctgcccacgccttcaaccacacccccaagaccatgaatggagacatgaggatgcagcgggagctggtgtatgcccggggagatggccctggggcccccaggcctggcagcacagcccacccccctcatgccatccccaacagcccccccagcacccctgtgccccacagcatgccacccagccccagccgcatcccctatggaggcaccaggtccatggtggtgcctggaaatgccaccatcccccgggaccgcatcagcagcctgcctgtgtcccggcccatcagccccagccccagcgccatcctggagaggagagatgtgaagccagatgaggacatgtctgggaagaacatcgccatgtacagaaatgaaggcttctatgctgacccctacctgtaccacgagggccgcatgagcatcgccagcagccatggaggccaccccctggatgtgcctgaccacatcatcgcctaccacaggacagccatccgcagcgccagcgcctactgcaaccccagcatgcaggccgagatgcacatggagcagagcctgtaccggcagaagagcaggaagtacccagacagccacctgcccaccctgggcagcaagaccccaccagccagcccccaccgggtgtctgacctgaggatgattgacatgcacgcccactacaatgcccacggccccccccacaccatgcagcctgaccgggccagccccagccggcaggccttcaagaaggagcccggcaccctggtgtacatcgagaagcccaggtctgctgctggcctgagcagcctggtggacctgggcccccccctgatggagaagcaggtgtttgcctacagcacagccaccatccccaaggaccgggagaccagcgagaagatgatgaagaccacagccaacagaaaccacacagacagcgctggcacccctcatgtgtctgggggcaagatgctgagcgccctggagagcacagtgccccccagccagcccccacctgtgggcaccagcgccatccacatgagcctgctggagatgagaagatctgtggccgagctgcggctgcagctgcagcagatgaggcagctgcagctgcagaaccaggagctgctgcgggccatgatgaagaaggccgagctggagatcagcggcaaggtgatggagaccatgaagaggctggaggaccctgtgcagaggcagagggtgctggtggagcaggagcggcagaagtacctgcacgaggaggagaagatcgtgaagaagctgtag

SEQ ID NO: 21167 - DNA, 189 bp, Artificial Sequence
  Description of Artificial Sequence: Synthetic coding sequence
tgagaaaaccccctggtgtactgtgatggccacggctgcagcgtggccgtgcaccaggcctgctacggcatcgtgcaggtgcccaccggcccctggttctgcaggaaatgtgagagccaggagagagctgcccgggtggtgggccccatgtggtttgtgccctgcatcttccagcgctacaacctgtag

SEQ ID NO: 21168 - DNA, 1869 bp, Artificial Sequence; identical to SEQ ID NO: 19023
  Description of Artificial Sequence: Synthetic coding sequence

SEQ ID NO: 21169 - DNA, 546 bp, Artificial Sequence
  Description of Artificial Sequence: Synthetic coding sequence
atgggcggccgcagcgcccaggccggcctgggcacccgcatcacccccatgatggagctgaagcccaatgccggcagtgaccgggcctgggtgtggaacacccacgccgactttgctgatgaatgtcccaagccagagctgctggccatccgcttcctgaatgcagaaaatgcccagaagttcaagaccaagtttgaagaatgtaggaaggagattgaggagcgggagaagaagggagatgtggtgccctgggtgggcggcctgctgtgccgcctgaccctgcacctgaccatcctgcccggcggctgcttcttctgcctgcctgacaagcacagccgggtgctgtggccccctcatgtgtcccgggtgatgcagctgcccggggacaccggggcctcctggggcgccctgagcacctgccagtgctgctggccccagagcaactgggccggcatcggcgtgcgggccctgcccggggcccaccagaaggtgctgtatgatggccccaggtttgtgtcccagagggcctggagccccctgccctag

SEQ ID NO: 21170 - DNA, 378 bp, Artificial Sequence
  Description of Artificial Sequence: Synthetic coding sequence
atgagcagcagcggctacccacccaaccagggcgccttcagcacagagcagagccgctacccaccccacagcgtgcagtacaccttccccaacaccaggcaccagcaggagtttgctgtgcctgactaccgcagcagccacctggaggtgtcccaggccagccagctgctgcagcagcagcagcagcagcagctgcggcggcggcccagcctgctgtctgagttccaccctggcagtgaccggccccaggagaggaggaccagctatgagcccttccaccctggccccagccctgtggaccatgacagcctggagagcaagaggccccggctggagcaggtgtctgacagccacttccagagggtgtctgctgcctag

SEQ ID NO: 21171 - DNA, 318 bp, Artificial Sequence
  Description of Artificial Sequence: Synthetic coding sequence
atgctgcgctgtggccagatgatctttgcccaggccctggtgtgccgccacctgggccgggactggcgctggacccagaggaagaggcagcctgacagctacttctctgtgctgaatgccttcatcgacaggaaggacagctactacagcatccaccagatcgcccagatgggcgtgggggagggcaagagcatcggccagtggtacggccccaacacagtggcccaggtgctgaagaagctggccgtgtttgacacctggagcagcctggccgtgcacatcgccatggacaacacagtggtgatggaggagatctag

SEQ ID NO: 21172 - DNA, 1305 bp, Artificial Sequence
  Description of Artificial Sequence: Synthetic coding sequence
atggacatcgacaaggacctggaggcccccctgtacctgaccccagagggctggagcctcttcctgcagcgctactaccaggtggtgcatgagggcgctgagctgcggcacctggacacccaggtgcagagatgtgaggacatcctgcagcagctgcaggccgtggtgccccagattgacatggagggggacaggaacatctggatcgtgaagccaggggccaagagccggggccggggcatcatgtgcatggaccacctggaggagatgctgaagctggtgaatggaaatcctgtggtgatgaaggatggcaagtgggtggtgcagaagtacatcgagcggcccctgctgatcttcggcaccaagtttgacctgcggcagtggttcctggtgacagactggaaccccctgactgtgtggttctacagagacagctacatccgcttcagcacccagcccttcagcctgaagaacctggacaacagcgtgcacctgtgcaacaacagcatccagaagcacctggagaacagctgccaccgccaccccctgctgcccccagacaacatgtggagcagccagcgcttccaggcccacctgcaggagatgggcgccccaaatgcctggagcaccatcatcgtgcccggcatgaaggatgctgtgatccacgccctgcagaccagccaggacacagtgcagtgcaggaaggccagctttgagctgtatggagctgactttgtgtttggagaggacttccagccctggctgattgagatcaatgccagccccaccatggcccccagcacagctgtgacagcccggctgtgtgccggcgtgcaggccgacaccctgcgggtggtgattgacaggatgctggacaggaactgtgacacaggagcctttgagctgatctacaagcagcctgctgtggaggtgccccagtatgtgggcatccggctgctggtggagggcttcaccatcaagaagcccatggccatgtgccacaggaggatgggcgtgcggcctgctgtgcccctgctgacccagaggggcagcggggaggcccggcaccacttccccagcctgcacaccaaggcccagctgcccagcccccacgtgctgcggcaccagggccaggtgctgcggcggcagcacagcaagctggtgggcaccaaggccctgagcaccaccgggaaggccctgcggaccctgcccacagccaaggtgttcatcagcctgccccccaacctggacttcaaggtggcccccagcatcctgaagcccaggaaggtgggcctggacctgtag

SEQ ID NO: 21173 - DNA, 576 bp, Artificial Sequence
  Description of Artificial Sequence: Synthetic coding sequence
atggccatcggcaagaggctggccaccctgcccaccaaggagcagaagacccagaggctcatcagcgagctgagcctgctgaaccacaagctgcctgcccgggtgtggctgcccacagctggctttgaccaccacgtggtgcgggtgccccacacccaggccgtggtgctgaacagcaaggacaaggccccctacctgatctacgtggaggtgctggagtgtgaaaattttgacaccacctctgtgcctgcccgcatccctgagaaccgcatccgcagcaccaggtctgtggagaacctgcctgaatgtggcatcacccatgagcagagagctggcagcttcagcacagtgcccaactatgacaatgatgatgaggcctggagcgtggatgacatcggggagctgcaggtggagctgcctgaggtgcacaccaacagctgtgacaacatcagccagttctctgtggacagcatcaccagccaggagagcaaggagcccgtcttcatcgctgctggggacatcagaagaaggctgtctgagcagctggcccacacccccacagccttcaagaggtag

SEQ ID NO: 21174 - DNA, 903 bp, Artificial Sequence
  Description of Artificial Sequence: Synthetic coding sequence
atggccaagtggggccagggcaacccccactggatcgtggaggagagagaagatggcaccaacgtgaacaactggcgctggaggacagaaagagatgccaccagcctgagcaagggcaagttccaggagctgctggtgggcatcgtggtggagaatgatgctggccgcggggagatcaatgagctgaagcaggtggagggggaggccagctgcagcagcaggaagggcaagctgatcttcttctatgagtggaacatcaagctgggctggaagggcatcgtgaaggagagcggcgtgaagcacaagggcctgattgagatccccaacctgtctgaagaaaatgaggtggatgacacagaggtgtccctgagcaagaagaagggagatggagtcatcctgaaggacctgatgaagacagctggaacagccaaggtgcgggaggccctgggggactacctgaaggccctgaagacagagttcaccaccggcatgatcctgcccaccaaggccatggccacccaggagctgactgtgaagaggaagctgagcggcaacaccctgcaggtgcaggccagcagccctgtggccctgggcgtgcgcatccccaccgtggccctgcacatgatggagctgtttgacaccaccgtggagcagctgtacagcatcttcaccgtgaaggagctgaccaacaagaagatcatcatgaagtggaggtgtggcaactggccagaggagcactacgccatggtggccctgaactttgtgcccaccctgggccagacagagctgcagctgaaggagttcctgagcatctgcaaggaggagaacatgaagttctgctggcagaagcagcactttgaggagatcaagggcagcctgcagctgacccccctgaatggatag

SEQ ID NO: 21175 - DNA, 1137 bp, Artificial Sequence
  Description of Artificial Sequence: Synthetic coding sequence
atgaaggatgtgcccggcttcctgcagcagagccagaacagcggccctggccagcctgctgtgtggcaccggctggaggagctgtacaccaagaacttcatgaagaccctgtctgtgaacctgaacacaggcaagagcctgagctctgtgttccactttgaaaatgaatgtattgatgcccggcgctgcagcaaggccggcggcttctacttccgggtgaaccccctgagcctggtggagatcatcctgcacgtggtgcggcagatgacagaccccaacgtggccctgaccttcctggagaagacccgggagaaggtgaagagcagtgatgaggccgtcatcctgtgcaagacagccatcggggccctgaagctgaacattggagacctgcaggtgaccaaggagaccattgaagatgtggaggagatgctgaacaacctgcccggggtgacctctgtgcacagccgcttctatgacctgagcagcaagtactaccagaccatcggcaaccacgccagctactacaaggatgccctgcgcttcctgggctgtgtggacatcaaggacctgcctgtgtctgagcagcaggagcgggccttcaccctgggcctggccggcctgctgggggagggcgtcttcaactttggagagctgctgatgcaccctgtgctggagagcctgaggaacacagaccggcagtggctgattgacaccctgtatgccttcaacagcggaaatgtggagcgcttccagaccctgaagacagcctggggccagcagcctgacctggccgccaatgaggcccagctgctgaggaagatccagctgctgtgcctgatggagatgaccttcaccaggcctgccaaccaccggcagctgacctttgaggagatcgccaagagcgccaagatcaccgtgaatgaggtggagctgctggtgatgaaggccctgtctgtgggcctggtgaagggcagcattgatgaggtggacaagagggtgcacatgacctgggtgcagccccgggtgctggacctgcagcagatcaagggcatgaaggaccggctggagttctggtgcacagatgtgaagtccatggagatgctggtggagcaccaggcccatgacatcctgacctag

SEQ ID NO: 21176 - DNA, 603 bp, Artificial Sequence
  Description of Artificial Sequence: Synthetic coding sequence
atgctgctggagcagaacctgatcaccgtggacatgcagaagcacagcctgaccttctggtggctggtggagtgctggccccaggtgttcaacaagctgatccgccgctacaagtacctggagaagggctttgaagatgaggtgaagaagctgctgctcttcctgaagggcttcagcgagagcgagaggaacaagctggccatgctgactggagtgctgctggccaacggcaccctgaatgccagcatcctgaacagcctgtacaatgaaaacctggtgaaggagggcgtgtctgctgcctttgctgtgaagctgttcaagtcctggatcaatgagaaggacatcaatgctgtggccgccagcctgaggaaggtgtccatggacaaccggctgatggagctgtttcctgccaacaagcagagcgtggagcacttcaccaagtacttcacagaggccggcctgaaggagctgtctgaatatgtgaggaaccagcagaccatcggggccaggaaggagctgcagaaggagctgcaggagcagatgagcagaggagaccccttcaaggacatcatcctgtatgtgaaggaggagatgaagaagtag

SEQ ID NO: 21177 - DNA, 1446 bp, Artificial Sequence; identical to SEQ ID NO: 21094
  Description of Artificial Sequence: Synthetic coding sequence

SEQ ID NO: 21178 - DNA, 261 bp, Artificial Sequence
  Description of Artificial Sequence: Synthetic coding sequence
atgggcaagatggtgtctgtcatcaacacagtggacaccagccatgaggacatgattcatgatgcccagatggactactacggcacccggctggccacctgcagcagtgacagatctgtgaagatctttgatgtgagaaatggaggccagatcctgattgctgacctgcggggccacgagggccctgtgtggcaggtggcctgggcccaccccatgtatggcaacatcctggccagctgcagctatgacaggaaggtgtag

SEQ ID NO: 21179 - DNA, 660 bp, Artificial Sequence
  Description of Artificial Sequence: Synthetic coding sequence
atggagcccagcgcccagcagctgcagctggccgccagcctgcctgccaacctgagcaacttctgccagggcagcgagatgcccaccaccagcaggcctgccctggatgtgaagggcggcaccagccctgccaaggaggatgccaaccaggagatgagctctgtggcctacagcaacctggccgtgaaggacaggaaggctgtggccatcctgcactacccaggagtggccagcaatggcaccaaggccagcggggcccccaccagcagcagcggcagccccatcggcagccccaccaccaccccacccaccaagccacccagcttcaacctgcacccagccccccacctgctggcctccatgcacctgcagaagctgaacagccagtaccagggcatggctgctgccaccccaggccagcctggagaggccggccccctgcagaactgggactttggagcccaggccggcggcgctgagagcctgagccccagcgctggggcccagagccctgccatcatcgacagcgaccctgtggatgaggaggtgctgatgagcctggtggtggagctgggcctggaccgggccaatgagctgcctgagctgtggctgggccagaatgaatttgacttcaccgctgacttccccagcagctgctag

SEQ ID NO: 21180 - DNA, 396 bp, Artificial Sequence
  Description of Artificial Sequence: Synthetic coding sequence
atgctgtgctggggctactggagcctgggccagcccggcatcagcaccaacctgcagggcatcgtggccgagccccaggtgtgtggcttcatcagtgacagatctgtgaaggaggtggcctgtggcggcaaccacagcgtcttcctgctggaggatggagaggtgtacacctgtggcctgaacaccaagggccagctgggccacgagcgggagggcaacaagccagagcagatcggggccctggccgaccagcacatcatccacgtggcctgtggggagagccacagcctggccctgagtgaccggggccagctgttctcctggggcgccggcagtgatggccagctgggcctgatgaccacagaggacagcgtggccgtgcccaggctcatctag

SEQ ID NO: 21181 - DNA, 3099 bp, Artificial Sequence
  Description of Artificial Sequence: Synthetic coding sequence
atggagggcgccctgacagcccgggacaaggtgggcgtgcaggactttgtgctgctggatgcctacaccagcgagagcgcctttgtggacaacctgaggaagcgcttcagcgagaacctgatctacacctacatcggcaccctgctggtgtctgtgaacccctaccaggagctgggcatctacacagtgtcccagatggagctgtaccagggcgtgaacttctttgagctgcccccccacgtgtatgccatcgctgacaatgcctacaggatgatgtgtgccgagctgaacaaccacttcatcctgatcagcggggagagcggggccggcaagacagaggccagcaagaagatcctggagtactttgctgtgacctgccccatgacccagagcctgcagatcgcccgggaccggctgctcttcagcaaccctgtgctggaggcctttggaaatgcccggaccctgagaaatgacaacagcagcagatttgggaagtacatggacatccagtttgacttccagggcatccctgtgggcggccacatcatctcctacctgattgagaagagccgggtggtgtaccagaatgaaggagagaggaacttccacatcttctaccagctgctggccggcggggaggaggagcggctgagctacctgggcctggagcgggacccccagctgtacaagtacctgagccagggccactgtgccaaggagagcagcatcagtgacaagaatgactggaagacagtgtccaatgccttctctgtgattgacttcacagaggccgacctggagaacctgtttggcatcatcgcctctgtgctgcacctgggcaacatcggctttgaggaggatgaccagggctgtgccaccatcccagacacccatgagatcaagtggatcgccaagctgctgggcgtgcaccccagcgtgctgctggaggccctgacccacaggaagattgaggccaagacagaggaggtgatctgccccctgaccctggagctgtctgtgtatgccagagatgccatggccaaggctgtgtatggccgcaccttcacctggctggtgaacaagatcaacagcagcctggtgaacaaggtgggccagaggatcctggaccccctgctgctgctgacctggaagacagtgattggcctgctggacatctacggctttgaggtgtttgacaagaatggatttgagcagttctgcatcaactactgcaatgagaagctgcagcagctgctgattgaaagaaccctgaaggccgagcaggccgagtatgagatggagggcatcgagtgggagcccatcaagtacttcaacaacaagatcatctgtgacctggtggaggagcggcacaagggcatcatcagcatcctggatgaggagtgcatccggcccggccctgccacagacctgtccttcctggagaagctggaggagaaggtgggcaagcacgcccactttgagaccaggaagctggccggccccaagggcaggaagagaattggctggatggagttccggctgctgcactacgccggggaggtgacctactgcaccaagggcttcctggagaagaacaatgacctgctgtaccgccacctgaaggaggtgctgtgcaagagcaagaacatcatcctgcgggagtgcttcctgctggccgagctggagaacagaagaagaccacccaccgtgggcacccagttcaagaacagcctgagcagcctgctggagaccctcatcagcaaggagcccagctacatccgctgcatcaagcccaatgacaggaaggagcccagcaagtttgatgacttcctgatccgccaccagatcaagtacctgggcctgatggagcacctgcgggtgcggcgggccggctttgcctacagaagaaaatatgagcacttcctgcagcgctacaagagcctgtgcccagacacctggccccactggcacggccccccagctgagggcgtggagcggctcatcaagtacatcggctacaagccagaggagtacaagctgggcaagaccaagatcttcatccgcttccccaggaccctgtttgccacagaagatgcctttgagttcagcaagcaccagctggtggcccgcatccaggccacctacaagcgctgcctgggcagaagagaatatgtgaagaagaggcaggccgccatcaagctggaggcccactggaggggggccctggccaggaaggccatccagaggaggaagtgggccgtgcgcatcatcaggaagttcatcaagggcttcatcagcaggaacaagcccctgtgcccagacaatgaggagttcatcgtgtttgtgaggaagaactacatcctgaacctgcgctaccacctgcccaagacagtgctggacaagtcctggctgcggcccccaggcatcctggagaatgccagtgacctgctgaggaagatgtgtgtgaggaacctggtgcagaagtactgccggggcatcacagctgagaggaaggccatgatgcagcagaaggtggtgaccagcgagatcttccggggcaggaaggatggctacacagagagcctgaaccagccctttgtgaacagcagaattgatgaaggagacatcaaccccaaggtgctgcagctgatcagccatgagaagatccagtatggagtgcctgtgatcaagtatgacaggaagggcttcaaggcccggcagaggcagctgatcctgacccagaaggccgcctacgtggtggagctggccaagatcaagcagaagattgagtacagcgccctgaagggcgtgtccaccagcaacctgagtgatggcatcctggtgatccacgtgtccccagaggacagcaagcagaagggagatgctgtgctgcagtgtggccacgtgtttgaggccgtgaccaagctggtgatgctggtgaagaaggaaaatattgtgaatgtggtgcagggcagcctgcagttcttcatcagccctgggaaggagggcaccatcgtgtttgacaccggcctggaggagcaggtgtacaagaacaagaatggccagctgactgtggtgtctgtgcggaggaagagctag

SEQ ID NO: 21182 - DNA, 1176 bp, Artificial Sequence
  Description of Artificial Sequence: Synthetic coding sequence
atgtgcagccagctgtggttcctgacagaccggcgcatccgggaggactacccccaggtgcagatcctgcgggccctgcggcagcgctgcagcgagcaggatgtgcgcttccgggctgtgctgatggaccagattgctgtgaccatcgtgggcggccacctgggcctgcagctgaaccagaaggccctgaccaccttcccagatgtggtgctggtgcgggtgcccacccccagcgtgcagagcgacagcgacatcaccgtgctgcggcacctggagaagctgggctgccgcctggtgaaccggccccagagcatcctgaactgcatcaacaagttctggaccttccaggagctggccggccatggagtgcccatgccagacaccttctcctatggaggccacgaggacttcagcaagatgattgatgaggccgagcccctgggctaccctgtggtggtgaagagcacccggggccaccggggcaaggctgtgttcctggcccgggacaagcaccacctgagtgacatctgccacctgatcagacatgatgtgccctacctgttccagaagtatgtgaaggagagccacggcaaggacatccgggtggtggtggtgggcggccaggtgattggctccatgctgcgctgcagcacagatggccgcatgcagagcaactgcagcctgggcggcgtgggcgtgaagtgccccctgacagagcagggcaagcagctggccatccaggtgagcaacatcctgggcatggacttctgtggcatcgacctgctgatcatggatgatggcagctttgtggtgtgtgaggccaatgccaacgtgggcttcctggcctttgaccaggcctgcaacctggatgtgggcggcatcatcgctgactacaccatgagcctgctgcccaaccggcagacaggcaagatggctgtgctgcccggcctgagcagcccccgggagaagaatgaaccagatggctgtgccagcgcccagggcgtggccgagagcgtgtacaccatcaacagcggcagcaccagcagcgagagcgagcctgagctgggggagatccgggacagcagcgccagcaccatgggcgcccctccttccatgctgcctgagcccggctacaacatcaacaaccgcatcgccagcgagctgaagctgaagtag

SEQ ID NO: 21183 - DNA, 1065 bp, Artificial Sequence
  Description of Artificial Sequence: Synthetic coding sequence
atggacatggaccacatcatgacctgggccacagatgtggccaagggcatgcactacctgcacatggaggcccctgtgaaggtgatccaccgggacctgaagagcagaaatgtggtgattgctgctgatggagtgctgaagatctgtgactttggagccagccgcttccacaaccacaccacccacatgagcctggtgggcaccttcccctggatggcccctgaggtgatccagagcctgcctgtgtctgagacctgtgacacctacagctatggagtggtgctgtgggagatgctgacccgggaggtgcccttcaagggcctggagggcctgcaggtggcctggctggtggtggagaagaatgaaaggctgaccatccccagcagctgccccaggagctttgctgagctgctgcaccagtgctgggaggctgatgccaagaagaggcccagcttcaagcagatcatcagcatcctggagagcatgagcaatgacaccagcctgcctgacaagtgcaacagcttcctgcacaacaaggccgagtggaggtgtgaaattgaggccaccctggagcggctgaagaagctggagcgggacctgtccttcaaggagcaggagctgaaggagcgggagcggcggctgaagatgtgggagcagaagctgacagagcagagcaacacccccctgctgctgcccctggccgccaggatgtctgaggagagctactttgagagcaagacagaggagagcaacagcgctgagatgagctgccagatcacagccaccagcaatggagagggccacggcatgaaccccagcctgcaggccatgatgctgatgggctttggagacatcttctccatgaacaaggccggggctgtgatgcacagcggcatgcagatcaacatgcaggccaagcagaacagcagcaagaccaccagcaagaggcggggcaagaaggtgaacatggccctgggcttcagtgactttgacctgtctgaaggagatgatgatgatgatgatgatggagaggaggaggacaatgacatggacaacagcgagtag

SEQ ID NO: 21184 - DNA, 1707 bp, Artificial Sequence
  Description of Artificial Sequence: Synthetic coding sequence
atgctggagcggcccccagccctggccatgcccatgcccacagagggcaccccaccacccctgagcggcacccccatccctgtgcctgcctacttcagacatgctgagcccggcttcagcctgaagaggccccggggcctgagccgcagcctgcccccacctcctccagccaagggcagcatccccatcagccgcctcttcccccccaggaccccaggctggcaccagctgcagccccggcgggtgtccttccggggggaggccagcgagaccctgcagagccctggctatgaccccagcaggcctgagagcttcttccagcagagcttccagaggctgagccggctgggccacggcagctatggagaggtgttcaaggtgcgcagcaaagaagatggccgcctgtatgctgtgaagaggtccatgagccccttccggggccccaaggaccgggccaggaagctggccgaggtgggcagccatgagaaggtgggccagcacccctgctgcgtgcggctggagcaggcctgggaggagggcggcatcctgtacctgcagacagagctgtgtggccccagcctgcagcagcactgtgaggcctggggcgccagcctgcctgaggcccaggtgtggggctacctgcgggacaccctgctggccctggcccacctgcacagccagggcctggtgcacctggatgtgaagccagccaacatcttcctgggcccccggggccgctgcaagctgggggactttggcctgctggtggagctgggcacagctggagctggggaggtgcaggagggggacccccgctacatggcccctgagctgctgcagggcagctatggaacagctgctgatgtgttcagcctgggcctgaccatcctggaggtggcctgcaacatggagctgccccatggaggagagggctggcagcagctgcggcagggctacctgcccccagagttcaccgctggcctgagcagcgagctgcggtctgtgctggtgatgatgctggagccagaccccaagctgcgggccacagctgaggccctgctggccctgcctgtgctgcggcagccccgggcctggggcgtgctgtggtgcatggctgctgaggccctgagccggggctgggccctgtggcaggccctgctggccctgctgtgctggctgtggcacggcctggcccacccagcctcctggctgcagcccctgggccccccagccaccccacctggcagccccccctgcagcctgctgctggacagcagcctgagcagcaactgggatgatgacagcctgggccccagcctgagccctgaggccgtgctggccaggacagtgggcagcaccagcacccccaggagccgctgcaccccccgggtgctgacccccctgcggctgagccctgctgctgagcccagcgcccctggcctgggccctgctgctgaggccccctgctgcgtggagcagaggggcttcctgagccgccacatccccaggagcttcagcgccttccaggccgccccacccaagagcgcctgcaatgccctgcacctgcacggccacacccagcccagcgcctttgtgtggagcctgacctgcagcagccaccacggccgcacctttgaggcccggaccaaggtggaccccctcttcaagatctgtggcggcttcctgactgtgtttgctgacctgtag

SEQ ID NO: 21185 - DNA, 642 bp, Artificial Sequence
  Description of Artificial Sequence: Synthetic coding sequence
atggccgagacagaggagaggagcctggacaacttctttgccaagagggacaagaagaagaagaaggagaggagcaacagagctgccagcgctgctggagctgctggcagcgctgggggcagcagcggggctgctggagctgctgggggcggggccggggccggcaccaggcctggagatggcggcacagccagcgctggagctgctggccctggagctgccaccaaggctgtgaccaaggatgaagatgagtggaaggagctggagcagaaggaggtggactacagcggcctgcgggtgcaggccatgcagatcagcagcgagaaggaggaggatgacaatgagaagaggcaggaccccggggacaactgggaggagggcggcggcggcggcggcggcatggagaagagcagcggcccctggaacaagacagcccctgtgcaggcccccccagcccctgtgattgtgacagagaccccagagcccgccatgaccagcggcgtgtacagacctcctggggcccggctgaccaccaccaggaagaccccccagggccccccagagatctacagcgacacccagttccccagcctgcagagcacagccaagcacgtggagagcaggaaccgctacctgaagtag

SEQ ID NO: 21186 - DNA, 4140 bp, Artificial Sequence
  Description of Artificial Sequence: Synthetic coding sequence
atggccagcagccccaccaagggcctgaccatgtctgtgcctgtggcccccaagaagagctgctacacccagctgcgggacaacagaaatgctgccaggaacaacaatgaaagcatcctgagcctgggggacaccaatgccaaccagatcatgctggaggtgagcagcagccatgatgagagcaagacctgtgacctgggagatgagatcggcaacaccaacagcagcgagccagaaaatagaacccacttccacaaggagttccaccagctgcagggctttgggaagggcagccaggccggcagcgccagcctgaaggacttccggctgagcagcaccatccagcgggagctgaatgaggagcacacagtggagcggggcacagacagcctgcagaccaccaggagcatccagggccccagcctgagctcctggagaaatgtgatgtctgaggccagcctggatgtgctggccaagagagatgctgagatccccaggcatgtgcccaaggacaagctggccaagaccctggacaatgaggagctgcggcggcacagcctggagcgggccagcagctctgtggccgctgtgggcagcctgaccccccagcacccccagcccctgagcctggacagccgggaggcccggggccagatccctgggggcggggagggcccccagaagaccctgcctgaccatgctgtgcctgctgccttccctgccacagacagcaccagcgagggcaagtctgtgcgccaccccaagcccagcaccagcgagagcaagcagagcaccccatctgagacccagacagtgggcgcccacgtgctgcaggtgtgcagcgagcacaccagccacagcgcccaccctgagcccgccctgaacctgaccctggccagcaaggagatccccagcaagctggaggcccagctgggccagggcaaaggagaggccaagctggacctgaagtatgtgcccccccggcgggtggagcaggagggcaaggccgcccaggagggctacctgggctgccacaaggaggagaacctgagcgccctggagggccgggacccctgtggggaggcccaccctgaggccacagatgccctgggccacctgctgaacagcgacctgcaccacctgggcgtgggccggggcaactgtgaggagaagaggggcgtgaaccctggagagcaggacagcctgcacaccacccccaagcagggcagcgccagcctgggcggcgctgacaaccagcccaccgggaagatcagcccctgtgccggggagaagctgggggagaggaccagcagcagcttcagccctggggacagccacgtggccttcatccccaacaacctgacagacagcaagcccctggatgtgattgaggaggagcggcggctgggcagcggcaacaaggacagcgtgatggtgctggtgttcaaccccagcgtgggggagaacaagacagaggtgcctgagcccctggacccccagagcggccgctctgaggcccgggagagcaaggaggtgaccacctctgtggccgagaacagaaacctgctggagaatgctgacaagattgagagcaccagcgcccgggctgacagcgtgctgaacatcccagcccccctgcaccctgagaccaccgtgaacatgacctaccagcccaccacccccagcagcagcttccaggatgtgtctgtgtttggcatggatgctggcagccccctggtggtgcccccacccacagattctgcccggctgctgaacaccagccccaaggtgcctgacaagaacacctgccccagcggcatccccaagcctgtgttcacccacagcaaggacacccccagcagccaggagggcatggagaactaccaggtggagaagacagaggagaggacagagaccaagcccatcatcatgcccaagcccaagcacgtgcggcccaagatcatcacctacatcagaagaaacccccaggccctgggccaggtggatgccagcctggtgcctgtgggcctgccctatgccccacccacctgcaccatgcccctgccccatgaggagaaggctgctggaggagacctgaagcccagcgccaacctgtatgagaagttcaagccagacctgcagaagcccagggtcttcagcagcggcctgatggtgtctggcatcaagcccccaggccaccccttcagccagatgtctgagaagttcctgcaggaggtgacagaccaccctgggaaggaggagttctgcagccccccctatgcccactatgaggtgccccccaccttctaccgcagcgccatgctgctgaagccccagctgggcctgggcgccatgagccggctgcccagcgccaagagccgcatcctgattgccagccagaggagcagcgccagcgccatccaccccccaggccccatcaccacagccaccagcctgtacagcagtgaccccagcgctgacctgaagaaggccagcagcagcaatgctgccaagagcaacctgcccaagagcggcctgcggcccccaggctacagccggctgcctgctgccaagctggccgccttcggctttgtgcgcagcagctctgtgtcctctgtgagcagcacccagagcggggacagcgcccagcctgagcagggccgcccagccaccaggagcacctttggaaatgaggagcagcctgtgctgaaggccagcctgcccagcaaggacacccccaagggggccggccgggtggcccccccagccagcagctctgtgacagcccccaggaggagcctgctgcctgcccccaagagcaccagcaccccagctggcaccaagaaggatgcccagaaggaccaggacaccaacaagccagctgtgagcagccccaagagggtggccgccagcaccaccaagctgcacagccctggctaccccaagcagaggacagctgctgccagaaatggcttcccccccaagccagacccccaggcccgggaggccgagcggcagctggtgctgcggctgaaggagcgctgtgagcagcagacccggcagctgggcgtggcccagggcgagctgaagagggccatctgtggctttgatgccctggccgtggccacccagcacttcttcaggaagaatgaaagtgccctggtgaaggagaaggagctgagcattgagctggccaacatcagagatgaggtggccttccacacagccaagtgtgagaagctgcagaaggagaaggaggagctggagaggagatttgaagatgaggtgaagaggctgggctggcagcagcaggccgagctgcaggagctggaggagcggctgcagctgcagtttgaggccgagatggcccggctgcaggaggagcacggggaccagctgctgagcatccgctgccagcaccaggagcaggtggaggacctgacagccagccatgatgctgccctgctggagatggagaacaaccacacagtggccatcaccatcctgcaggatgaccatgaccacaaggtgcaggagctgatgagcacccatgagctggagaagaaggagctggaggagaactttgagaagctgcggctgagcctgcaggaccaggtggacaccctgaccttccagagccagagcctgcgggaccgggccaggagatttgaggaggccctgaggaagaacacagaggagcagctggagatcgccctggccccctaccagcacctggaggaggacatgaagagcctgaagcaggtgctggagatgaagaaccagcagatccacgagcaggagaagaagatcctggagctggagaagctggccgagaagaacatcatcctggaggagaagatccaggtgctgcagcagcagaatgaagacctgaaggccagaattgaccagaacacagtggtgacccggcagctgtctgaggagaatgccaacctgcaggagtatgtggagaaggagacccaggagaagaagaggctgagcaggaccaatgaggagctgctgtggaagctgcagacaggagaccccaccagccccatcaagctgagccccaccagccctgtgtaccggggcagcagcagcggccccagcagccctgcccgggtgtccaccaccccaagatag

SEQ ID NO: 21187 - DNA, 1041 bp, Artificial Sequence
  Description of Artificial Sequence: Synthetic coding sequence
atgcagcacctgaagagcaagaagcgggaggagcgctggatgagggccagcaagaggcagagcgagaaggagatggaggagctgcaccacaacattgatgacctgctgcaggagaagaagagcctggagtgtgaggtggaggagctgcacaggacagtgcagaagaggcagcagcagaaggacttcattgatggaaatgtggagagcctgatgacagagctggagattgagaagagcctgaagcaccacgaggacatcgtggatgaaattgaatgtattgagaagaccctgctgaagagaagaagtgagctgcgggaggccgaccggctgctggccgaggccgagagcgagctgagctgcaccaaggagaagaccaagaatgctgtggagaagttcacagatgccaagaggagcctgctgcagacagaaagtgatgctgaggagctggagcggcgggcccaggagacagctgtgaacctggtgaaggctgaccagcagctgcggagcctgcaggctgatgccaaggacctggagcagcacaagatcaagcaggaggagatcctgaaggagatcaacaagatcgtggccgccaaggacagcgacttccagtgcctgagcaagaagaaggagaagctgacagaggagctgcagaagctgcagaaggacatcgagatggccgagagaaatgaagaccaccacctgcaggtgctgaaggagagcgaggtgctgctgcaggccaagagagctgagctggagaagctgaagagccaggtgaccagccagcagcaggagatggctgtgctggaccggcagctgggccacaagaaggaggagctgcacctgctgcagggctccatggtgcaggccaaggctgacctgcaggaggccctgcggctgggggagacagaggtgacagagaagtgcaaccacatccgggaggtgaagagcctgctggaggagctgtccttccagaagggggagctgaatgtgcagatcagcgagaggaagacccagctgaccctcatcaagcaggagatctag

SEQ ID NO: 21188 - DNA, 369 bp, Artificial Sequence; identical to SEQ ID NO: 21112
  Description of Artificial Sequence: Synthetic coding sequence

SEQ ID NO: 21189 - DNA, 291 bp, Artificial Sequence
  Description of Artificial Sequence: Synthetic coding sequence
atgagcatcagcagtgatgaggtgaacttcctggtgtaccgctacctgcaggagagcggcttcagccacagcgccttcaccttcggcatcgagagccacatcagccagagcaacatcaacggggccctggtgcccccagctgccctgatcagcatcatccagaagggcctgcagtatgtggaggccgaggtgtccatcaatgaagatggcaccctgtttgatggccggcccatcgagagcctgagcctgattgatgctgtgatgccagatgtggtgcagacccggcagtag

SEQ ID NO: 21190 - DNA, 2913 bp, Artificial Sequence
  Description of Artificial Sequence: Synthetic coding sequence
atgctgcagcaggtgaatggccacaaccctggcagtgatggccaggcccgggagtacctgcgggaggacctgcaggagttcctgggcggggaggtgctgctgtacaagctggatgacctgaccagggtgaaccctgtgaccctggagaccgtgctgcgctgcctgcaggcccgctacatggctgacaccttctacaccaatgccggctgcaccctggtggccctgaaccccttcaagcctgtgccccagctgtacagccctgagctgatgagggagtaccacgccgccccccagccccagaagctgaagccccacgtgttcaccgtgggggagcagacctacagaaatgtgaagagcctgattgagcctgtgaaccagagcatcgtggtgtctggagagagcggggccggcaagacctggaccagccgctgcctgatgaagttctatgctgtggtggccaccagccctgcctcctgggagagccacaagattgctgagcgcatcgagcagaggatcctgaacagcaaccctgtgatggaggcctttggaaatgcctgcaccctgaggaacaacaacagcagcagatttgggaagttcatccagctgcagctgaacagagcccagcagatgactggagctgctgtgcagacctacctgctggagaagaccagggtggcctgccaggccagcagcgagaggaacttccacatcttctaccagatctgcaagggggcctctgaagatgagcggctgcagtggcacctgcctgagggcgccgccttctcctggctgcccaaccctgagaggagcctggaggaggactgctttgaggtgacccgggaggccatgctgcacctgggcatcgacacccccacccagaacaacatcttcaaggtgctggccggcctgctgcacctgggcaacatccagtttgctgcctctgaagatgaggcccagccctgccagcccatggatgatgccaagtacagcgtgaggacagctgccagcctgctgggcctgcctgaagatgtgctgctggagatggtgcagatccgcaccatccgggccggccggcagcagcaggtgttcaggaagccctgtgcccgggcagaatgtgacacccggcgggactgcctggccaagctgatctatgcccggctgtttgactggctggtgtctgtcatcaacagcagcatctgtgccgacacagacagctggaccaccttcatcggcctgctggatgtgtatggctttgagagcttcccagacaacagcctggagcagctgtgcatcaactatgccaatgagaagctgcagcagcactttgtggcccactacctgcgggcccagcaggaggagtatgctgtggagggcctggagtggagcttcatcaactaccaggacaaccagccctgcctggacctgattgagggcagccccatcagcatctgcagcctcatcaatgaggagtgccgcctgaaccggcccagcagcgctgcccagctgcagacccgcatcgagacagccctggccggcagcccctgcctgggccacaacaagctgagccgggagcccagcttcatcgtggtgcactacgccggccctgtgcgctaccacacagctggcctggtggagaagaacaaggaccccatccccccagagctgacccggctgctgcagcagagccaggaccccctgctgatgggcctcttccccaccaaccccaaggagaagacccaggaggagcccccaggccagagccgggcccctgtgctgactgtggtgtccaagttcaaggccagcctggagcagctgctgcaggtgctgcacagcaccaccccccactacatccgctgcatcaagcccaacagccagggccaggcccagaccttcctgcaggaggaggtgctgagccagctggaggcctgtggcctggtggagaccatccacatctctgctgctggcttccccatccgggtgagccacaggaactttgtggagcgctacaagctgctgcggcggctgcacccctgcaccagcagcggccctgacagcccctacccagccaagggcctgcctgagtggtgcccccacagcgaggaggccaccctggagcccctcatccaggacatcctgcacaccctgcctgtgctgacccaggccgccgccatcactggagacagcgctgaggccatgcctgcccccatgcactgcggccgcaccaaggtgttcatgacagacagcatgctggagctgctggagtgtggccgggcccgggtgctggagcagtgtgcccgctgcatccagggcggctggaggaggcaccgccaccgggagcaggagcggcagtggagggctgtgatgctgatccaggccgccatccgctcctggctgaccaggaagcacatccagaggctgcacgccgccgccaccgtcatcaagagggcctggcagaagtggaggatccgcatggcctgcctggccgccaaggagctggatggagtggaggagaagcacttcagccaggccccctgcagcctgagcaccagccccctgcagacccggctgctggaggccatcatccggctgtggcccctgggcctggtgctggccaacacagccatgggcgtgggcagcttccagaggaagctggtggtgtgggcctgcctgcagctgccccggggcagccccagcagctacacagtgcagacagcccaggaccaggccggcgtgaccagcatccgggccctgccccagggcagcatcaagttccactgcaggaagagccccctgcgctatgctgacatctgcccagagcccagcccctacagcatcaccggcttcaaccagatcctgctggagcggcacaggctcatccacgtgaccagcagcgccttcaccggcctgggctag

SEQ ID NO: 21191 - DNA, 3303 bp, Artificial Sequence; identical to SEQ ID NO: 18635
  Description of Artificial Sequence: Synthetic coding sequence

SEQ ID NO: 21192 - DNA, 390 bp, Artificial Sequence; identical to SEQ ID NO: 19988
  Description of Artificial Sequence: Synthetic coding sequence

SEQ ID NO: 21193 - DNA, 498 bp, Artificial Sequence
  Description of Artificial Sequence: Synthetic coding sequence
atgagcctgcacggcaagaggaaggagatctacaagtatgaggccccctggacagtgtatgccatgaactggagcgtgcggccagacaagcgcttccggctggccctgggcagctttgtggaggagtacaacaacaaggtgcagctggtgggcctggatgaggagagcagcgagttcatctgcaggaacacctttgaccacccctaccccaccaccaagctgatgtggatcccagacaccaagggcgtgtacccagacctgctggccaccagcggggactacctgcgggtgtggagggtgggggagacagagacccggctggagtgcctgctgaacaacaacaagaacagcgacttctgtgcccccctgaccagctttgactggaatgaggtggacccctacctgctgggcaccagcagcattgacaccacctgctgcttccagtggcctgtgtgcctgagcctgctgtgcacccactgctaccagaagctgctgtag

SEQ ID NO: 21194 - DNA, 1044 bp, Artificial Sequence
  Description of Artificial Sequence: Synthetic coding sequence
atgagcctggcccagagccctggcatctggggcgaggaccctgtgaagctgaccctggccctgaagatgacccggcaggacctgaccaggacccagatggagctgaacaacatgaaggccaactttggagatgtggtgccccggcgggactttgagatgcaggagaagaccaacaaggacctgcaggagcagctggacaccctgcgggccagctatgaggaggtgaggaaggagcacgagatcctgatgcagctgcacatgagcaccctgaaggagcgggaccagttcttcagcgagctgcaggagatccagaggaccagcacccccaggccagactggaccaagtgcaaggatgtggtggccggcggccctgagcgctggcagatgctggccgagggcaagaacagcgaccagctggtggatgtgctgctggaggagatcggcagcggcctgctgcgggagaaggacttcttccctggcctgggctatggagaggccatcccagccttcctgcgctttgatggcctggtggagaacaagaagcccagcaagaaggatgtggtgaacctgctgaaggatgcctggaaggagcggctggccgaggagcagaaggagaccttcccagacttcttcttcaacttcctggagcacagatttggccccagtgatgccatggcctgggcctacaccatctttgagaacatcaagatcttccacagcaatgaggtgatgagccagttctatgctgtgctgatgggcaagagaagtgaaaatgtgtatgtgacccagaaggagaccgtggcccagctgctgaaggagatgaccaatgctgacagccagaatgaaggcctgctgaccatggagcagttcaacacagtgctgaagagcaccttccccctgaagacagaggagcagatccaggagctgatggaggccggcggctggcaccccagcagcagcaatgctgacctgctgaactaccgcagcctcttcatggaggatgaggagggccagagcgagccctttgtgcagaagctgtggtag

SEQ ID NO: 21195 - DNA, 219 bp, Artificial Sequence
  Description of Artificial Sequence: Synthetic coding sequence
atgtggagcctgacagccagcgagggggagagcaccacagcccacttcttcctgggcgctggagatgagggcctgggcacccggggcatcggcatgaggcctgaggagagtgacagcgagctgctggaggatgaggaggatgaggtgcccccagagccccagatcatcgtgggcatctgtgccatgaccaagaagagcaagagcaagcccatgacctag

SEQ ID NO: 21196 - DNA, 1149 bp, Artificial Sequence; identical to SEQ ID NO: 19044
  Description of Artificial Sequence: Synthetic coding sequence

SEQ ID NO: 21197 - DNA, 1620 bp, Artificial Sequence; identical to SEQ ID NO: 19050
  Description of Artificial Sequence: Synthetic coding sequence

SEQ ID NO: 21198 - DNA, 390 bp, Artificial Sequence; identical to SEQ ID NO: 19988
  Description of Artificial Sequence: Synthetic coding sequence

SEQ ID NO: 21199 - DNA, 1089 bp, Artificial Sequence; identical to SEQ ID NO: 18944
  Description of Artificial Sequence: Synthetic coding sequence

SEQ ID NO: 21200 - DNA, 1266 bp, Artificial Sequence
  Description of Artificial Sequence: Synthetic coding sequence
atgtctgccctgcggcgcagcggctacggccccagtgatggccccagctatggccgctactacggccctggaggaggagatgtgcctgtgcaccccccaccacccctgtaccccctgcggcctgagcccccccagccccccatctcctggagggtgcggggcggcggccctgctgagaccacctggctgggggagggcggcggcggagatggctactaccccagcggcggggcctggccagagcccggccgggccggcggcagccaccagagcctgaacagctacaccaatggagcctacggccccacctacccacctggccctggggccaacacagccagctacagcggggcctactatgcccctggctacacccagaccagctacagcacagaggtgcccagcacctaccgcagcagcggcaacagccccacccctgtgagccgctggatctacccccagcaggactgccagacagaggccccacccctgcggggccaggtgcccggctacccacccagccagaaccctggcatgaccctgccccactacccctatggagatggcaacagatctgtgccccagagcggccccaccgtgcggccccaggaggatgcctgggccagccctggggcctacggcatgggcggccgctacccctggcccagcagcgcccccagcgcccctcctggcaacctgtacatgacagagagcaccagcccctggcccagcagcggcagcccccagagcccccccagcccccctgtgcagcagcccaaggacagcagctacccctacagccagagcgaccagagcatgaacagacacaacttcccctgcagcgtgcaccagtatgagagcagcggcaccgtgaacaatgatgacagcgacctgctggacagccaggtgcagtacagcgctgagccccagctgtatggaaatgccaccagtgaccaccccaacaaccaggaccagagcagcagcctgcctgaggagtgtgtgcccagtgatgagagcaccccacccagcatcaagaagatcatccacgtgctggagaaggtgcagtacctggagcaggaggtggaggagtttgtgggcaagaagacagacaaggcctactggctgctggaggagatgctgaccaaggagctgctggagctggacagcgtggagaccggcggccaggacagcgtgcggcaggccaggaaggaggccgtgtgcaagatccaggccatcctggagaagctggagaagaagggcctgtag

SEQ ID NO: 21201 - DNA, 321 bp, Artificial Sequence
  Description of Artificial Sequence: Synthetic coding sequence
tgaaacctgcgggagggcgctgagcagaaggtggtgttcatcaccggccgggtgcaccctggagagacccccagcagctttgtgtgccagggcatcatcgacttcctggtgtcccagcaccccatcgcctgtgtgctgcgggagtacctggtgttcaagatcgcccccatgctgaacccagatggagtgtacctgggcaactaccgctgcctgagcctgatgagaaatggcagccggggccggcccttcttccccagcagcagcgccaggatgctgcggaccagccccatcccagcccaccccctgaccggcaccctgtag

SEQ ID NO: 21202 - DNA, 684 bp, Artificial Sequence
  Description of Artificial Sequence: Synthetic coding sequence
tgactcatctttgcctgcctggtgcccggcttccctgctgtgatgagcagccggggcccctgcaccctggagaccctcatcaaccccagccccagcgtggctgatgtgaagatctacccagaggagatcacccccctgctgcctgccatctctggagagaagattgctgaggaccagacctgcttcttcctgcagatcctgctgaagtacatggtgatccaggccgccagcctggagtggaagaacaaggagaaccaggacaccggcttcaagttcctgttcaccctcttcaggaagtactacctgccccacctgttccccagcttcaccaagctgaccaacatctacaagcctgtgctggacatcccccacctgcggcccaagcctgtgtacatcaccaccacccgggacaatgaaaacatctacagcaccaagatcccctacatggccgcccgggtggtgttcatcaagtggatcgtgaccttcttcctggagaagaagtacctgacagccacccagaacaccaagaatggagtggatgtgctgcccaagatcatccagacagtgggcggcggcgctgtgcaggagcgggcccctgagctggatggcggcggccccacagagcaggacaagagccacagcaacagcagcaccctgagtgaccggcggctgagcaacagctag

SEQ ID NO: 21203 - DNA, 573 bp, Artificial Sequence
  Description of Artificial Sequence: Synthetic coding sequence
atggagccccccatggagcccagcggcggggagcaggagcccggggctgtgcgcttcctggacctgccctgggaggatgtgctgctgccccacgtgctgaacagagtgcccctgcggcagctgctgcggctgcagagggtgtcccgggccttccgcagcctggtgcagctgcacctggccggcctgcggagatttgatgctgcccaggtgggcccccagatccccagggctgccctggcccggctgctgagagatgctgagggcctgcaggagctggccctggccccctgccacgagtggctgagtgatgaggacctggtgcctgtgctggccaggaacccccagctgcggtctgtggccctgggcggctgcggccagctgagcagaagagccctgggcgccctggccgagggctgcccccggctgcagaggctgagcctggcccactgtgactgggtggatggcctggccctgcggggcctggccgaccgctgcccagccctggaggagctggacctgacagcctgccggcagctgaaggatgaggccatcgtgtacctggcccagaggtag

SEQ ID NO: 21204 - DNA, 270 bp, Artificial Sequence; identical to SEQ ID NO: 20498
  Description of Artificial Sequence: Synthetic coding sequence

SEQ ID NO: 21205 - DNA, 381 bp, Artificial Sequence
  Description of Artificial Sequence: Synthetic coding sequence
atgaccaccaggtctgtgctggatgtggagacctttgtggccgacatcctgaagggggagaacctgagcaagaaggccaaggagaagcgggagagcctcatcaagaagatcaaggatgtgaagagcatctacctgcaggagttccaggacaagggagatgctgaagatggagaggagtatgatgacccctttgctggccccccagacaccatcagcctggccagcgagagatatgacaaggatgatgaggcccccagtgatggagcccagttcccccccatcgccgcccaggacctgccctttgtgctgaaggccggctacctggagaagaggaggaaggaccacagcttcctgggctttgagtggcagaagcgctggtag

SEQ ID NO: 21206 - DNA, 678 bp, Artificial Sequence
  Description of Artificial Sequence: Synthetic coding sequence
atgctgtctgctgtggcccggggctaccagggctggttccacccctgtgcccggctgtctgtgaggatgagcagcacaggcatcgacagaaaaggagtgctggccaacagagtggccgtggtgacaggcagcaccagcggcatcggctttgccatcgcccggcggctggccagagatggagcccacgtggtgatcagcagcaggaagcagcagaatgtggaccgggccatggccaagctgcagggcgagggcctgtctgtggccggcatcgtgtgccacgtgggcaaggccgaggaccgggagcagctggtggccaaggccctggagcactgcggcggcgtggacttcctggtgtgcagcgctggggtgaaccccctggtgggcagcaccctgggcaccagcgagcagatctgggacaagatcctgtctgtgaatgtgaagagccctgccctgctgctgagccagctgctgccctacatggagaacagaagaggagctgtgatcctggtgagcagcattgctgcctacaaccctgtggtggccctgggcgtgtacaacgtgtccaagacagccctgctgggcctgaccaggaccctggccctggagctggcccccaaggacatccgggtgaactgtgtggtgcccggcatcatcaagacagacttcagcaaggtgtag

SEQ ID NO: 21207 - DNA, 1080 bp, Artificial Sequence
  Description of Artificial Sequence: Synthetic coding sequence
tgagccacagccatgaccagcgcctggctggcccagggcaccggggagggcgtgaatgatgtgaggaaaggagcctgtgccagccacgtgtccaccatggccagcttcctgaagggggcccacgtgaccatcaatgcccgggcagaggaggatgtggagcctgagtgcatcatggagaaggtggccaaggccagcggggccaactacagcttccacaaggagagcggccgcttccaggatgtgggcccccaggcccctgtgggctctgtgtaccagaagaccaatgctgtgtctgagatcaagagggtgggcaaggacagcttctgggccaaggccgagaaggaggaggagaacagaaggctggaggagaagagaagagctgaggaggcccagaggcagctggagcaggagcggcgggagcgggagctgcgggaggccgcccggcgggagcagcgctaccaggagcagggcggggaggccagcccccagaggacctgggagcagcagcaggaggtggtgtccaggaacagaaatgagcaggagagcgctgtgcacccccgggagatcttcaagcagaaggagcgggccatgagcaccaccagcatcagcagcccccagcccgggaagctgcggagccccttcctgcagaagcagctgacccagcctgagacccacttcggccgggagcctgctgctgccatcagccggcccagggctgacctgcctgctgaggagcccgcccccagcaccccaccctgcctggtgcaggccgaggaggaggccgtgtatgaggagcccccagagcaggagaccttctatgagcagccccccctggtgcagcagcagggcgccggcagcgagcacatcgaccaccacatccagggccagggcctgagcggccagggcctgtgtgcccgggccctgtatgactaccaggccgcagatgacacagagatcagctttgatcctgagaacctgatcaccggcatcgaggtgattgatgagggctggtggaggggctacggcccagatggccacttcggcatgtttcctgccaactacgtggagctgattgaatag

SEQ ID NO: 21208 - DNA, 483 bp, Artificial Sequence; identical to SEQ ID NO: 20009
  Description of Artificial Sequence: Synthetic coding sequence

SEQ ID NO: 21209 - DNA, 2616 bp, Artificial Sequence
  Description of Artificial Sequence: Synthetic coding sequence
atgggagacagtgatgatgaatatgacagaagaagaagagacaagttcagaagagagaggagtgactatgacaggagccgggagagagatgagaggagaagaggagatgactggaatgaccgggagtgggaccggggccgggagaggaggagcagaggagagtacagagattatgacaggaacagaagagagcgcttcagcccccccaggcatgagctgagccccccccagaagaggatgagaagagactgggatgagcacagcagtgacccctaccacagcggctatgagatgccctatgccggcggcggcggcggccccacctacggccccccccagccctggggccacccagatgtgcacatcatgcagcaccacgtgctgcccatccaggcccggctgggcagcattgctgagattgacctgggcgtgcccccacctgtgatgaagaccttcaaggagttcctgctgagcctggatgacagcgtggatgaaacagaggccgtgaagcgctacaatgactacaagctggacttccggcggcagcagatgcaggacttcttcctggcccacaaggatgaggagtggttccgcagcaagtaccacccagatgaggtgggcaagaggcggcaggaggcccggggggccctgcagaaccggctgcgggtcttcctgagcctgatggagaccggctggtttgacaacctgctgctggacatcgacaaggcagatgccatcgtgaagatgctggatgctgctgtgatcaagatggagggcggcacagaaaatgacctgcgcatcctggagcaggaggaggaggaggagcaggccggcaagccaggagagcccagcaagaaggaggagggccgggccggggccggcctgggagatggagagaggaagaccaatgacaaggatgagaagaaggaggatggcaagcaggccgagaatgacagcagcaatgatgacaagaccaagaagtcagaaggagatggagacaaggaggagaagaaggaggacagcgagaaggaggccaagaagagcagcaagaagaggaacaggaagcacagcggagatgacagctttgatgagggctctgtgtctgagagcgagagcgagagcgagagcggccaggccgaggaggagaaggaggaggccgaggccctgaaggagaaggagaagcccaaggaggaggagtgggagaagcccaaggatgctgctggcctggagtgcaagccccggcccctgcacaagacctgcagcctcttcatgagaaatattgcccccaacatcagcagagctgagatcatcagcctgtgcaagcgctacccaggcttcatgagggtggccctgtctgagccccagcctgagcggcgcttcttccggcggggctgggtgacctttgacagatctgtgaacatcaaggagatctgctggaacctgcagaacatccggctgcgggagtgtgagctgagccctggggtgaacagagacctgaccaggagagtgaggaacatcaatggcatcacccagcacaagcagatcgtgagaaatgacatcaagctggccgccaagctgatccacaccctggatgacaggacccagctgtgggccagcgagcccggcaccccacccctgcccaccagcctgcccagccagaaccccatcctgaagaacatcacagactacctgattgaggaggtgtctgctgaggaggaggagctgctgggcagcagtggaggagcccctcctgaggagccccccaaggagggcaacccagctgagatcaacgtggagagagatgagaagctgatcaaggtgctggacaagctgctgctgtacctgagaattgtgcacagcctggactactacaacacctgtgagtacccaaatgaagatgagatgcccaacagatgtggcatcatccacgtgcggggccccatgccacccaaccgcatcagccatggagaggtgctggagtggcagaagacctttgaggagaagctgacccccctgctgtctgtgcgggagagcctgtctgaggaggaggcccagaagatgggcaggaaggaccctgagcaggaggtggagaagtttgtgaccagcaacacccaggagctgggcaaggacaagtggctgtgccccctgagcggcaagaagttcaagggccctgagtttgtgaggaagcacatcttcaacaagcacgccgagaagattgaggaggtgaagaaggaggtggccttcttcaacaacttcctgacagatgccaagaggcctgccctgcctgagatcaagccagcccagcccccaggccctgcccagagcctgaccccaggcctgccctacccccaccagaccccccagggcctgatgccctacggccagccccggccccccatcctgggctatggagctggagctgtgcggcctgctgtgcccaccggcggccccccctacccccacgccccctacggggccggccggggcaactatgatgccttccggggccagggcggctacccaggcaagcccaggaacaggatggtgcggggggacccccgggccatcgtggagtacagagacctggatgccccagatgatgtggacttcttctag

SEQ ID NO: 21210 - DNA, 2025 bp, Artificial Sequence; identical to SEQ ID NO: 19458
  Description of Artificial Sequence: Synthetic coding sequence

SEQ ID NO: 21211 - DNA, 1467 bp, Artificial Sequence
  Description of Artificial Sequence: Synthetic coding sequence
atgtctgatgaggtgttcagcaccaccctggcctacaccaagagccccaaggtgaccaagaggaccaccttccaggatgagctgatccgggccatcacagcccggagcgcccggcagaggagcagcgagtacagtgatgactttgacagtgatgaaattgtgtccctgggggacttcagtgacaccagcgcagatgagaacagcgtgaacaagaagatgaatgacttccacatcagtgatgatgaggagaagaaccccagcaagctgctcttcctgaagaccaacaagagcaatggaaacatcaccaaggatgagcctgtgtgtgccatcaagaatgaggaggagatggccccagatggctgtgaggacatcgtggtgaagagcttcagcgagagccagaacaaggatgaggagtttgagaaggacaagatcaagatgaagcccaagccccgcatcctgagcatcaagagcaccagcagcgagaacaacagcctggacacagatgaccacttcaagcccagcccccggcccaggtccatgctgaagaagaagagccacatggaggagaaggatggcctggaggacaaggagacagccctgtctgaggagctggagctgcacagcgcccccagcagcctgcccaccccaaatggcatccagctggaggccgagaagaaggccttcagcgagaacctggaccctgaggacagctgcctgaccagcctggccagcagcagcctgaagcagatcctgggggacagcttcagccctggcagcgagggcaatgccagcggcaaggaccccaatgaggagatcacagagaaccacaacagcctgaagagtgatgagaacaaggagaacagcttctctgctgaccacgtgaccacagctgtggagaagagcaaggagagccaggtgacagcagatgacctggaggaggagaaggccaaggccgagctgatcatggatgatgacagaacagtggaccccctgctgagcaagagccagagcatcctgatcagcaccagcgccacagccagcagcaagaagaccattgaagatagaaacatcaagaacaagaagagcaccaacaacagagccagcagcgccagcgcccggctgatgaccagcgagttcctgaagaagagcagcagcaagaggaggacccccagcaccaccaccagcagccactacctgggcaccctgaaggtgctggaccagaagcccagccagaagcagagcattgaaccagacagagctgacaacatccgggctgctgtgtaccaggagtggctggagaagaagaatgtgtacctgcacgagatgcaccgcatcaagagaattgaaagtgagaacctgcgcatccagaatgagcagaagaaggccgccaagcgggaggaggccctggccagctttgaggcctggaaggccatgaaggagaaggaggccaagaagattgctgcctag

SEQ ID NO: 21212 - DNA, 564 bp, Artificial Sequence
  Description of Artificial Sequence: Synthetic coding sequence
atggtgcgggagcccggccccaggcctggcaccccaggctgcagcgccagcggccagtggacagccaccctgcggccctacctgtctgctgtgcgggccaccctgcaggccgccctgtgcctggagaacttcagcagccaggtggtggagcggcacaacaagccagaggtggaggtgcgcagcagcaaggagctgctgctgcagcctgtgaccatcagcagaaatgagaaggagaaggtgctgattgagggcagcatcaacagcgtgcgggtgtccattgctgtgaagcaggctgatgaaattgagaagatcctgtgccacaagttcatgaggttcatgatgatgagagctgagaacttcttcatcctgcggaggaagcctgtggagggctatgacatctccttcctgatcaccaacttccacacagagcagatgtacaagcacaagctggtggactttgtgatccacttcatggaggagattgacaaggagatcagcgagatgaagctgtctgtgaatgcccgggcccgcatcgtggccgaggagttcctgaagaacttctag

SEQ ID NO: 21213 - DNA, 1068 bp, Artificial Sequence
  Description of Artificial Sequence: Synthetic coding sequence
tgaagcctggccagcagcctgaggaacaaggagggcaccctgggcagcaaggtgggctacctggatgtggaggcccggggccctggagagggccggggcggcggcggggagagcccccccctgcagcccccacctccagcccctgtgctgctgtatgaccagggcggcggcagaagaagaagaggagaggccgaggccgaggccgaggagtgggaggccgagagcgtgctgggcaccctgctgcagaagctgcgggaggagggctacctggcctactacctgcagggcggcttcagccgcttccaggccgagtgcccccacctgtgtgagaccagcctggccggccgggccggcagctccatggcccctgtgcccggccctgtgcctgtggtgggcctgggcagcctgtgcctgggcagtgactgcagtgatgctgagagcgaggccgaccgggacagcatgagctgtggcctggacagcgagggcgccaccccacctcctgtgggcctgcgggccagcttccctgtgcagatcctgcccaacctgtacctgggcagcgcccgggacagcgccaacctggagagcctggccaagctgggcatccgctacatcctgaatgtgacccccaacctgcccaacttctttgagaagaatggagacttccactacaagcagatccccatcagtgaccactggagccagaacctgagccgcttcttccctgaggccatcgagttcattgatgaggccctgagccagaactgtggggtgctggtgcactgcctggccggcgtgagccgctctgtgacagtgacagtggcctacctgatgcagaagctgcacctgagcctgaatgatgcctatgacctggtgaagaggaagaagagcaacatcagccccaacttcaacttcatgggccagctgctggactttgagaggagcctgcggctggaggagcggcacagccaggagcagggcagcggcggccaggccagcgctgccagcaaccccccatccttcttcaccacccccaccagtgatggagcctttgagctggcccccacctag

SEQ ID NO: 21214 - DNA, 51 bp, Artificial Sequence; identical to SEQ ID NO: 20857
  Description of Artificial Sequence: Synthetic coding sequence

SEQ ID NO: 21215 - DNA, 1620 bp, Artificial Sequence; identical to SEQ ID NO: 19050
  Description of Artificial Sequence: Synthetic coding sequence

SEQ ID NO: 21216 - DNA, 474 bp, Artificial Sequence; identical to SEQ ID NO: 20844
  Description of Artificial Sequence: Synthetic coding sequence

SEQ ID NO: 21217 - DNA, 2553 bp, Artificial Sequence
  Description of Artificial Sequence: Synthetic coding sequence
atggagcctgagaggaagggcctgagcctggccagcagcagtgatggagatggccgggaggagaacaagctgaagcagggcatcagccaggacctggccagcagcagccggctggaccgctacaagatcgcccggcagctgacagagaaggccatcaaggagaagaagatcttcagcatctacggccactaccctgtggtgcgggccgccctgcggaggaagggctgggtggagaagaagttccacttcctgcccaaggtgatcccagatgtggaggatgaaggagcccgggtgaatgatgacacctgtgccaaggtgaaggagaaccaggagatggccctggagaagacagacaacatccatgatgtgatgagccggctggtgaagaatgagatgccctacctgctgtggaccatcaagagggacatcatcgactaccacagcctgacctatgaccagatgctgaaccactacgccaagacagccagcttcaccaccaagattggcctgtgtgtgaacatgaggagcctgccctggtacgtgcctgccaacccagacagcttcttcccccgctgctacagcctgtgcacagaaagtgagcagcaggagttcctggaggacttccggaggaccatggccagcagcatcctgaagtgggtggtgagccaccagagctgcagccgcagcagccgcagcaagccccgggaccagcgggaggaggccggcagcagtgacctgagcagccggcaggatgctgaaaatgctgaggccaagctgcggggcctgcccggccagctggtggacatcgcctgcaaggtgtgccaggcctacctgggccagctggagcacgaggacatcgacaccagcgcagatgctgtggaggacctgacagaagctgagtgggaggacctgacccagcagtactacagcctggtgcatggagatgccttcatcagcaacagcaggaactacttcagccagtgccaggccctgctgaaccgcatcacctctgtgaacccccagacagacattgatggcctgaggaacatctggatcatcaagccagctgccaagagccggggccgggacatcgtgtgcatggacagagtggaggagatcctggagctggccgctgctgaccaccccctgagccgggacaacaagtgggtggtgcagaagtacatcgagacccccctgctgatctgtgacaccaagtttgacatccggcagtggttcctggtgacagactggaaccccctgaccatctggttctacaaggagagctacctgcgcttcagcacccagcgcttcagcctggacaagctggacagcgccatccacctgtgcaacaatgctgtgcagaagtacctgaagaatgatgtgggccgcagccccctgctgcctgcccacaacatgtggaccagcacccgcttccaggagtacctgcagaggcagggcagaggagctgtgtggggcagcgtcatctaccccagcatgaagaaggccatcgcccacgccatgaaggtggcccaggaccacgtggagcccaggaagaacagctttgagctgtatggagctgactttgtgctgggccgggacttccggccctggctgattgagatcaacagcagccccaccatgcaccccagcacccctgtgacagcccagctgtgtgcccaggtgcaggaggacaccatcaaggtggccgtggacaggagctgtgacatcggcaactttgagctgctgtggaggcagcctgtggtggagcccccacccttcagcggcagtgacctgtgtgtggccggcgtgtctgtgcggcgggcccggcggcaggtgctgcctgtgtgcaacctgaaggccagcgccagcctgctggatgcccagcccctgaaggcccggggccccagcgccatgccagaccctgcccagggcccccccagccctgccctgcagagggacctgggcctgaaggaggagaagggcctgcccctggccctgctggcccccctgcggggagctgctgagagcggcggggccgcccagcccaccaggaccaaggccgccggcaaggtggagctgcctgcctgcccctgccgccacgtggacagccaggcccccaacacaggagtgcctgtggcccagcctgccaagtcctgggaccccaaccagctgaatgcccaccccctggagcctgtgctgcggggcctgaagacagctgagggcgccctgcggcccccacctgggggcaagggggagggcaccgtgtgcagccggctgccccaccacggccaccacgtggccgcctgccagaccaccggcaccacctgggatggcggccctggggtgtgcttcctgcggcagctgctggccagcgagctgcccatgggccctggcctgccccgggacccccgggccccaccctgcctggtgtgccggggcctgctgcccccagctggcccctgcaagcgctgccgctccttctgtgccgctgtgctgcagggcgccagctttgtgcggctgggcggccgcagctgcagccccaggaccccctag

SEQ ID NO: 21218 - DNA, 2739 bp, Artificial Sequence
  Description of Artificial Sequence: Synthetic coding sequence
atgaagaggggcatccggcgggaccccttcaggaagaggaagctgggcggccgggccaagaaggtgcgggagcccacagctgtgaacagcttctaccgggaggccagcctgcccagcgtgtgggccagcctgcggcggcgggagatggtgcgcagcggggcccggcccggccaggtgctgagcagcggccgccacacaggccctgccaagctgaccaacgggaagaaggccacctacctgaggaagatcccccgcttcaatgctgacagcggctacagcatccacagcgacagcgagagccaggccgagaccgtgcacggcctggatggctgtgccagcctgctgcgggacatcctgagaaatgaagacagcgccagcagtgacaacaagaagcagatccccaatgaggccagcgcccggtctgagcgggacaccagtgacctggagcagaactggagcctgcaggaccactacaggatgtacagccccatcatctaccaggccctgtgtgagcacgtgcagacccagatgagcctgatgaatgacctgaccagcaagaacatccccaacggcatcccagctgtgccctgccacgcccccagccacagcgagagccaggccaccccccacagcagctatggcctgtgcaccagcacccctgtgtggagcctgcagaggcctccctgcccccccaaggtgcacagcgaggtgcagacagatggcaacagccagtttgccagccagggcaagacagtgtctgccacctgcacagatgtgctgagaaattccttcaacaccagccctggggtgccctgcagcctgcccaagacagacatcagcgccatccccaccctgcagcagctgggcctggtgaatggcatcctgccccagcagggcatccacaaggagacagacctgctgaagtgcatccagacctacctgagcctcttccgcagccacggcaaggagacccacctggacagccagacccacaggagccccacccagagccagcctgccttcctggccaccaatgaggagaagtgtgcccgggagcagatccgggaggccaccagcgagaggaaggacctgaacatccacgtgcgggacaccaagacagtgaaggatgtgcagaaggccaagaatgtgaacaagacagctgagaaggtgcgcatcatcaagtacctgctgggggagctgaaggccctggtggccgagcaggaggacagcgagatccagaggctcatcacagagatggaggcctgcatctctgtgctgcccaccgtgtctggcaacacagacatccaggtggagatcgccctggccatgcagcccctgcggagtgaaaatgcccagctgcggcggcagctgcgcatcctgaaccagcagctgcgggagcagcagaagacccagaagcccagcggggctgtggactgcaacctggagctgttcagcctgcagagcctgaacatgagcctgcagaaccagctggaggagagcctgaagagccaggagctgctgcagagcaagaatgaggagctgctgaaggtgattgagaaccagaaggatgagaacaagaagttcagcagcatcttcaaggacaaggaccagaccatcctggagaacaagcagcagtatgacatcgagatcacccgcatcaagattgagctggaggaggccctggtgaatgtgaagagcagccagttcaagctggagacagctgagaaggagaaccagatcctgggcatcaccctgcggcagagagatgctgaggtgacccggctgcgggagctgaccaggaccctgcagacctccatggccaagctgctgagtgacctgtctgtggacagcgcccgctgcaagccaggcaacaacctgaccaagagcctgctgaacatccatgacaagcagctgcagcacgaccctgccccagcccacaccagcatcatgagctacctgaacaagctggagaccaactacagcttcacccacagcgagcccctgagcaccatcaagaatgaggagaccattgaaccagacaagacctatgaaaatgtgctgagcagccggggcccccagaacagcaacacccggggcatggaggaggccagcgcccctggcatcatcagcgccctgagcaagcaggacagtgatgagggcagcgagaccatggccctgattgaagatgagcacaacctggacaacaccatctacatcccctttgcccggagcaccccagagaagaagagccccctgagcaagaggctgagcccccagccccagatccgggccgccaccacccagctggtgagcaacagcggcctggccgtgtctgggaaggagaacaagctgtgcacccctgtgatctgcagcagcagcaccaaggaggccgaggatgcccctgagaagctgagccgggccagtgacatgaaggacacccagctgctgaagaagatcaaggaggccatcggcaagatcccagctgccaccaaggagcctgaggagcagacagcctgccacggccccagcggctgcctgagcaacagcctgcaggtgaagggcaacacagtgtgtgatggctctgtgttcaccagtgacctgatgtctgactggagcatcagcagcttcagcaccttcaccagcagagatgagcaggacttcagaaatggcctggccgccctggatgccaacatcgcccggctgcagaagagcctgaggacaggcctgctggagaagtag

SEQ ID NO: 21219 - DNA, 528 bp, Artificial Sequence
  Description of Artificial Sequence: Synthetic coding sequence
atggagctgaccatcttcatcctgcggctggccatctacatcctgaccttccccctgtacctgctgaacttcctgggcctgtggagctggatctgcaagaagtggttcccctacttcctggtgcgcttcaccgtcatctacaatgagcagatggccagcaagaagcgggagctgttcagcaacctgcaggagtttgctggccccagcggcaagctgagcctgctggaggtgggctgcggcactggagccaacttcaagttctacccacctggctgccgggtgctgcggcctggaggagccttctacttcatggagcacgtggccgctgagtgcagcacctggaactacttctggcagcaggtgctggaccctgcctggcacctgctgtttgatggctgcaacctgacccgggagagctggaaggccctggagcgggccagcttcagcaagctgaagctgcagcacatccaggcccccctgtcctgggagctggtgcggccccacatctacggctatgctgtgaagtag

SEQ ID NO: 21220 - DNA, 1392 bp, Artificial Sequence
  Description of Artificial Sequence: Synthetic coding sequence
atgtctgggggcaccccctacatcggcagcaagatcagcctcatcagcaaggccgagatccgctatgagggcatcctgtacaccatcgacacagagaacagcacagtggccctggccaaggtgcgcagctttggaacagaagatcggcccacagaccggcccatccccccaagagatgaggtgtttgagtacatcatcttccggggcagtgacatcaaggacctgactgtgtgtgagccccccaagccccagtgcagcctgccccaggaccctgccatcgtgcagagcagcctgggcagcagcaccagcagcttccagagcatgggcagctatggccccttcggccgcatgcccacctacagccagttcagccccagcagcctggtgggccagcagtttggagctgtgggcgtggccggcagcagcctgaccagctttggaacagagaccagcaacagcggcaccctgccccagagcagcgctgtgggcagcgccttcacccaggacaccaggagcctgaagacccagctgagccagggccgcagcagcccccagctggaccccctgaggaagagccccaccatggagcaggccgtgcagacagccagcgcccacctgcctgccccagctgctgtgggccgccgcagccctgtgtccacccggcccctgcccagcgccagccagaaggccggggagaaccaggagcacagaagagctgaggtgcacaaggtgtccaggccagaaaatgagcagctgagaaatgacaacaagaggcaggtggcccctggggcccccagcgccccccggcggggccggggcggccacagaggaggccggggccgcttcggcatcagaagagatggccccatgaagtttgagaaggactttgattttgagagcgccaatgcccagttcaacaaggaggagattgaccgggagttccacaacaagctgaagctgaaggaggacaagctggagaagcaggagaagcctgtgaatggagaagataaaggagacagcggcgtggacacccagaacagcgagggcaatgctgatgaggaggaccccctgggccccaactgctactatgacaagaccaagagcttctttgacaacatcagctgtgatgacaaccgggagcggcggcccacctgggccgaggagcggcggctgaatgctgagaccttcggcatccccctgcggcccaacagaggccggggcggctaccggggccggggcggcctgggcttccggggcggccggggccggggcggcggccggggcggcaccttcaccgccccccggggcttccggggcggcttccggggcggccggggcggccgggagtttgctgactttgagtacaggaagaccacagccttcggcccctag

SEQ ID NO: 21221 - DNA, 2790 bp, Artificial Sequence
  Description of Artificial Sequence: Synthetic coding sequence
atggccgaggtggaggccgtgcagctgaaggaggagggcaacagacacttccagctgcaggactacaaggccgccaccaacagctacagccaggccctgaagctgaccaaggacaaggccctgctggccaccctgtacagaaacagagctgcctgtggcctgaagacagagagctatgtgcaggccgccagtgatgccagccgggccatcgacatcaacagcagtgacatcaaggccctgtaccgccgctgccaggccctggagcacctgggcaagctggaccaggccttcaaggatgtgcagagatgtgccaccctggagcccaggaaccagaacttccaggagatgctgcggcggctgaacaccagcatccaggagaagctgcgggtgcagttcagcacagacagccgggtgcagaagatgtttgagatcctgctggatgagaacagcgaggccgacaagcgggagaaggccgccaacaacctgattgtgctgggccgggaggaggccggggctgagaagatcttccagaacaatggagtggccctgctgctgcagctgctggacaccaagaagccagagctggtgctggccgctgtgaggaccctgagcggcatgtgcagcggccaccaggcccgggccaccgtcatcctgcatgctgtgagaattgaccgcatctgcagcctgatggctgtggagaatgaggagatgagcctggccgtgtgcaacctgctgcaggccatcatcgacagcctgtctggagaggacaagcgggagcaccggggcaaggaggaggccctggtgctggacaccaagaaggacctgaagcagatcaccagccacctgctggacatgctggtgtccaagaaggtgtctggccagggccgggaccaggccctgaacctgctgaacaagaatgtgcccaggaaggacctggccatccatgacaacagcaggaccatctacgtggtggacaatggcctgaggaagatcctgaaggtggtgggccaggtgcctgacctgcccagctgcctgcccctgacagacaacaccaggatgctggccagcatcctgatcaacaagctgtatgatgacctgcgctgtgaccctgagcgggaccacttcaggaagatctgtgaggagtacatcaccgggaagtttgacccccaggacatggacaagaacctgaatgccatccagacagtgtctggcatcctgcagggcccctttgacctgggcaaccagctgctgggcctgaagggcgtgatggagatgatggtggccctgtgtggcagcgagcgggagacagaccagctggtggccgtggaggccctgattcatgccagcaccaagctgagccgggccaccttcatcatcaccaatggagtgtccctgctgaagcagatctacaagaccaccaagaatgagaagatcaagatccgcaccctggtgggcctgtgcaagctgggcagcgctgggggcacagattatggcctgcggcagtttgctgagggcagcacagagaagctggccaagcagtgcaggaagtggctgtgcaacatgagcattgacaccaggacccggcgctgggccgtggagggcctggcctacctgaccctggatgctgatgtgaaggatgactttgtgcaggatgtgcctgccctgcaggccatgtttgagctggccaagaccagtgacaagaccatcctgtacagcgtggccaccaccctggtgaactgcaccaacagctatgatgtgaaggaggtgattcctgagctggtgcagctggccaagttcagcaagcagcacgtgcctgaggagcaccccaaggacaagaaggacttcatcgacatgagggtgaagaggctgctgaaggccggggtcatcagcgccctggcctgcatggtgaaggctgacagcgccatcctgacagaccagaccaaggagctgctggcccgggtcttcctggccctgtgtgacaaccccaaggaccggggcaccatcgtggcccagggcggcggcaaggccctgatccccctggccctggagggcacagatgtgggcaaggtgaaggccgcccacgccctggccaagattgctgctgtgagcaacccagacatcgccttccctggagagcgggtgtatgaggtggtgcggcccctggtgcggctgctggacacccagagagatggcctgcagaactatgaggccctgctgggcctgaccaacctgagcggccgcagtgacaagctgcggcagaagatcttcaaggagcgggccctgcctgacatcgagaactacatgtttgagaaccacgaccagctgcggcaggccgccacagagtgcatgtgcaacatggtgctgcacaaggaggtgcaggagcgcttcctggctgatggaaatgaccggctgaagctggtggtgctgctgtgtggagaagatgatgacaaggtgcagaatgctgctgctggggccctggccatgctgacagctgcccacaagaagctgtgcctgaagatgacccaggtgaccacccagtggctggagatcctgcagaggctgtgcctgcatgaccagctgtctgtgcagcaccggggcctggtgattgcctacaacctgctggccgcagatgctgagctggccaagaagctggtggagagcgagctgctggagatcctgactgtggtgggcaagcaggagccagatgagaagaaggccgaggtggtgcagacagcccgggagtgcctgatcaagtgcatggactatggcttcatcaagcctgtgtcctag

SEQ ID NO: 21222 - DNA, 246 bp, Artificial Sequence
  Description of Artificial Sequence: Synthetic coding sequence
atgagccactacggcagctactacggcggcctgggctacagctgtggcggctttggaggcctgggctacggctacggctgcggctgcggcagcttctgccggcggggcagcggctgcggctatggaggctacggctacggcagcggctttggaggctacggctacggcagcggctttggaggctacggctacggctgctgccggcccagctacaacggcggctacggcttcagcggcttctactag

SEQ ID NO: 21223 - DNA, 150 bp, Artificial Sequence
  Description of Artificial Sequence: Synthetic coding sequence
atggaggtgccccggctggaccacgccctgaacagccccaccagcccctgtgaggaggtgatcaagaacctgagcctggaggccatccagctgtgtgacagagatgtggtgtttgaggagctgaccagcaagcagaccaggaagggctag

SEQ ID NO: 21224 - DNA, 498 bp, Artificial Sequence
  Description of Artificial Sequence: Synthetic coding sequence
atgagccgctacctgcggccccccaacaccagcctgtttgtgagaaatgtggctgatgacaccaggtctgaggacctgcggcgggagtttggccgctatggccccatcgtggatgtgtatgtgcccctggacttctacacccggcggccccggggctttgcctacgtgcagtttgaagatgtgagagatgctgaagatgccctgcacaacctggacaggaagtggatctgtggccggcagatcgagatccagtttgcccagggcgacaggaagacccccaaccagatgaaggccaaggagggcagaaatgtgtacagcagcagccgctatgatgattatgaccgctacagaagaagccgcagccgctcctatgaaagaagaagaagccgcagccgcagctttgactacaactacagaagaagctacagccccaggaagcccaactgctcctggaacacccagtacagcagcgcctactacaccagcaggaagatctag

SEQ ID NO: 21225 - DNA, 1803 bp, Artificial Sequence; identical to SEQ ID NO: 20162
  Description of Artificial Sequence: Synthetic coding sequence

SEQ ID NO: 21226 - DNA, 465 bp, Artificial Sequence
  Description of Artificial Sequence: Synthetic coding sequence
atggtgagcagcgcccagatgggcttcaacctgcaggccctgctggagcagctgagccaggatgagctgagcaagttcaagtacctgatcaccaccttcagcctggcccacgagctgcagaagatcccccacaaggaggtggacaaggcagatggcaagcagctggtggagatcctgaccacccactgtgacagctactgggtggagatggccagcctgcaggtgtttgagaagatgcacaggatggacctgtctgagcgggccaaggatgaggtgcgggaggccgccctgaagagcttcaacaagaggaagcccctgagcctgggcatcaccaggaaggagcggccccccctggatgtggatgagatgctggagcgcttcaagacagaggcccaggccttcacagagaccaagggaaatgtcatctgcctgggcaaggaggtgttcaagggcaagaagccctag

SEQ ID NO: 21227 - DNA, 474 bp, Artificial Sequence; identical to SEQ ID NO: 20844
  Description of Artificial Sequence: Synthetic coding sequence

SEQ ID NO: 21228 - DNA, 348 bp, Artificial Sequence; identical to SEQ ID NO: 20824
  Description of Artificial Sequence: Synthetic coding sequence

SEQ ID NO: 21229 - DNA, 432 bp, Artificial Sequence
  Description of Artificial Sequence: Synthetic coding sequence
gtgcgggagctggaggccgagctggatgctgagcagaagaagcacgccgaggccctgaagggcgtgaggaagcatgaaagaagagtgaaggagctggcctaccaggtgggggacagagtgtccctgggcagcggccctggggccggccctgcccaggccagccctgagagccccctgcctgcccaggccgaggaggacaggaagaacctggccaggatgcaggacctggtggacaagctgcagagcaaggtgaagagctacaagaggcagtttgaggaggccgagcagcaggccaacaccaacctggccaagtacaggaaggcccagcacgagctggatgatgctgaggagagagctgacatggccgagacccaggccaacaagctgcgggcccggaccagagatgccctgggccccaagcacaaggagtag

SEQ ID NO: 21230 - DNA, 828 bp, Artificial Sequence; identical to SEQ ID NO: 19333
  Description of Artificial Sequence: Synthetic coding sequence

SEQ ID NO: 21231 - DNA, 339 bp, Artificial Sequence
  Description of Artificial Sequence: Synthetic coding sequence
tgatgtgccaggacagctgggggctgcctgggctgcctgagcggccagtgctgctgccgcctgtgccccctgaccctgcctgccaccaggagcctgtgccccggccgggtggtgtgggcccggcggcgctggtggcccagctggctggcctggcgctgcctgtggtgcaccacccggcccccagcctgcatggagaacacagatgccttcctgttcctgttctccttcacagaccgggccagctttgaggacctgcccggccagctggccagaattgctggggaggcccctggggtggtgaggatggtgattggcagcaagtttgaccagtacatgtag

SEQ ID NO: 21232 - DNA, 3330 bp, Artificial Sequence
  Description of Artificial Sequence: Synthetic coding sequence
atgggcactggagacttcatctgcatctccatgactggaggagccccctggggcttccggctgcagggcggcaaggagcagaagcagcccctgcaggtggccaagatccggaaccagagcaaggccagcggcagcggcctgtgtgaaggagatgaggtggtgtccatcaatggaaacccctgtgccgacctgacctacccagaggtgatcaagctgatggagagcatcacagacagcctgcagatgctgatcaagaggcccagcagcggcatcagcgaggccctgatcagtgaaaatgaaaacaagaacctggagcacctgacccatggaggctacgtggagagcaccaccctgcagatccggcctgccaccaagacccagtgcacagagttcttcctggcccctgtgaagacagaggtgcccctggccgagaaccagaggagcggccctgactgtgccggcagcctgaaggaggagaccggccccagctaccagagggccccccagatgccagacagccagaggggccgggtggccgaggagctgatcctgcgggagaaggtggaggccgtgcagcccggccctgtggtggagctgcagctgagcctgagccaggagcggcacaagggggccagcggccccctggtggccctgcctggagctgagaagagcaagagcccagaccctgaccccaacctgagccatgaccgcatcgtgcacatcaacagcatccccaccaatgagaaggctgaccccttcctgcggagcagcaagatcatccagatcagcagcggccgggagctgcgggtcatccaggagagcgaggccggagatgctggcctgccccgggtggaggtgatcctggactgcagcgaccggcagaagacagagggctgccgcctgcaggccggcaaggaatgtgtggacagccctgtggagggcggccagagcgaggccccacccagcctggtgtcctttgctgtgagcagcgagggcacagagcagggcgaggaccccaggtctgagaaggaccacagccggccccacaagcaccgggcccggcatgcccggctgcggcgctctgagagcctgtctgagaagcaggtgaaggaggccaagagcaagtgcaagagcatcgccctgctgctgacagatgcccccaaccccaacagcaagggcgtgctgatgttcaagaagagaagaagaagagccaggaagtacaccctggtgtcctatggcaccggggagctggagcgggaggctgatgaggaggaggagggggacaaggaggacacctgtgaggtggccttcctgggcgccagcgagagcgaggtggatgaggagctgctgagtgatgtggatgacaacacccaggtggtgaactttgactgggacagcggcctggtggacatcgagaagaagctgaacagaggagacaagatggagatgctgcctgacaccaccgggaagggggccctgatgtttgccaagaggcgggagaggatggaccagatcacagcccagaaggaggaggacaaggtgggcggcacccccagccgggagcaggatgctgcccagacagatggcctgcggaccaccaccagctaccagaggaaggaggaggagagcgtgaggacccagagctctgtgtccaagagctacatcgaggtgagccacggcctgggccacgtgccccagcagaatggcttcagcggcaccagcgagacagccaacatccagaggatggtgcccatgaacagaacagccaagcccttccctggctctgtgaaccagcctgccacccccttcagccccaccaggaacatgaccagccccatcgctgacttccctgcccccccaccctacagcgctgtgaccccacctccagatgccttcagcagaggagtgagcagccccatcgccggccctgcccagcccccaccctggccccagcctgccccctggagccagcctgccttctatgacagcagcgagagaattgccagcagagatgagcgcatctctgtgcctgccaagaggacaggcatcctgcaggaggccaagagaagaagcaccaccaagcccatgttcaccttcaaggagcccaaggtgagccccaaccctgagctgctgagcctgctgcagaacagcgagggcaagaggggcactggagctggaggagacagcggccctgaggaggactacctgagcctgggcgctgaggcctgcaacttcatgcagagcagcagcgccaagcagaagaccccacctcctgtggcccccaagccagctgtgaagagcagcagcagccagcctgtgacccctgtgtcccctgtgtggagccctggggtggcccccacccagcccccagccttccccaccagcaaccccagcaaaggaacagtggtgagcagcatcaagatcgcccagcccagctaccccccagcccggcctgccagcaccctgaatgtggccggccccttcaagggcccccaggccgctgtggccagccagaactacacccccaagcccaccgtgtccacccccaccgtgaatgctgtgcagcccggggctgtgggccccagcaatgagctgcccggcatgagcggccgcggggcccagctgtttgccaagaggcagagcaggatggagaagtatgtggtggacagcgacacagtgcaggcccatgctgcccgggcccagagccccacccccagcctgcctgcctcctggaagtacagcagcaatgtgcgggcccctcctcctgtggcctacaaccccatccacagccccagctaccccctggccgccctgaagagccagcccagcgctgcccagcccagcaagatgggcaagaagaagggcaagaagcccctgaatgccctggatgtgatgaagcaccagccctaccagctgaatgccagcctcttcaccttccagcccccagatgccaaggatggcctgccccagaagagctctgtgaaggtgaacagcgccctggccatgaagcaggccctgccccccaggcctgtgaatgctgccagccccaccaacgtgcaggccagctctgtgtacagcgtgcctgcctacaccagccccccatccttctttgctgaggccagcagccctgtgtctgccagccctgtgcctgtgggcatccccaccagccccaagcaggagagcgccagcagcagctactttgtggccccccggcccaagttcagcgccaagaagtctggagtgaccatccaggtgaagtgcaagagcggcatccacagccaggacatcatccgcacctacttccctgcctacctgagcagcagcacctag

SEQ ID NO: 21233 - DNA, 1554 bp, Artificial Sequence; identical to SEQ ID NO: 18881
  Description of Artificial Sequence: Synthetic coding sequence

SEQ ID NO: 21234 - DNA, 348 bp, Artificial Sequence; identical to SEQ ID NO: 20824
  Description of Artificial Sequence: Synthetic coding sequence

SEQ ID NO: 21235 - DNA, 1014 bp, Artificial Sequence
  Description of Artificial Sequence: Synthetic coding sequence
atggagctgaagaccctgtgggagaacaagctgatgcagagcagagctgtggatggcttccacagcgaggagcagcagctgctgctgcaggtgcagcagcagcaccagccccagcagcagcagcaccaccaccaccaccaccaccagcaggcccagccccagcagacagtgccccagcaggcccagacccagcaggtgctgatcccagccagccagcaggccacagccccccaggtgattgtgcctgacagcaagctgatccagcacatgaatgccagcaacatgtctgctgctgccacagctgccaccctggccctgcctgctggggtgacccctgtgcagcagatcctgaccaacagcggccagctgctgcaggtggtgcgggccgccaatggagcccagtacatcttccagccccagcagagcgtggtgctgcagcagcaggtgatcccccagatgcagcctggaggagtgcaggcccctgtgatccagcaggtgctggcccccctgcccggcggcatcagcccccagacaggagtcatcatccagccccagcagatcctcttcaccggcaacaagacccaggtgatccccaccaccgtggccgcccccaccccagcccaggcccagatcacagccaccggccagcagcagccccaggcccagcctgcccagacccaggcccccctggtgctgcaggtggatggcactggagacaccagcagcgaggaggatgaagatgaggaggaggactatgatgatgatgaggaggaggacaaggagaaggatggagcagaagatggccaggtggaggaggagcccctgaacagtgaagatgatgtgtctgatgaggagggccaggagctgtttgacacagaaaatgtggtggtgtgccagtatgacaagatccacaggagcaagaacaagtggaagttccacctgaaggatggcatcatgaacctgaatggccgggactacatcttcagcaaggccatcggagatgctgagtggtag

SEQ ID NO: 21236 - DNA, 3012 bp, Artificial Sequence
  Description of Artificial Sequence: Synthetic coding sequence
atgagccagtggaccccagagtacaatgagctgtacaccctgaaggtggacatgaagtctgagatccccagtgatgcccccaagacccaggagagcctgaagggcatcctgctgcaccctgagcccatcggggccgccaagagcttccctgctggggtggagatgatcaacagcaaggtgggcaatgagttcagccacctgtgtgatgacagccagaagcaggagaaggagatgaatggaaaccagcaggagcaggagaagagcctggtggtgaggaagaagaggaagagccagcaggccggccccagctatgtgcagaactgtgtgaaggagaaccagggcatcctgggcctgcggcagcacctgggcacccccagtgatgaggacaatgacagcagcttcagtgactgcctgagcagccccagcagcagcctgcactttggagacagcgacacagtgaccagtgatgaggacaaggaggtgtctgtgcgccacagccagaccatcctgaatgccaagagccgcagccacagcgcccggagccacaagtggcccaggacagaaacagaatctgtgtctggcctgctgatgaagaggccctgcctgcacggcagcagcctgcggcggctgccctgcaggaagagatttgtgaagaacaacagcagccagaggacccagaagcagaaggagcgcatcctgatgcagaggaagaagcgggaggtgctggcccggaggaaatatgccctgctgcccagcagcagcagcagcagtgaaaatgacctgagcagcgagagcagcagcagcagcagcacagaaggagaggaggacctgtttgtgtctgccagcgagaaccaccagaacaacccagctgtgcccagcggcagcattgatgaagatgtggtggtgattgaggccagcagcaccccccaggtgacagccaatgaggagatcaacgtgaccagcacagacagcgaggtggagatcgtgacagtgggggagagctaccgcagccgcagcaccctgggccacagccgcagccactggagccagggcagcagcagccacgccagccggccccaggagcccaggaacagaagccgcatcagcaccgtcatccagcccctgcggcagaatgctgctgaggtggtggacctgactgtggatgaagatgagcccaccgtggtgcccaccaccagcgccaggatggagagccaggccaccagcgccagcatcaacaacagcaaccccagcaccagcgagcaggccagtgacacagccagcgctgtgaccagcagccagcccagcacagtgtctgagaccagcgccaccctgaccagcaacagcaccaccggcaccagcattggagatgacagcaggaggaccaccagcagcgctgtgacagaaacaggccccccagccatgccccggctgcccagctgctgcccccagcacagcccctgtggcggcagcagccagaaccaccacgccctgggccacccccacaccagctgcttccagcagcacggccaccacttccagcaccaccaccaccaccaccacaccccccaccctgctgtgcctgtgagccccagcttcagtgaccctgcctgccctgtggagcggcccccccaggtgcaggccccctgtggggccaacagcagcagcggcaccagctaccacgagcagcaggccctgcctgtggacctgagcaacagcggcatccgcagccacggcagcggcagcttccatggagccagcgcctttgacccctgctgccctgtgagcagcagcagagctgccatcttcggccaccaggccgctgctgctgcccccagccagcccctgagcagcattgatggctacggcagctccatggtggcccagccccagccccagcccccaccccagcccagcctgagcagctgccgccactacatgcccccaccctatgccagcctgacccggcccctgcaccaccaggccagcgcctgcccccacagccacggcaaccccccaccccagacccagcccccaccccaggtggactatgtgatcccccaccctgtgcacgccttccacagccagatcagcagccacgccaccagccaccctgtggcccctcctccacccacccacctggccagcacagctgcccccatcccccagcacctgccccccacccaccagcccatcagccaccacatcccagccacagcccccccagcccagaggctgcacccccatgaggtgatgcagaggatggaggtgcagaggaggaggatgatgcagcaccccaccggcctgtttgtgttctgtgtgtccagaagagcccacgagcggcccccaccccacccccacaggatgcaccccaactacggccacggccaccacatccacgtgccccagaccatgagcagccacccccggcaggcccctgagaggtctgcctgggagctgggcattgaagctggggtgacagctgccacctacacccctggggccctgcacccccacctggcccactaccacgccccaccccggctgcaccacctgcagctgggcgccctgcccctgatggtgcctgacatggccggctacccccacatccgctacatcagcagcggcctggatggcaccagcttccggggccccttccggggcaactttgaggagctgatccacctggaggagcggctgggcaatgtgaacagaggagccagccagggcaccatcgagcgctgcacctacccccacaagtacaagaaggtgaccacagactggttcagccagaggaagctgcactgcaagcaggatggagaggagggcacagaggaggacacagaggagaagtgcaccatctgcctgagcatcctggaggagggggaggatgtgcggcggctgccctgcatgcacctgttccaccaggtgtgtgtggaccagtggctgatcaccaacaagaagtgccccatctgccgggtggacatcgaggcccagctgcccagcgagagctag

SEQ ID NO: 21237 - DNA, 3309 bp, Artificial Sequence
  Description of Artificial Sequence: Synthetic coding sequence
atggccgagaaggaggcccggaggaagttcaagcagatcgtgacagctgtgtacttctgccactgcagaaatattgtgcaccgggacctgaaggccgagaacctgctgctggatgccaacctgaacatcaagattgctgactttggcttcagcaacctcttcaccccaggccagctgctgaagacctggtgtggcagccccccctatgctgcccctgagctgtttgagggcaaggagtatgatggccccaaggtggacatctggagcctgggcgtggtgctgtatgtgctggtgtgtggggccctgccctttgatggcagcaccctgcagaacctgcgggcccgggtgctgagcggcaagttccgcatccccttcttcatgagcacagaatgtgagcacctgatccgccacatgctggtgctggaccccaacaagaggctgtccatggagcagatctgcaagcacaagtggatgaagctgggagatgctgaccccaactttgaccggctgattgctgagtgccagcagctgaaggaggagcggcaggtggaccccctgaatgaagatgtgctgctggccatggaggacatgggcctggacaaggagcagaccctgcagagcctgcggagtgatgcctatgaccactacagcgccatctacagcctgctgtgtgacagacacaagaggcacaagaccctgcggctgggcgccctgcccagcatgccccgggccctggccttccaggcccctgtgaacatccaggccgagcaggccggcacagccatgaacatctctgtgccccaggtgcagctgatcaaccctgagaaccagatcgtggagccagatggcaccctgaacctggacagtgatgaaggagaggagcccagccctgaggccctggtgcgctacctgtccatgagaagacacacagtgggcgtggccgaccccaggacagaggtgatggaggacctgcagaagctgctgcccggcttccctggggtgaacccccaggcccccttcctgcaggtggcccccaacgtgaacttcatgcacaacctgctgcccatgcagaacctgcagcccaccggccagctggagtacaaggagcagagcctgctgcagccccccaccctgcagctgctgaatggcatgggccccctgggcagaagagccagtgatggaggagccaacatccagctgcacgcccagcagctgctgaagaggccccggggccccagccccctggtgaccatgaccccagctgtgcctgctgtgacccctgtggatgaggagagcagtgatggagagccagaccaggaggccgtgcagagcagcacctacaaggacagcaacaccctgcacctgcccacagagcgcttcagccctgtgcggcgcttcagtgatggagctgccagcatccaggccttcaaggcccacctggagaagatgggcaacaacagcagcatcaagcagctgcagcaggagtgtgagcagctgcagaagatgtatggaggccagattgatgagaggaccctggagaagacccagcagcagcacatgctgtaccagcaggagcagcaccaccagatcctgcagcagcagatccaggacagcatctgccccccccagcccagcccccccctgcaggccgcctgtgagaaccagcctgccctgctgacccaccagctgcagaggctgcgcatccagcccagcagccccccacccaaccaccccaacaaccacctgttccggcagcccagcaacagccccccacccatgagcagcgccatgatccagccccatggagctgccagcagcagccagttccagggcctgcccagccgcagcgccatcttccagcagcagcctgagaactgcagcagccccccaaatgtggccctgacctgcctgggcatgcagcagcctgcccagagccagcaggtgaccatccaggtgcaggagcctgtggacatgctgagcaacatgcctggaacagctgctggcagcagcggccggggcatcagcatcagccccagcgctggccagatgcagatgcagcacaggaccaacctgatggccaccctgtcctatggccaccggcccctgagcaagcagctgtctgctgacagcgctgaggcccacagcgcccaccagcagcccccccactacaccaccagcgccctgcagcaggccctgctgagccccaccccaccagactacaccaggcaccagcaggtgccccacatcctgcagggcctgctgagccccaggcacagcctgaccggccacagcgacatccggctgcccccaacagaatttgcccagctgatcaagaggcagcagcagcagaggcagcagcagcagcagcagcagcagcagcaggagtaccaggagctgttccgccacatgaaccagggagatgctggcagcctggcccccagcctgggcggccagagcatgacagagcggcaggccctgagctaccagaatgctgacagctaccaccaccacaccagcccccagcacctgctgcagatccgggcccaggagtgtgtgtcccaggccagcagccccaccccaccccacggctacgcccaccagcctgccctgatgcacagcgagagcatggaggaggactgcagctgtgagggcgccaaggatggcttccaggacagcaagagcagcagcaccctgaccaagggctgccacgacagccccctgctgctgagcactggaggccctggggaccctgagagcctgctgggcaccgtgagccacgcccaggagctgggcatccacccctacggccaccagcccacagctgccttcagcaagaacaaggtgcccagccgggagcctgtgattggcaactgcatggacaggagcagccctggccaggccgtggagctgcctgaccacaacggcctgggctacccagcccggcccagcgtgcatgagcaccaccggccccgggccctgcagaggcaccacaccatccagaacagtgatgatgcctacgtgcagctggacaacctgcccggcatgagcctggtggccggcaaggccctgagcagcgccaggatgtctgatgctgtgctgagccagagcagcctgatgggcagccagcagttccaggatggagaaaatgaagaatgtggggccagcctgggcggccacgagcacccagacctgagtgatggcagccagcacctgaacagcagctgctaccccagcacctgcatcacagacatcctgctgagctacaagcaccctgaggtgtccttctccatggagcaggccggcgtgtag

SEQ ID NO: 21238 - DNA, 1461 bp, Artificial Sequence
  Description of Artificial Sequence: Synthetic coding sequence
atgaccctgatggtgctgaccttcagcagctacatcctggacttcatcaacgtgctgtcctatgacctgcacggctcctgggagcgcttcaccggccacaacagccccctcttcagcctgcctgaggaccccaagagcagcgcctatgccatgaactactggaggaagctgggcgcccccagcgagaagctgatcatgggcatccccacctacggccgcaccttccggctgctgaaggccagcaagaatggcctgcaggcccgggccatcggccctgccagccctgggaagtacaccaagcaggagggcttcctggcctactttgagatctgcagctttgtgtggggcgccaagaagcactggattgactaccagtatgtgccctatgccaacaagggcaaggagtgggtgggctatgacaatgccatctccttctcctacaaggcctggttcatcagaagagagcactttggaggagccatggtgtggaccctggacatggatgatgtgcggggcaccttctgtggcaccggccccttccccctggtgtatgtgctgaatgacatcctggtgcgggcagagttcagcagcaccagcctgccccagttctggctgagcagcgctgtgaacagcagcagcacagatcctgagcggctggccgtgaccacagcctggaccacagacagcaagatcctgcccccaggaggagaggccggcgtgacagagatccacggcaaatgtgagaacatgaccatcaccccccggggcaccaccgtgacccccaccaaggagaccgtgtccctgggcaagcacacagtggccctgggggagaagacagagatcaccggggccatgaccatgacctctgtgggccaccagagcatgaccccaggagagaaggccctgacccctgtgggccaccagagcgtgaccaccggccagaagaccctgacctctgtgggctaccagagcgtgaccccaggagagaagaccctgacccctgtgggccaccagagcgtgacccctgtgagccaccagagcgtgtcccctgggggcaccaccatgacccctgtgcacttccagacagagaccctgcggcagaacacagtggcccccaggaggaaggctgtggcccgggagaaggtgacagtgcccagcaggaacatctctgtgaccccagagggccagaccatgcccctgcggggggagaacctgaccagcgaggtgggcacccaccccaggatgggcaacctgggcctgcagatggaggctgaaaataggatgatgctgagcagcagccctgtgatccagctgcctgagcagacccccctggcctttgacaacagatttgtgcccatctacggcaaccacagctctgtgaacagcgtgaccccccagaccagccccctgagcctgaagaaggagatccctgagaacagcgctgtggatgaggaggcctag

SEQ ID NO: 21239 - DNA, 1017 bp, Artificial Sequence
  Description of Artificial Sequence: Synthetic coding sequence
atggagctgtggggccgcatgctgtgggccctgctgagcggccctggaagaagaggcagcacccggggctgggccttcagctcctggcagccccagccccccctggccggcctgagcagcgccatcgagctggtgagccactggacaggagtgtttgagaagaggggcatccctgaggcccgggagagcagcgagtacatcgtggcccacgtgctgggcgccaagaccttccagagcctgcggcctgccctgtggacccagcccctgaccagccagcagctgcagtgcatccgggagctgagcagccggcggctgcagaggatgcctgtgcagtacatcctgggggagtgggacttccagggcctgagcctgaggatggtgccccctgtgttcatccccaggcctgagacagaggagctggtggagtgggtgctggaggaggtggcccagaggagccatgctgtgggcagccctggcagccccctcatcctggaggtgggctgcggcagcggggccatcagcctgagcctgctgagccagctgccccagagccgggtgattgctgtggacaagcgggaggccgccatcagcctgacccatgaaaatgcccagaggctgcggctgcaggaccgcatctggatcatccacctggacatgaccagcgagaggtcctggacccacctgccctggggccccatggacctgattgtgagcaaccccccctacgtgttccaccaggacatggagcagctggcccctgagatccgctcctatgaagatcctgctgccctggatggaggagaggagggcatggacatcatcacccacatcctggccctggccccccggctgctgaaggacagcggcagcatcttcctggaggtggaccccaggcaccctgagctggtgtcctcctggctgcagagcaggccagacctgtacctgaacctggtggccgtgagaagagacttctgtggccggccccgcttcctgcacatccgccgcagcggcccctag

SEQ ID NO: 21240 - DNA, 1899 bp, Artificial Sequence; identical to SEQ ID NO: 18887
  Description of Artificial Sequence: Synthetic coding sequence

SEQ ID NO: 21241 - DNA, 1791 bp, Artificial Sequence
  Description of Artificial Sequence: Synthetic coding sequence
atgagcaaccagcaggagaagtatgaggcccagaacatcgtgaacagcacagaggagagtgatgatgcctttgacacagtgaccatccctgtgcccagcgaggagccccaggagagtgaccagacagaggagcatgaaagtggcatcgagcagttcagcgagagccacgccatccacgtggaggagcagagcgaccagagcttcagcagcctggagccagacaatgagcagctgatggaggaggtgatcagcccccggcaggtgtcctacaccccccagcaccacgagaagcagtatgccatgcagaggcccaatgatgacagcctggccttcctggacaagatcaagtctgtgaaggagagcctgcaggagagcgtggaggacagcctggccaccgtgaaggtggtgctgatccctgtgggccaggagatcgtcatccccttcaaggtggacaccatcctgaagtacctgaaggaccacttcagccacctgctgggcatcccccacagcgtgctgcagatccgctacagcggcaagatcctgaagaacaatgagaccctggtgcagcacggcgtgaagccccaggagatcgtgcaggtggagatcttcagcaccaacccagacctgtaccctgtgagaagaattgatggcctgacagatgtgtcccagatcatcaccgtgacagtgcagacaggcctggaccagtaccagcaggtgcctgtggagatcgtgaagagtgacttccacaagcccttcctgggcggcttccgccacaaggtgactggagtggagtaccacaatgccggcacccagacagtgcccaagagaattcctgagcggctgagcatcttctgccgggacacccagaccgtcttccagaagaagaacctgcagcagaccaccaacaccaccagcacccagatgaccaacattggagtgtatgtgagcaacatgacagacaagctggtgaccccaggcaagtacttctctgctgctgagtaccacgcccagaggctgaaggctgtgattgtcatccagacctactaccggcagtggcacgccaagatctttgtggagaacctgcggcggcagaagagcctgcggctggagtgggagacccagcaggagctgaggaagatccgggagaaggaggagtggatcaagctggactaccacagaagacacaaccccaagaccaatgaagattttgagttcctgtacaatgccctggagttctggaggcaggaggagctgacccgcatcaaccagagcttcaccggggctgagaggaaggccgccctgtgtgagctgctggagaaggagacccagatcatcgccagcatcggccgccaccgctacatcgcctacatggccaaccaggaggccgccatccaggccttcctggacaagtgcagcgcccccaagatctggaggaccccaaatggcaagaccatcgagatggacacccagttcaccatccgggcccgggagctgcagaacatctacaagtgcatcatgctgaagaacatcagccaggatgagcggctggatgtgctgctgaccctgaagcacacagtgaaggagcacgagtgcaagctgacccaggagatcctggagctgattgaccgggaggtggacctgatgatgagaggagtgaagcaccacaacctggagggcctgaggaagagaattgccaccctcttcttccactacatcaagacccccctcttcaaccctgaggtggccaagtacctgaagatgggcggggagtacctgtccatggccctgtag

SEQ ID NO: 21242 - DNA, 1305 bp, Artificial Sequence
  Description of Artificial Sequence: Synthetic coding sequence
atggtgcaggacggcaccttcaagacccgggacagcacctggacctgtgagagcaccaggatggctgctgcccctccttcctactgctttgtggccttccccccccgggccaaggatggcctggtggtgtttgggaagaacagcgcccggcccagagatgaggtgcaggaggtggtgtacttctctgctgctgaccacgagcctgagagcaaggtggagtgcacctacatcagcattgaccaggtgcccaggacctacgccatcatgatcagcaggcctgcctggctgtggggcgctgagatgggcgccaatgagcacggcgtgtgcatcgccaatgaggccatcaacacccgggagcctgctgctgagattgaggccctgctgggcatggacctggtgcggctgggcctggagcggggggagacagccaaggaggccctggatgtgattgtgtccctgctggaggagcacggccagggcggcaactactttgaagatgccaacagctgccacagcttccagagcgcctacctgattgtggacagagatgaggcctgggtgctggagaccatcggcaagtactgggccgctgagaaggtgacagaaggagtgcgctgcatctgcagccagctgagcctgaccaccaagatggatgctgagcaccctgagctgcggagctatgcccagagccagggctggtggacaggagagggggagttcaacttcagcgaggtgttcagccctgtggaggaccacctggactgtggggccggcaaggacagcctggagaagcaggaggagagcatcaccgtgcagaccatgatgaacaccctgcgggacaaggccagcggcgtgtgcattgattctgagttcttcctgaccacagccagcggcgtgtctgtgctgccccagaacagaagcagcccctgcatccactacttcaccggcaccccagaccccagccgcagcatcttcaagcccttcatctttgtggatgatgtgaagctggtgcccaagacccagagcccctgctttggagatgatgatcctgccaagaaggagccccgcttccaggagaagccagacagaagacatgagctgtacaaggcccacgagtgggcccgggccatcatcgagagtgaccaggagcagggcaggaagctgcggagcaccatgctggagctggagaagcagggcctggaggccatggaggagatcctgaccagcagcgagcccctggaccctgctgaggtgggggacctcttctatgactgtgtggacacagagatcaagttcttcaagtag

SEQ ID NO: 21243 - DNA, 1320 bp, Artificial Sequence
  Description of Artificial Sequence: Synthetic coding sequence
atggcctggccctgcatcacccgggcctgctgcatcgcccgcttctggaaccagctggacaaggctgacattgctgtgcccctggtgttcaccaagtacagcgaggccacagagcaccctggggccccaccccagcccccaccaccccagcagcaggcccagcctgccctggcccctccttctgcccgggctgtggccatcgagacccagcctgcccagggcgagctggatgctgtggcccgggccactggacctgcccctggccccaccggggagcgggagcctgctgctggccctggccgcagcggccctggccctggcctgggcagcggcagcaccagcggccctgctgacagcgtgatgaggcaggactaccgggcctggaaggtgcagaggcctgagcccagctgccggcccaggtctgagtaccagcccagtgatgccccctttgagcgggagacccagtaccagaaggacttccgggcctggcccctgcccaggagaggagaccacccctggatccccaagcctgtgcagatctctgctgccagccaggccagcgcccccatcctgggcgcccccaagaggcggccccagagccaggagcgctggcctgtgcaggccgctgctgaggcccgggagcaggaggccgcccctggaggagctgggggcctggccgccggcaaggccagcggggctgatgagcgggacaccaggaggaaggccggccctgcctggatcgtgagaagagctgagggcctgggccacgagcagacccccctgcctgctgcccaggcccaggtgcaggccactggacctgaggccggccggggccgggctgctgctgatgccctgaaccggcagatccgggaggaggtggccagcgctgtgagcagcagctacagaaatgagttccgggcctggacagacatcaagcctgtgaagcccatcaaggccaagccccagtacaagcccccagatgacaagatggtgcatgagaccagctacagcgcccagttcaagggggaggccagcaagcccaccacagctgacaacaaggtgattgacagaagacgcatccgcagcctgtacagcgagcccttcaaggagccccccaaggtggagaagcccagcgtgcagagcagcaagcccaagaagaccagcgccagccacaagcccaccaggaaggccaaggacaagcaggccgtgtctggccaggccgccaagaagaagtctgctgagggccccagcaccaccaagccagatgacaaggagcagagcaaggagatgaacaacaagctggccgaggccaaggagtag

SEQ ID NO: 21244 - DNA, 813 bp, Artificial Sequence
  Description of Artificial Sequence: Synthetic coding sequence
atgggcggctgcttcagcaagcccaagcctgtggagctgaagattgaggtggtgctgcctgagaaggagcggggcaaggaggagctgagcgccagcggcaagggcagcccccgggcctaccagggcaatggaacagcccggcacttccacacagaggagcggctgagcaccccccacccctaccccagcccccaggactgtgtggaggccgctgtgtgccacgtgaaggacctggagaatggccagatgagggaggtggagctgggctggggcaaggtgctgctggtgaaggacaatggagagttccacgccctgggccacaagtgcccccactacggggcccccctggtgaagggcgtgctgagccggggccgggtgcgctgcccctggcatggagcctgcttcaacatcagcactggagacctggaggacttccctggcctggacagcctgcacaagttccaggtgaagattgagaaggagaaggtgtatgtgcgggccagcaagcaggccctgcagctgcagaggaggaccaaggtgatggccaagtgcatcagccccagcgctggctacagcagcagcaccaacgtgctgattgtgggcgctggagctgctggcctggtgtgtgccgagaccctgcggcaggagggcttcagtgaccgcatcgtgctgtgcaccctggacagacacctgccctatgaccggcccaagctgagcaagagcctggacacccagcctgagcagctggccctgcggcccaaggagttcttccgggcctacggcatcgaggtgctgacagaggcccaggtgtag

SEQ ID NO: 21245 - DNA, 369 bp, Artificial Sequence; identical to SEQ ID NO: 21112
  Description of Artificial Sequence: Synthetic coding sequence

SEQ ID NO: 21246 - DNA, 1269 bp, Artificial Sequence
  Description of Artificial Sequence: Synthetic coding sequence
atgacccccagcatccccagcatccggcggctgggcagcggctacttcagcagcaatggcaagctggaggaggtgaagacccccaagaaccctgtgaagaggaaggacctgctgcggcatgaccctgacctgcacatgcaccagggctatgacaagtatgatgtgtctgagttctgcagctacatcaagagcagcagcagcctgggcaatgccaccagtgatgaggaccccaacaccaacatcatgaacatcaatgaaaacaagaacatccccaaggccaagaacaagtctgagagtgaaaatgagcccaaggccggcacagacagccctgtgtcctgtgcctctgtgacagaggagcgggtggccagtgacagccccaagccagccctgaccctgcagcagggccaggagttctctgctgggggccagaatgctgagaacctgtgccagttcttcaagatcagcccagacctgaacatcaagtgtgagaggaaggatgacttcctgggcgctgctgagggcaagctgcagtgcaaccggctgatgcccaacagccagaaggactgccactgcctgggagatgtgctgattgagaacaccaaggagagcaagagccagagcgaggacctgggcaggaagcccatggagagcagctctgtggtgtcctgccgggacaggaaggacagaagaagatccatgtgctacagtgatggccgcagcctgcacctggagaagaatggaaaccacacccccagcagctctgtgggcagctctgtggagatcagcctggagaacagcgagctgttcaaggacctgagtgatgccatcgagcagaccttccagaggagaaattctgagaccaaggtgcggcgcagcacccggctgcagaaggacctggagaatgaaggcctggtgtggatcagcctgcccctgcccagcaccagccagaaggccaagaggaggaccatctgcacctttgacagcagcggctttgagagcatgagccccatcaaggagaccgtgagcagccggcagaagccccagatggcccctcctgtgtctgaccctgagaacagccagggccctgctgctggcagcagtgatgagcccgggaagaggaggaagagcttctgcatcagcaccctggccaacaccaaggccaccagccagttcaagggctacagaagaagaagcagcctgaatggaaaaggagagagcagcctgacagccctggagcgcatcgagcacaatggagagaggaagcagtag

SEQ ID NO: 21247 - DNA, 3336 bp, Artificial Sequence
  Description of Artificial Sequence: Synthetic coding sequence
atggtgcgggagaggaagtgcatcctgtgccacatcgtgtacagcagcaagaaggagatggatgagcacatgaggtccatgctgcaccaccgggagctggagaacctgaagggccgcttcggcatcgagatggtgcccctggtgcagaatgagcaggaggccctggacctggatggagagccagacctgagcagcctggagggcttccagtgggagggcgtgtccatcagcagcagccctggcctggccaggaagaggagcctgtctgagagcagcgtcatcatggaccgggcccccagcgtgtacagcttcttcagcgaggagggcaccgggaaggaaaatgagccccagcagatggtgagccccagcaacagcctgcgggccggccagagccagaaggccaccatgcacctgaagcaggaggtgaccccccgggccgccagcctgaggactggagagcgggcagaaaatgtggccacccagaggaggcacagcgcccagctgagcagtgaccacatcatccccctgatgcacctggccaaggacctgaacagccaggagaggagcatccccccatctgagaaccagaacagccaggagagcaatggagagggcaactgcctgagcagcagcgccagcagcgccctggccatcagcagcctggctgatgctgccacagacagcagctgcaccagcggggctgagcagaatgatggccagagcatcaggaagaagaggcgggccactggagatggcagcagccctgagctgcccagcctggagaggaagaacaagaggaggaagatcaagggcaagaaggagaggagccaggtggaccagctgctgaacatcagcctgcgggaggaggagctgagcaagagcctgcagtgcatggacaacaacctgctgcaggcccgggccgccctgcagacagcctacgtggaggtgcagaggctgctgatgctgaagcagcagatcaccatggagatgtctgccctgcggacccaccgcatccagatcctgcagggcctgcaggagacctatgagcccagcgagcacccagaccaggtgccctgcagcctgacccgggagaggaggaacagccgcagccagaccagcattgatgctgccctgctgcccacccccttcttccccctcttcctggagccccccagcagccacgtgagccccagccccaccggggccagcctgcagatcaccaccagccccaccttccagacccacggctctgtgcctgccccagacagctctgtgcagatcaagcaggagcccatgagccctgagcaggatgaaaatgtgaatgctgtgccccccagcagcgcctgcaatgtgtccaaggagctgctggaggccaaccgggagatcagtgacagctgccctgtgtaccctgtgatcacagcccggctgagcctgcctgagagcacagagagcttccacgagcccagccaggagctgaagttctctgtggagcagaggaacaccaggaaccgggagaacagccccagcagccagagcgctggcctgagcagcatcaacaaggagggggaggagcccaccaagggcaacagcggcagcgaggcctgcaccagcagcttcctgcggctgagctttgccagcgagacccccctggagaaggagccccacagccctgctgaccagcctgagcagcaggccgagagcaccctgaccagcgctgagacccggggcagcaagaagaagaagaagctgaggaagaagaagagcctgcgggccgcccacgtgcctgagaacagcgacacagagcaggatgtgctgactgtgaagcctgtgaggaaggtgaaggccggcaagctgatcaagggcggcaaggtgaccaccagcacctgggaggacagcaggacaggccgggagcaggagagcgtgagagatgagccagacagcgacagcagcctggaggtgctggagatccccaacccccagctggaggtggtggccatcgacagcagcgagagcggggaggagaagccagacagccccagcaagaaggacatctggaacagcacagagcagaaccccctggagaccagccgcagcggctgtgatgaggtgagcagcaccagcgagatcggcacccgctacaaggatggcatccctgtgtctgtggccgagacccagaccgtcatcagcagcatcaagggcagcaagaacagcagcgagatcagcagcgagcctggagatgatgatgagcccacagagggcagctttgagggccaccaggccgctgtgaatgccatccagatcttcggcaacctgctgtacacctgcagcgctgacaagacagtgcgggtgtacaacctggtgtccaggaagtgcatcggcgtgtttgagggccacaccagcaaggtgaactgcctgctggtgacccagaccagcggcaagaatgctgccctgtacacaggcagcagtgaccacaccatccgctgctacaacgtgaagagcagagaatgtgtggagcagctgcagctggaggacagagtgctgtgcctgcacagccgctggaggatcctgtatgccggcctggccaacggcaccgtggtgaccttcaacatcaagaacaacaagaggctggagatctttgagtgccacggccccagggctgtgtcctgcctggccacagcccaggagggcgccaggaagctgctggtggtgggcagctatgactgcaccatctctgtgagagatgccagaaatggcctgctgctgcggaccctggagggccacagcaagaccatcctgtgcatgaaggtggtgaatgacctggtgttttctggcagcagtgaccagagcgtgcacgcccacaacatccacactggagagctggtgcgcatctacaagggccacaaccacgctgtgacagtggtgaacatcctgggcaaggtgatggtgacagcctgcctggacaagtttgtgcgggtgtatgagctgcagagccatgaccggctgcaggtgtatggaggccacaaggacatgatcatgtgcatgaccatccacaagtccatgatctacacaggctgctatgatggcagcatccaggccgtgcggctgaacctgatgcagaactaccgctgctggtggcacggctgcagcctcatcttcggcgtggtggaccacctgaagcagcacctgctgacagaccacaccaaccccaacttccagaccctgaagtgccgctggaagaactgtgatgccttcttcaccgccaggaagggcagcaagcaggatgctgctggccacatcgagagacatgctgaagatgacagcaagattgacagctag

SEQ ID NO: 21248 - DNA, 354 bp, Artificial Sequence
  Description of Artificial Sequence: Synthetic coding sequence
atgtacagccccatcatctaccaggccctgtgtgaacatgtgcagacccagatgagcctgatgaatgacctgaccagcaagaacatccccaacggcatcccagctgtgccctgccacgcccccagccacagcgagagccaggccaccccccacagcagctatggcctgtgcaccagcacccctgtgtggagcctgcagaggcctccctgcccccccaaggtgcacagcgaggtgcagacagatggcaacagccagtttgccagccagggcaagacagtgtctgccacctgcacagatgtgctgaggaacagcttcaacaccagccctggggtgccctgcagcctgcccaagtag

SEQ ID NO: 21249 - DNA, 189 bp, Artificial Sequence
  Description of Artificial Sequence: Synthetic coding sequence
atggccgccctgcggcccctggtgaagcccaagatcgtgaagaagaggaccaagaagttcatccgccaccagagcgaccgctacgtgaagatcaagaggaactggaggaagccccggggcatcgacaacagagtgagaagacgcttcaagggccagatcctgatgcccaacatcggctacggcagctag

SEQ ID NO: 21250 - DNA, 411 bp, Artificial Sequence
  Description of Artificial Sequence: Synthetic coding sequence
atgtctgccagctgtgatggctgtgtgggcagcaggcctcctgtgcacctggccagcggctacagcctggccgacctgctggtgctggagatgggcatgggcacccagtgctggacagaggaccagaggcgctggagcagcctgtggccctggagccacctgagctctgtgctgctggccgacaaggagggcggccccccagctgtggatgaggtgctggatgaggccgtgcctgagtaccgggcccctggcaggaagagcctgctggagatccggcagctggaccctgatgacaggagcctggccaagtacaagagggtgctgctgggccccctgcccccagctgtggaccccagcctgcccaacgtgcaggtgacccggctgaccctgctgtctgagcaggccccctag

SEQ ID NO: 21251 - DNA, 1803 bp, Artificial Sequence
  Description of Artificial Sequence: Synthetic coding sequence
atgcctgagatccgggtgacccccctgggcgccggccaggatgtgggccgcagctgcatcctggtgtccattgctgggaagaatgtgatgctggactgtggcatgcacatgggcttcaatgatgaccggcgcttcccagacttctcctacatcacccagaatggccgcctgacagacttcctggactgtgtgatcatcagccacttccacctggaccactgtggggccctgccctacttcagcgagatggtgggctatgatggccccatctacatgacccaccccacccaggccatctgccccatcctgctggaggactacaggaagattgctgtggacaagaagggggaggccaacttcttcaccagccagatgatcaaggactgcatgaagaaggtggtggccgtgcacctgcaccagacagtgcaggtggatgatgagctggagatcaaggcctactatgccggccacgtgctgggcgccgccatgttccagatcaaggtgggcagcgagagcgtggtgtacaccggggactacaacatgaccccagacagacacctgggcgccgcctggattgacaagtgccggcccaacctgctgatcacagagagcacctacgccaccaccatccgggacagcaagcgctgccgggagcgggacttcctgaagaaggtgcatgagaccgtggagcggggcggcaaggtgctgatccctgtgtttgccctgggccgggcccaggagctgtgcatcctgctggagaccttctgggagaggatgaacctgaaggtgcccatctacttcagcacaggcctgacagagaaggccaaccactactacaagctgttcatcccctggaccaaccagaagatcaggaagacctttgtgcagaggaacatgtttgagttcaagcacatcaaggcctttgaccgggcctttgctgacaaccctggccccatggtggtgtttgccaccccaggcatgctgcacgccggccagagcctgcagatcttcaggaagtgggccggaaatgagaagaacatggtgatcatgcctggctactgtgtgcagggcaccgtgggccacaagatcctgagcggccagaggaagctggagatggagggccggcaggtgctggaggtgaagatgcaggtggagtacatgtccttcagcgcccatgctgatgccaagggcatcatgcagctggtgggccaggccgagcctgagagcgtgctgctggtgcacggggaggccaagaagatggagttcctgaagcagaagattgagcaggagctgcgggtgaactgctacatgcctgccaacggggagaccgtgaccctgcccaccagccccagcatccctgtgggcatcagcctgggcctgctgaagcgggagatggcccagggcctgctgcctgaggccaagaagccccggctgctgcacggcaccctcatcatgaaggacagcaacttccggctggtgtcctctgagcaggccctgaaggagctgggcctggccgagcaccagctgcgcttcacctgccgggtgcacctgcatgacaccaggaaggagcaggagacagccctgcgggtgtacagccacctgaagtctgtgctgaaggaccactgtgtgcagcacctgcctgatggctctgtgacagtggagagcgtgctgctgcaggccgccgcccccagtgaagatcctggcaccaaggtgctgctggtgtcctggacctaccaggatgaggagctgggcagcttcctgaccagcctgctgaagaagggcctgccccaggcccccagctag

SEQ ID NO: 21252 - DNA, 774 bp, Artificial Sequence
  Description of Artificial Sequence: Synthetic coding sequence
atgctggagtatgccctgaagcaggagcgggccaagtaccacaagctgaagtttggaacagacctgaaccagggcgagaagaaggcagatgtgtctgagcaggtgtccaatggacctgtggagagcgtgaccctggagaacagccccctggtgtggaaggagggccggcagctgctgcggcagtacctggaggaggtgggctacacagacaccatcctggacatgaggagcaagagggtgcgcagcctgctgggccgcagcctggagctgaatggagctgtggagcccagcgagggcgccccccgggcccctcctggccctgctggcctgtctggaggagagagcctgctggtgaagcagatcgaggagcagatcaagagaaatgctgctgggaaggatggcaaggagcggctgggcggctctgtgctgggccagatccccttcctgcagaactgtgaagatgaagattctgatgaagatgatgagctggacagcgtgcagcacaagaagcagagggtgaagctgcccagcaaggccctggtgcctgagatggaggatgaagatgaggaggatgattctgaagatgccatcaatgaatttgacttcctgggcagcggagaagatggagagggcgccccagacccccggcgctgcaccgtggatggcagcccccatgagctgggccctgagctgcacagccccacagagtggcagggcgccctgtctgtgggcaaggccagccccatgccagactgggtgggcacagctggatag

SEQ ID NO: 21253 - DNA, 381 bp, Artificial Sequence
  Description of Artificial Sequence: Synthetic coding sequence
atgcctggggtgaagctgaccacccaggcctactgcaagatggtgctgcatggagccaagtacccccactgtgctgtgaatggcctgctggtggccgagaagcagaagcccaggaaggagcacctgcccctgggcggccctggggcccaccacaccctgtttgtggactgcatccccctcttccacggcaccctggccctggcccccatgctggaggtggccctgaccctgattgacagctggtgcaaggaccacagctatgtgattgctggctactaccaggccaatgaaagagtgaaggatgccagccccaaccaggtggccgagaaggtggccagcagaattgctgagggcttcagtgacacagccctgatcatgtag

SEQ ID NO: 21254 - DNA, 450 bp, Artificial Sequence
  Description of Artificial Sequence: Synthetic coding sequence
gtgcgggagctggaggccgagctggatgctgagcagaagaagcacgccgaggccctgaagggcgtgaggaagcatgaaagaagagtgaaggagctggcctaccaggtgggggacagagtgtccctgggcagcggccctggggccggccctgcccaggccagccctgagagccccctgcctgcccaggccgaggaggacaggaagaacctggccaggatgcaggacctggtggacaagctgcagagcaaggtgaagagctacaagaggcagtttgaggaggccgagcagcaggccaacaccaacctggccaagtacaggaaggcccagcacgagctggatgatgctgaggagagagctgacatggccgagacccaggccaacaagctgcgggcccggaccagagatgccctgggccccaagctgagcctgagcccccagcacaaggagtag

SEQ ID NO: 21255 - DNA, 2349 bp, Artificial Sequence; identical to SEQ ID NO: 18602
  Description of Artificial Sequence: Synthetic coding sequence

SEQ ID NO: 21256 - DNA, 495 bp, Artificial Sequence
  Description of Artificial Sequence: Synthetic coding sequence
atgatgtctgaggtggaggaggccatgcagtgtgtggaggagctgaatgcccagggcctgctgcacgtgtttgtgcgggtgggcgtggagagcaccctggagaggagccagatcacccgggaccacatgggccagctgctgtaccagctggtgcagagcgagaagctgagcaagcaggacttcttcaagggcttcagcgagaccctggagctggctgatgacatggccatcgacatcccccacatctggctgtacctggccgagctggtgacccccatgctgaaggagggcggcatctccatgagggagctgaccatcgagttcagcaagcccctgctgcctgtgggccgggccggcgtgctgctgtctgagatcctgcacctgctgtgcaagcagatgagccacaagaaggtgggcgccctgtggagggaggccgacctgtcctggaaggacttcctgcctgaaggagaagatgtgcacaacttcctgctgtag

SEQ ID NO: 21257 - DNA, 369 bp, Artificial Sequence; identical to SEQ ID NO: 21112
  Description of Artificial Sequence: Synthetic coding sequence

SEQ ID NO: 21258 - DNA, 3345 bp, Artificial Sequence
  Description of Artificial Sequence: Synthetic coding sequence
atggcctgcagaagacgctactttgtggagggggaggcccccagcagcgagaccggcaccagcctggacagccccagcgcctacccccagggccccctggtgcccggcagcagcctgagcccagaccactatgagcacacctctgtgggcgcctacggcctgtacagcggccccccaggccagcagcagaggacccggcggcccaagctgcagcacagcaccagcatcctgaggaagcaggccgaggaggaggccatcaagaggagccgcagcctgtctgagagctatgagctgagcagtgacctgcaggacaagcaggtggagatgctggagaggaaatatggaggccgcctggtgaccaggcatgctgcccggaccatccagacagccttccggcagtaccagatgaacaagaactttgagcggctgcggagctccatgtctgaaaataggatgagccgccgcatcgtgctgagcaacatgaggatgcagttctcctttgagggccctgagaaggtgcacagcagctactttgagggcaagcaggtgtctgtgaccaatgatggcagccagctgggcgccctggtgtccccagaatgtggggacctgtctgagcccaccaccctgaagagccctgcccccagcagtgactttgctgatgccatcacagagctggaggatgccttcagccggcaggtgaagagcctggccgagagcattgatgatgccctgaactgccgcagcctgcacacagaggaggccccagccctggatgctgcccgggcccgggacacagagccccagacagccctgcacggcatggaccacaggaagctggatgagatgacagccagctacagtgatgtgaccctgtacattgatgaggaggagctgagcccccccctgcccctgagccaggccggggaccggcccagcagcacagaaagtgacctgcggctgcgggccggcggggccgccccagactactgggccctggcccacaaggaggacaaggctgacacagacaccagctgccgcagcacccccagcctggagcggcaggagcagaggctgcgggtggagcacctgcccctgctgaccatcgagccccccagcgacagctctgtggacctgagtgacagaagtgagcggggcagcctgaagaggcagagcgcctatgaaagaagcctgggcggccagcagggcagccccaagcacggcccccacagcggggcccccaagagcctgccccgggaggagcctgagctgcggcccaggcctccccggcccctggacagccacctggccatcaatggcagcgccaaccggcagagcaagtctgagagtgactacagtgatggagacaatgacagcatcaacagcaccagcaacagcaatgacaccatcaactgcagcagcgagagcagcagccgggacagcctgcgggagcagaccctgagcaagcagacctaccacaaggaggccaggaacagctgggacagccctgccttcagcaatgatgtgatcaggaagaggcactaccgcatcggcctgaacctcttcaacaagaagccagagaagggcgtgcagtacctgattgagcggggctttgtgcctgacacccctgtgggcgtggcccacttcctgctgcagaggaagggcctgagccggcagatgattggagagttcctgggcaaccggcagaagcagttcaacagagatgtgctggactgtgtggtggatgagatggacttcagcaccatggagctggatgaggccctgaggaagttccaggcccacatccgggtgcagggcgaggcccagaaggtggagcggctcatcgaggccttcagccagcgctactgcatctgcaaccctggggtggtgcggcagttcagaaatccagacaccatcttcatcctggcctttgccatcatcctgctgaacacagacatgtacagccccaacgtgaagccagagaggaagatgaagctggaggacttcatcaagaacctgcggggcgtggatgatggagaggacatcccccgggagatgctgatgggcatctatgaaagaatcaggaagcgggagctgaagaccaatgaagaccacgtgtcccaggtgcagaaggtggagaagctgattgtgggcaagaagcccatcggcagcctgcaccctggcctgggctgtgtgctgagcctgccccaccggcggctggtgtgctactgccgcctgtttgaggtgcctgaccccaacaagccccagaagctgggcctgcaccagcgggagatcttcctgttcaatgacctgctggtggtgaccaagatcttccagaagaagaagaacagcgtgacctacagcttccggcagagcttcagcctgtatggcatgcaggtgctgctgtttgagaaccagtactacccaaatggcatccggctgaccagctctgtgcctggagctgacatcaaggtgctgatcaacttcaatgcccccaacccccaggacaggaagaagttcacagatgacctgcgggagagcattgctgaggtgcaggagatggagaagcaccgcatcgagagcgagctggagaagcagaagggcgtggtgcggcccagcatgagccagtgcagcagcctgaagaaggagagcggaaatggcaccctgagccgggcctgcctggatgacagctatgccagcggggagggcctgaagaggtctgccctgagcagcagcctgcgggacctgtctgaggccggcaagagaggaagaagaagcagcgctggcagcctggagagcaatgtggagggcagcatcatcagcagcccccacatgagaagaagagccaccagcaccagagaatgtcccagccggccccaccagaccatgcccaacagcagcagcctgctgggcagcctgtttggcagcaagaggggcaagcccccaccccaggcccacctgcccagcgccccagccctgcccccaccccacccccctgtggtgctgccccacctgcagcacagcgtggccggccaccacctgggccccccagagggcctgccccaggccgccatgcacggccaccacacccagtactgccacatgcagaaccccccaccctaccaccaccaccaccaccaccaccccccccagcacatccagcacgcccaccagtaccaccacggcccccatggaggccacccagcctatggagcccacgcccacggccacccccccctgcccagcgcccacgtgggccacacagtgcaccaccacggccagcccccagcccctcctccacccaccagcagcaaggccaagcccagcggcatcagcaccatcgtgtag

SEQ ID NO: 21259 - DNA, 903 bp, Artificial Sequence
  Description of Artificial Sequence: Synthetic coding sequence
atggccgaggaggtgtccaccctgatgaaggccaccgtgctgatgaggcagcccggccgggtgcaggagatcgtgggcgccctgaggaagggcggcggggaccggctgcaggtgatcagtgactttgacatgaccctgagcagatttgcctacaacgggaagcgctgccccagcagctacaacatcctggacaacagcaagatcatcagcgaggagtgcaggaaggagctgacagccctgctgcaccactactaccccattgaaattgacccccacaggacagtgaaggagaagctgccccacatggtggagtggtggaccaaggcccacaacctgctgtgccagcagaagatccagaagttccagatcgcccaggtggtgcgggagagcaatgccatgctgcgggagggctacaagaccttcttcaacaccctgtaccacaacaacatccccctcttcatcttctctgctggcattggagacatcctggaggagatcatccggcagatgaaggtgttccaccccaacatccacatcgtgagcaactacatggacttcaatgaagatggcttcctgcagggcttcaagggccagctgatccacacctacaacaagaacagcagcgcctgtgaaaattctggctacttccagcagctggagggcaagaccaacgtcatcctgctgggggacagcatcggggacctgaccatggctgatggagtgcctggggtgcagaacatcctgaagattggcttcctgaatgacaaggtggaggagcggcgggagcgctacatggacagctatgacatcgtgctggagaaggatgagaccctggatgtggtgaatggcctgctgcagcacatcctgtgccagggcgtgcagctggagatgcagggcccctag

SEQ ID NO: 21260 - DNA, 834 bp, Artificial Sequence
  Description of Artificial Sequence: Synthetic coding sequence
atgtttcctggggccaccacccccctgcccaaggctgctgcctacccaggagtgtatggcagcaatggccgcaccccccagcctgcctacctgtctgaggccatgaagctgacccagagcgagcaggcccacctgagcctggagctgcagagggacagccacatgaagcagctgctgctgatccaggagcgctggaagagggcccagcgggaggagcggctgaaggcccagcagaacacagacaaggatgctgctgcccacctgcagaccagccacaagcccagcgcagaagatgctgagggccagagccccctgagccagaagtacagccccagcacagagaagtgcctgcctgagatccagggcatctttgaccgggaccctgacaccctgctgtacctgctgcagcagaagtctgagcctgctgagccctgcatcggcagcaaggcccccaaggatgacaagaccatcatcgaggagcaggccaccaagattgctgacctgaagagacatgtggagttcctggtggccgagaatgaaaggctgaggaaagaaaacaagcagctgaaggccgagaaggcccggctgctgaagggccccatcgagaaggagctggatgtggatgctgactttgtggagaccagcgagctgtggagcctgccccctcatgctgagacagccacagccagcagcacctggcagaagtttgctgccaacacaggcaaggccaaggacatccccatccccaacctgccccccctggacttccccagccctgagctgcccctgatggagctgtctgaggacatcctgaagggcttcatgaacaactag

SEQ ID NO: 21261 - DNA, 138 bp, Artificial Sequence
  Description of Artificial Sequence: Synthetic coding sequence
atgagcccccagaagagggtgaagaatgtgcaggcccagaacagaaccagccagggcagcagcagcttccagaccaccctgagcgcctggaaggtgaagcaggaccccagcaacagcaagaacatcagcaagcactag

SEQ ID NO: 21262 - DNA, 819 bp, Artificial Sequence
  Description of Artificial Sequence: Synthetic coding sequence
atgcctggggaccaccggcgcatccggggccctgaggagagccagcccccccagctgtatgctgctgatgaggaggaggcccctggcacccgggaccccacccggctgcggcctgtgtatgcccgggccggcctgctgagccaggccaagggcagcgcctacctggaggccggcggcaccaaggtgctgtgtgctgtgtctggcccccggcaggccgagggcggggagcggggcggcggccctgctggggccggcggggaggccccagctgccctgcggggccgcctgctgtgtgacttcagaagagccccctttgctggaagaagaagaagagcccctcctgggggctgtgaggagcgggagctggccctggccctgcaggaggccctggagcctgctgtgcggctgggccgctacccccgggcccagctggaggtgtctgccctgctgctggaggatggcggcagcgccctggccgccgccctgacagctgctgccctggccctggctgatgctggggtggagatgtatgacctggtggtgggctgcggcctgagcctggcccctggccctgcccccacctggctgctggaccccacccggctggaggaggagagagctgctgctggcctgactgtggccctgatgcctgtgctgaaccaggtggccggcctgctgggcagcggggagggcggcctgacagagagctgggccgaggccgtgcggctgggcctggagggctgccagaggctgtaccctgtgctgcagcagagcctggtgcgggccgccaggagaagaggagctgctgcccagccctag

SEQ ID NO: 21263 - DNA, 429 bp, Artificial Sequence
  Description of Artificial Sequence: Synthetic coding sequence
atggccagcggaaatgcccgcatcggcaagccagccccagacttcaaggccacagctgtggtggatggagccttcaaggaggtgaagctgagtgactacaagggcaagtatgtggtgctcttcttctaccccctggacttcacctttgtgtgccccacagagatcatcgccttcagcaacagagctgaggacttcaggaagctgggctgtgaggtgctgggcgtgtctgtggacagccagttcacccacctggcctggtatgagcagggccccaagcgggaggtggccgccaagctgacccccagcggccccagctctgtggcctcctggcccctgctgaacctgtggaacctgcgcttccccatcgtgaagatcatggagaccctgccccccaagagcctgaggatgatgaccgtcatcagcatctag

SEQ ID NO: 21264 - DNA, 1137 bp, Artificial Sequence; identical to SEQ ID NO: 20335
  Description of Artificial Sequence: Synthetic coding sequence

SEQ ID NO: 21265 - DNA, 324 bp, Artificial Sequence
  Description of Artificial Sequence: Synthetic coding sequence
tgaattcatgagcagtgggagaaggccaacgtgagcagcccccaccgggagttccccccagccacagcccgggaggtggaccccctgcgcatccccccccaccacccccacaccagccggcagcccccctggccccggcggggcggcatgattgtggaccccctgcggagcggcttcccccgggccctgattgaccccagcagcggcctgcccaaccggctgcccccaggagctgtgcccccaggggccaggtttgaccccttcggccccatcggcaccagccccccaggccccaacccagaccacctgcccccacctggatag

SEQ ID NO: 21266 - DNA, 201 bp, Artificial Sequence
  Description of Artificial Sequence: Synthetic coding sequence
atggctgctgccactggagaccccggcctgagcaagctgcagtttgcccccttcagcagcgccctggatgtgggcttctggcatgagctgacccagaagaagctgaatgagtaccgcctggatgaggcccccaaggacatcaagggctactactacaatggagacagcgctggcctgcctgcccggctgaccctggagtag

SEQ ID NO: 21267 - DNA, 2115 bp, Artificial Sequence
  Description of Artificial Sequence: Synthetic coding sequence
atgctgcccacagccagcagcaagaggaggacctttgctgcccgctacttcaccaggagcaagagcctggtgatgggagagcagagccgcagccctggccgcatgccctgcccccaccggctgggccctgtgctgaaggccggctggctgaagaagcagaggagcatcatgaagaactggcagcagcgctggtttgtgctgcggggggaccagctgttctactacaaggacaaggatgagatcaagccccagggcttcatcagcctgcagggcacccaggtgacagagctgcccccaggccctgaggaccccgggaagcacctgtttgagatcagccctggaggagctggggagcgggagaaggtgcctgccaaccctgaggccctgctgctgatggccagcagccagagggacatggaggactgggtgcaggccatcagaagagtcatctgggcccccctgggcggcggcatcttcggccagaggctggaggagaccgtgcaccacgagaggaaatatggcccccggctggcccccctgctggtggagcagtgtgtggacttcatccgggagcggggcctgacagaggagggcctcttcaggatgcctggccaggccaacctggtgcgggacctgcaggacagctttgactgtggggagaagcccctgtttgacagcaccacagatgtgcacacagtggccagcctgctgaagctgtacctgcgggagctgcctgagcctgtggtgccctttgcccgctatgaggacttcctgagctgtgcccagctgctgaccaaggatgaaggagagggcaccctggagctggccaagcaggtgagcaacctgccccaggccaactacaacctgctgcgctacatctgcaagttcctggatgaggtgcaggcctacagcaatgtgaacaagatgtctgtgcagaacctggccaccgtgtttggccccaacatcctgcggccccaggtggaggaccctgtgaccatcatggagggcaccagcctggtgcagcacctgatgacagtgctgatcaggaagcacagccagctgttcaccgcccctgtgcctgagggccccaccagcccccggggcggcctgcagtgtgctgtgggctggggcagcgaggaggtgacccgggacagccagggcgagcccggcggccctggcctgcctgcccacaggaccagcagcctggatggagctgctgtggccgtgctgagcaggacagcccccaccggccctggcagccgctgcagccctgggaagaaggtgcagaccctgcccagctggaagagcagcttccggcagcccaggagcctgagcggcagccccaagggcggcggcagcagcctggaggtgcccatcatcagcagcggcggcaactggctgatgaatggcctgagcagcctgcggggccaccggcgggccagcagcggggaccggctgaaggacagcggctctgtgcagaggctgagcacctatgacaacgtgcctgcccctggcctggtgcccggcatccccagcgtggcctccatggcctggagcggggccagcagcagcgagagctctgtgggcggcagcctgagcagctgcacagcctgccgggccagtgacagcagcgcccggagcagcctgcacacagactgggccctggagcccagccccctgcccagcagcagcgaggaccccaagagcctggacctggaccacagcatggatgaagctggagctggggccagcaacagcgagcccagcgagccagacagccccacccgggagcacgcccggcgctctgaggccctgcagggcctggtgacagagctgcgggcagagctgtgccggcagaggacagaatatgaaagatctgtgaagagaattgaggagggcagcgctgacctgaggaagaggatgagccggctggaggaggagctggaccaggagaagaagaagtacatcatgctggagatcaagctgagaaattctgagcgggcccgggaggatgctgagaggaggaaccagctgctgcagcgggagatggaggagttcttcagcaccctgggcagcctgactgtgggcgccaagggggcccgggcccccaagtag

SEQ ID NO: 21268 - DNA, 630 bp, Artificial Sequence
  Description of Artificial Sequence: Synthetic coding sequence
atgatcagcaactacagaaatggaagtgagctggtgtgcttcaacagcggcgtgggctgcttcctgattggctgtgactgggccttcaccgtgctggtgaacaccttcttctccttcctgcggaggaagacagacttcttcatcggcggggaggagggcatggccgagaagctgatcacccagaccttcagccaccacaaccagctggcccagaagacccggcgggagaagagggcccggcaggaggccgagcggcgggagaaggccgagcgggccgcccggctggccaaggaggccaagtctgagaccagcggcccccagatcaaggagctgacagatgaggaggccgagcggctgcagctggagattgaccagaagaaggatgctgagaaccacgaggcccagctgaagaatggcagcctggacagccctgggaagcaggacacagaagaagatgaggaggaggatgagaaggacaagggcaagctgaagcccaacctgggcaatggagctgacctgcccaactaccgctggacccagaccctgtctgagctggacctggccgtgcccttctgtgtgaacttccggctgaagggcaaggacatggtggtggacatccagaggaggtag

SEQ ID NO: 21269 - DNA, 309 bp, Artificial Sequence; identical to SEQ ID NO: 21031
  Description of Artificial Sequence: Synthetic coding sequence

SEQ ID NO: 21270 - DNA, 273 bp, Artificial Sequence
  Description of Artificial Sequence: Synthetic coding sequence
atggccatggcccccagccccagcctggtgcaggtgtacaccagccctgctgctgtggccgtgtgggagtggcaggacggcctgggcacctggcacccctacagcgccaccgtgtgcagcttcatcgagcagcagtttgtgcagcagaagggccagcgcttcggcctgggcagcctggcccacagcatccccctgggccaggccgaccccagcctggccccctacatcatcgacctgcccagctggacccagttccggcaggacacaggatag

SEQ ID NO: 21271 - DNA, 207 bp, Artificial Sequence
  Description of Artificial Sequence: Synthetic coding sequence
atggatgccaacagcaaggacaagcccccagagaccaaggagagcgccatgaacaatgctggaaatgccagcttcatcctgggcaccgggaagatcgtgaccccccagaagcatgctgagctgccccccaacccctgcaccccagacaccttcaagagccccctgaacttcagcacagtgacagtggagcagctgggcatcaactag

SEQ ID NO: 21272 - DNA, 879 bp, Artificial Sequence
  Description of Artificial Sequence: Synthetic coding sequence
atggatggcagctttgtgcagcacagcgtgcgggtgctgcaggagctgaacaagcagcgggagaagggccagtactgtgatgccaccctggatgtgggcggcctggtgttcaaggcccactggagcgtgctggcctgctgcagccacttcttccagagcctgtatggagatggcagcggcggctctgtggtgctgcctgctggctttgctgagatcttcggcctgctgctggacttcttctacacaggccacctggccctgaccagcggcaacagagaccaggtgctgctggccgcccgggagctgcgggtgcctgaggccgtggagctgtgccagagcttcaagcccaagacctctgtgggccaggccgccggcggccagagcggcctgggccccccagccagccagaatgtgaacagccacgtgaaggagcccgccggcctggaggaggaggaggtgtccaggaccctgggcctggtgccccgggaccaggagccccggggcagccacagcccccagaggccccagctgcacagccctgcccagagcgagggccccagcagcctgtgtgggaagctgaagcaggccctgaagccctgccccctggaggacaagaagccagaggactgcaaggtgcccccccggcccctggaggccgagggcgcccagctgcagggcggcagcaatgagtgggaggtggtggtgcaggtggaggatgatggagatggagactacatgtctgagcctgaggccgtgctgaccaggaggaagagcaatgtcatcaggaagccctgtgccgctgagcccgccctgtctgctggcagcctggccgctgagcctgctgagaacagaaaaggaacagctgtgcctgtggagtag

SEQ ID NO: 21273 - DNA, 408 bp, Artificial Sequence; identical to SEQ ID NO: 20517
  Description of Artificial Sequence: Synthetic coding sequence

SEQ ID NO: 21274 - DNA, 810 bp, Artificial Sequence
  Description of Artificial Sequence: Synthetic coding sequence
atgaagacccctgtggagctggccgtgtctggcatgcagaccctgggcctgcagcaccgctgccggggcggctacagagtgaaggcccggaccagctatgtggatgagaccctgtttggcagccctgctggcacccggcccaccccaccagactttgaccccccctgggtggagaaggccaacagaacccggggcgtgggcaaggaggccagcaaggccctgggcgccaagggcagctgtgagaccacccccagccggggcagcacccccaccctgacccccaggaagaagaacaagtaccggcccatcagccacacccccagctactgtgatgagagcctgtttggcagccgctctgagggcgccagctttggagcccccaggatggccaagggagatgctgccaagctgcgggccctgctgtggaccccaccacccaccccccggggcagccacagcccccggccccgggaggcccccctgcgggccatccaccctgctggccccagcaagacagagcccggccctgctgctgacagccagaagctgtccatgggcggcctgcacagcagccggcccctgaagaggggcctgagccacagcctgacccacctgaatgtgcccagcacaggccacccagccaccagcgccccccacaccaacggcccccaggacctgcggcccagcaccagcggcgtgaccttccgcagccccctggtgaccagccgggcccggtctgtgtccatctctgtgcccagcaccccccggcggggcggggccacccagaagcccaagccaccctggaagtag

SEQ ID NO: 21275 - DNA, 840 bp, Artificial Sequence
  Description of Artificial Sequence: Synthetic coding sequence
atggtggaccacctggccaacacagagatcaacagccagagaattgctgctgtggagagctgcttcggggccagcggccagcccctggccctgcccggccgggtgctgctgggggagggcgtgctgaccaaggaatgtaggaagaaggccaagccccgcatcttcttcctgttcaatgacatcctggtgtatggcagcatcgtgctgaacaagaggaagtaccgcagccagcacatcatccccctggaggaggtgaccctggagctgctgcctgagaccctgcaggccaagaaccgctggatgatcaagacagccaagaagagctttgtggtgtctgctgccagcgccacagagcggcaggagtggatcagccacatcgaggagtgtgtgcggcggcagctgcgggccaccggccggccccccagcacagaacatgctgccccctggatcccagacaaggccacagacatctgcatgcgctgcacccagacccgcttcagcgccctgaccaggaggcaccactgcaggaaatgtggctttgtggtgtgtgctgaatgttcccggcagcgcttcctgctgccccggctgagccccaagcctgtgcgggtgtgcagcctgtgctaccgggagctggccgcccagcagaggcaggaggaggccgaggagcagggcgccggcagccctggccagcctgcccacctggcccggcccatctgtggggccagcagtggagatgatgatgacagtgatgaggacaaggagggcagcagagatggagactggcccagctctgtggagttctacgccagcggcgtggcctggagcgccttccacagctag

SEQ ID NO: 21276 - DNA, 279 bp, Artificial Sequence
  Description of Artificial Sequence: Synthetic coding sequence
tgaagaagcagcaccagcccctgtggcaccagcaagagccccaaccgggagtgggagggcaagtctgtggcctacatgccctatgcagaggtgaagagggccctggagcaggaggcccagatgcacaacacagctgcccggagcgccagcccctgccgcctgagcccccgggaggtgtccaaggccgccccccagcctgacatgtctgctgcccgctacagcgtgccccctgtgctgcagcctgccccccaccaggtgatcaccaacctgcctgagtag

SEQ ID NO: 21277 - DNA, 771 bp, Artificial Sequence
  Description of Artificial Sequence: Synthetic coding sequence
atgagcaacaacctgtctgagctggacaccaagatccaggagaaggccatgaaggtggacatggacatctgcagaagaattgacatcacagccaagctgtgtgatgtggcccagcagaggaactgtgaggacatgatccagatgttccagaagaagctggtgcccagcatgggcggcaggaagcgggagaggaaggctgctgtggaggaggacaccagcctgtctgagagcgagggcccccggcagccagatggagatgaggaggagagcacagccctgagcatcaatgaggagatgcagaggatgctgaaccagctgcgggagtatgactttgaagatgactgtgacagcctgacctgggaggagacagaggagaccctgctgctgtgggaggacttcagcggctacgccatggctgctgctgaggcccagggcgagcagcaggaggacagcctggagaaggtgatcaaggacacagagagcctcttcaagacccgggagaaggagtaccaggagaccatcgaccagatcgagctggagctggccacagccaagaatgacatgaacagacacctgcacgagtacatggagatgtgcagcatgaagaggggcctggatgtgcagatggagacctgcagaagactcatcacccagagcggggacaggaagagccctgccttcaccgctgtgcccctgagtgaccccccacctccacccagcgaggctgaagattctgacagagatgtgtccagtgacagctccatgaggtag

SEQ ID NO: 21278 - DNA, 1620 bp, Artificial Sequence; identical to SEQ ID NO: 19050
  Description of Artificial Sequence: Synthetic coding sequence

SEQ ID NO: 21279 - DNA, 750 bp, Artificial Sequence
  Description of Artificial Sequence: Synthetic coding sequence
atggccttcatgaccaggaagctgtgggacctggagcagcaggtgaaggcccagacagatgagatcctgagcaaggaccagaagattgctgccctggaggacctggtgcagaccctgcggccccaccctgctgaggccaccctgcagaggcaggaggagctggagaccatgtgtgtgcagctgcagaggcaggtgcgggagatggagcgcttcctgagtgactatggcctgcagtgggtgggggagcccatggaccaggaggacagcgagagcaagacagtgtctgaacatggagagcgggactggatgacagccaagaagttctggaagccaggggacagcctggcccctcctgaggtggactttgaccggctgctggccagcctgcaggacctgtctgagctggtggtggagggggacacccaggtgacccctgtgcctggaggagcccggctgcggaccctggagcccatccccctgaagctgtacagaaatggcatcatgatgtttgatggccccttccagcccttctatgaccccagcacccagcgctgcctgcgggacatcctggatggcttcttccccagcgagctgcagaggctgtaccccaacggggtgcccttcaaggtgatcagctgcagcagcaaccacacctttggagactttgagggcagcggggacacccagcccccccagaccccacccatcctgcggggcagccgctgcaccccctggggcacccctgtgtag

SEQ ID NO: 21280 - DNA, 2763 bp, Artificial Sequence
  Description of Artificial Sequence: Synthetic coding sequence
atgtctgaagattctgagaaggaggactacagcgacaggaccatcagtgatgaagatgaaagtgatgaggacatgttcatgaagtttgtgtctgaggacctgcaccgctgtgccctgctgacagctgacagctttggagaccccttcttccccaggaccacccagatcctgctggagtaccagctgggccgctgggtgccccggctgcgggagccccgggacctgtatggagtgagcagcagcggccccctgagccccacccgctggccctaccactgtgaggtgattgatgagaaggtgcagcacatcgactggacccccagctgcccagagcctgtgtacatccccaccggcctggagacagagcccctgtacccagacagcaaggaggccaccgtggtgtacctggccgaggatgcctacaaggagccctgctttgtgtacagccgggtgggcggcaacagaacacccctgaagcagcctgtggactacagagacaacaccctgatgtttgaggccaggtttgaaagtggcaacctgcagaaggtggtgaaggtggccgagtatgagtaccagctgactgtgcggccagacctcttcaccaacaagcacacccagtggtactacttccaggtgaccaacatgagagctggcatcgtgtaccgcttcaccatcgtgaacttcaccaagccagccagcctgtacagccggggcatgaggcccctcttctacagcgagaaggaggccaaggcccaccacatcggctggcagagaattggagaccagatcaagtactacagaaacaaccctggccaggacggccgccactacttcagcctgacctggaccttccagttcccccacaacaaggacacctgctactttgcccactgctacccctacacctacaccaacctgcaggagtacctgagcggcatcaacaatgaccctgtgcgcagcaagttctgcaagatccgggtgctgtgccacaccctggccaggaacatggtgtacatcctgaccatcaccacccccctgaagaacagcgacagcaggaagaggaaggccgtcatcctgacagcccgggtgcaccctggagagaccaacagctcctggatcatgaagggcttcctggactacatcctgggcaacagcagtgatgcccagctgctgcgggacacctttgtgttcaaggtggtgcccatgctgaacccagatggagtgattgtgggcaactaccgctgcagcctggccggccgggacctgaacagaaactacaccagcctgctgaaggagagcttccccagcgtgtggtacaccaggaacatggtgcaccggctgatggagaagcgggaggtgatcctgtactgtgacctgcacggccacagcaggaaggagaacatcttcatgtatggctgtgatggcagtgacaggagcaagaccctgtacctgcagcagaggatcttccccctgatgctgagcaagaactgcccagacaagttctccttcagcgcctgcaagttcaacgtgcagaagagcaaggagggcaccggccgggtggtgatgtggaagatgggcatccggaacagcttcaccatggaggccaccttctgtggcagcaccctgggcaacaagaggggcacccacttcagcaccaaggacctggagagcatgggctaccacttctgtgacagcctgctggactactgtgaccctgacaggaccaagtactaccgctgcctgaaggagctggaggagatggagcggcacatcaccctggagaaggtgtttgaggacagcgacacccctgtgattgacatcaccctggatgtggagagcagcagccggggcagtgacagcagcgagagcattgacagcctgacctacctgctgaagctgaccagccagaagaagcacctgaagaccaagaaggagaggaacagcaccatcgccagccaccagaatgcccggggccaggaggtgtatgaccggggccacctgctgcagaggcacacccagagcaacagtgatgtgaaggacacccggcccaatgaaccagatgactacatggtggactacttccggcggcagctgcccaaccagggcctggacctgcaccacaacctgaagagcaagatcaaggagtgcatctccttccagagcaagaagacaggcatcaactggacagatgatgagaagaggagctacaaggacaagggcatcgtgcagacccaggagatcctgcagtacctgctgcccatcgtgcacagcaccaagaacatgcagaccacccagatcaagcagctgttcaaccccaggaccaacttccagatccagcaccagctgaacccagccacctgcaggaacatcaagaagtacagcacctcctggacagcccccaggaaccacccctttgtgatccagggagatgtgatggccaacagcagcgagtgggtgcagagcaagccccacaggagcctggagagcctgagccccctgaagggccccaagaagaacaagcacagccagatctgggccatcaagaatgaagacatcaagcccctgagcagcaagtgggagacagccagcagcagctttggcatggatgccaacgtgctgaagtacaagagcctgcaggccgaggagaccaaccagcagagcagcaagcacacagccctgcacctgaccaagaacaaggatgagcaggccaacaagaatgatggccagcccaccctgtacctgaagttccagcgggagagctag

SEQ ID NO: 21281 - DNA, 858 bp, Artificial Sequence
  Description of Artificial Sequence: Synthetic coding sequence
atgaccaatgcccagatcatcctgctgattgacaatgccaggatggctgtggatgacttcaacctgaagtatgaaaatgagcacagcttcaagaaggacctggagattgaggtggagggcctgcggaggaccctggacaacctgaccatcgtgaccacagacctggagcaggaggtggagggcatgaggaaggagctgatcctgatgaagaagcaccacgagcaggagatggagaagcaccacgtgcccagcgacttcaacgtgaatgtgaaggtggacaccggcccccgggaggacctgatcaaggtgctggaggacatgaggcaggagtatgagctgatcatcaagaagaagcaccgggacctggacacctggtacaaggagcagagcgctgccatgagccaggaggccgccagccctgccaccgtgcagagccggcagggcgacatccacgagctgaagaggaccttccaggccctggagattgacctgcagacccagtacagcaccaagagcgccctggagaacatgctgtctgagacccagagccgctacagctgcaagctgcaggacatgcaggagatcatcagccactatgaggaggagctgacccagctgcggcatgagctggagcggcagaacaatgagtaccaggtgctgctgggcatcaagacccacctggagaaggagatcaccacctacagaaggctgctggagggggagagcgagggcacccgggaggagagcaagagctccatgaaggtgtctgccacccccaagatcaaggccatcacccaggagaccatcaatggccgcctggtgctgtgccaggtgaatgagatccagaagcacgcctag

SEQ ID NO: 21282 - DNA, 2013 bp, Artificial Sequence
  Description of Artificial Sequence: Synthetic coding sequence
atgagcccctgcagcggcggccgcggggagctgcgggccgcctgcctgcagcctgaggtgcctggggcccctggcctgtcctggtggcccagcacagctggcctgcggcagagccagacagacctgcagctgagcctgagcatctggtgtgggaagaagatgggcagctacctgtctgtgcctgcctacttcaccagccgggacctcttccgctgcagcgagtgccaggacagcctgaccaactggtactatgagaaggatggcaagctgtactgccccaaggactactggggcaagtttggagagttctgccacggctgcagcctgctgatgacaggccccttcatggtggccggggagttcaagtaccaccctgagtgctttgcctgcatgagctgcaaggtgatcattgaagatggagatgcctatgccctggtgcagcacgccaccctgtactgtgggaagtgccacaatgaggtggtgctggcccccatgtttgagcggctgagcacagaatctgtgcaggagcagctgccctacagcgtgaccctcatctccatgcctgccaccacagagggccggcggggcttctctgtgtctgtggagagcgcctgcagcaactatgccaccaccgtgcaggtgaaggaggtgaacaggatgcacatcagccccaacaacagaaatgccatccaccctggggaccgcatcctggagatcaatggcacccctgtgaggaccctgcgggtggaggaggtggaggatgccatcagccagaccagccagaccctgcagctgctgattgaacatgaccctgtgtcccagaggctggaccagctgcggctggaggcccggctggccccccacatgcagaatgccggccacccccacgccctgagcaccctggacaccaaggagaacctggagggcaccctgcggcggcgcagcctgcggcgcagcaacagcatcagcaagagccctggccccagcagccccaaggagcccctgctcttcagccgggacatcagccgctctgagagcctgcgctgcagcagcagctacagccagcagatcttccggccctgtgacctgattcatggagaggtgctgggcaagggcttcttcggccaggccatcaaggtgacccacaaggccaccgggaaggtgatggtgatgaaggagctgatccgctgtgatgaggagacccagaagaccttcctgacagaggtgaaggtgatgaggagcctggaccaccccaacgtgctgaagttcatcggcgtgctgtacaaggacaagaagctgaacctgctgacagagtacatcgagggcggcaccctgaaggacttcctgcgctccatggaccccttcccctggcagcagaaggtgcgctttgccaagggcatcgccagcggcatggcctacctgcacagcatgtgcatcatccaccgggacctgaacagccacaactgcctgatcaagctggacaagacagtggtggtggccgactttggcctgagccgcctcatcgtggaggagaggaagagggcccccatggagaaggccaccaccaagaagaggaccctgaggaagaatgacaggaagaagcgctacacagtggtgggcaacccctactggatggcccctgagatgctgaatggcaagagctatgatgagaccgtggacatcttctcctttggcatcgtgctgtgtgagatcatcggccaggtgtatgctgaccctgactgcctgcccaggaccctggactttggcctgaatgtgaagctgttctgggagaagtttgtgcccacagactgccccccagccttcttccccctggccgccatctgctgccgcctggagcctgagagcaggcctgccttcagcaagctggaggacagctttgaggccctgagcctgtacctgggggagctgggcatccccctgcctgctgagctggaggagctggaccacacagtgtccatgcagtatggcctgacccgggacagccccccatag

SEQ ID NO: 21283 - DNA, 459 bp, Artificial Sequence
  Description of Artificial Sequence: Synthetic coding sequence
atggcccacctgcggggctttgccaaccagcacagccgggtggaccctgaggagctgttcaccaagctggaccgcatcggcaagggcagctttggagaggtgtacaagggcatcgacaaccacaccaaggaggtggtggccatcaagatcatcgacctggaggaggctgaagatgaaattgaggacatccagcaggagatcaccgtgctgagccagtgtgacagcccctacatcacccgctacttcggcagctacctgaagagcaccaagctgtggatcatcatggagtacctgggcggcggcagcgccctggacctgctgaagccaggccccctggaggagacctacatcgccaccatcctgcgggagatcctgaagggcctggactacctgcacagcgagaggaagatccaccgggacatcaaggccgccaacgtgctgctgtctgagcagggctag

SEQ ID NO: 21284 - DNA, 1365 bp, Artificial Sequence
  Description of Artificial Sequence: Synthetic coding sequence
atggccccctgccgggccaggacaggccccagcacctggaggtctgccaccagcagcaccaggaggaggaagggggcccggcggcacctgagcgccctgcaggtgctggagacctgtgtgaagaactgtggccaccgcttccacgtgctggtggccagccaggactttgtggagagcgtgctggtgaggaccatcctgcccaagaacaacccccccaccatcgtgcatgacaaggtgctgaacctgatccagagctgggcagatgccttccgcagcagcccagacctgactggagtggtgaccatctatgaggacctgcggaggaagggcctggagttccccatgacagacctggacatgctgagccccatccacaccccccagaggacagtgttcaacagcgagacccagagcggccaggacagcgtgggcacagacagcagccagcaggaggacagcggccagcacgccgcccccctgcctgccccacccatcctgagcggggacacccccatcgcccccaccccagagcagatcggcaagctgcggtctgagctggagatggtgtctggaaatgtgcgggtgatgtctgagatgctgacagagctggtgcccacccaggccgagcctgctgacctggagctgctgcaggagctgaacagaacctgccgggccatgcagcagagggtgctggagctgatcccccagatcgccaatgagcagctgacagaggagctgctgattgtgaatgacaacctgaacaacgtgttcctgcggcatgaaagatttgagcgcttcagaacaggccagaccaccaaggcccccagcgaggccgagcctgctgctgacctgattgacatgggccctgaccctgctgccaccggcaacctgagcagccagctggccggcatgaacctgggcagcagctctgtgcgggccggcctgcagagcctggaggccagcggccgcctggaggatgaatttgacatgtttgccctgacccggggcagcagcctggccgaccagaggaaggaggtgaagtatgaggccccccaggccacagatggcctggccggggccctggatgcccggcagcagagcactggagccatccctgtgacccaggcctgcctgatggaggacatcgagcagtggctgagcacagatgtgggcaatgatgctgaggagcccaagggcgtgaccagcgaggagtttgacaagttcctggaggagcgggccaaggctgctgaccggctgcccaacctgagcagccccagcgctgagggccccccaggccccccatctggccctgcccccaggaagaagacccaggagaaggatgatgacatgctgtttgccctgtag

SEQ ID NO: 21285 - DNA, 378 bp, Artificial Sequence
  Description of Artificial Sequence: Synthetic coding sequence
atgcagaccagcagcagccgctctgtgcacctgtctgagtggcagaagaactactttgccatcaccagcggcatctgcaccggccccaaggcagatgcctaccgggcccagatcctgcgcatccagtatgcctgggccaacagcgagatcagccaggtgtgtgccaccaagctgttcaagaagtatgcagagaagtacagcgccatcatcgacagcgacaacgtggagagcggcctgaacaactatgcagagaacatcctgaccctggccggcagccagcagacagacagcgacaagtggcagagcggcctgagcatcaacaacgtgttcaagatgagctctgtgcagaagatgatgcaggccggcaagaagttctag

SEQ ID NO: 21286 - DNA, 30 bp, Artificial Sequence; identical to SEQ ID NO: 12254
  Description of Artificial Sequence: Synthetic coding sequence

SEQ ID NO: 21287 - DNA, 270 bp, Artificial Sequence; identical to SEQ ID NO: 20498
  Description of Artificial Sequence: Synthetic coding sequence

SEQ ID NO: 21288 - DNA, 3732 bp, Artificial Sequence
  Description of Artificial Sequence: Synthetic coding sequence
atgctgatcaaggagtaccacatcctgctgcccatgagcctggatgagtaccaggtggcccagctgtacatgatccagaagaagagccgggaggagagcagcggggagggcagcggcgtggagatcctggccaaccggccctacacagatggccctgggggcagcggccagtacacccacaaggtgtaccacgtgggcagccacatccctggctggttccgggccctgctgcccaaggccgccctgcaggtggaggaggagagctggaatgcctacccctacaccaggacccgctacacctgcccctttgtggagaagttcagcattgaaattgagacctactacctgcctgatggcggccagcagcccaacgtgttcaacctgtctggagctgagcggcggcagaggatcctggacaccattgatattgtgagagatgctgtggcccctggagagtacaaggccgaggaggacccccggctgtaccacagcgtgaagacaggccggggccccctgagtgatgactgggccaggacagctgcccagacaggccccctgatgtgtgcctacaagctgtgcaaggtggagttccgctactggggcatgcaggccaagattgagcagttcatccatgatgtgggcctgcggcgggtgatgctgcgggcccaccggcaggcctggtgctggcaggatgagtggacagagctgtccatggctgacatccgggccctggaggaggagacagccaggatgctggcccagaggatggccaagtgcaacacaggcagcgagggcagcgaggcccagcccccaggcaagcccagcacagaggcccggtctgctgccagcaacacaggcaccccagatggccctgaggcccctcctggcccagatgccagcccagatgccagctttgggaagcagtggagcagcagcagccgcagcagctacagcagccagcacggcggcgctgtgagcccccagagcctgtctgagtggaggatgcagaacatcgcccgggacagcgagaacagcagcgaggaggagttctttgatgcccacgagggcttcagtgacagcgaggaggtgttccccaaggagatgaccaagtggaacagcaatgacttcattgatgcctttgccagccctgtggaggccgagggcaccccagagcccggggctgaggccgccaagggcattgaagatggagcccaggccccccgggacagcgagggcctggatggagctggggagctgggcgctgaggcctgtgctgtgcacgccctcttcctgatcctgcacagcggcaacatcctggacagcggccctggagatgccaacagcaagcaggctgatgtgcagaccctgagcagcgcctttgaggccgtgacccgcatccacttccctgaggccctgggccacgtggccctgcggctggtgccctgcccccccatctgtgccgccgcctatgccctggtgagcaacctgagcccctacagccatgatggagacagcctgagccgcagccaggaccacatccccctggccgccctgcccctgctggccaccagcagcagccgctaccagggcgctgtggccaccgtcatcgcccggaccaaccaggcctacagcgccttcctgcggagccctgagggcgccggcttctgtggccaggtggccctgattggagatggagtgggcggcatcctgggctttgatgccctgtgccacagcgccaatgccggcaccggcagccggggcagcagccggcggggctccatgaacaatgagctgctgagccctgagtttggacctgtgcgggaccccctggctgatggagtggagggcctgggccggggcagccctgagcccagcgccctgcccccccagaggatccccagcgacatggccagccctgagcctgagggcagccagaacagcctgcaggccgccccagccaccaccagctcctgggagccccggcgggccagcacagccttctgccccccagctgccagcagcgaggccccagatggccccagcagcacagcccggctggacttcaaggtgtctggcttcttcctgtttggcagccccctgggcctggtgctggccctgaggaagacagtgatgcctgccctggaggcccagatgaggcctgcctgtgagcagatctacaacctcttccacgccgctgacccctgtgccagccggctggagcccctgctggcccccaagttccaggccatcgcccccctgactgtgccccgctaccagaagttccccctgggagatggcagcagcctgctgctggccgacaccctgcagacccacagcagcctcttcctggaggagctggagatgctggtgcccagcacccccaccagcaccagcggggccttctggaagggcagcgagctggccacagatcctccagcccagcctgctgcccccagcaccaccagcgaggtggtgaagatcctggagcgctggtggggcaccaagagaattgactacagcctgtactgcccagaggccctgacagccttccccaccgtgaccctgccccacctgttccacgccagctactgggagagcgcagatgtggtggccttcatcctgcggcaggtgattgagaaggagcggccccagctggctgaatgtgaggagcccagcatctacagccctgccttcccccgggagaagtggcagaggaagaggacccaggtgaagatcagaaatgtgaccagcaaccaccgggccagtgacacagtggtgtgtgagggccggccccaggtgctgagcggccgcttcatgtatggccccctggatgtggtgaccctgactggagagaaggtggatgtgtacatcatgacccagcccctgagcggcaagtggatccactttggaacagaggtgaccaacagcagcggccgcctgaccttccctgtgcccccagagcgggccctgggcatcggcgtgtaccctgtgaggatggtggtgcggggggaccacacctatgcagagtgctgcctgactgtggtggcccggggcacagaagctgtggtgttcagcattgatggcagcttcaccgcctctgtgtccatcatgggcagtgaccccaaggtgcgggccggggctgtggatgtggtgcgccactggcaggacagcggctacctgattgtgtatgtgacaggccgcccagacatgcagaagcaccgggtggtggcctggctgagccagcacaacttcccccacggcgtggtgtccttctgtgatggcctgacccatgaccccctgcggcagaaggccatgttcctgcagagcctggtgcaggaggtggagctgaacatcgtggccggctacggcagccccaaggatgtggccgtgtatgctgccctgggcctgagccccagccagacctacatcgtgggccgggctgtgaggaagctgcaggcccagtgccagttcctgagtgatggctacgtggcccacctgggccagctggaggccggcagccacagccacgccagcagcggccccccccgggccgccctgggcaagagcagctatggagtggccgcccctgtggacttcctgaggaagcagagccagctgctgcggagccggggccccagccaggccgagcgggagggccctggcaccccacccaccaccctggcccggggcaaggcccggagcatcagcctgaagctggacagcgaggagtag

SEQ ID NO: 21289 - DNA, 1614 bp, Artificial Sequence
  Description of Artificial Sequence: Synthetic coding sequence
atgagcagcagcggctacccacccaaccagggcgccttcagcacagagcagagccgctacccaccccacagcgtgcagtacaccttccccaacaccaggcaccagcaggagtttgctgtgcctgactaccgcagcagccacctggaggtgtcccaggccagccagctgctgcagcagcagcagcagcagcagctgcggcggcggcccagcctgctgtctgagttccaccctggcagtgaccggccccaggagaggaggaccagctatgagcccttccaccctggccccagccctgtggaccatgacagcctggagagcaagaggccccggctggagcaggtgtctgacagccacttccagagggtgtctgctgctgtgctgcccctggtgcaccccctgcctgagggcctgcgggccagcgcagatgccaagaaggaccctgcctttggaggcaagcatgaggcccccagcagccccatcagcggccagccctgtggagatgaccagaatgccagccccagcaagctgagcaaggaggagctgatccagagcatggacagagtggaccgggagatcgccaaggtggagcagcagatcctgaagctgaagaagaagcagcagcagctggaggaggaggccgccaagcccccagagcctgagaagcctgtgtccccacctcctgtggagcagaagcacaggagcatcgtgcagatcatctatgatgagaacaggaagaaggccgaggaggcccacaagatctttgagggcctgggccccaaggtggagctgcccctgtacaaccagcccagcgacaccaaggtgtaccacgagaacatcaagacaggagtgcctgcccggaggatgatgaagaaccaggtgatgaggaagaagctgatcctcttcttcaagagaagaaatcatgccaggaagcagcgggagcagaagatctgccagagatatgaccagctgatggaggcctgggagaagaaggtggacagaattgagaacaaccccaggaggaaggccaaggagagcaagacccgggagtactatgagaagcagtttcctgagatcaggaagcagcgggagcagcaggagcgcttccagagggtgggccagagaggagctggcctgagcgccaccatcgcccggagtgaacatgagatcagcgagatcattgatggcctgtctgagcaggagaacaatgagaagcagatgaggcagctgagcgtcatcccccccatgatgtttgatgctgagcagaggagagtgaagttcatcaacatgaatggcctgatggaggaccccatgaaggtgtacaaggaccggcagttcatgaatgtgtggacagaccacgagaaggagatcttcaaggacaagttcatccagcaccccaagaactttggcctgattgccagctacctggagaggaagtctgtgcctgactgtgtgctgtactactacctgaccaagaagaatgaaaactacaaggccctggtgagaagaaactacggcaagagaagaggaagaaaccagcagatcgcccggcccagccaggaggagaaggtggaggagaaggaggaggacaaggccgagaagacagagaagaagtag

SEQ ID NO: 21290 - DNA, 147 bp, Artificial Sequence
  Description of Artificial Sequence: Synthetic coding sequence
atggaggacctgtttgagaccttccaggatgagatgggcttcagcaacatggaggatgatggccctgaggaggaggagcgggtggccgagccccaggccaacttcaacaccccccaggccctgcggcagctgctgctgctgatgtag

SEQ ID NO: 21291 - DNA, 798 bp, Artificial Sequence
  Description of Artificial Sequence: Synthetic coding sequence
atggccagcagctctgtgcccccagccaccgtgtctgctgccacagctggccctggccctggcttcggctttgccagcaagaccaagaagaagcactttgtgcagcagaaggtgaaggtgttccgggctgctgaccccctggtgggcgtcttcctgtggggcgtggcccacagcatcaatgagctgagccaggtgcccccacctgtgatgctgctgcctgatgacttcaaggccagcagcaagatcaaggtgaacaaccacctgttccaccgggagaacctgcccagccacttcaagttcaaggagtactgcccccaggtgttcaggaacctgcgggacagatttggaattgatgaccaggactacctggtgtccctgaccaggaacccccccagcgagagcgagggcagtgatggccgcttcctgatctcctatgacaggaccctggtgatcaaggaggtgtccagtgaagatattgctgacatgcacagcaacctgagcaactaccaccagtacatcgtgaagtgccacggcaacaccctgctgccccagttcctgggcatgtacagagtgtctgtggacaatgaagacagctacatgctggtgatgaggaacatgttcagccaccggctgcctgtgcacaggaaatatgacctgaagggcagcctggtgtcccgggagcccgccatcaggaagaggctgaagaactgcccccccctgcgcatctggaccttcagcaccaggaccaggaagtacatcctggtgaagagaagaaggaagtacttctggaggagctag

SEQ ID NO: 21292 - DNA, 462 bp, Artificial Sequence
  Description of Artificial Sequence: Synthetic coding sequence
atgagccctgaggtggccctgaaccgcatcagccccatgctgagccccttcatcagctctgtggtgagaaatggcaaggtgggcctggatgccaccaactgcctgcgcatcacagacctgaagagcggctgcaccagcctgaccccaggccccaactgtgaccgcttcaagctgcacatcccctatgctggggagaccctgaagtgggacatcatcttcaatgcccagtacccagagctgcccccagacttcatctttggagaagatgctgagttcctgcctgaccccagcgccctgcagaacctggcctcctggaaccccagcaacccagaatgtctgctgctggtggtgaaggagctggtgcagcagtaccaccagttccagtgcagccggctgcgggagagcagccggctgatgtttgagtaccagaccctgctggaggagccccagtatggagagtag

SEQ ID NO: 21293 - DNA, 78 bp, Artificial Sequence
  Description of Artificial Sequence: Synthetic coding sequence
atggagctgcgctgtggcggcctgctcttcagcagcagatttgacagcggcaacctggcccacgtggagaaggtgtag

SEQ ID NO: 21294 - DNA, 228 bp, Artificial Sequence
  Description of Artificial Sequence: Synthetic coding sequence
atggccagcgaggtgggccacaacctggagagccctgagaccccaggcggcggcggctggaccagggtggagttccccccaccagcccccaagggagctgccaccgtgtggtgcctgaaccggctgggcagcaggaagctgagcctcatctggatcaccttcaacacaggctggaacatgaagagccgcctcatcatcctgatccagcaggtgtcctgccaccactag

SEQ ID NO: 21295 - DNA, 1620 bp, Artificial Sequence; identical to SEQ ID NO: 19050
  Description of Artificial Sequence: Synthetic coding sequence

SEQ ID NO: 21296 - DNA, 390 bp, Artificial Sequence
  Description of Artificial Sequence: Synthetic coding sequence
atgcctggcctgagctgccgcttctaccagcacaagtttcctgaggtggaggatgtggtgatggtgaatgtgcgcagcattgctgagatgggcgcctacgtgtccctgctggagtacaacaacatcgagggcatgatcctgctgtctgagctgagcagaagacgcatccgcagcatcaacaagctgatcagaattggaagaaatgaatgtgtggtggtgatccgggtggacaaggagaagggctacatcgacctgagcaagaggcggctgaccctgtgggagacagagagcaacctgaggaacacagagcagcgcttcctggccgtgaacccccggctggagagcttccctgtgctgaagaccagcaagctgaacatcttctacttctag

SEQ ID NO: 21297 - DNA, 1842 bp, Artificial Sequence; identical to SEQ ID NO: 18580
  Description of Artificial Sequence: Synthetic coding sequence

SEQ ID NO: 21298 - DNA, 1983 bp, Artificial Sequence
  Description of Artificial Sequence: Synthetic coding sequence
attgccaagccccagggcacctaccaggtgctgccccccaacacaggcagcctgtacatcgacaaggactgcagcgctgtgtactgccacgagagcagcagcaacatctactaccccttccagaagcgggagcagctgcgggccggccgctacatcatgaggcacaccagcgaggtgatctgtgaggtgctggaccctgagggcaacaccttccaggtgatggctgatggcagcatcagcaccatcctgcctgagaagaagctggaggatgacctgaatgagaagacagagggctatgacagcctgagctccatgcacctggagaagaaccaccagcagatctatggagagcacgtgccccgcttctttgtgatgtatgcagatggcagcggcatggagctgctgcgggacagcgacatcgaggagtacctgagcctggcctacaaggagagcaacacagtggtgctgcaggagcctgtgcaggagcagcccggcaccctgaccatcaccgtgctgcggcccttccacgaggccagcccctggcaggtgaagaaggaggacaccatcgtgccccccaacctgcggagccgctcctgggagaccttccccagcgtggagaagaagaccccaggcccccccttcggcacccagatctggaagggcctgtgcatcgagagcaagcagctggtgtctgcccctggggccatcctgaagagccccagcgtgctgcagatgaggcagttcatccagcatgaagtcatcaagaatgaggtgaagctgcggctgcaggtgtccctgaaggactacatcaactacatcctgaagaaggaggatgagctgcaggagatgatggtgaaggacagcaggacagaggaggagagaggaaatgctgctgacctgctgaagctggtgatgtccttccccaagatggaggagaccaccaagagccacgtgacagaggtggccgcccacctgacagacctcttcaagcagagcctggccaccccacccaagtgccccccagacaccttcggcaaggacttctttgagaagacctggaggcacacagccagcagcaagcgctggaaggagaagattgacaagaccaggaaggagattgagaccacccagaactacctgatggacatcaagaaccgcatcatcccccccttcttcaagtctgagctgaaccagctgtaccagagccagtacaaccacctggacagcctgagcaagaagctgcccagcttcaccaagaagaatgaagatgccaatgaaacagctgtgcaggacaccagtgacctgaacctggacttcaagccccacaaggtgtctgagcagaagagcagctctgtgcccagcctgcccaagccagagatctctgctgacaagaaggacttcaccgcccagaaccagacagagaacctgaccaagagccctgaggaggccgagagctatgagcctgtgaagatccccacccagagcctgctgcaggatgtggccggccagaccaggaaggagaaggtgaagctgccccactacctgctgagcagcaagcccaagagccagcccctggccaaggtgcaggacagcgtgggcggcaaggtgaacaccagctctgtggccagcgctgccatcaacaatgccaagagcagcctgtttggcttccacctgctgcccagctctgtgaagtttggagtgctgaaggagggccacacctacgccaccgtggtgaagctgaagaatgtgggcgtggacttctgccgcttcaaggtgaagcagcccccacccagcacaggcctgaaggtgacctacaagccaggccctgtggccgccggcatgcagacagagctgaacatcgagctgtttgccacagctgtgggagaagatggagccaagggcagcgcccacatcagccacaacatcgagatcatgacagagcacgaggtgctcttcctgcctgtggaggccaacatcctgtag

SEQ ID NO: 21299 - DNA, 2475 bp, Artificial Sequence
  Description of Artificial Sequence: Synthetic coding sequence
atgtacagcaatgaagacagccggcagaccatcgtgtacagcgaggagagcaacaccaccatgagctacacccagaagatcaccaaccccctgcctgctgccagcagcacagatcctgccccctttgccaacatcaacacccctgtgctgcaggaggactaccggcaggacagccagacccggcgcatcagcaccctgaagctgacccacaaccaggacctgggcagcagcagccccatcagcaccccccagttcagcaagtctgtggaggtgcccagcttcctgaagaggcccaggagcctgacccccaaccctgtgcctgagacccacacagccagcctgagcatccagatcgcccccctgagcggccaggacctggagagccacaagcagctgcctgagctgagccctgagacagccaagatccccctgcagcaggagcggcagaagtctgctgtggccgccgccagccagagcagtgactgccgggtgtcccagatcaccgtgaatggaaattctggaggagctgtgagccccatgagctactaccagaggcccttcagccccagcgcctacagcctgcctgccagcctgaacagcagcatcgtgatgcagcacggcaccagcctggacagcacagacacctacccccagcacgcccagagcctggatggcaccaccagcagcagcatccccctgtaccgcagcagcgaggaggagaagagggtgaccgtcatcaaggccccccactacccaggcatcggccctgtggatgagagcggcatccccacagccatccgcaccaccgtggaccggcccaaggactggtacaagaccatgttcaagcagatccacatggtgcacaagccagatgatgacacagacatgtacaacaccccctacacctacaatgccggcctgtacaaccccccctacagcgcccagagccaccctgctgccaagacccagacctaccggcccctgagcaagagccacagcgacaacagccccaatgccttcaaggatgccagcagccctgtgcccccacctcatgtgcccccacctgtgccccccctgcggccccgggacaggagcagcacagagaagcatgactgggaccccccagacaggaaggtggacaccaggaagttccgctctgagcccaggagcatctttgaatatgagcccgggaagagcagcatcctgcagcacgagcggcccccacccctgcccaccacccccacccctgtgccccgggagcccggcaggaagcccctgagcagcagccggctgggggaggtgacaggcagccccagccccccacccaggtctggggcccccacccccagcagccgggccccagccctgagccccaccaggcctcccaagaagcccctggactatgtgcaggaccacagcagcggggtcttcaatgaggccagcctgtaccagagcagcattgacaggagcctggagcggcccatgagcagcgcctccatggccagtgacttcaggaagaggaggaagtctgagcctgctgtgggccccccccggggcctgggggaccagagcgccagcaggaccagccctggccgggtggacctgcccggcagcagcaccaccctgaccaagagcttcaccagcagcagccccagcagccccagccgggccaaggaccgggagagccccaggagctacagcagcaccctgacagacatgggccgcagcgccccccgggagcggcggggcaccccagagaaggagaagctgcctgccaaggctgtgtatgacttcaaggcccagaccagcaaggagctgtccttcaagaagggggacacagtgtacatcctgaggaagattgaccagaactggtatgaaggagagcaccacggccgggtgggcatcttccccatctcctatgtggagaagctgaccccacctgagaaggcccagcctgcccggcccccacctccagcccagcctggagagatcggggaggccatcgccaagtacaacttcaatgctgacaccaacgtggagctgagcctgaggaaaggagacagagtcatcctgctgaagagggtggaccagaactggtatgagggcaagatccctggcaccaaccggcagggcatcttccctgtgtcctatgtggaggtggtgaagaagaacaccaagggagctgaggactacccagacccccccatcccccacagctacagcagtgaccgcatccacagcctgagcagcaacaagccccagaggcctgtgttcacccatgagaacatccagggcggcggggagcccttccaggccctgtacaactacaccccaagaaatgaagatgagctggagctgcgggagagtgatgtgattgatgtgatggagaagtgtgatgatggctggtttgtgggcaccagcaggaggaccaagttcttcggcaccttccctggcaactacgtgaagaggctgtag

SEQ ID NO: 21300 - DNA, 228 bp, Artificial Sequence
  Description of Artificial Sequence: Synthetic coding sequence
atgagatactacggcagctactaccggggcctgggctacggctgcggcggctttggaggcctgggctacggctgcggctgcggcggctaccgctatggcagcggctacggcggctaccgctatggctgctgccggcccagctgccgggagggctacggcttcagcggcttcaagaagctggccgacagccacaccctgacccccaggagctgcccctatgccagctag

SEQ ID NO: 21301 - DNA, 183 bp, Artificial Sequence
  Description of Artificial Sequence: Synthetic coding sequence
atggtgctgatcctgggccgccgcctgaaccgggaggacctgggcgtgcgggacagccctgccaccaagaggaaggtgtttgagatggaccccaagagcctgactggacatgagttctttgacttcagcagcggcagcagccatgctgagaacatcctgcagatcttcaatgagttcagatag

SEQ ID NO: 21302 - DNA, 600 bp, Artificial Sequence
  Description of Artificial Sequence: Synthetic coding sequence
atgaagctgggcaagaagcccatgtacaagcctgtggacccctacagcaggatgcagagcacctacaactacaacatgaggggcggggcctacccaccccgctacttctaccccttccctgtgccccccctgctgtaccaggtggagctgtctgtgggcggccagcagttcaacgggaagggcaagacccggcaggccgccaagcatgatgctgctgccaaggccctgcgcatcctgcagaatgagcccctgcctgagcggctggaggtgaatggccgggagagcgaggaggagaacctgaacaagtctgagatcagccaggtgtttgaaattgccctgaagaggaacctgcctgtgaactttgagagcttccccctgaagcaggtggcccgggagagcggccccccccacatgaagaactttgtgaccaaggtgtctgtgggggagtttgtgggggagggggagggcaagagcaagaagatcagcaagaagaatgctgccatcgctgtgctggaggagctgaagaagctgccccccctgcctgctgtggagcgggtgaagccccgcatcaagaagaagaccaagcccatcgtgaagtag

SEQ ID NO: 21303 - DNA, 2685 bp, Artificial Sequence
  Description of Artificial Sequence: Synthetic coding sequence
atgcctgagcagttctctgtggccgagttcctggccgtgacagctgaggacctgagcagccctgctggagctgctgcctttgctgccaagatgccccgctacagaggagctgccctggcccgggaggagatcctggagggggaccaggccatcctgcagaggatcaagaaggctgtgcgggccatccacagcagcggcctgggccacgtggagaatgaggagcagtaccgggaggccgtggagagcctgggcaacagccacctgagccagaacagccatgagctgagcacaggcttcctgaacctggccgtgttcacccgggaggtggccgccctcttcaagaacctgatccagaacctgaacaacatcgtgtccttccccctggacagcctgatgaagggccagctgagagatggccggcaggccagcctgagcctgggcagccgggccaagctggagaaggagcgggaccgggcccgggtgactggaggcatccctggagaggtggcccaggacatgcagcgggagcggcgcatcttccagctgcacatgtgtgagtacctgctgaaggccggggagagccagatgaagcagggccctgacttcctgcagagcctcatcaagttcttccacgcccagcacaacttcttccaggacggctggaaggccgcccagagcctcttccccttcatcgagaagctggccgcctctgtgcacgccctgcaccaggcccaggaggatgagctgcagaagctgacccagctgcgggacagcctgcggggcaccctgcagctggagagccgggaggagcacctgagcaggaagaacagcggctgcggctacagcatccaccagcaccagggcaacaagcagtttggaacagagaaggtgggcttcctgtacaagaagagtgatggcatccggcgggtgtggcagaagaggaaatgtggggtgaagtatggctgcctgaccatcagccacagcaccatcaacagacctcctgtgaagctgaccctgctgacctgccaggtgcggcccaaccctgaggagaagaagtgctttgacctggtgacccacaacagaacctaccacttccaggccgaggatgaacatgaatgtgaggcctgggtgtctgtgctgcagaacagcaaggatgaggccctgagcagcgccttcctgggggagcccagcgctggccctggctcctggggcagcgctggccatgatggagagccccatgacctgaccaagctgctgattgctgaggtgaagagcaggcctggcaacagccagtgctgtgactgtggggctgctgaccccacctggctgagcaccaacctgggcgtgctgacctgcatccagtgcagcggcgtgcaccgggagctgggcgtgcgcttcagcaggatgcagagcctgaccctggacctgctgggccccagcgagctgctgctggccctgaacatgggcaacaccagcttcaatgaggtgatggaggcccagctgcccagccacggcggccccaagcccagcgctgagagtgacatgggcacccggcgggactacatcatggccaagtatgtggagcacagatttgcccggcgctgcaccccagagccccagaggctgtggacagccatctgcaacagagacctgctgtctgtgctggaggcctttgccaacggccaggactttggccagcccctgcccggcccagatgcccaggcccctgaggagctggtgctgcacctggccgtgaaggtggccaaccaggccagcctgcccctggtggacttcatcatccagaatggaggccacctggatgccaaggctgctgatggcaacacagccctgcactacgccgccctgtacaaccagcctgactgcctgaagctgctgctgaagggccgggccctggtgggcaccgtgaatgaagctggggagacagccctggacatcgccaggaagaagcaccacaaggaatgtgaggagctgctggagcaggcccaggccggcacctttgccttccccctgcacgtggactacagctgggtgatcagcacagagcccggcagtgacagtgaagaagatgaggaggagaagcgctgcctgctgaagctgcctgcccaggcccactgggccagcggccgcctggacatcagcaacaagacctatgagaccgtggccagcctgggcgccgccaccccccagggcgagagcgaggactgccccccacccctgcctgtgaagaacagcagcaggaccctggtgcagggctgtgcccggcatgccagcggggacagaagtgaggtgagcagcctgagcagcgaggcccctgagaccccagagagcctgggcagccctgccagcagcagcagcctgatgagccccctggagcccggggaccccagccaggccccacccaacagcgaggagggcctgcgggagcccccaggcaccagccggcccagcctgaccagcggcaccaccccatctgagatgtacctgcctgtgcgcttcagcagcgagagcaccaggagctaccgccgcggggcccggagcccagaagatggccccagcgcccggcagcccctgcccaggagaaatgtgcctgtgggcatcacagaaggagatggcagcaggacaggcagcctgcctgccagctctgtgcagctgctgcaggactag

SEQ ID NO: 21304 - DNA, 354 bp, Artificial Sequence; identical to SEQ ID NO: 20811
  Description of Artificial Sequence: Synthetic coding sequence

SEQ ID NO: 21305 - DNA, 1797 bp, Artificial Sequence
  Description of Artificial Sequence: Synthetic coding sequence
atgtttgtgtctgacttcaggaaggagttctatgaggtggtgcagagccagagggtgctgctgtttgtggccagtgatgtggatgccctgtgtgcctgcaagatcctgcaggccctcttccagtgtgaccacgtgcagtacaccctggtgcctgtgtctggctggcaggagctggagacagccttcctggagcacaaggagcagttccactacttcatcctgatcaactgtggggccaacgtggacctgctggacatcctgcagccagatgaggacaccatcttctttgtgtgtgacacccacaggcctgtgaatgtggtgaatgtgtacaatgacacccagatcaagctgctgatcaagcaggatgatgacctggaggtgcctgcctatgaggacatcttcagagatgaggaggaggatgaggagcacagcggaaatgacagtgatggcagcgagcccagcgagaagaggacccggctggaggaggagatcgtggagcagaccatgagaagacggcagaggcgggagtgggaggcccggagcggcagcggcagcgagcctgtggccgccgccctggagaagagcagccggctgtttgctggccccatgtctgacagaacagcccccaggagcccccggcgggacatcctgtttgattatgagcagtatgagtaccacggcaccagcagcgccatggtgatgtttgagctggcctggatgctgagcaaggacctgaatgacatgctgtggtgggccatcgtgggcctgacagaccagtgggtgcaggacaagatcacccagatgaagtatgtgacagatgtgggcgtgctgcagagacatgtgagccgccacaaccacagaaatgaagatgaggagaacaccctgtctgtggactgcacccgcatcagctttgaatatgacctgcggctggtgctgtaccagcactggagcctgcatgacagcctgtgcaacaccagctacacagctgcccgcttcaagctgtggagcgtgcacggccagaagaggctgcaggagttcctggccgacatgggcctgcccctgaagcaggtgaagcagaagttccaggccatggacatcagcctgaaggagaacctgcgggagatgattgaggagagcgccaacaagtttggcatgaaggacatgagggtgcagaccttcagcatccacttcggcttcaagcacaagttcctggccagtgatgtggtgtttgccaccatgagcctgatggagagccctgagaaggatggcagcggcacagaccacttcatccaggccctggacagcctgagccgcagcaacctggacaagctgtaccacggcctggagctggccaagaagcagctgcgggccacccagcagaccatcgccagctgcctgtgcaccaacctggtgatcagccagggccccttcctgtactgcagcctgatggagggcaccccagatgtgatgctgttcagcaggcctgccagcctgagcctgctgagcaagcacctgctgaagagctttgtgtgcagcaccaagaacagacgctgcaagctgctgcccctggtgatggccgcccccctgtccatggagcacggcaccgtgacagtggtgggcatccccccagagacagacagcagtgacaggaagaacttcttcggccgggcctttgagaaggctgctgagagcaccagcagcaggatgctgcacaaccactttgacctgtctgtgattgagctgaaggccgaggacaggagcaagttcctggatgccctgatcagcctgctgtcctag

SEQ ID NO: 21306 - DNA, 2994 bp, Artificial Sequence
  Description of Artificial Sequence: Synthetic coding sequence
atgcccagcgagaagaagatcagcagcgccaatgactgcatctccttcatgcaggccggctgtgagctgaagaaggtgcggcccaacagccgcatctacaaccgcttcttcaccctggacacagacctgcaggccctgcgctgggagcccagcaagaaggacctggagaaggccaagctggacatcagcgccatcaaggagatccggctgggcaagaacacagagaccttcaggaacaacggcctggccgaccagatctgtgaggactgtgccttcagcatcctgcacggggagaactatgagagcctggacctggtggccaacagcgcagatgtggccaacatctgggtgtctggcctgcgctacctggtgagccgcagcaagcagcccctggacttcatggagggcaaccagaacaccccccgcttcatgtggctgaagacagtgtttgaggccgcagatgtggatggaaatggcatcatgctggaggacacctctgtggagctgatcaagcagctgaaccccaccctgaaggaggccaagatccggctgaagttcaaggagatccagaagagcaaggagaagctgaccaccagggtgacagaggaggagttctgtgaggccttctgtgagctgtgcaccaggcctgaggtgtacttcctgctggtgcagatcagcaagaacaaggagtacctggatgccaatgacctgatgctgttcctggaggccgagcagggcgtgacccacatcacagaggacatctgcctggacatcatccgccgctatgagctgtctgaggagggccggcagaagggcttcctggccattgatggcttcacccagtacctgctgagcagtgaatgtgacatctttgatcctgagcagaagaaggtggcccaggacatgacccagcccctgagccactactacatcaatgccagccacaacacctacctgattgaggaccagttccggggccctgctgacatcaatggctacatccgggccctgaagatgggctgccgctctgtggagctggatgtgtctgatggcagtgacaatgagcccatcctgtgcaacagaaacaacatgaccacccacgtgtccttccgcagcgtcatcgaggtgatcaacaagtttgcctttgtggccagcgagtaccccctcatcctgtgcctgggcaaccactgcagcctgccccagcagaaggtgatggcccagcagatgaagaaggtgtttggaaacaagctgtacacagaggcccccctgcccagcgagagctacctgcccagccctgagaagctgaagaggatgatcatcgtgaagggcaagaagctgcccagcgaccctgatgtgctggagggggaggtgacagatgaagatgaggaggccgagatgagcaggaggatgtctgtggactacaatggagagcagaagcagatccggctgtgccgggagctgagtgacctggtgtccatctgcaagtctgtgcagtacagagactttgagctgtccatgaagagccagaactactgggagatgtgcagcttcagcgagacagaggccagcagaattgccaatgagtacccagaagattttgtgaactacaacaagaagttcctgagccgcatctaccccagcgccatgagaattgacagcagcaacctgaacccccaggacttctggaactgtggctgccagatcgtggccatgaacttccagaccccaggccccatgatggacctgcacacaggctggttcctgcagaatggaggctgcggctacgtgctgcggcccagcatcatgagagatgaggtgtcctacttcagcgccaacaccaagggcatcctgcccggggtgagccccctggccctgcacatcaagatcatcagcggccagaacttccccaagcccaagggggcctgtgccaagggagatgtgattgacccctacgtgtgcatcgagatccacggcatcccagctgactgcagcgagcagaggaccaagacagtgcagcagaacagcgacaaccccatctttgatgagacctttgagttccaggtgaacctgcctgagctggccatgatccgctttgtggtgctggatgatgactacatcggagatgagttcatcggccagtacaccatcccctttgaatgtctgcagcccggctacagacatgtgcccctgcggagctttgtgggggacatcatggagcacgtgaccctgtttgtgcacatcgccatcaccaacagaagtggcggcggcaaggcccagaagaggagcctgtctgtgaggatgggcaagaaggtgcgggagtacaccatgctgaggaacatcggcctgaagaccattgatgacatcttcaagattgctgtgcaccccctgcgggaggccatcgacatgagggagaacatgcagaatgccatcgtgtccatcaaggagctgtgtggcctgccccccatcgccagcctgaagcagtgcctgctgaccctgagcagccgcctcatcaccagtgacaacacccccagcgtgtccctggtgatgaaggacagcttcccctacctggagcccctgggcgccatcccagatgtgcagaagaagatgctgacagcctatgacctgatgatccaggagagccgcttcctgattgagatggctgacacagtgcaggagaagatcgtgcagtgccagaaggccggcatggagttccacgaggagctgcacaacctgggcgccaaggagggcctgaagggcaggaagctgaacaaggccacagagagctttgcctggaacatcaccgtgctgaagggccagggcgacctgctgaagaatgccaagaatgaggccatcgagaacatgaagcagatccagctggcctgcctgagctgtggcctgagcaaggcccccagcagcagcgctgaggccaagagcaagaggagcctggaggccatcgaggagaaggagagcagtgaagaaaatggcaagctgtag

SEQ ID NO: 21307 - DNA, 612 bp, Artificial Sequence
  Description of Artificial Sequence: Synthetic coding sequence
atgagaaatggagacttcctgcccacccggctgcaggcccagcaggatgctgtgaacatcgtgtgccacagcaagaccaggagcaacccagaaaataatgtgggcctcatcaccctggccaatgactgtgaggtgctgaccaccctgaccccagacaccggccgcatcctgagcaagctgcacacagtgcagcccaagggcaagatcaccttctgcaccggcatccgggtggcccacctggccctgaagcaccggcagggcaagaaccacaagatgaggatcatcgcctttgtgggcagccctgtggaggacaatgagaaggacctggtgaagctggccaagaggctgaagaaggagaaggtgaatgtggacatcatcaactttggagaggaggaggtgaacacagagaagctgacagcctttgtgaacaccctgaatggcaaggatggcaccggcagccacctggtgacagtgcccccaggccccagcctggctgatgccctgatcagcagccccatcctggccggggagggcggggccatgctgggcctgggcgccagtgactttgaatttggagtggaccccagcgctgaccctgagctggccctgtag

SEQ ID NO: 21308 - DNA, 429 bp, Artificial Sequence; identical to SEQ ID NO: 19383
  Description of Artificial Sequence: Synthetic coding sequence

SEQ ID NO: 21309 - DNA, 1410 bp, Artificial Sequence
  Description of Artificial Sequence: Synthetic coding sequence
atgtgcagcctggccagcggggccaccggctacagccacctgctgaagaagcacttccacacagtgtccctgagcatcagcctcatcctgacagcctggttcatcaacatgaaccccaccgtggagtacatgaacagcatctacaaccctgtgccctgggagaaggaggagtacctgaagcctgtgctggaggatgacctgctgctgcagtttgatgtggaggacctgtatgagcctgtgtctgtgcccttctcctaccccaacggcctgtctgagaacacctctgtggtggagaagctgaagcacatggaggcccgggccctgtctgctgaggccgccctggcccgggcccgggaggacctgcagaagatgaagcagtttgcccaggactttgtgatgcacacagatgtgaggacctgcagcagcagcacctctgtgattgctgacctgcaggaggatgaagatggagtgtacttcagcagctatggccactacggcatccacgaggagatgctgaaggacaagatcagaacagagagctacagagacttcatctaccagaacccccacatcttcaaggacaaggtggtgctggatgtgggctgcggcaccggcatcctgtccatgtttgctgccaaggccggggccaagaaggtgctgggcgtggaccagagcgagatcctgtaccaggccatggacatcatccggctgaacaagctggaggacaccatcaccctcatcaagggcaagattgaggaggtgcacctgcctgtggagaaggtggatgtgatcatcagcgagtggatgggctacttcctgctgtttgagagcatgctggacagcgtgctgtatgccaagaacaagtacctggccaagggcggctctgtgtacccagacatctgcaccatcagcctggtggccgtgtctgatgtgaacaagcatgctgaccgcatcgccttctgggatgatgtgtatggcttcaagatgagctgcatgaagaaggctgtgattcctgaggccgtggtggaggtgctggaccccaagaccctcatcagcgagccctgtggcatcaagcacatcgactgccacaccaccagcatcagtgacctggagttcagcagtgacttcaccctgaagatcaccaggacctccatgtgcacagccatcgccggctactttgacatctactttgagaagaactgccacaacagagtggtgttcagcacaggcccccagagcaccaagacccactggaagcagacagtgttcctgctggagaagcccttctctgtgaaggccggggaggccctgaagggcaaggtgacagtgcacaagagcaagaaggaccccaggagcctgactgtgaccctgaccctgaacaacagcacccagacctacggcctgcagtag

SEQ ID NO: 21310 - DNA, 525 bp, Artificial Sequence
  Description of Artificial Sequence: Synthetic coding sequence
atggccagcgctggcacccagcactacagcatcggcctgcggcagaagaacagcttcaagcagagcggccccagcggcaccgtgcctgccaccccacctgagaagcccagcgagggccgggtgtggccccaggcccaccagcaggtgaagcccatctggaagctggagaagaagcaggtggagaccctgtctgctggcctgggccctggcctgctgggcgtgcccccccagcctgcctacttcttctgccccagcaccctgtgcagcagcggcaccacagctgtgattgctggccacagcagcagctgctacctgcacagcctgcctgacctcttcaacagcaccctgctgtacagaagaagcagctaccggcagaagccctaccagcagctggagagcttctgcctgcggagcagccccagcgagaagagccccttcagcctgccccagaagagcctgcctgtgtccctgacagccaacaaggccaccagctccatggtgttctccatggcccagcccatgtag

SEQ ID NO: 21311 - DNA, 1572 bp, Artificial Sequence
  Description of Artificial Sequence: Synthetic coding sequence
atgcagaaggagcgggagctgcaggagaccatctacttcaagaacacctggccagcctgcatgttcctgattgtggcccccctgtctgtgctgtacaactggaaggatgagctggacacctggggctacttccgggtgacagtgctgcacggcaacaggaaggacaatgagctgatccgggtgaagcagaggaaatgtgagatcgccctgaccacctatgagaccctgcggctgtgcctggatgagctgaacagcctggagtggagcgctgtgattgtggatgaggcccaccgcatcaagaaccccaaggcccgggtgacagaggtgatgaaggccctgaagtgcaatgtgagaattggcctgaccggcaccatcctgcagaacaacatgaaggagctgtggtgtgtgatggactgggccgtgcccggcctgctgggcagcggcacctacttcaagaagcagttcagtgaccctgtggagcacggccagaggcacacagccaccaagcgggagctggccaccggcaggaaggccatgcagaggctggccaagaagatgagcggctggttcctgcggaggaccaagaccctcatcaaggaccagctgcccaagaaggaggacaggatggtgtactgcagcctgacagacttccagaaggctgtgtaccagacagtgctggagacagaagatgtgaccctcatcctgcagagcagcgagccctgcacctgccgcagcggccagaagagaagaaactgctgctacaagaccaacagccatggagagaccgtgaagaccctgtacctgagctacctgactgtgctgcagaaggtggccaaccacgtggccctgctgcaggccgccagcaccagcaagcagcaggagaccctcatcaagaggatctgtgaccaggtgttcagccgcttcccagactttgtgcagaagagcaaggatgctgcctttgagaccctgagtgaccccaagtacagcggcaagatgaaggtgctgcagcagctgctgaaccactgcaggaagaacagagacaaggtgctgctcttctccttcagcaccaagctgctggatgtgctgcagcagtactgcatggccagcggcctggactaccgccgcctggatggcagcaccaagtctgaggagcggctgaagatcgtgaaggagttcaacagcacccaggatgtgaacatctgcctggtgtccaccatggccggcggcctgggcctgaactttgtgggcgccaacgtggtggtgctgtttgaccccacctggaacccagccaatgacctgcaggccatcgaccgggcctaccgcatcggccagtgcagagatgtgaaggtgctgcggctcatcagcctgggcaccgtggaggagatcatgtacctgcggcagatctacaagcagcagctgcactgtgtggtggtgggctctgaaaatgccaagcgctactttgaagctgtgcagggcagcaaggagcaccagggcgagctgtttggcatccacaacctcttcaagttccgcagccagggcagctgcctgaccaaggacatcctggaggtgtag

SEQ ID NO: 21312 - DNA, 1179 bp, Artificial Sequence; identical to SEQ ID NO: 20458
  Description of Artificial Sequence: Synthetic coding sequence

SEQ ID NO: 21313 - DNA, 1566 bp, Artificial Sequence
  Description of Artificial Sequence: Synthetic coding sequence
atggagcagagcagcctgtacttctgggacctgctggagggcagcgagaaggctgtggtgggcaccacctacaagcacctgaaggacctgctgagcaagctgctgaacagcggctactttgagagcatccctgtgcccaagaatgccaaggagaaggaggtgcccctggaggaggagatgctgatccagagcgagaagaagacccagctgagcaagacagaatctgtgaaggagagcgagagcctgatggagtttgcccagcctgagatccagccccaggagttcctgaacagacgctacatgacagaggtggactacagcaacaagcagggcgaggagcagccctgggaggccgactatgccaggaagcccaacctgcccaagcgctgggacatgctgacagagccagatggccaggagaagaagcaggagagcttcaagtcctgggaggccagcggcaagcaccaggaggtgtccaagccagctgtgtccctggagcagaggaagcaggacaccagcaagctgcggagcaccctgcctgaggagcagaagaagcaggagatcagcaagagcaagcccagccccagccagtggaagcaggacacccccaagagcaaggccggctacgtgcaggaggagcagaagaagcaggagacccccaagctgtggcctgtgcagctgcagaaggagcaggaccccaagaagcagacccccaagtcctggacccccagcatgcagagcgagcagaacaccaccaagtcctggaccacccccatgtgtgaggagcaggacagcaagcagcctgagacccccaagtcctgggagaacaacgtggagagccagaagcacagcctgaccagccagagccagatcagccccaagtcctggggcgtggccacagccagcctcatccccaatgaccagctgctgcccaggaagctgaacacagagcccaaggatgtgcccaagcctgtgcaccagcctgtgggcagcagcagcaccctgcccaaggaccctgtgctgaggaaggagaagctgcaggacctgatgacccagatccagggcacctgcaacttcatgcaggagagcgtgctggactttgacaagcccagcagcgccatccccaccagccagcccccatctgccaccccaggcagccctgtggccagcaaggagcagaacctgagcagccagagcgacttcctgcaggagcccctgcaggccgccatccccccaggcaagcagcccagcagcctggccagccccaacccccccatggccaagggcagcgagcagggcttccagagccccccagccagcagcagctctgtgaccatcaacacagcccccttccaggccatgcagaccgtcttcaacgtgaatgcccccctgccccccaggaaggagcaggagatcaaggagagcccctacagccctggctacaaccagagcttcaccacagccagcacccagaccccaccccagtgccagctgcccagcatccacgtggagcagacagtgcacagccaggagacagcccctggcaaccaccacagcaccttctag

SEQ ID NO: 21314 - DNA, 480 bp, Artificial Sequence; identical to SEQ ID NO: 20848
  Description of Artificial Sequence: Synthetic coding sequence

SEQ ID NO: 21315 - DNA, 270 bp, Artificial Sequence; identical to SEQ ID NO: 20498
  Description of Artificial Sequence: Synthetic coding sequence

SEQ ID NO: 21316 - DNA, 1356 bp, Artificial Sequence
  Description of Artificial Sequence: Synthetic coding sequence
atggccgagggcgcccagccccaccagcccccccagctgggccctggagctgctgcccggggcatgaagcgggagagcgagctggagctgcctgtgcctggagctggaggagatggagctgaccccggcctgagcaagaggcccaggacagaggaggccgctgctgatggcggcggcggcatgcagaatgagcccctgaccccaggctaccacggcttccctgcccgggacagccagggcaaccaggagcccaccaccaccccagatgccatggtgcagcccttcaccaccatccccttccccccaccaccccagaatggcatccccacagaatatggagtgccccacacccaggactatgccggccagacaggagagcacaacctgaccctgtatggcagcacccaggcccacggggagcagagcagcaacagccccagcacccagaatggcagcctgacccagacagagggcggggcccagacagatggccagcagagccagacccagagcagtgaaaattctgagagcaagagcacccccaagaggctgcacgtgagcaacatccccttccgcttccgggaccctgacctgcggcagatgtttggccagtttgggaagatcctggatgtggagatcatcttcaatgaaagaggcagcaaaggatttggatttgtgacctttgaaaattctgcagatgctgaccgggcccgggagaagctgcacggcaccgtggtggagggcaggaagattgaggtgaacaatgccacagcccgggtgatgaccaacaagaagatggtgaccccctatgccaacggctggaagctgagccctgtggtgggcgctgtgtatggccctgagctgtatgctgccagcagcttccaggctgatgtgtccctgggcaatgatgctgctgtgcccctgagcggccggggcggcatcaacacctacatccccctcatcagcctgcccctggtgcccggcttcccctaccccacagctgccaccacagctgctgccttccggggggcccacctgcggggccggggccgcacagtgtatggagctgtgcgggctgtgcccccaacagccatcccagcctacccaggagtggtgtaccaggacggcttctacggggctgacctgtatggaggctatgctgcctaccgctatgcccagcctgccacagccacagctgccacagctgctgctgctgctgctgctgcctacagtgatggctacggccgggtgtacacagctgacccctaccacgccctggccccagctgccagctatggagtgggcgctgtggccagcctgtacagaggaggctacagcagatttgccccctactag

SEQ ID NO: 21317 - DNA, 855 bp, Artificial Sequence
  Description of Artificial Sequence: Synthetic coding sequence
atgttcagccgccgcagccatggagatgtgaagaagagcacccagaaggtgctggaccccaagaaggatgtgctgacccggctgaagcacctgcgggccctgctggacaacgtggatgccaatgacctgaagcagttctttgagaccaactacagccagatctacttcatcttctatgagaacttcatcgccctggagaacagcctgaagctgaagggcaacaacaagagccagcgggaggagctggacagcatcctcttcctgtttgagaagatcctgcagttcctgcctgagcgcatcttcttccgctggcactaccagagcatcggcagcaccctgaagaagctgctgcacactggaaacagcatcaagatccgctgtgagggcatccgcctcttcctgctgtggctgcaggccctgcagaccaactgtgccgaggagcaggtgctgatctttgcctgcctggtgcccggcttccctgctgtgatgagcagccggggcccctgcaccctggagaccctcatcaaccccagccccagcgtggctgatgtgaagatctacccagaggagatcacccccctgctgcctgccatctctggagagaagattgctgaggaccagacctgcttcttcctgcagatcctgctgaagtacatggtgatccaggccgccagcctggagtggaagaacaaggagaaccaggacaccggcttcaagttcctgttcaccctcttcaggaagtactacctgccccacctgttccccagcttcaccaagctgaccaacatctacaagcctgtgctggacatcccccacctgcggcccaagcctgtgtacatcaccaccaccaggtag

SEQ ID NO: 21318 - DNA, 846 bp, Artificial Sequence
  Description of Artificial Sequence: Synthetic coding sequence
atgggagacacagtggtggagcccgcccccctgaagcccaccagcgagcccaccagcggccccccaggcaacaatggaggcagcctgctgagcgtcatcacagagggcgtgggggagctgtctgtgattgatcctgaggtggcccagaaggcctgccaggaggtgctggagaaggtgaagctgctgcatggaggagtggccgtgagcagccggggcacccccctggagctggtgaatggagatggagtggacagcgagatccgctgcctggatgatcctccagcccagatccgggaggaggaggatgagatgggcgctgctgtggccagcggcacagccaagggggccaggagaagacggcagaacaacagcgccaagcagagctggctgctgcggctgtttgagagcaagctgtttgacatctccatggccatctcctacctgtacaacagcaaggagcccggggtgcaggcctacatcggcaacagactcttctgcttcagaaatgaagatgtggacttctacctgccccagctgctgaacatgtacatccacatggatgaagatgtgggagatgccatcaagccctacatcgtgcaccgctgccggcagagcatcaacttcagcctgcagtgtgccctgctgctgggcgcctacagcagtgacatgcacatcagcacccagaggcacagccggggcaccaagctgaggaagctgatcctgagtgatgagctgaagccagcccacaggaagcgggagctgcccagcctgagccctgccccagacaccggcctgagccccagcaagaggacccaccagaggagcaagagtgatgccacagcctag

SEQ ID NO: 21319 - DNA, 591 bp, Artificial Sequence; identical to SEQ ID NO: 19409
  Description of Artificial Sequence: Synthetic coding sequence

SEQ ID NO: 21320 - DNA, 1620 bp, Artificial Sequence; identical to SEQ ID NO: 19050
  Description of Artificial Sequence: Synthetic coding sequence

SEQ ID NO: 21321 - DNA, 1086 bp, Artificial Sequence
  Description of Artificial Sequence: Synthetic coding sequence
gtcaccacagagaagacctacaccagcaccagcaacaacagcatcagcggcagcctgaagaggctggaggacaccacagcccgcttcaccaatgccaacttccaggaggtgtctgcccacaccagcagcggcaaggatgtgtctgagacccggggcagcgagggcaagggcaagaagagcagcgcccacagcagcggccagaggggcaggaagccaggcggcggcaggaaccctggcaccaccgtgtctgctgccagccccttcccccaggccggctacaagagggcccagaccagcggcatcgaggaggagaccgtgaaggagaagaagaggaagggcaacaagcagagcaagcacggccctggccggcccaagggcaacaagaaccaggagaatgtgagccacctgtctgtgagcagcgccagccccaccagctctgtggccagcgctgctggcagcatcaccagcagcagcctgcagaagagccccaccctgctgagaaatggcagcctgcagagcctgtctgtgggcagcagccctgtgggcagcgagatctccatgcagtacagacatgatggagcctgccccaccaccaccttcagcgagctgctgaatgccatccacaatgacagaggagacagcagcaccctgaccaagcaggagctgaagttcatcggcatctacaacagcaatgatgtggccgtgtccttccccaacgtggtgtctggcagcggcagcagcacccctgtgagcagcagccacctgccccagcagagcagcggccacctgcagcaggtgggcgccctgagccccagcgctgtgagcagcgctgccccagctgtggccaccacccaggccaacaccctgagcggcagcagcctgagccaggcccccagccacatgtatggcaacagaagcaacagctccatggccgccctgattgcccagagcgagaacaaccagacagaccaggacctgggggacaacagcaggaacctggtgggccggggcagcagcccccggggcagcctgagccccaggagccctgtgagcagcctgcagatccgctatgaccagcccggctag

SEQ ID NO: 21322 - DNA, 426 bp, Artificial Sequence
  Description of Artificial Sequence: Synthetic coding sequence
atggctgctgcccctccttcctactgctttgtggccttccccccccgggccaaggatggcctggtggtgtttgggaagaacagcgcccggcccagagatgaggtgcaggaggtggtgtacttctctgctgctgaccacgagcctgagagcaaggtggagtgcacctacatcagcattgaccaggtgcccaggacctacgccatcatgatcagcaggcctgcctggctgtggggcgctgagatgggcgccaatgagcacggcgtgtgcatcgccaatgaggccatcaacacccgggagcctgctgctgagattgaggccctgctgggcatggacctggtgcggctgggcctggagcggggggagacagccaaggaggccctggatgtgattgtgtccctgctggaggagcacggccagggcggctag

SEQ ID NO: 21323 - DNA, 573 bp, Artificial Sequence
  Description of Artificial Sequence: Synthetic coding sequence
tgacagctggccgccctgaaggagatccaggccgaggtgcaggagaaggagagtgatgctgtgaagcccaagaaccaggacatccagggcggcaaggccgccccagctgaggccctgggcatcccagatgagcactacctggacaacctgtgcatcttctgtggggagaggtctgagagcttcacagaggagggcctggacctgcactactggaagcactgcctgatgctgacccgctgtgaccactgcaagcaggtggtggagatcagcagcctgacagagcacctgctgacagaatgtgacaagaaggatggctttgggaagtgctaccgctgcagcgaggccgtgttcaaggaggagctgcccaggcacatcaagcacaaggactgcaacccagccaagccagagaagctggccaaccgctgccccctgtgccacgagaacttcagccctggagaggaggcctggaaggcccacctgatgggccctgctggctgcaccatgaacctgaggaagacccacatcctgcagaaggccccagccctgcagcccggggagggccagaggaggtag

SEQ ID NO: 21324 - DNA, 723 bp, Artificial Sequence
  Description of Artificial Sequence: Synthetic coding sequence
atgacagtgggcaagagcagcaagatgctgcagcacatcgactacaggatgcgctgcatcctgcaggacggccgcatcttcatcggcaccttcaaggcctttgacaagcacatgaacctgatcctgtgtgactgtgatgagttcaggaagatcaagcccaagaacagcaagcaggccgagcgggaggagaagagggtgctgggcctggtgctgctgcggggggagaacctggtgtccatgacagtggagggccccccacccaaggacaccggcatcgcccgggtgcccctggccggggctgctgggggccctggcatcggccgggccgccggccggggcatcccagctggggtgcccatgccccaggccccagctggcctggccggccctgtgcggggcgtgggcggccccagccagcaggtgatgaccccccagggccggggcaccgtggccgctgctgctgctgctgccacagccagcattgctggggcccccacccagtacccacctggccggggcggccccccaccacccatgggccgcggggcccctcctcctggcatgatgggccccccacctggcatgaggcctcccatgggcccccccatgggcatccccccaggccggggcacccccatgggcatgcctcctcctggcatgaggcctcctcctcctggcatgaggggccccccacctcctggcatgaggcctccccggccctag

SEQ ID NO: 21325 - DNA, 420 bp, Artificial Sequence
  Description of Artificial Sequence: Synthetic coding sequence
atggagacagactgcaaccccatggagctgagctccatgagcggctttgaggagggcagcgagctgaatggatttgagggcacagacatgaaggacatgaggctggaggccgaggccgtggtgaatgatgtgctgtttgctgtgaacaacatgtttgtgtccaagagcctgcgctgtgctgatgatgtggcctacatcaacgtggagaccaaggagaggaaccgctactgcctggagctgacagaagctggcctgaaggtggtgggctacgcctttgaccaggtggatgaccacctgcagaccccctaccacgagaccgtgtacagcctgctggacaccctgagccctgcctaccgggaggcctttggaaatgccctgctgcagaggctggaggccctgaagagagatggccagagctag

SEQ ID NO: 21326 - DNA, 606 bp, Artificial Sequence
  Description of Artificial Sequence: Synthetic coding sequence
atggccggcctggaggtgctgtttgccagcgctgccccagccatcacctgccggcaggatgccctggtgtgcttcctgcactgggaggtggtgacccacggctacttcggcctgggcgtgggggaccagcccggccccaatgacaagaagtctgagctgctgcctgctggctggaacaacaacaaggacctgtatgtgctgcgctatgagtacaaggatggcagcaggaagctgctggtgaaggccatcaccgtggagagctccatgatcctgaatgtgctggagtatggcagccagcaggtggccgacctgaccctgaacctggatgactacattgatgctgagcacctgggggacttccaccgctgtgaccccctgggcccctttgtggtgggcggggaggacctggaccccttcggcccccggcggggcggcatgattgtggaccccctgcggagcggcttcccccgggccctgattgaccccagcagcggcctgcccaaccggctgcccccaggagctgtgcccccaggggccaggtttgaccccttcggccccatcggcaccagccccccaggccccaggccagaccggcggggccagtag

SEQ ID NO: 21327 - DNA, 747 bp, Artificial Sequence; identical to SEQ ID NO: 20797
  Description of Artificial Sequence: Synthetic coding sequence

SEQ ID NO: 21328 - DNA, 1842 bp, Artificial Sequence; identical to SEQ ID NO: 18580
  Description of Artificial Sequence: Synthetic coding sequence

SEQ ID NO: 21329 - DNA, 1620 bp, Artificial Sequence; identical to SEQ ID NO: 19050
  Description of Artificial Sequence: Synthetic coding sequence

SEQ ID NO: 21330 - DNA, 1089 bp, Artificial Sequence
  Description of Artificial Sequence: Synthetic coding sequence
atggcccccaagccaggagctgagtggagcacagccctgagccacctggtgctgggcgtggtgtccctgcatgctgctgtgtccacagctgaggccagcagaggagctgctgctggcttcctgctgcaggtgctggccgccaccaccaccctggcccctggcctgagcacccatgaggactgcctggccggggcctgggtggccaccgtgattggcctgcccctgctggcctttgacttccactggtgcaccaacggccacctgatgtgtgccggctgcttcatccacctgctggctgatgcccggctgaaggaggagcaggccacctgccccaactgccgctgtgagatcagcaagagcctgtgctgcaggaacctggccgtggagaaggctgtgtctgagctgcccagtgaatgtggcttctgcctgcggcagttccccaggagcctgctggagcggcaccagaaggaggagtgccaggacagagtgacccagtgcaagtacaagagaattggctgcccctggcacggccccttccacgagctgactgtgcatgaagctgcctgtgcccaccccaccaagacaggcagcgagctgatggagatcctggatggcatggaccagagccacaggaaggagatgcagctgtacaacagcatcttcagcctgctgagctttgagaagattggctacacagaggtgcagttccggccctacagaacagatgacttcatcacccggctgtactatgagaccccccgcttcaccgtgctgaaccagacctgggtgctgaaggcccgggtgaatgattctgaaagaaaccccaacctgagctgcaagaggaccctgtccttccagctgctgctgaagagcaaggtgacagcccccctggagtgcagcttcctgctgctgaagggcccctatgatgatgtgcgcatcagccctgtgatctaccactttgtgttcaccaatgaaagcaatgaaacagattatgtgcccctgcccatcattgattctgtggagtgcaacaagctgctggccgccaagaacatcaacctgcggctcttcctgttccagatccagaagtag

SEQ ID NO: 21331 - DNA, 273 bp, Artificial Sequence; identical to SEQ ID NO: 21270
  Description of Artificial Sequence: Synthetic coding sequence

SEQ ID NO: 21332 - DNA, 2502 bp, Artificial Sequence
  Description of Artificial Sequence: Synthetic coding sequence
atggctgtggaggacagcaccctgcaggtggtggtgcgggtgcggccccccaccccccgggagctggacagccagaggaggcctgtggtgcaggtggtggatgagcgggtgctggtgttcaaccctgaggagccagatggcggcttccctggcctgaagtggggcggcacccatgatggccccaagaagaagggcaaggacctgacctttgtgtttgacagagtgtttggagaggccgccacccagcaggatgtgttccagcacaccacccacagcgtgctggacagcttcctgcagggctacaactgcagcgtgtttgcctacggggccactggagctgggaagacccacaccatgctgggccgggagggggaccccggcatcatgtacctgaccaccgtggagctgtaccgccgcctggaggcccggcagcaggagaagcactttgaggtgctgatctcctaccaggaggtgtacaatgagcagatccatgacctgctggagcccaagggccccctggccatcagagaagatcctgacaagggcgtggtggtgcagggcctgtccttccaccagcctgccagcgctgagcagctgctggagatcctgacccggggcaacagaaacagaacccagcaccccacagatgccaatgccaccagcagccgcagccacgccatcttccagatctttgtgaagcagcaggacagagtgcccggcctgacccaggccgtgcaggtggccaagatgagcctgattgacctggccggcagcgagcgggccagcagcacccacgccaagggggagcggctgcgggagggcgccaacatcaacagaagcctgctggccctgatcaacgtgctgaatgccctggctgatgccaagggcaggaagacccacgtgccctacagagacagcaagctgacccggctgctgaaggacagcctgggcggcaactgcaggacagtgatgattgctgccatcagccccagcagcctgacctatgaggacacctacaacaccctgaagtatgctgaccgggccaaggagatccggctgagcctgaagagcaatgtgaccagcctggactgccacatcagccagtatgccaccatctgccagcagctgcaggccgaggtggccgccctgaggaagaagctgcaggtgtatgagggcggcggccagcccccaccccaggacctgcccggcagccccaagagcggccccccacctgagcacctgcccagcagccccctgcccccccacccccccagccagccctgcaccccagagctgcctgctggcccccgggccctgcaggaggagagcctgggcatggaggcccaggtggagcgggccatggagggcaacagcagtgaccaggagcagagcccagaagatgaagatgagggccctgctgaggaggtgcccacccagatgcctgagcagaaccccacccacgccctgcctgagagcccccggctgaccctgcagcccaagcctgtggtgggccacttcagcgcccgggagctggatggagacaggagcaagcagctggccctgaaggtgctgtgtgtggcccagaggcagtacagcctgctgcaggccgccaacctgctgaccccagacatgatcacagaatttgagaccctgcagcagctggtgcaggaggagaagattgagcccggggctgaggccctgcggaccagcggcctggcccggggggcccccctggcccaggagctgtgcagcgagagcatccctgtgcccagccccctgtgcccagagcccccaggctacacaggccctgtgaccaggaccatggcccggcggctgagcggccccctgcacaccctgggcatccccccaggccccaactgcaccccagcccagggcagccgctggcccatggagaagaagagaagaagaccttctgccctggaggccgacagccccatggcccccaagaggggcaccaagaggcagaggcagagcttcctgccctgcctgcggcggggcagcctgcctgacacccagcccagccagggccccagcacccccaagggggagcgggccagcagcccctgccacagcccccgggtgtgcccagccaccgtcatcaagagccgggtgcccctgggccccagcgccatgcagaactgcagcacccccctggccctgcccacccgggacctgaatgccacctttgacctgtctgaggagccccccagcaagcccagcttccacgagtgcatcggctgggacaagatcccccaggagctgagccggctggaccagcccttcatcccccgggcccctgtgcccctcttcaccatgaagggccccaagcccaccagcagcctgcccggcaccagcgcctgcaagaagaagagggtggccagcagctctgtgagccacggccgcagcagaattgcccggctgcccagcagcaccctgaagaggcctgctggccccctggtgctgcccggggactggcactag

SEQ ID NO: 21333 - DNA, 1842 bp, Artificial Sequence; identical to SEQ ID NO: 18580
  Description of Artificial Sequence: Synthetic coding sequence

SEQ ID NO: 21334 - DNA, 654 bp, Artificial Sequence
  Description of Artificial Sequence: Synthetic coding sequence
atgaacagccagccccagaccaggagccccttcttccagaggccccagatccagcccccccgggccaccatccccaacagcagccccagcatccggcctggggcccagacccccacagctgtgtaccaggccaaccagcacatcatgatggtgaaccacctgcccatgccctaccctgtgccccagggcccccagtactgcatcccccagtaccgccacagcggccccccctacgtgggccccccccagcagtaccctgtgcagcccccaggccctggccccttctacccaggccctggccctggggacttccccaatgcctacggcacccccttctaccccagccagcctgtgtaccagagcgcccccatcatcgtgcccacccagcagcagcccccaccagccaagcgggagaagaagaccatccgcatccgggaccccaaccagggcggcaaggacatcacagaggagatcatgtctgggggcggcagcaggaaccccaccccacccatcggccggcccaccagcacccccaccccaccccagcagctgcccagccaggtgcctgagcacagccctgtggtgtatggcaccgtggagagcgcccacctggccgccagcacccctgtgacagctgccagtgaccagaagtag

SEQ ID NO: 21335 - DNA, 969 bp, Artificial Sequence
  Description of Artificial Sequence: Synthetic coding sequence
atgtacttctgctggggcgctgacagccgggagctgcagaggagaagaacagctggcagccctggagctgagctgctgcaggccgccagcggggagcggcacagcctgctgctgctgaccaaccaccgggtgctgagctgtggggacaacagccggggccagctgggcagaagaggagcccagagaggagagctgcctgagcccatccaggccctggagaccctcatcgtggacctggtgtcctgtgggaaggagcacagcctggccgtgtgccacaagggccgggtgtttgcctggggcgccggcagcgagggccagctgggcattggagagttcaaggagatctccttcacccccaagaagatcatgaccctgaatgacatcaagatcatccaggtgtcctgtggccactaccacagcctggccctgagcaaggacagccaggtgttctcctggggcaagaacagccacggccagctgggcctgggcaaggagttccccagccaggccagcccccagagggtgcgcagcctggagggcatccccctggcccaggtggccgccggcggggcccacagctttgccctgagcctgtgtggcaccagctttggctggggcagcaacagcgctggccagctggccctgagcggcagaaatgtgcctgtgcagagcaacaagcccctgtctgtgggcgccctgaagaacctgggcgtggtgtacatcagctgtggagatgcccacacagctgtgctgacccaggacggcaaggtgttcaccttcggggacaacagaagtggccagctgggctacagccccaccccagagaagaggggcccccagctggtggagagaattgatggcctggtgtcccagattgactgtggccgcctgcggggctgcagcagccagacccacttctgctggaacatctgccagctgtgtgacaacagctctgtgaagctggagtag

SEQ ID NO: 21336 - DNA, 1743 bp, Artificial Sequence
  Description of Artificial Sequence: Synthetic coding sequence
atgagggccctgactgtgcagagggtgaagtttgccatggacctgcccctgctgaagagagctggccaggacctggccgagaagaccaagaactttgtgagccgcagcctggtgattggagaggtgctgtccatggctgacatggccaccggggtgaagtgtggcatcatctactggctgtttggaggagccatccggaacctgggcagccctgagcacgtgaccaagtggttccagcccctgcaggagcagaagtacacaggcatgtttgccatgacagagcggggccacggcagcaatgcccggggcatccagacagaggccacctttgacctgagcgcccaggagtttgtgattgacaccccctgtgaaaatgctgagaagatgtacatcggaaatgccatgtatggcaactatgctgctgtgtttgcccagctgatcattgatggccgcagccagggcccccactgcttcatcgtgcctgtgagagatgaaaatggcagcctgtacccaggagtgacagccatcgacatgatgtacaaggagggcctgcatggagtggacaatggcatcctgatctttgacaaggtgcgcatcccccgggagaacctgctggacaagtttggatctgtggccccagatggccagtaccacagccccatccggaacaagagcgcccgcttcaatgccatgctggccgccctgacccccagccggctggccgtggccttccaggccatgggcgccatgaagctgggcctgaccatcgccatccgctacagccacagccggcggcagtttggccccaagaccaaggaggaggtgaagatcatcgagcaccagacccagaccctgcggctgatgccccacctggccacagccctggccctgacctttgtgagccgctatgctggggccctgctggatgaagatgtgttccagggcaaggagctggtgaacagccgcagcctgcaggccctggtggccggcctgaaggcctacagcacctgggagaacatccgctgcctgcaggactgccgggagtgcaccggcggcatggtggtgggccgggagctgctggcccagtacaccaagcagtatgaggagaagcccctgtttggcctgctgcagaactgggccgagagcgtgggggacaagctgcggaccagcttcctggccttcaacatggacacagtggatgacctggccttcctgctgaaggctgtgaagttccgggagcgggtgctgcagaggggcctggtggcccgcatctactacaaggtgaagaccaagaaggaggacttcttccacgcctggaacagctgcctgcaccacgtggccagcctgagcctggcccacacccaccgggtgaccctggagcagttcagcctggccgtgaagagctgcccagaccaggaggaccagaccctgctgatgaagttctgcctgctgtatggcaccaagctggtgttccaggagcgggcctggtacctggagcacaagtacctgacccccatggccagcacccgcatccggaaccagctgctggacctgtgtgacagcgtgaaggatgatgcccggcgggtcatcagcaccttcaacatcccccacacctacctgcacgcccccatcgccggcatcagcaacccccgggccgcctgggccttctacccagcccccctgcagccccggccccgggaggaggcccggagccggcggcccaagctgggcgccaagctgtag

SEQ ID NO: 21337 - DNA, 561 bp, Artificial Sequence
  Description of Artificial Sequence: Synthetic coding sequence
atgggcgtgaaccagagcgtgggcttcccccctgtgacaggcccccacctggtgggctgtggagatgtgatggagggccagaacctgcagggcagcttcttccgcctcttctacccctgccagaaggccgaggagaccatggagcagcccctgtggatccccaggtatgagtactgcaccggcctggccgagtacctgcagttcaacaagagatgtggcggcctgctcttcaacctggccgtgggcagctgccgcctgcctgtgtcctggaatggccccttcaagaccaaggacagcggctaccccctcatcatcttcagccacggcctgggcgccttccgcaccctgtacagcgccttctgcatggagctggccagccggggctttgtggtggccgtgcctgagcaccgctgtgtgtacttccgggacagatctgctgccaccacctacttctgcaagcaggcccctgaggagaaccagcccaccaatgaaagcctgcaggaggagtggatccccttccggcgggtggaggagggggagaaggagttccacgtgaggtag

SEQ ID NO: 21338 - DNA, 1620 bp, Artificial Sequence; identical to SEQ ID NO: 19050
  Description of Artificial Sequence: Synthetic coding sequence

SEQ ID NO: 21339 - DNA, 2613 bp, Artificial Sequence
  Description of Artificial Sequence: Synthetic coding sequence
atgagcaggaaccccagcagcaacagccctgaggaggacacagtgcctgtgcccaagggctctgtgcctgctgcccggcccagccggggcggcatgtctgtggtgggcatcgacctgggcttcctgaactgctacatcgctgtggcccggagcggcggcatcgagaccatcgccaatgagtacagcgaccgctgcaccccagcctgcatcagcctgggcagcaggacccgggccatcggaaatgctgccaagagccagatcgtgaccaacgtgaggaacaccatccacggcttcaagaagctgcacggccgcagctttgatgaccccatcgtgcagacagagcgcatccggctgccctatgagctgcagaagatgcccaatggatctgctggggtgaaggtgcgctacctggaggaggagcggccctttgccatcgagcaggtgacaggcatgctgctggccaagctgaaggagaccagtgaaaatgccctgaagaagcctgtggccgactgtgtgatcagcatccccagcttcttcacagatgctgagcggcgctctgtgatggccgccgcccaggtggccggcctgaactgcctgcggctgatgaatgagaccacagctgtggccctggcctacggcatctacaagcaggacctgccccccctggatgagaagcccagaaatgtggtgttcatcgacatgggccacagcgcctaccaggtgctggtgtgtgccttcaacaagggcaagctgaaggtgctggccaccacctttgacccctacctgggcggcaggaactttgatgaggccctggtggactacttctgtgatgagttcaagaccaagtacaagatcaacgtgaaggagaacagccgggccctgctgcggctgtaccaggagtgtgagaagctgaagaagctgatgtctgccaatgccagtgacctgcccctgaacatcgagtgcttcatgaatgacctggatgtgagcagcaagatgaacagagcccagtttgagcagctgtgtgccagcctgctggcccgggtggagccccccctgaaggctgtgatggagcaggccaacctgcagcgggaggacatcagcagcattgaaattgtgggcggggccacccgcatcccagctgtgaaggagcagatcaccaagttcttcctgaaggacatcagcaccaccctgaatgctgatgaggccgtggcccggggctgtgccctgcagtgtgccatcctgagccctgccttcaaggtgcgggagttcagcatcacagacctggtgccctacagcatcaccctgcgctggaagaccagctttgaagatggcagcggagaatgtgaggtgttctgcaagaaccacccagcccccttcagcaaggtgatcaccttccacaagaaggagccctttgagctggaggccttctacaccaacctgcacgaggtgccctacccagatgcccgcatcggcagcttcaccatccagaatgtgttcccccagagtgatggagacagcagcaaggtgaaggtgaaggtgcgggtgaacatccacggcatcttctctgtggccagcgcctctgtgattgagaagcagaacctggagggggaccacagtgatgcccccatggagacagagaccagcttcaagaatgaaaacaaggacaacatggacaagatgcaggtggaccaggaggagggccaccagaagtgccacgccgagcacaccccagaggaggagattgaccacactggagccaagaccaagtctgctgtgtctgacaagcaggaccggctgaaccagaccctgaagaagggcaaggtgaagagcattgacctgcccatccagagcagcctgtgccggcagctgggccaggacctgctgaacagctacattgaaaatgaaggcaagatgatcatgcaggacaagctggagaaggagagaaatgatgccaagaatgctgtggaggagtatgtgtatgacttccgggaccggctgggcaccgtgtatgagaagttcatcaccccagaggacctgagcaagctgtctgctgtgctggaggacacagagaactggctgtatgaagatggagaggaccagcccaagcaggtgtatgtggacaagctgcaggagctgaagaagtatggccagcccatccagatgaagtacatggagcacgaggagcggcccaaggccctgaatgacctgggcaagaagatccagctggtgatgaaggtgattgaggcctacagaaacaaggatgaaagatatgaccacctggaccccacagagatggagaaggtggagaagtgcatcagtgatgccatgtcctggctgaacagcaagatgaatgcccagaacaagctgagcctgacccaggaccctgtggtgaaggtgtctgagatcgtggccaagagcaaggagctggacaacttctgcaaccccatcatctacaagcccaagcccaaggccgaggtgcctgaggacaagcccaaggccaacagcgagcacaacggccccatggatggccagagcggcacagagaccaagagtgacagcaccaaggacagcagccagcacaccaagagcagcggggagatggaggtggactag

SEQ ID NO: 21340 - DNA, 5463 bp, Artificial Sequence
  Description of Artificial Sequence: Synthetic coding sequence
atggagcccccccaggagaccaaccggcccttcagcaccctggacaacagaagtggccaggtgcaggtgctgagcgccacccccctgctgcagaggaacccctacagcagcccagacatcatgcacatcaagggcagcgaggccagctctgtgccctatgccctgaaccagggcaccacagccctgcccaagaacaagaaccaggagggcaccggccaccggctgctgaacatgctgaggaagaccctgaaggagagtgacagcgaggagctggagatcacccaggagacccccaacctggtgccctttggagatgtggtgggctgcctgggcatccacatcaagaactgccgccacttcatgcccaagatcagcctgcagcactacgccaacctcttcatccgcatcagcatcaacaaggctgtgaagtgcaccaagatgtgcagcctgctgagcaagaatgatgagaagaacacagtcatcaagtttgatgaggtgaagtacttctctgtgcaggtgcccaggagatatgatgacaagaggaacaacatcctgctggagctgatccagtatgacaaccgggagaagagggccttcctgctgggctctgtgcagatccacctgtatgaagtcatccagaagggctgcttcatcgaggaggtgcaggtgctgcacggcaacatctttgtgtgccgcctggaggtggagttcatgttctcctatggcaactttggctacggcttcagccaccagctgaagcccctgcagaagatcacagagcccagcatgttcatgaacctggcccctcctcctgagaggacagatcctgtgaccaaggtgatcaccccccagacagtggagtacccagccttcctgagcccagacctgaatgtgacagtgggcaccccagctgtgcagagcagcaaccagcccagcgtggtgcggctggagaagctgcagcagcagccccgggagcggctggagaagatgaagaaggagtacagaaacctgaacacctggattgacaaggccaactacctggagagcatcctgatgcccaagctggagcacaaggacagcgaggagaccaacattgatgaggccagcgagaacaccaagagcaaccaccctgaggaggagctggagaacatcgtgggcgtggacatccccctggtgaatgaggaggccgagaccacagccaatgagctgctggacaatgacagcgagaagggcctgaccatccccaccctgaaccagagcgaccaggacaacagcacagcagatgccagcaagaatgatgagagcacccccagccccacagaggtgcacagcctgtgcaccatcagcaaccaggagaccatcaaggccggccgcatcccccccctgggggagcggcagagcgagagcatgccagacaggaagatgaagaatgtgttcttccccctggaggtgaagctgaaggacaactaccccagcatcctgaaggctgacagcagcctgtctgaggtggccttcagccccaaggagtacaacagccccagcttccggcctgagtacatcgagttcaagcccaagttccagttccagaagttcaacaagaatggatttgaccccttcctgaggaacatcaacaagatgtctgtgaggaagaggaaggaccaggacatctacaagtacagaaacatcctgggcgctgaggtgattgaacatgaggaccaggaccccccctacccagcccagagcaagacagctggccctgccaacaccacctgggcccatgaccccaacatcttcaccaccaagatgctggagacagagaacaagctggccccagaccccaccatcaacaccatcaagggcctggacaccaagaacagcctgaaggagaacctgcccaacgtgtccctgcccagcatcaagggggagagcagcagagctggaaatgtgcaggccaacacctgccacctgagcaagagcctgaacttcaccccccacatcgagtacctgaagcagagcatgatcctgaagagcatcctgtctgagaacctgcaggacctgagtgacaagctgttcagcaagccagaggtgtccatgaacagcgaggcccgggagaagagcagcagccccctgctgagcatccatgacaagagcagcagctccatggaggacaacgtgctggagaagaagcaggacctgaacaactggctgtctgagaaggacatcctgaacagcaagaccaccctgagccagatcatcaagaacatcccagctgacagcttcagcgagggcagccagatcatcgagaacatcccagctgacagcctgctggagggcggccaggtgatcaagaacatccctgagtacagcctgtctgagggcggccagatcatcaagaacatcccagctgacagcttcctggagagcggccctggccagagccctgaggtggaggagcacgtgtccaagaagcactttgaagcagatgagcgggacttccccatcaagaagaacagcagcaccaagaagaagcacctgatcagcgaggtgcccaacagcaagagcggcagcagcggcaccgtgcatgactacatcatgaggcagatcttcaccgcccccatcttcagcgagctggagattgaggtgaaggagcccagcgagacccccatgaacctggagaaccagctgcccaccccctggaagaggagcctgagcagccacatcctcttccacgaggagaatgctgatgaaattgagctgccccagcccaggtctgccaccagccagatcatccaggccttccccatcgacaccctgctggagagcggcatcatcaaggtgattgagctggacaaggagcaccacaagagcagcctgctgggcaccggcatcaccagccccaagggcaacctgaaggacagccaggagtactacagcgagatccgctcagaaacagagcccctgtctgagcagagcatccccatcatccccaaggacaccacctctgtgtccagagctgagttcatccaggaggaccagaacatgttcccccaggacagcagctactacagcatcgccaacaaggagctgtacctgcccagaaatggccagaggctgtgcaaggacaagaatgacctgagcagcaccctggagagcctgaccaacagcctgatggacaagctgtctgagagtgatgagatcatgctgaagagcttcctgaagaacatcttcaacgtgttcttcaagtacaaccacagcgagcggcggggccagcctgagaaggagctggagcggctcatccagcccagcttcaccagtgacacagagcacctggaggagctgcaggaggactttgacaaggctgacaagctggacaggaagcccatcctgagccccaagctgcgggtcttcctggaggagctgtctgagagcgaggtgaagcacctgaagtctgagctgagcaagcagatccagcactacctggtggagcggctgtctgagagcggccacatcaccaaggaggacctgcccaagatctaccagaacctgtacctgatgaatgagaaggccgagcagaagggccccaacagcttccagggcaagtacagcgagaccgtgaaggagatcatgagctttgtgaacaacttcaaccaccacttcatcgacaagcacctggagatcaagctgcggagcttcctgaaggagatcctgcagaactacttcctgaagaacatcagcgagagcagcctcttcaatgaaacagccagcgagaccatctaccccaacatcagcagcctgcggaccaagtctgtgtccatctccttccacgagctggagcaggacatcagcaagggcagctttggccgccgctttgagatcaacatgaagtaccccctgagcaagagcctgcagaactacctgattgccctgtctgaaaatgagctgctgcacctgaaggctgacctgagcaagcacctgcagagcctcttcatcgagaagctgagcaagagcggcctgatgaccaagaagcagctggagggcatcaaccagcacatcaacctgctgaacagcagcagcatccccctgaagtacatcaagacccacctgcccttcagagatgactgccactttgtggagaagcacagcgagaagcagaacaagtacagccgcatcgtgcagcagaccaccctgcagacagtgtctgaggacaagctgcgggaggccgagctgatccgggagaaggagaagaagtacttccccctgcagaacctgaagggcaacagcagcctcatcaaggagcagaagagctactacaccaaggaggaggccaagacccccagcctcatcaaggtgcagcccagcagcaatgaaaacatccaggccagccccctgagcaagagcagcgagatcctgacagacatcctgctgaagaagctgaggaaggagcacgtgttcacccagctgccccaggctgaaaattctgtgcacaagacagagatccaggacccctacagctggggcggcaagagcaagatcacccagagcaaggcctggtgtgagaagaccctgaagatgaagagcctggacaggaaggagcacgtgaacatctacaagtggacagtgcaggagaagccagaggccgtgctgaccagctacccccgcatccccaatgccaggatgccccgggaggatgagtacctgaaccgcatcaccttccccagctggcagagcagcaccctgacccacttcaacacagagaccggggagaagagcaagctggaggaccagtactgccagaccctgaagggcaacaacaacaacaacaagaagcacctggtgacctttgcccagtacaagaaggagatccagaccctgtacatcaagccagatgagatctgcagcgagaagtgtgccaagtttcctgagatccagagcttccagtacaaggtggtggaggatgagaagaacctgaagccccacctgtttcctgagctgttcaagattgaggacctgaagcccaaggtgaggaaggagcgggacagagtggcccagcccaagaagagcttcaacaagatcgtgcgcatcctgcccaccaccctgcccaccacccgcatccacctgaagaagtctgtgcccaggaccctgctgcactggacagcccggaggaccatccatgactgcagcgacaagtttgaggacctgcatgacatgaccagcttcacccacctgaagaaggtgaagagccgcagccggctgctgggcaagagcagtgatgacatccacaaccacgcccggcacagcgcccggccctacacagcccctgaggtgaacaagcagcgggagagctacagcggcaagttcaccagcaggaggatggtgagcagcggcctggtgcacatcaatgacaagaccagtgactatgagatgcacaagatgaggcccaagaagatcaagaggggctactag

SEQ ID NO: 21341 - DNA, 498 bp, Artificial Sequence
  Description of Artificial Sequence: Synthetic coding sequence
atggagcccacccgggactgccccctgtttggaggagccttcagcgccatcctgcccatgggcgccattgatgtgtctgacctgcggcctgtgcctgacaaccaggaggtgttctgccaccctgtgacagaccagagcctcatcgtggagctgctggagctgcaggcccacgtgcggggggaggccgccgcccgctaccactttgaagatgtgggcggcgtgcagggcgcccgggctgtgcacgtggagagcgtgcagcccctgagcctggagaacctggccctgcggggccgctgccaggaggcctgggtgctgagcggcaagcagcagatcgccaaggagaaccagcaggtgcgggcccgggagtgtgtgatgtcctggaagggcggcagcggagatgctgagatccaggtgtccatcctgaccctcatccccctgggcagcaagggccgggacaccagcagcggcctggccgaggccgcccctgtgcctgactag

SEQ ID NO: 21342 - DNA, 4482 bp, Artificial Sequence
  Description of Artificial Sequence: Synthetic coding sequence
atggccagcatcacccagctgtttgatgacctgtgtgaggccctgctgcctgctgccaagacccacctgggccagaggtctgtgaacaggaagagggccaagaggagcctgaagaaggtggcctacaatgccctcttcaccaacctcttccaggatgagacccagcagctgcagcctgacatgagcaagctgcctgccaggaacaagatcctgatgctgagctttgacctgcgggtgggcggcctgggccccaaggctgaccggctggaggagctggtggaggagctggaggccgccccctgctgccccctgctggaggtgggctctgtgctggacctgctggtgcagctggccggcagcggccccccccaggtgctgcccaggaagagggactacttcctgaacaacaagcacgtgggcagaaatgtgccctacagcggctatgactgtgatgacctgtctgtgtttgagatggatgtgcagagcctcatcagccgggaggagtgcctgtgccacagcatgatccaggagaccctgcaggtgatggaggccgcccctggcaccggcctgcccaccgtgggcctcttctcctttggagacccctgtggggacagatttgagcgggacaccagggtgtccctgtttggagccctggtgcacagcaggacctatgacatggatgtgcggctgggcctgccccctgtgcctgacaatgctgacctgagcggcctggccatcaaggtgcccccatctgtggaccagtgggaggatgagggcttccagagcgccagcaacctgaccccagacagccagagcgagcccagcgtgaccccagatgtggacctgtgggaggccgccctgacctatgaggccagcaagaggcgctgctgggagcgggtgggctgccccccaggccaccgggaggagccctacctgacagaagctggaagagatgcctttgacaagttctgccgcctgcaccagggcgagctgcagctgctggccggcggcgtgctgcaggccccccagcctgtgctggtgaaggaatgtgagctggtgaaggatgtgctgaatgtgctgattggagtggtgtctgccaccttcagcctgtgccagcctgcccaggcctttgtggtgaagaggggcgtgcacgtgtctggggccagccctgagagcatcagcagcctgctgtctgaggtggccgagtatggcacctgctacacccggctgagccacttcagcctgcagcctgtgctggacagcctgtacagcaagggcctggtgttccaggccttcaccagcggcctgcggcgctacctgcagtactaccgggcctgtgtgctgagcaccccacccaccctgagcctgctgaccatcggcttcctgttcaagaagctgggccggcagctgcgctacctggccgagctgtgtggggtgggcgctgtgctgcccggcacctgtggcggcggccccagggctgccttccccactggagtgaagctgctgagctacctgtaccaggaggccctgcacaactgcagcaatgagcactaccctgtgctgctgagcctgctgaagaccagctgtgagccctacacccgcttcatccatgactgggtgtacagcggggtcttcagagatgcctatggagagttcatgatccaggtgaaccacgagtacctgtccttccgggacaagctgtactggacccacggctacgtgctgatcagcaaggaggtggaggactgtgtgcctgtgttcctgaagcacatcgcccatgacatctacgtgtgtgggaagaccatcaacctgctgaagctgtgctgccccaggcactacctgtgctggagcgatgtgcctgtgccccgcatcagcgtcatcttcagcctggaggagctgaaggagattgagaaggactgtgctgtgtatgtgggccgcatggagcgggtggcccggcacagctctgtgtccaaggaggagaaggagctgaggatggagatcgccaagcaggagctgattgcccacgcccgggaggccgccagccgggtgctgagcgccctgagtgaccggcagatgtctgagaggatggccctggatgccaggaagcgggagcagttccagaggctgaaggagcagtttgtgaaggaccaggagcggcggcaggccgcccggcaggaggagctggatgatgacttctcctatgcccgggagctgcgggaccgggagcggcggctgaagagcctggaggaggagctggagaggaaggcccggcaggccctggtggaccactacagcaagctgtctgctgaggccgcccggcgggagcagaaggccctgtggaggatccagaggcaccggctggagagcgcccggctgcgcttcctgctggaggatgagaagcacatccaggagatgctgaaggctgtgtctgaggcccaccagccccaggagcccccagatgtgctgctgtctgtgcacccccaggtgaccagccctggccctgagcaccctgagggcggccagggctgtgacagcggcagcgctgagcagcacagccctgcctgggatggctggaacagacctggcctgctgaccccccagcccctgaagcccctggccgtgggcgctgggggccggggcctgcagcaggccgagggcgcccggcccttcagtgacagcctgagcatcggggacttcctgcctgtgggccctggagctgagcccagcgtgcagacaggcatggtgcccctgctggaggtggccctgcagaccatcaacctggacctgccccccagcgcccctggagaggccccagctgctgccagcacccagcccagccggccccaggagtatgacttcagcacagtgctgcggcctgctgtggccaccagccctgcccctggccccctgcaggccgctgagtgcagcctgggcagcagcggcctgcagctgtgggaggacagctgtgggaagatggatgcctgtggcagcgccagccgggagaccctgctgcccagccaccccccccggcgggccgccctggaggagggcagcagccagcccacagagcggctgtttggccaggtgtctgggggcggcctgcccaccggggactatgccagcgagatcgcccccacccggccccgctggaacacccacggccacgtgtctgatgccagcatccgggtgggagaaaatgtgtctgatgtggcccccacccagccccgctggaacacccacggccacgtgtccaatgccagcatcagcctgggggagagcgtgtctgatgtggcccccacccggccccgctggaacatccacggccacgtgtccaatgccagcatccgggtgggagaaaatgtgtctgatgtggcccccacccggccccgctggaacacccacggccacgtgtccaatgccagcatccgggtgggggagaatgtgtctgatgtggcccccacccggccccgctggaacacccacggccacgtgtctgatgccagcatcagcctgggggagagcgtgtctgacatggccccagcccggccccgctggaacacccacggccacgtgtctgatgccagcatcagcctgggggagagcgtgtctgacatggcccccacccggccccgctggaacacccacggccacgtgtctgacaccagcatccgggtgggagaaaatgtgtctgatgtggcccccatccgcagccgctgcaacacccacggccacgtgtctgatgccagcatcagcctgggggagcctgtgtctgatgtggtgtccacccggccccgctggaacacccacgtgcccatccccccaccccacatggtgctgggcgccctgagccctgaggccgagcccaacaccccccggccccagcagagccccccaggccacaccagccagagcgccctgagcctgggcgcccagagcacagtgctggactgtggcccccggctgcctgtggaggtgggccccagcctgagcagccccagcagcggctgtggggagggcagcatctctgtgggagaaaatgtgtctgatgtggcccccacccagccctggtggcccaacacccctggggacagcgtgtctgaggagctgggccagagccgggtggccggcggccaggagtgggactgtggcacccaccgggcctgggaggccctgggcggggccggcaccctgcggaccagcctgcagatcggcctgagcacccacaggaagacccagctgccccgggccgcccaggccgtggtgagaagaagaagacacagaagaagaaggctgcgggtgggcagccggcccacctggcaggcctggcagggcagcaccacctggagcggcaccaggacagtgaccagcccctgccccagccggcccctgctgatcttctgtgccccctgcttccctggccccagccccagcccctggacccccaggagcagcctgcccctgatgaggctgctgtgcagctag

SEQ ID NO: 21343 - DNA, 1077 bp, Artificial Sequence; identical to SEQ ID NO: 18512
  Description of Artificial Sequence: Synthetic coding sequence

SEQ ID NO: 21344 - DNA, 2757 bp, Artificial Sequence; identical to SEQ ID NO: 19844
  Description of Artificial Sequence: Synthetic coding sequence

SEQ ID NO: 21345 - DNA, 222 bp, Artificial Sequence
  Description of Artificial Sequence: Synthetic coding sequence
atgagctaccagcagcagcagtgcaagcagccctgccagcccccacctcctgtgtgccgcctgcccaagaggcctgagccctgcccccccctgaagtgcccagagccctgccccccacccaagtgcccccagccctgccccccccagcagtgccagcagaagtaccccctggtgacccccagccccccctgccagcccaagtgcccccccaagagcaagtag

SEQ ID NO: 21346 - DNA, 576 bp, Artificial Sequence; identical to SEQ ID NO: 18243
  Description of Artificial Sequence: Synthetic coding sequence

SEQ ID NO: 21347 - DNA, 60 bp, Artificial Sequence
  Description of Artificial Sequence: Synthetic coding sequence
atgctgaagaacaagggccacagcagcaagaaggacaacctggccgtgaatgctgtgtag

SEQ ID NO: 21348 - DNA, 1026 bp, Artificial Sequence
  Description of Artificial Sequence: Synthetic coding sequence
atggagagcaacttcaaccaggagggcgtgccccggcccagctatgtgttttctgctgaccccatcgcccggcccagcgagatcaactttgatggcatcaagctggacctgagccatgagttcagcctggtggcccccaacacagaggccaacagctttgagagcaaggactacctgcaggtgtgcctgcgcatccggcccttcacccagagcgagaaggagctggagagcgagggctgtgtgcacatcctggacagccagacagtggtgctgaaggagccccagtgcatcctgggccgcctgtctgagaagagcagcggccagatggcccagaagttctccttcagcaaggtgtttggacctgccaccacccagaaggagttcttccagggctgcatcatgcagcctgtgaaggacctgctgaagggccagagccgcctcatcttcacctacggcctgaccaacagcggcaagacctacaccttccagggcacagaagaaaatattggcatcctgcccaggaccctgaatgtgctgtttgacagcctgcaggagcggctgtacaccaagatgaacctgaagccccacaggagccgggagtacctgcggctgagcagcgagcaggagaaggaggagatcgccagcaagagcgccctgctgcggcagatcaaggaggtgacagtgcacaatgacagtgatgacaccctgtatggcagcctgaccaacagcctgaacatcagcgagtttgaggagagcatcaaggactatgagcaggccaacctgaacatggccaacagcatcaagttctctgtgtgggtgtccttctttgagatctacaatgagtacatctatgacctgtttgtgcctgagctggccaagaccaagggggagctgatcaagaccaaggaggagctgaagaagagagaaaatgaaagtgacagcctcatccaggagctggagaccagcaacaagaagatcatcacccagaaccagaggatcaaggagctgatcaacatcatcgactag

SEQ ID NO: 21349 - DNA, 27 bp, Artificial Sequence
  Description of Artificial Sequence: Synthetic coding sequence
atggctgacacagacctcttcatgtag

SEQ ID NO: 21350 - DNA, 2628 bp, Artificial Sequence
  Description of Artificial Sequence: Synthetic coding sequence
atgatgtacacagtgctgcctgatggcagccctgtgccccagggcatggccctgtatgcccctcctccacccctgcccaacaacagccggcccctgaccccaggcaccgtggtgtatggccccccacctgctggggcccccatggtgtatggccccccaccacccaacttcagcatccccttcatccccatgggcgtgctgcactgcaatgtgcctgagcaccacaacctggagaatgaggtgtcccggctggaggacatcatgcagcacctgaagagcaagaagcgggaggagcgctggatgagggccagcaagaggcagagcgagaaggagatggaggagctgcaccacaacattgatgacctgctgcaggagaagaagagcctggagtgtgaggtggaggagctgcacaggacagtgcagaagaggcagcagcagaaggacttcattgatggaaatgtggagagcctgatgacagagctggagattgagaagagcctgaagcaccatgaagatattgtggatgaaattgagtgcatcgagaagaccctgctgaagagaagaagtgagctgcgggaggccgaccggctgctggccgaggccgagagcgagctgagctgcaccaaggagaagaccaagaatgctgtggagaagttcacagatgccaagaggagcctgctgcagacagaaagtgatgctgaggagctggagcggcgggcccaggagacagctgtgaacctggtgaaggctgaccagcagctgcggagcctgcaggctgatgccaaggacctggagcagcacaagatcaagcaggaggagatcctgaaggagatcaacaagatcgtggccgccaaggacagcgacttccagtgcctgagcaagaagaaggagaagctgacagaggagctgcagaagctgcagaaggacatcgagatggccgagagaaatgaagaccaccacctgcaggtgctgaaggagagcgaggtgctgctgcaggccaagagagctgagctggagaagctgaagagccaggtgaccagccagcagcaggagatggctgtgctggaccggcagctgggccacaagaaggaggagctgcacctgctgcagggctccatggtgcaggccaaggctgacctgcaggaggccctgcggctgggggagacagaggtgacagagaagtgcaaccacatccgggaggtgaagagcctgctggaggagctgtccttccagaagggggagctgaatgtgcagatcagcgagaggaagacccagctgaccctcatcaagcaggagattgagaaggaggaggagaacctgcaggtggtgctgcggcagatgagcaagcacaagacagagctgaagaacatcctggacatgctgcagctggagaaccacgagctgcagggcctgaagctgcagcacgaccagagggtgtctgagctggagaagacccaggtggccgtgctggaggagaagctggagctggagaacctgcagcagatcagccagcagcagaagggggagattgagtggcagaagcagctgctggagcgggacaagcgggagattgaaagaatgacagctgagagccgggccctgcagagctgtgtggagtgcctgagcaaggagaaggaggacctgcaggagaagtgtgacatctgggagaagaagctggcccagaccaagagggtgctggccgctgctgaggagaacagcaagatggagcagagcaacctggagaagctggagctgaatgtgaggaagctgcagcaggagctggaccagctgaacagagacaagctgagcctgcacaatgacatcagcgccatgcagcagcagctgcaggagaagcgggaggccgtgaacagcctgcaggaggagctggccaacgtgcaggaccacctgaacctggccaagcaggacctgctgcacaccaccaagcaccaggatgtgctgctgtctgagcagacccggctgcagaaggacatcagcgagtgggccaacagatttgaggactgccagaaggaggaggagaccaagcagcagcagctgcaggtgctgcagaatgaaattgaggagaacaagctgaagctggtgcagcaggagatgatgttccagaggctgcagaaggagcgggagagcgaggagagcaagctggagaccagcaaggtgaccctgaaggagcagcagcaccagctggagaaggagctgacagaccagaagagcaagctggaccaggtgctgagcaaggtgctggccgctgaggagcgggtgaggaccctgcaggaggaggagcgctggtgtgagagcctggagaagaccctgagccagaccaagaggcagctgtctgagcgggagcagcagctggtggagaagagcggggagctgctggccctgcagaaggaggccgacagcatgagagctgacttcagcctgctgaggaaccagttcctgacagagaggaagaaggccgagaagcaggtggccagcctgaaggaggccctgaagatccagaggagccagctggagaagaacctgctgacagcccgggaggccgaggcccagaagctgaagaagcaggtgtgtgcccagaaggcccagctggccagcctgggccgggagtag

SEQ ID NO: 21351 - DNA, 1188 bp, Artificial Sequence
  Description of Artificial Sequence: Synthetic coding sequence
atggagcccccccaggagaccaaccggcccttcagcaccctggacaacagaagtggccaggtgcaggtgctgagcgccacccccctgctgcagaggaacccctacagcagcccagacatcatgcacatcaagggcagcgaggccagctctgtgccctatgccctgaaccagggcaccacagccctgcccaagaacaagaaccaggagggcaccggccaccggctgctgaacatgctgaggaagaccctgaaggagagtgacagcgaggagctggagatcacccaggagacccccaacctggtgccctttggagatgtggtgggctgcctgggcatccacatcaagaactgccgccacttcatgcccaagatcagcctgcagcactacgccaacctcttcatccgcatcagcatcaacaaggctgtgaagtgcaccaagatgtgcagcctgctgagcaagaatgatgagaagaacacagtcatcaagtttgatgaggtgaagtacttctctgtgcaggtgcccaggagatatgatgacaagaggaacaacatcctgctggagctgatccagtatgacaaccgggagaagagggccttcctgctgggctctgtgcagatccacctgtatgaagtcatccagaagggctgcttcatcgaggaggtgcaggtgctgcacggcaacatctttgtgtgccgcctggaggtggagttcatgttctcctatggcaactttggctacggcttcagccaccagctgaagcccctgcagaagatcacagagcccagcatgttcatgaacctggcccctcctcctgagaggacagatcctgtgaccaaggtgatcaccccccagacagtggagtacccagccttcctgagcccagacctgaatgtgacagtgggcaccccagctgtgcagagcagcaaccagcccagcgtggtgcggctggagaagctgcagcagcagccccgggagcggctggagaagatgaagaaggagtacagaaacctgaacacctggattgacaaggccaactacctggagagcatcctgatgcccaagctggagcacaaggacagcgaggagaccaacattgatgaggccagcgagaacaccaagagcaaccaccctgaggaggagctggagaacatcgtgggcgtgggcggcttcttcaccaagaggatctag

SEQ ID NO: 21352 - DNA, 282 bp, Artificial Sequence
  Description of Artificial Sequence: Synthetic coding sequence
atgagctactaccagaggcccttcagccccagcgcctacagcctgcctgccagcctgaacagcagcatcgtgatgcagcacggcaccagcctggacagcacagacacctacccccagcacgcccagagcctggatggcaccaccagcagcagcatccccctgtaccgcagcagcgaggaggagaagagggtgaccgtcatcaaggccccccactacccaggcatcggccctgtggatgaaagtggcatccccacagccatccgcaccaccgtggacagatag

SEQ ID NO: 21353 - DNA, 558 bp, Artificial Sequence
  Description of Artificial Sequence: Synthetic coding sequence
atggccgcctctgtggagcagcgggagggcaccatccaggtgcagggccaggccctcttcttccgggaggccctgcccggcagcggccaggcccgcttctctgtgctgctgctgcacggcatccgcttcagcagcgagacctggcagaacctgggcaccctgcaccggctggcccaggccggctacagagctgtggccatcgacctgcccggcctgggccacagcaaggaggccgccgccccagcccccatcggggagctggcccctggcagcttcctggccgctgtggtggatgccctggagctgggcccccctgtggtgcctgtggcccccatctgcacagacaagatcaatgctgccaactatgcctctgtgaagaccccagccctgattgtgtatggagaccaggaccccatgggccagaccagctttgagcacctgaagcagctgcccaaccaccgggtgctgatcatgaagggagctggccacccctgctacctggacaagccagaggagtggcacacaggcctgctggacttcctgcagggcctgcagtag

SEQ ID NO: 21354 - DNA, 1443 bp, Artificial Sequence
  Description of Artificial Sequence: Synthetic coding sequence
atgctggagcggcccccagccctggccatgcccatgcccacagagggcaccccaccacccctgagcggcacccccatccctgtgcctgcctacttcagacatgctgagcccggcttcagcctgaagaggccccggggcctgagccgcagcctgcccccacctcctccagccaagggcagcatccccatcagccgcctcttcccccccaggaccccaggctggcaccagctgcagccccggcgggtgtccttccggggggaggccagcgagaccctgcagagccctggctatgaccccagcaggcctgagagcttcttccagcagagcttccagaggctgagccggctgggccacggcagctatggagaggtgttcaaggtgcgcagcaaagaagatggccgcctgtatgctgtgaagaggtccatgagccccttccggggccccaaggaccgggccaggaagctggccgaggtgggcagccatgagaaggtgggccagcacccctgctgcgtgcggctggagcaggcctgggaggagggcggcatcctgtacctgcagacagagctgtgtggccccagcctgcagcagcactgtgaggcctggggcgccagcctgcctgaggcccaggtgtggggctacctgcgggacaccctgctggccctggcccacctgcacagccagggcctggtgcacctggatgtgaagccagccaacatcttcctgggcccccggggccgctgcaagctgggggactttggcctgctggtggagctgggcacagctggagctggggaggtgcaggagggggacccccgctacatggcccctgagctgctgcagggcagctatggaacagctgctgatgtgttcagcctgggcctgaccatcctggaggtggcctgcaacatggagctgccccatggaggagagggctggcagcagctgcggcagggctacctgcccccagagttcaccgctggcctgagcagcgagctgcggtctgtgctggtgatgatgctggagccagaccccaagctgcgggccacagctgaggccctgctggccctgcctgtgctgcggcagccccgggcctggggcgtgctgtggtgcatggctgctgaggccctgagccggggctgggccctgtggcaggccctgctggccctgctgtgctggctgtggcacggcctggcccacccagcctcctggctgcagcccctgggccccccagccaccccacctggcagccccccctgcagcctgctgctggacagcagcctgagcagcaactgggatgatgacagcctgggccctggccaccccccctgcctggcctgccccccagctggcctgcacagccccctgcggctgtcctggccaggcctgtggggcgcccctcctcctcctggagctggggcccaccctggcatgccctggacctag

SEQ ID NO: 21355 - DNA, 1740 bp, Artificial Sequence; identical to SEQ ID NO: 21072
  Description of Artificial Sequence: Synthetic coding sequence

SEQ ID NO: 21356 - DNA, 975 bp, Artificial Sequence
  Description of Artificial Sequence: Synthetic coding sequence
atggaggccctgggccctggaggagaccgggccagccctgccagcagcaccagcagcctggacctgtggcacctgtccatgagagctgacagcgcctacagcagcttctctgctgccagcggcggccctgagcccaggacccagagccctggaacagacctgctgccctacctggactgggactatgtgcgggtggtgtggggcggccctggccctgcccccccagatgctgccctgtgcaccagcccccggcccaggcctgctgtggccgcccggagcggcccccagcccacagaggtgcccggcaccccaggccccctgaaccggcaggccacccccctgctgtatgccctggccgctgaggccgaggccgccgcccaggccgctgagccccccagccccccagccagcagagctgcctaccggcagaggctgcagggcgcccagaggagagtgctgcgggagaccagcttccagaggaaggagctgaggatgagcctgcctgcccggctgcggcccaccgtgcctgcccggcccccagccacccaccccaggtctgccagcctgagccaccctggaggagagggggagcccgcccggagccgggccccagcccctggaacagctggccggggccccctggccaaccagcagaggaagtggtgcttcagcgagcccgggaagctggacagagtgggccggggcggcggccctgccagagaatgtctgggggaggcctgcagcagcagcggcctgcccggccctgagcccctggagttccagcacccagccctggccaagtttgaagatcatgaggtgggctggctgcctgagacccagccccagggctccatgaacctggacagcggcagcctgaagctgggagatgccttccggcctgccagccgcagccgcagcgccagcggggaggtgctgggctcctggggcggcagcggcggcaccatccccatctag

SEQ ID NO: 21357 - DNA, 780 bp, Artificial Sequence
  Description of Artificial Sequence: Synthetic coding sequence
atgccccgggcccggagcggccgccgcagcagaggagctgggggccgggaggagaccttcctgcgggtgcgggccaaccggcagacccggctgaatgccagaattggcaagatgaagaggaggaagcaggatgagggccagcgggagggcagctgcatggctgaagatgatgctgtggacattgaacatgagaacaacaacagatttgaggagtatgagtggtgtggccagaagaggatccgggccaccaccctgctggagggcggcttccggggcagcggcttcatcatgtgcagcggcaaggagaacccagacagtgatgctgacctggatgtggatggagatgacaccctggagtatggcaagccccagtacacagaagcagatgtgatcccctgcaccggggaggagcccggggaggccaaggagcgggaggccctgcggggagctgtgctgaatggaggcccccccagcacccgcatcaccccagagttcagcaagtgggccagtgatgagatgcccagcaccagcaatggagagagcagcaagcaggaggccatgcagaagacctgcaagaacagcgacatcgagaagatcacagaagattctgctgtgaccacctttgaggccctgaaggcccgggtgcgggagctggagcggcagctgagcagaggagaccgctacaagtgcctgatctgcatggacagctacagcatgcccctgaccagcatccagtgctggcacgtgcactgtgaggagtgctggctgcggaccctgtag

SEQ ID NO: 21358 - DNA, 369 bp, Artificial Sequence; identical to SEQ ID NO: 21112
  Description of Artificial Sequence: Synthetic coding sequence

SEQ ID NO: 21359 - DNA, 984 bp, Artificial Sequence
  Description of Artificial Sequence: Synthetic coding sequence
atggccagcttcctgaagggggcccacgtgaccatcaatgcccgggcagaggaggatgtggagcctgagtgcatcatggagaaggtggccaaggccagcggggccaactacagcttccacaaggagagcggccgcttccaggatgtgggcccccaggcccctgtgggctctgtgtaccagaagaccaatgctgtgtctgagatcaagagggtgggcaaggacagcttctgggccaaggccgagaaggaggaggagaacagaaggctggaggagaagagaagagctgaggaggcccagaggcagctggagcaggagcggcgggagcgggagctgcgggaggccgcccggcgggagcagcgctaccaggagcagggcggggaggccagcccccagaggacctgggagcagcagcaggaggtggtgtccaggaacagaaatgagcaggagagcgctgtgcacccccgggagatcttcaagcagaaggagcgggccatgagcaccaccagcatcagcagcccccagcccgggaagctgcggagccccttcctgcagaagcagctgacccagcctgagacccacttcggccgggagcctgctgctgccatcagccggcccagggctgacctgcctgctgaggagcccgcccccagcaccccaccctgcctggtgcaggccgaggaggaggccgtgtatgaggagcccccagagcaggagaccttctatgagcagccccccctggtgcagcagcagggcgccggcagcgagcacatcgaccaccacatccagggccagggcctgagcggccagggcctgtgtgcccgggccctgtatgactaccaggccgcagatgacacagagatcagctttgatcctgagaacctgatcaccggcatcgaggtgattgatgagggctggtggaggggctacggcccagatggccacttcggcatgtttcctgccaactacgtggagctgattgaatag

SEQ ID NO: 21360 - DNA, 438 bp, Artificial Sequence
  Description of Artificial Sequence: Synthetic coding sequence
atgcagggccgcatcaccaaggtgctgaacatgaagcccccagagatcctgtccatgattgaggaggccgccggcaccaggatgtatgagtacaagaagattgctgcccagaagaccatcgagaagaaggaggccaagctgaaggagatcaagaccatcctggaggaggagatcacccccaccatccagaagctgaaggaggagaggagcagctacctggagtaccagaaggtgatgagagaaattgagcacctgagccggctgtacatcgcctaccagttcctgctggccgaggacaccaaggtgcgctctgctgaggagctgaaggagatgcaggacaaggtgatcaagctgcaggaggagctgtctgaaaatgacaagaagatcaaggccctgaaccacgagattgaggagctggagaagaggaaggacaagtag

SEQ ID NO: 21361 - DNA, 816 bp, Artificial Sequence
  Description of Artificial Sequence: Synthetic coding sequence
atggagaaggagaccggcatcagccagcagaggaactactacttcacccagagcaaaggagagcccctgcagattgaccacctggtgtttgtggtgcatggaattggccctgcctgtgacctgcgcttccgcagcatcgtgcagtgtgtgaatgacttccgctctgtgtccctgaacctgctgcagacccacttcaagaaggcccaggagaaccagcagatcggccgggtggagttcctgcctgtgaactggcacagccccctgcacagcactggagtggatgtggacctgcagaggatcaccctgcccagcatcaaccggctgcggcacttcaccaatgacaccatcctggatgtgttcttctacaacagccccacctactgccagaccatcgtggacacagtggccagcgagatgaaccgcatctacaccctcttcctgcagagaaatccagacttcaagggcggcgtgtccattgctggccacagcctgggcagcctcatcctgtttgacatcctgaccaaccagaaggacagcctgggggacattgattctgagaaggacagcctgaacatcgtgatggaccagggcgacacccccaccctggaggaggacctgaagaagctgcagctgtctgagttctttgacatctttgagaaggagaaggtggacaaggaggccctggccctgtgcacagaccgggacctgcaggagatcggcatccccctgggccccaggaagaacctgagcagcgctgtggccgtcatcctggagatggtgaccatctggatgctggccctgggccgctgcctgtag

SEQ ID NO: 21362 - DNA, 1818 bp, Artificial Sequence; identical to SEQ ID NO: 20587
  Description of Artificial Sequence: Synthetic coding sequence

SEQ ID NO: 21363 - DNA, 294 bp, Artificial Sequence
  Description of Artificial Sequence: Synthetic coding sequence
atgcagaccagcagcagccgctctgtgcacctgtctgagtggcagaagaactactttgccatcaccagcggcatctgcaccggccccaaggcagatgcctaccgggcccagatcctgcgcatccagtatgcctgggccaacagcgagatcagccaggtgtgtgccaccaagctgttcaagaagtatgcagagaagtacagcgccatcatcgacagcgacaacgtggagagcggcctgaacaactatgcagagaacatcctgaccctggccggcagccagcagacagacagctag

SEQ ID NO: 21364 - DNA, 333 bp, Artificial Sequence; identical to SEQ ID NO: 19493
  Description of Artificial Sequence: Synthetic coding sequence

SEQ ID NO: 21365 - DNA, 627 bp, Artificial Sequence
  Description of Artificial Sequence: Synthetic coding sequence
atggagccccccatggagcccagcggcggggagcaggagcccggggctgtgcgcttcctggacctgccctgggaggatgtgctgctgccccacgtgctgaacagagtgcccctgcggcagctgctgcggctgcagagggtgtcccgggccttccgcagcctggtgcagctgcacctggccggcctgcggagatttgatgctgcccaggtgggcccccagatccccagggctgccctggcccggctgctgagagatgctgagggcctgcaggagctggccctggccccctgccacgagtggctgagtgatgaggacctggtgcctgtgctggccaggaacccccagctgcggtctgtggccctgggcggctgcggccagctgagcagaagagccctgggcgccctggccgagggctgcccccggctgcagaggctgagcctggcccactgtgactgggtggatggcctggccctgcggggcctggccgaccgctgcccagccctggaggagctggacctgacagcctgccggcagctgaaggatgaggccatcgtgtacctggcccagaggagaggagctggcctgcggagcctgagcctggccgtgaatgccaacgtgggggactag

SEQ ID NO: 21366 - DNA, 1419 bp, Artificial Sequence
  Description of Artificial Sequence: Synthetic coding sequence
gtcacccactacaagcagtacccacccaacaccagcaaggtgtacagctactttgaatgtcgggagaagaagacagagaacagcaagctgaggaaggtgaagtatgaggagaccgtcttctacggcctgcagtacatcctgaacaagtacctgaagggcaaggtggtgaccaaggagaagatccaggaggccaaggatgtgtacaaggagcacttccaggatgatgtggtgaatgagaagggctggaactacatcctggagaagtatgatggccacctgcccatcgagatcaaggctgtgcctgagggcttcgtcatccccagaggaaatgtgctcttcaccgtggagaacacagatcctgagtgctactggctgaccaactggattgagaccatcctggtgcagagctggtaccccatcaccgtggccaccaacagccgggagcagaagaagatcctggccaagtacctgctggagaccagcggcaacctggatggcctggagtacaagctgcatgactttggctaccggggcgtgagcagccaggagacagctggcattggagccagcgcccacctggtgaacttcaagggcacagacacagtggccggcctggccctgaacaagaagtactacggcaccaaggaccctgtgcccggctacagcgtgcctgctgctgagcacagcaccatcacagcctggggcaaggaccacgagaaggatgcctttgagcacatcgtgacccagttcagctctgtgcctgtgtctgtggtgagcaacagctatgacatctacaatgcctgtgagaagatctggggcgaggacctgcggcacctgattgtgagccgcagcacccaggcccccctcatcatccggccagattctggcaaccccctggacacagtgctgaaggtgctggagatcctgggcaagaagtttcctgtgacagagaacagcaagggctacaagctgctgcccccctacctgcgggtcatccagggagatggagtggacatcaacaccctgcaggagatcgtggagggcatgaagcagaagatgtggagcattgaaaatattgcctttggaagtggcggcggcctgctgcagaagctgacccgggacctgctgaactgcagcttcaagtgcagctatgtggtgaccaacggcctgggcatcaacgtgttcaaggaccctgtggccgaccccaacaagaggagcaagaagggccgcctgagcctgcacaggaccccagctggcaactttgtgaccctggaggagggcaagggggacctggaggagtatggccaggacctgctgcacacagtgttcaagaatggcaaggtgaccaagagctacagctttgatgagatcaggaagaatgcccagctgaacatcgagctggaggccgcccaccactag

SEQ ID NO: 21367 - DNA, 519 bp, Artificial Sequence
  Description of Artificial Sequence: Synthetic coding sequence
tgcaagcagagcaccaagacagaggagaagctgcggcccaccaggaccagcagcgagagcatctacagcaggcctggcagcagcatccctggcagccctggccacaccatctatgccaaggtggacaatgagatcctggactacaaggacctggccgccatccccaaggtgaaggccatctatgacatcgagaggccagacctgatcacctatgagcccttctacaccagcggctatgatgacaagcaggagcggcagagcctgggggagagccccaggaccctgagccccacccccagcgctgagggctaccaggatgtgcgggacaggatgatccacaggagcaccagccagggcagcatcaacagccctgtgtacagccgccacagctacacccccaccaccagccgcagcccccagcacttccacaggccagaccagggcatcaacatctacaggaagccacccatctacaagcagcacgtgctgtttgaggtgatcctgctgctgctgatctag

SEQ ID NO: 21368 - DNA, 2445 bp, Artificial Sequence
  Description of Artificial Sequence: Synthetic coding sequence
atgaggctgctggatggcaagcagaccagccgctacagtgaaaatgcctgtgagaagaagatcttcagcatctacggccactaccctgtggtgcgggccgccctgcggaggaagggctgggtggagaagaagttccacttcctgcccaaggtgatcccagatgtggaggatgaaggagcccgggtgaatgatgacacctgtgccaaggtgaaggagaaccaggagatggccctggagaagacagacaacatccatgatgtgatgagccggctggtgaagaatgagatgccctacctgctgtggaccatcaagagggacatcatcgactaccacagcctgacctatgaccagatgctgaaccactacgccaagacagccagcttcaccaccaagattggcctgtgtgtgaacatgaggagcctgccctggtacgtgcctgccaacccagacagcttcttcccccgctgctacagcctgtgcacagaaagtgagcagcaggagttcctggaggacttccggaggaccatggccagcagcatcctgaagtgggtggtgagccaccagagctgcagccgcagcagccgcagcaagccccgggaccagcgggaggaggccggcagcagtgacctgagcagccggcaggatgctgaaaatgctgaggccaagctgcggggcctgcccggccagctggtggacatcgcctgcaaggtgtgccaggcctacctgggccagctggagcacgaggacatcgacaccagcgcagatgctgtggaggacctgacagaagctgagtgggaggacctgacccagcagtactacagcctggtgcatggagatgccttcatcagcaacagcaggaactacttcagccagtgccaggccctgctgaaccgcatcacctctgtgaacccccagacagacattgatggcctgaggaacatctggatcatcaagccagctgccaagagccggggccgggacatcgtgtgcatggacagagtggaggagatcctggagctggccgctgctgaccaccccctgagccgggacaacaagtgggtggtgcagaagtacatcgagacccccctgctgatctgtgacaccaagtttgacatccggcagtggttcctggtgacagactggaaccccctgaccatctggttctacaaggagagctacctgcgcttcagcacccagcgcttcagcctggacaagctggacagcgccatccacctgtgcaacaatgctgtgcagaagtacctgaagaatgatgtgggccgcagccccctgctgcctgcccacaacatgtggaccagcacccgcttccaggagtacctgcagaggcagggcagaggagctgtgtggggcagcgtcatctaccccagcatgaagaaggccatcgcccacgccatgaaggtggcccaggaccacgtggagcccaggaagaacagctttgagctgtatggagctgactttgtgctgggccgggacttccggccctggctgattgagatcaacagcagccccaccatgcaccccagcacccctgtgacagcccagctgtgtgcccaggtgcaggaggacaccatcaaggtggccgtggacaggagctgtgacatcggcaactttgagctgctgtggaggcagcctgtggtggagcccccacccttcagcggcagtgacctgtgtgtggccggcgtgtctgtgcggcgggcccggcggcaggtgctgcctgtgtgcaacctgaaggccagcgccagcctgctggatgcccagcccctgaaggcccggggccccagcgccatgccagaccctgcccagggcccccccagccctgccctgcagagggacctgggcctgaaggaggagaagggcctgcccctggccctgctggcccccctgcggggagctgctgagagcggcggggccgcccagcccaccaggaccaaggccgccggcaaggtggagctgcctgcctgcccctgccgccacgtggacagccaggcccccaacacaggagtgcctgtggcccagcctgccaagtcctgggaccccaaccagctgaatgcccaccccctggagcctgtgctgcggggcctgaagacagctgagggcgccctgcggcccccacctgggggcaagggggagggcaccgtgtgcagccggctgccccaccacggccaccacgtggccgcctgccagaccaccggcaccacctgggatggcggccctggggtgtgcttcctgcggcagctgctggccagcgagctgcccatgggccctggcctgccccgggacccccgggccccaccctgcctggtgtgccggggcctgctgcccccagctggcccctgcaagcgctgccgctccttctgtgccgctgtgctgcagggcgccagctttgtgcggctgggcggccgcagctgcagccccaggaccccctag

SEQ ID NO: 21369 - DNA, 318 bp, Artificial Sequence
  Description of Artificial Sequence: Synthetic coding sequence
atggacaagaacattggagagcagctgaacaaggcctatgaggccttccggcaggcctgcatggaccgggacagcgctgtgaaggagctgcagcagaagacagaaaattatgagcagaggatccgggagcagcaggagcagctgagcctgcagcagaccatcatcgacaagctgaagagccagctgctgctggtgaacagcacccaggacaacaactacggctgtgtgcccctgctggaggacagcgagaccaggaagaacaacctgaccctggaccagccccaggacaaggtgatcagcggcatcgcccgggagtag

SEQ ID NO: 21370 - DNA, 816 bp, Artificial Sequence
  Description of Artificial Sequence: Synthetic coding sequence
atggcccctgtgggcgtggagaagaagctgctgctgggccccaatggacctgctgtggccgccgccggggacctgaccagcgaggaggaggagggccagagcctgtggagcagcatcctgtctgaggtgtccacccgggcccggagcaagctgcccagcggcaagaacatcctggtgtttgaccacacccgctgcaatgtgtggatcctggatggagacctgtaccacaagggcctgctgaagtttgctgtgtctgctgagagcctgcctgagaccctggtgatctttgtggccgacatgagccggccctggacagtgatggagagcctgcagaagtgggcctctgtgctgcgggagcacatcgacaagatgaagatccccccagagaagatgagggagctggagaggaagtttgtgaaggacttccaggactacatggagcctgaggagggctgccagggcagcccccagaggcggggccccctgaccagcggcagtgatgaagaaaatgtggccctgcccctgggggacaacgtgctgacccacaacctgggcatccctgtgctggtggtgtgcaccaagtgtgatgctgtgtctgtgctggagaaggagcatgactacagagatgagcacctggacttcatccagagccacctgcggcgcttctgcctgcagtacggggccgccctgatctacacctctgtgaaggaggagaagaacctggacctgctgtacaagtacatcgtgcacaagacctacggcttccacttcaccaccccagccctggtggtggagaaggatgctgtgttcatgtag

SEQ ID NO: 21371 - DNA, 522 bp, Artificial Sequence
  Description of Artificial Sequence: Synthetic coding sequence
atggctgacaggatgcagatcgtggtgatcctgtctgagttcttcaacaccacctggcaggaggccaactgtgccaactgcctgaccaacaacagcgaggagctgagcaacagcacagtgtacttcctgaacctcttcaaccacaccctgacctgctttgagcacaacctgcagggcaatgcccacagcctgctgcagaccaagaactacagcgaggtgtgcaagaactgccgggaggcctacaagaccctgagcagcctgtacagcgagatgcagaagatgaatgagctggagaacaaggccgagcccggcacccacctgtgcattgatgtggaggatgccatgaacatcaccaggaagctgtggagcaggaccttcaactgcagcgtgccctgcagcgacacagtgcctgtgattgctgtgtctgtgttcatcctcttcctgcctgtggtgttctacctgagcagcttcctgcacagcgagcagaagaagaggaagctgatcctgcccaagaggctgtag

SEQ ID NO: 21372 - DNA, 435 bp, Artificial Sequence
  Description of Artificial Sequence: Synthetic coding sequence
tgattcatccactgcacagatgacagcccagacccctgcatcgagtatgagctggtgctgaggaagtggtgtgagctgatccctggagctgagttccgctgctttgtgaaggagaacaagctgattggcatcagccagagggactacacccagtactatgaccacatcagcaagcagaaggaggagatccgccgctgcatccaggacttcttcaagaagcacatccagtacaagttcctggatgaggactttgtgtttgacatctacagagacagccggggcaaggtgtggctgattgacttcaacccctttggagaggtgacagacagcctgctcttcacctgggaggagctgatcagcgagaacaacctgaatggagacttcagcgaggtggatgcccaggagcagaagaggaaccagcaggaggatgactag

SEQ ID NO: 21373 - DNA, 978 bp, Artificial Sequence
  Description of Artificial Sequence: Synthetic coding sequence
tgaatccagggcgaggccagccggcgggctgctggggagcctgaggccggcagtgactatgtgaagttcagcaaggagaagtacatcctggacagcagccctgagaagctgcacaaggagctggaggaggagctgaagctgagcagcacagacctgcggagccacgcctggtaccacggccgcatcccccgggaggtgtctgagaccctggtgcagagaaatggagacttcctgatccgggacagcctgaccagcctgggggactatgtgctgacctgccgctggaggaaccaggccctgcacttcaagatcaacaaggtggtggtgaaggccggggagagctacacccacatccagtacctgtttgagcaggagagctttgaccacgtgcctgccctggtgcgctaccacgtgggcagcaggaaggctgtgtctgagcagagcggggccatcatctactgccctgtgaacagaaccttccccctgcgctacctggaggccagctatggcctgggccagggcagcagcaagccagccagccctgtgagccccagcggccccaagggcagccacatgaagagaagatctgtgaccatgacagatggcctgacagctgacaaggtgaccaggagtgatggctgccccaccagcaccagcctgccccggccccgggacagcatccgcagctgtgccctgtccatggaccagatcccagacctgcacagccccatgagccccatcagcgagagccccagcagccctgcctacagcacagtgaccagggtgcacgccgccccagctgcccccagcgccacagccctgcctgccagccctgtggcccggcgcagcagcgagccccagctgtgccccggcagcgcccccaagacccatggagagagtgacaagggcccccacaccagccccagccacaccctgggcaaggccagccccagccccagcctgagcagctacagctag

SEQ ID NO: 21374 - DNA, 330 bp, Artificial Sequence
  Description of Artificial Sequence: Synthetic coding sequence
atgagcagcaagggcagcagcacagatggccgcacagacctggccaacggcagcctgagcagcagccctgaggagatgtctggagctgaggagggccgggagaccagcagcggcatcgaggtggaggccagtgacctgagcctgagcctgactggagatgatggcggccccaacagaaccagcacagagagccggggcacagacacagagagcagcggggaggacaaggacagcgacagcatggaggacaccggccactacagcatcaatgatgagaacagagtgcatgacagaagtgaggaggaggaggaggaggaggaggaggagtag

SEQ ID NO: 21375 - DNA, 1638 bp, Artificial Sequence
  Description of Artificial Sequence: Synthetic coding sequence
gctgctggggccccccggctgctgggccctggagctgtgcggggccctgctggggtgggccgggtggccgccggggccatggagggcgtgctgtacaagtggaccaactacctgagcggctggcagccccgctggttcctgctgtgtggcggcatcctgagctactatgacagcccagaagatgcctggaagggctgcaagggcagcatccagatggctgtgtgtgagatccaggtgcacagcgtggacaacaccaggatggacctgatcatccctggagagcagtacttctacctgaaggcccggtctgtggccgagcggcagcgctggctggtggccctgggcagcgccaaggcctgcctgacagacagcaggacccagaaggagaaggagtttgctgagaacacagagaacctgaagaccaagatgtctgagctgcggctgtactgtgacctgctggtgcagcaggtggacaagaccaaggaggtgaccaccaccggggtgagcaacagcgaggagggcattgatgtgggcaccctgctgaagagcacctgcaacaccttcctgaagaccctggaggagtgcatgcagatcgccaatgctgccttcaccagcgagctgctgtaccgcaccccacctggcagcccccagctggccatgctgaagagcagcaagatgaagcaccccatcatccccatccacaacagcctggagcggcagatggagctgagcacctgtgaaaatggcagcctgaacatggagatcaacggggaggaggagatcctgatgaagaacaagaacagcctgtacctgaagtctgctgagattgactgcagcatcagcagcgaggagaacacagatgacaacatcaccgtgcagggcgagatcagaaaagaagatggcatggagaacctgaagaaccacgacaacaacctgacccagagcggcagtgacagcagctgcagccctgagtgcctgtgggaggagggcaaggaggtgatccccaccttcttcagcaccatgaacaccagcttcagtgacatcgagctgctggaggacagcggcatccccacagaggccttcctggccagctgctatgctgtggtgcctgtgctggacaagctgggccccaccgtgtttgcccctgtgaagatggacctggtgggcaacatcaagaaggtgaaccagaagtacatcaccaacaaggaggagttcaccaccctgcagaagatcgtgctgcacgaggtggaggctgatgtggcccaggtgaggaacagcgccacagaggccctgctgtggctgaagaggggcctgaagttcctgaagggcttcctgacagaggtgaagaatggagagaaggacatccagacagccctgaacaatgcctacggcaagaccctgcggcagcaccacggctgggtggtgcggggcgtgtttgccctggccctgcgggccgcccccagctatgaggactttgtggccgccctgactgtgaaggagggggaccaccagaaggaggccttcagcatcggcatgcagagggacctgagcctgtacctgcctgccatggagaagcagctggccatcctggacaccctgtatgaggtgcacggcctggagagtgatgaggtggtgtag

SEQ ID NO: 21376 - DNA, 522 bp, Artificial Sequence
  Description of Artificial Sequence: Synthetic coding sequence
atgtacaccctgctgagcggcctgtacaagtacatgttccagaaggatgagtactgcatcctgatcctgggcctggacaatgctgggaagaccaccttcctggagcagagcaagacccgcttcaacaagaactacaagggcatgagcctgagcaagatcaccaccaccgtgggcctgaacattggaacagtggatgtgggcaaggcccggctgatgttctgggacctgggcggccaggaggagctgcagagcctgtgggacaagtactatgcagagtgccacggcgtcatctacgtgattgacagcacagatgaggagcggctggccgagagcaagcaggcctttgagaaggtggtgaccagcgaggccctgtgtggggtgcctgtgctggtgctggccaacaagcaggatgtggagacctgcctgagcatcccagacatcaagacagccttcagtgactgcaccagcaagattggccggcgggactgcctgacccaggcctgcagcgccctgaccggctag

SEQ ID NO: 21377 - DNA, 729 bp, Artificial Sequence
  Description of Artificial Sequence: Synthetic coding sequence
atgggcctggtgtgtgtgctgggagatggcaagacagagcagaagggcggggacaagaagaggggcgtgaagaggccccgggaggaccacggccggggctactttgagtacatcgaggagaacaagtacagccgggccaagagcccccagccccctgtggaggaggaggatgagcactttgatgacacagtggtgtgcctggacacctacaactgtgacctgcacttcaagatcagccgggaccggctgagcgccagcagcctgaccatggagagctttgccttcctgtgggccggcggccgggccagctatggagtgtccaagggcaaggtgtgctttgagatgaaggtgacagagaagatccctgtgcgccacctgtacaccaaggacatcgacatccacgaggtgcgcatcggctggagcctgaccaccagcggcatgctgctgggggaggaggagttctcctatggctacagcctgaagggcatcaagacctgcaactgtgaaacagaagattatggagagaagtttgatgaaaatgatgtgatcacctgctttgccaactttgaaagtgatgaggtggagctgtcctatgccaagaatggccaggacctgggcgtggccttcaagatcagcaaggaggtgctggccggccggcccctcttcccccacgtgctgtgccacaactgtgctgtggagttcaactttggccagaaggagaagccctag

SEQ ID NO: 21378 - DNA, 2922 bp, Artificial Sequence
  Description of Artificial Sequence: Synthetic coding sequence
agcagcagtgacaaggagagcatcctgaccatcctgaaggtgctgggggacctgctgtctgtgggcacagaccggcgcatccactacatgatcagcaaaggaggcagcgaggccctgctgcagaccctggtggacacagccaggacagcccccccagactatgacatcctgctgcccctcttccggctgctggccaaggtgggcctgcgggacaagaagattggaaggaaggccctggagctggaggccctggatgtgaccctcatcctggccaggaagaacctgagccacggccagaacctgctgcactgcctgtgggccctgcgggtgtttgccagctctgtgtccatgggcgccatgctgggcatcaacggggccatggagctgctcttcaaggtgatcaccccctacaccaggaagaggacccaggccatccgggccgccacagaggtgctggccgccctgctgaagagcaagagcaatggaagaagagctgtgaacagaggctacgtgaccagcctgctgggcctgcaccaggactggcacagccatgacacagccaatgcctacgtgcagatccggcggggcctgctgctgtgcctgcggcacatcgccgccctgcggagcggccgggaggccttcctggccgcccagggcatggagatcctcttcagcaccacccagaactgcctggatgacaagtccatggagcccgtcatctctgtggtgctgcagatcctgcggcagtgctaccccaccagccccctgcccctggtgacagccagcagcgcctatgccttccctgtgcccggctgcatcaccacagagccccctcatgacctgcctgaggaggactttgaagatgatggagatgatgaggtggacaaggacagcgacacagaagatggcaaggtggaggatgatgacctggagacagatgtgaacaagctgagcagcaagccaggcctggacaggcctgaggaggagctgatgcagtatgaggtgatgtgcctggagctgagctacagctttgaggagctgcagagcaagctgggagatgacctgaacagcgagaagacccagtatgccaaccaccaccacatcccagctgctgccagcagcaagcagcactgctacagcaaggaccagagcagctgtggccaggagcgggagtatgctgtgcagaccagcctgctgtgccgggtgaagacaggccgcagcacagtgcacctgggcagcaagaagaaccctggggtgaacctgtaccagaatgtgcagagcaacagcctgcggcgggacagcagcgagagcgagatcccagacatccaggccagccccaaggcagatgcctgggatgtggatgccatcttctgccccaggatgtctgccagcttcagcaacagcaccaggacccgggaggtggtgaaggtgattgacaagctgctgcagacccacctgaagagggtgcccttccatgacccctacctgtacatggccaaggcccggaggaccagctctgtggtggacttcaagatgatggccttcccagatgtgtggggccactgccccccacccaccacccagcccatgctggagaggaaatgtggggtgcagaggatccgcatctttgaggacatcagaagactcatccagcccagtgatgtgatcaacaaggtggtgttcagcctggatgagccctggcccctgcaggacaatgccagcaactgcctgcgcttcttcagcaagtttgaaagtggcaacctgaggaaggccatccaggtgcgggagtttgaatatgacctgctggtgaatgctgatgtgaacagcacccagcaccagcagtggttctacttcaaggtgtctggcatgcaggccgccatcccctaccacttcaacatcatcaactgtgagaagcccaacagccagttcaactacggcatgcagcccaccctgtacagcgtgaaggaggccctgctgggcaagcccacctggatcagaactggacatgagatctgctactacaagaaccactaccggcagagcacagctgtggccggcggggccagcggcaagtgctactacaccctgacctttgctgtgaccttcccccacagtgaagatgtgtgctacctggcctaccactacccctacacctacacagccctgatgacccacctggacatcctggagaagtctgtgaacctgaaggaggtgtacttccggcaggatgtgctgtgccagaccctgggcggcaacccctgccccctggtgaccatcacagccatgcctgagagcaacagtgatgagcacctggagcagttccgccaccggccctaccaggtgatcacagcccgggtgcaccctggagagagcaatgcctcctgggtgatgaagggcaccctggagttcctggtgtccagtgaccctgtggcccggctgctgcgggagaacttcatcttcaagatcatccccatgctgaacccagatggagtcatcaatggaaaccaccgctgcagcctgtctggagaggacctgaaccggcagtggctgagccccagcgcccacctgcagcccaccatctaccacgccaagggcctgctgtaccacctgagcagcatcggccgcagccctgtggtgagccacttcctgctggtgttctgtgacttccacggccacagccagaagaagaatgtgttcctgtatggctgcagcatcaaggagaccctgtggcaggccgcctgcaccgtgggcaccagcaccatcctggaggaggtgaactaccgcaccctgcccaagatcctggacaagctggccccagccttcaccatgagcagctgcagcttcctggtggagaagagccgggccagcacagcccgggtggtggtgtggagggagatgggcgtgagccgcagctacacctag

SEQ ID NO: 21379 - DNA, 7752 bp, Artificial Sequence
  Description of Artificial Sequence: Synthetic coding sequence
tgaagcagcatcaccttctctgtgaaggtggagggccggcctgtgcccaccgtgcactggctgcgggaggaggccgagcggggcgtgctgtggattggccctgacaccccaggctacacagtggccagcagcgcccagcagcacagcctggtgctgctggatgtgggccggcagcaccagggcacctacacctgcatcgccagcaatgctgctggccaggccctgtgcagcgccagcctgcacgtgtctggcctgcccaaggtggaggagcaggagaaggtgaaggaggccctgatcagcaccttcctgcagggcaccacccaggccatcagcgcccagggcctggagacagccagctttgctgacctgggcggccagaggaaggaggagcccctggccgccaaggaggccctgggccacctgagcctggccgaggtgggcacagaggagttcctgcagaagctgaccagccagatcacagagatggtgtctgccaagatcacccaggccaagctgcaggtgcctggaggagacagtgatgaggacagcaagaccccatctgccagccccaggcatggccgcagccggcccagcagcagcatccaggagagcagcagcgagagtgaagatggagatgcccggggggagatctttgacatctacgtggtgacagctgactacctgcccctgggcgctgagcaggatgccatcaccctgcgggagggccagtatgtggaggtgctggatgctgcccaccccctgcgctggctggtgaggaccaagcccaccaagagcagccccagccggcagggctgggtgtccccagcctacctggaccggcggctgaagctgagccctgagtggggcgctgctgaggcccctgagttccctggagaggccgtgtctgaagatgagtacaaggcccggctgagcagcgtcatccaggagctgctgagcagcgagcaggcctttgtggaggagctgcagttcctgcagagccaccacctgcagcacctggagcgctgcccccacgtgcccatcgctgtggccggccagaaggccgtcatcttcagaaatgtgcgggacatcggccgcttccacagcagcagcttcctgcaggagctgcagcagtgtgacacagatgatgatgtggccatgtgcttcatcaagaaccaggccgcctttgagcagtacctggagttcctggtgggccgggtgcaggccgagagcgtggtggtgtccacagccatccaggagttctacaagaagtatgcagaggaggccctgctggccggggaccccagccagcccccacctccacccctgcagcactacctggagcagcctgtggagcgggtgcagcgctaccaggccctgctgaaggagctgatccggaacaaggccaggaaccggcagaactgtgccctgctggagcaggcctatgctgtggtgtctgccctgccccagagagctgagaacaagctgcacgtgtccctgatggagaactacccaggcaccctgcaggccctgggggagcccatccggcagggccacttcatcgtgtgggagggcgcccctggggccaggatgccctggaagggccacaacagacatgtgttcctgttcaggaaccacctggtgatctgcaagccccggcgggacagcaggacagacacagtgtcctatgtgttcaggaacatgatgaagctgagcagcattgacctgaatgaccaggtggagggagatgaccgggcctttgaggtgtggcaggagagagaagattctgtgaggaagtacctgctgcaggccaggacagccatcatcaagagctcctgggtgaaggagatctgtggcatccagcagaggctggccctgcctgtgtggaggcccccagactttgaggaggagctggccgactgcacagctgagctgggggagaccgtgaagctggcctgccgggtgacaggcacccccaagcctgtgatctcctggtacaaggatggcaaggctgtgcaggtggacccccaccacatcctgattgaagatcctgatggcagctgtgccctgatcctggacagcctgactggagtggacagcggccagtacatgtgctttgctgccagcgctgctggcaactgcagcaccctgggcaagatcctggtgcaggtgccccccaggtttgtgaacaaggtgcgggccagcccctttgtggagggggaggatgcccagttcacctgcaccatcgagggcgccccctacccccagatccgctggtacaaggatggagccctgctgaccactggaaacaagttccagaccctgtctgagcccaggagcggcctgctggtgctggtgatccgggccgccagcaaggaggacctgggcctgtatgaatgtgagctggtgaaccggctgggcagcgcccgggccagcgctgagctgcgcatccagagccccatgctgcaggcccaggagcagtgccaccgggagcagctggtggccgctgtggaggacaccaccctggagagagctgaccaggaggtgacctctgtgctgaagaggctgctgggccccaaggcccctggccccagcactggagacctgactggacctggcccctgccccaggggggccccagccctgcaggagaccggcagccagccccctgtgacaggcaccagcgaggccccagctgtgcccccccgggtgccccagcccctgctgcacgagggccctgagcaggagcctgaggccatcgcccgggcccaggagtggacagtgcccatccgcatggagggcgccgcctggccaggagctggcactggagagctgctgtgggatgtgcacagccacgtggtgcgggagaccacccagaggacctacacctaccaggccatcgacacccacacagcccggcccccatccatgcaggtgaccattgaagatgtgcaggcccagacaggaggaacagcccagtttgaggccatcattgaaggagacccccagcccagcgtgacctggtacaaggacagcgtgcagctggtggacagcacccggctgagccagcagcaggagggcaccacctacagcctggtgctgcggcacgtggccagcaaggatgctggggtgtacacctgcctggcccagaacacaggaggccaggtgctgtgcaaggccgagctgctggtgctgggcggggacaatgaaccagacagcgagaagcagagccacaggaggaagctgcacagcttctatgaggtgaaggaggagatcggccggggcgtgtttggatttgtgaagagggtgcagcacaagggcaacaagatcctgtgtgccgccaagttcatccccctgcggagcaggacccgggcccaggcctaccgggagcgggacatcctggccgccctgagccaccccctggtgacaggcctgctggaccagtttgagaccaggaagaccctcatcctgatcctggagctgtgcagcagcgaggagctgctggaccggctgtacagaaaaggagtggtgacagaagctgaggtgaaggtgtacatccagcagctggtggagggcctgcactacctgcacagccacggcgtgctgcacctggacatcaagcccagcaacatcctgatggtgcacccagcccgggaggacatcaagatctgtgactttggatttgcccagaacatcaccccagctgagctgcagttcagccagtatggcagccctgagtttgtgtccccagagatcatccagcagaaccctgtgtctgaggccagtgacatctgggccatgggcgtcatctcctacctgagcctgacctgcagcagcccctttgctggggagagtgaccgggccaccctgctgaatgtgctggagggccgggtgtcctggagcagccccatggccgcccacctgtctgaagatgccaaggacttcatcaaggccaccctgcagagggccccccaggcccggcccagcgctgcccagtgcctgagccacccctggttcctgaagtccatgcctgctgaggaggcccacttcatcaacaccaagcagctgaagttcctgctggcccggagccgctggcagaggagcctgatgagctacaagagcatcctggtgatgaggagcatccctgagctgctgcggggccccccagacagccccagcctgggcgtggcccggcacctgtgccgggacacaggaggcagcagcagcagcagcagcagcagtgacaatgagctggccccctttgcccgggccaagagcctgccccccagccctgtgacccacagccccctgctgcacccccggggcttcctgcggcccagcgccagcctgcctgaggaggccgaggccagcgagaggagcacagaggccccagcccccccagccagccctgagggcgccggccccccagctgcccagggctgtgtgcccaggcacagcgtcatccgcagcctcttctaccaccaggccggggagagccctgagcacggggccctggcccctggcagcagaagacacccagccaggagaagacacctgctgaagggcggctacatcgccggggccctgcccggcctgcgggagcccctgatggagcaccgggtgctggaggaggaggccgcccgggaggagcaggccaccctgctggccaaggcccccagctttgaaacagccctgcggctgcctgccagcggcacccacctggcccctggccacagccacagcctggagcatgacagccccagcaccccccggcccagcagcgaggcctgtggggaggcccagaggctgcccagcgcccccagcggcggggcccccatccgggacatgggccacccccagggcagcaagcagctgcccagcactggaggccaccctggaacagcccagcctgagcggcccagcccagacagcccctggggccagcctgcccccttctgccaccccaagcagggcagcgccccccaggagggctgcagcccccaccctgctgtggccccctgccccccaggcagcttccccccaggcagctgcaaggaggcccccctggtgcccagcagccccttcctgggccagccccaggcccccccagccccagccaaggccagcccccccctggacagcaagatgggccctggggacatcagcctgcccggccggcccaagccaggcccctgcagcagccctggcagcgccagccaggccagcagcagccaggtgagcagcctgcgggtgggcagcagccaggtgggcacagagcccggccccagcctggatgctgagggctggacccaggaggccgaggacctgagtgacagcacccccaccctgcagaggccccaggagcaggccaccatgaggaagttcagcctgggcggccggggcggctacgccggcgtggccggctacggcacctttgcctttggaggagatgctgggggcatgctgggccagggccccatgtgggcccgcatcgcctgggccgtgtcccagagcgaggaggaggagcaggaggaggcccgggcagagagccagagcgaggagcagcaggaggcccgggcagagagccccctgccccaggtgtctgcccggcctgtgcctgaggtgggccgggcccccaccaggagcagccctgagcccaccccctgggaggacatcggccaggtgtccctggtgcagatccgggacctgtctggagatgctgaggccgctgacaccatcagcctggacatcagcgaggtggaccctgcctacctgaacctgagtgacctgtatgacatcaagtacctgccctttgagttcatgatcttcaggaaggtgcccaagagcgcccagcctgagccccccagccccatggccgaggaggagctggccgagttccctgagcccacctggccctggccaggagagctgggcccccacgccggcctggagatcacagaggagagtgaagatgtggatgccctgctggccgaggccgctgtgggcaggaagaggaagtggagcagccccagccgcagcctcttccacttccctggccgccacctgcccctggatgagcctgctgagctgggcctgcgggagcgggtgaaggcctctgtggagcacatcagccgcatcctgaagggccggcctgagggcctggagaaggagggcccccccaggaagaagccaggcctggccagcttccggctgagcggcctgaagtcctgggaccgggcccccaccttcctgcgggagctgagtgatgagaccgtggtgctgggccagagcgtgaccctggcctgccaggtgtctgcccagcctgctgcccaggccacctggagcaaggatggagcccccctggagagcagcagccgggtgctgatcagcgccaccctgaagaacttccagctgctgaccatcctggtggtggtggccgaggacctgggcgtgtacacctgcagcgtgtccaatgccctgggcaccgtgaccaccactggagtgctgaggaaggccgagcggcccagcagcagcccctgcccagacatcggggaggtgtatgcagatggagtgctgctggtgtggaagcctgtggagagctatggccctgtgacctacatcgtgcagtgcagcctggagggcggctcctggaccaccctggccagtgacatctttgactgctgctacctgaccagcaagctgagccggggcggcacctacaccttcagaacagcctgtgtgtccaaggccggcatgggcccctacagcagccccagcgagcaggtgctgctgggcggccccagccacctggccagcgaggaggagagccagggccgcagcgcccagcccctgcccagcaccaagacctttgccttccagacccagatccagaggggccgcttctctgtggtgcggcagtgctgggagaaggccagcggccgggccctggccgccaagatcatcccctaccaccccaaggacaagacagctgtgctgcgggagtatgaggccctgaagggcctgcggcacccccacctggcccagctgcacgccgcctacctgagccccaggcacctggtgctgatcctggagctgtgcagcggccctgagctgctgccctgcctggccgagcgggccagctacagcgagagcgaggtgaaggactacctgtggcagatgctgagcgccacccagtacctgcacaaccagcacatcctgcacctggacctgcggtctgagaacatgatcatcacagagtacaacctgctgaaggtggtggacctgggcaatgcccagagcctgagccaggagaaggtgctgcccagcgacaagttcaaggactacctggagaccatggagctgctggagggccagggcgctgtgccccagacagacatctgggccatcggcgtgacagccttcatcatgctgtctgctgagtaccctgtgagcagcgagggcgcccgggacctgcagaggggcctgaggaagggcctggtgcggctgagccgctgctacgccggcctgtctggaggagctgtggccttcctgcggagcaccctgtgtgcccagccctggggccggccctgtgccagcagctgcctgcagtgcccctggctgacagaggagggccctgcctgcagcaggcctgcccctgtgaccttccccacagcccggctgcgggtgtttgtgaggaaccgggagaagagaagagccctgctgtacaagaggcacaacctggcccaggtgaggtag

SEQ ID NO: 21380 - DNA, 1749 bp, Artificial Sequence
  Description of Artificial Sequence: Synthetic coding sequence
atggagaaggctgtgaatgatggcagccacagcgaggagctgttctgccacctgaagaccatcagcgagaaggaggacctgccccgctgcaccagcgagagccacctgagctgcctgaagcaggacatcctgaatgagaagacagagctggaggccaccctgaaggaggccgagctggtgacccacagcgtggagctgctgctgcccctcttcaaggacaccatcgagaagatcaactttgaaaatgccaacctgagcgccctgaacctgaagatcagcgagcagaaggagatcctgatcaaggagctggacaccttcaagtctgtgaagctggccctggagcacctgctgaggaagagggactacaagcagacaggagacaacctgagctccatgctgctggagaacctgacagacaatgaaagtgagaacaccaacctgaagaagaaggtgtttgagaaggaggcccacatccaggagctgagctgcctcttccagagcgagaaggccaacaccctgaaggccaaccgcttcagccagagcgtgaaggtggtgcatgagcggctgcagatccagatccacaagcgggaggctgaaaatgacaagctgaaggagtatgtgaagagcctggagaccaagatcgccaagtggaacctgcagagcaggatgaacaagaatgaggccatcgtgatgaaggaggccagccggcagaagacagtggccctgaagaaggccagcaaggtgtacaagcagaggctggaccacttcaccggggccatcgagaagctgaccagccagatccgggaccaggaggccaagctgtctgagaccatcagcgccagcaatgcctggaagagccactatgagaagatcgtgattgagaagacagagctggaggtgcagatcgagaccatgaagaagcagatcatcaacctgctggaggacctgaagaagatggaggaccacggcaagaacagctgtgaggagatcctgaggaaggtgcacagcattgaatatgaaaatgagaccctgaacctggagaacaccaagctgaagaccaccctggccgccctgaaggatgaggtggtgtctgtggagaatgagctgtctgagctgcaggaggtggagaagaagcagaagaccctgattgagatgtacaagacccaggtgcagaagctgcaggaggccgctgagatcgtgaagagccgctgtgagaacctgctgcacaagaacaaccagatcaccaagaccaagaacaagaatgtggagaagatgaggggccagatggagagccacctgaaggagctggagcgggtgtgtgacagcctgacagctgctgagcggcggctgcacgagtgccaggtggatggcaaccacaacctgctgaccaagctgagcctggaggaggagaactgcctgatccagctgaagtgtgagaacctgcagcagaagctggagcagatggatgctgagaacaaggagctggagaagaagctggccaaccaggaggagtgcctgaagcacagcaacctgaagttcaaggagaagtctgctgagtacacagccctggcccggcagctggaggccgccctggaggagggccggcagaaggtggccgaggagattgagaagatgagcagccgggagagcgccctgcagatcaagatcctggacctggagacagagctgaggaagaagaatgaggagcagaaccagctggtgtgcaagatgaacagcaccaatggatag

SEQ ID NO: 21381 - DNA, 384 bp, Artificial Sequence
  Description of Artificial Sequence: Synthetic coding sequence
atggtgagcagcggccgccgctggctgcgggagcagcagcaccggcgctggaggctgcactgcctgaagctgcagcccctgagccctgtgcccagcgacatcgagatcagccggggccagacccccaaggctgtggatgtgctggccaaggagatcggcctgctggctgatgaaattgagatctacggcaagagcaaggccaaggtgcggctgtctgtgctggagcggctgaaggaccaggctgatggcaagtatgtgctggtggccggcatcacccccacccccctgggggagggcaagagcacagtgaccatcggcctggtgcaggccctgacagcccacctgaatgtgaacagctttgcctgcctgcggcagcccagctag

SEQ ID NO: 21382 - DNA, 1929 bp, Artificial Sequence
  Description of Artificial Sequence: Synthetic coding sequence
atgaagatcttctgcagccgggccaaccccaccaccggctctgtggagtggctggaggaggatgagcactatgactaccaccaggagatcgcccggagcagctatgctgacatgctgcatgacaaggacagagtcttcaagcccatggctgatgctgctgtgaagatcgtggagaagaatggcttcagtgacaagatcaaggtgatcaacaagcacagcacagaggtgacagtgggccctgagggggacatgccctgccgggccaacatcctggtgacagagctgtttgacacagagctgattggagagggcgccctgcccagctatgaacatgcccaccgccacctggtggaggagaactgtgaggccgtgccccaccgggccaccgtgtatgcccagctggtggagagcggccgcatgtggagctggaacaagctgttccccatccacgtgcagaccagcctgggggagcaggtgattgtgccccctgtggatgtggagagctgccctggggcccccagcgtgtgtgacatccagctgaaccaggtgtccccagctgacttcaccgtgctgagtgatgtgctgcccatgttcagcattgacttcagcaagcaggtgagcagcagcgctgcctgccacagcagaagatttgagcccctgaccagcggccgggcccaggtggtgctgtcctggtgggacatcgagatggaccctgagggcaagatcaagtgcaccatggcccccttctgggcccacagcgaccctgaggagatgcagtggagggaccactggatgcagtgtgtgtacttcctgccccaggaggagcctgtggtgcagggcagcgccctgtacctggtggcccaccatgatgactactgtgtgtggtacagcctgcagaggaccagccctgagaagaatgaaagagtgcggcagatgaggcctgtgtgtgactgccaggcccacctgctgtggaaccggcccaggtttggagagatcaatgaccaggacagaacagacagatatgtgcaggccctgaggacagtgctgaagccagattctgtgtgcctgtgtgtgtctgatggcagcctgctgtctgtgctggcccaccacctgggcgtggagcaggtgttcaccgtggagagcagcgctgccagccacaagctgctgaggaagatcttcaaggccaaccacctggaggacaagatcaacatcatcgagaagaggcctgagctgctgaccaatgaagacctgcagggcaggaaggtgtccctgctgctgggggagcccttcttcaccaccagcctgctgccctggcacaacctgtacttctggtacgtgaggacagctgtggaccagcacctgggccctggggccatggtgatgccccaggccgccagcctgcatgctgtggtggtggagttccgggacctgtggaggatccgcagcccctgtggggactgtgagggctttgatgtgcacatcatggatgacatgatcaagagggccctggacttccgggagagccgggaggccgagccccaccccctgtgggagtacccctgccgcagcctgtctgagccctggcagatcctgacctttgacttccagcagcctgtgcccctgcagcccctgtgtgccgagggcaccgtggagctgcggcggcccggccagagccacgccgctgtgctgtggatggagtaccacctgaccccagagtgcaccctgagcacaggcctgctggagcctgctgaccctgagggcggctgctgctggaacccccactgcaagcaggccgtgtacttcttcagccctgccccagacccccgggccctgctgggcggccccaggacagtgtcctatgctgtggagttccacccagacaccggggacatcatcatggagttcagacatgctgacaccccagactag

SEQ ID NO: 21383 - DNA, 300 bp, Artificial Sequence
  Description of Artificial Sequence: Synthetic coding sequence
atggtggtgaagctgctgagcaacaagaggagccaggccgtgggcatcctgatgagcagcctgcacctggacatgaaggacatccagcacgctgtggtgaacctggacaacagcgtggtggacctggagaccctgcaggccctgtatgagaacagagcccagagtgatgagctggagaagattgagaagcacggccgcagcagcaaggacaaggaaaatgccaagagcctggacaagccagagcagttcctgtatgagctgagcctcatccccaacttcagcgagagggtcttctgctag

SEQ ID NO: 21384 - DNA, 390 bp, Artificial Sequence
  Description of Artificial Sequence: Synthetic coding sequence
atgggcggctgcttcagcaagcccaagcctgtggagctgaagattgaggtggtgctgcctgagaaggagcggggcaaggaggagctgagcgccagcggcaagggcagcccccgggcctaccagggcaatggaacagcccggcacttccacacagaggagcggctgagcaccccccacccctaccccagcccccaggactgtgtggaggccgctgtgtgccacgtgaaggacctggagaatggccagatgagggaggtggagctgggctggggcaaggtgctgctggtgaaggacaatggagagttccacgccctgggccacaagtgcccccactacggggcccccctggtgaagggcgtgctgagccggggccgggtgcgctgcccctag

SEQ ID NO: 21385 - DNA, 453 bp, Artificial Sequence
  Description of Artificial Sequence: Synthetic coding sequence
atgaacctggccgagatctgtgacaatgccaagaagggccgggagtatgccctgctgggcaactatgacagctccatggtgtactaccagggcgtgatgcagcagatccagaggcactgccagagcgtgcgggaccctgccatcaagggcaagtggcagcaggtgcggcaggagctgctggaggagtatgagcaggtgaagagcatcgtgtccaccctggagagcttcaagattgacaagcccccagacttccctgtgtcctgccaggatgagcccttccgggaccctgctgtgtggcccccacctgtgcctgctgagcaccgggccccaccccagatccggcggcccaaccgggaggtgcggcccctgaggaaggagatggccggcgtgggcgcccggggccctgtgggccgggcccaccccatcagcaagtctgagaagcccagcacctag

SEQ ID NO: 21386 - DNA, 498 bp, Artificial Sequence
  Description of Artificial Sequence: Synthetic coding sequence
atgggcgtgaaccagagcgtgggcttcccccctgtgacaggcccccacctggtgggctgtggagatgtgatggagggccagaacctgcagggcagcttcttccgcctcttctacccctgccagaaggccgaggagaccatggagcagcccctgtggatccccaggtatgagtactgcaccggcctggccgagtacctgcagttcaacaagagatgtggcggcctgctcttcaacctggccgtgggcagctgccgcctgcctgtgtcctggaatggccccttcaagaccaaggacagcggctaccccctcatcatcttcagccacggcctgggcgccttccgcaccctgtacagcgccttctgcatggagctggccagccggggctttgtggtggccgtgcctgagcaccgggacagatctgctgccaccacctacttctgcaagcaggcccctgaggagaaccagcccaccaatgaaagcctgcaggaggagtggtag

SEQ ID NO: 21387 - DNA, 270 bp, Artificial Sequence; identical to SEQ ID NO: 20498
  Description of Artificial Sequence: Synthetic coding sequence

SEQ ID NO: 21388 - DNA, 6009 bp, Artificial Sequence
  Description of Artificial Sequence: Synthetic coding sequence
atggaggagaggaagcatgagaccatgaacccagcccacgtgctgtttgacagatttgtgcaggccaccacctgcaagggcaccctgaaggccttccaggagctgtgtgaccacctggagctgaagcccaaggactaccgctccttctaccacaagctgaagagcaagctgaactactggaaggccaaggccctgtgggccaagctggacaagaggggcagccacaaggactacaagaagggcaaggcctgcaccaacaccaagtgcctgatcatcggggccggcccctgtggcctgaggacagccatcgacctgagcctgctgggcgccaaggtggtggtgattgagaagagagatgccttcagcagaaataatgtgctgcacctgtggcccttcaccatccatgacctgcggggcctgggcgccaagaagttctacggcaagttctgtgccggggccatcgaccacatcagcatccggcagctgcagctgatcctgctgaaggtggccctgatcctgggcatcgagatccacgtgaatgtggagttccagggcctcatccagcccccagaggaccaggagaatgaaagaattggctggagggccctggtgcaccccaagacccaccctgtgtctgaatatgaatttgaggtgatcattggaggagatggaagaagaaacaccctggagggcttccggaggaaggagttccggggcaagctggccatcgccatcacagccaacttcatcaacagaaacaccacagctgaggccaaggtggaggagatcagcggcgtggccttcatcttcaaccagaagttcttccaggagctgcgggaggccaccggcatcgacctggagaacatcgtgtactacaaggatgacacccactactttgtgatgacagccaagaagcagagcctgctggacaagggcgtcatcctgcatgactatgctgacacagagctgctgctgagccgggagaatgtggaccaggaggccctgctgtcctatgcccgggaggccgctgacttcagcacccagcagcagctgcccagcctggactttgccatcaaccactacggccagccagatgtggccatgtttgacttcacctgcatgtatgcctctgaaaatgctgccctggtgcgggagcagaatggccaccagctgctggtggccctggtgggggacagcctgctggagcccttctggcccatgggcactggaattgcccggggcttcctggccgccatggattctgcctggatggtgcgctcctggagcctgggcaccagccccctggaggtgctggccgagcgggagagcatctaccgcctgctgccccagaccaccccagaaaatgtgtccaagaacttcagccagtacagcattgatcctgtgacccgctaccccaacatcaacgtgaacttcctgcggcccagccaggtgcgccacctgtatgacaccggggagaccaaggacatccacctggagatggagagcctggtgaacagcaggaccacccccaagctgaccagaaatgaatctgtggcccggagcagcaagctgctgggctggtgccagaggcagacagatggctacgccggcgtgaatgtgacagacctgaccatgtcctggaagagcggcctggccctgtgtgccatcatccaccgctacagaccagacctgattgactttgacagcctggatgagcagaatgtggagaagaacaaccagctggcctttgatattgctgagaaggagctgggcatcagccccatcatgaccgggaaggagatggcctctgtgggggagccagacaagctgtccatggtgatgtacctgacccagttctatgagatgttcaaggacagcctgcccagcagtgacaccctggacctgaatgctgaggagaaggctgtgctgattgccagcaccaggagccccatctccttcctgagcaagctgggccagaccatcagcaggaagaggagccccaaggacaagaaggagaaggacctggatggagctgggaagaggaggaagaccagccagagcgaggaggaggaggccccccggggccacagaggagagcggcccaccctggtgtccaccctgacagacaggaggatggatgtggccgtgggcaaccagaacaaggtgaagtacatggccacccagctgctggccaagtttgaagaaaatgccccagcccagagcatcggcatccggcggcagggctccatgaagaaggagttcccccagaacctgggcggcagtgacacctgctacttctgccagaagagggtgtatgtgatggagcggctgtctgctgagggcaagttcttccacaggagctgcttcaagtgtgagtactgtgccaccaccctgcggctgagcgcctatgcctatgacattgaagatggcaagttctactgcaagccccactactgctaccgcctgagcggctacgcccagaggaagaggcctgctgtggcccccctgagcggcaaggaggccaagggccccctgcaggatggagccaccacagatgccaacggccgggccaatgctgtggccagcagcacagagaggaccccaggcagcggcgtgaatggcctggaggagcccagcatcgccaagaggctgcggggcaccccagagagaattgagctggagaactaccgcctgagcctgcggcaggccgaggccctgcaggaggtgcctgaggagacccaggccgagcacaacctgagctctgtgctggacacaggagcagaagaagatgtggccagcagcagcagcgagagcgagatggaggaggagggggaggaggaggaggaggagccccggctgccccccagcgacctgggcggcgtgccctggaaggaggccgtgcgcatccacgccctgctgaagggcaagtctgaggaggagctggaggccagcaagagctttggacctggaaatgaggaggaggaggaggaggaggaggagtatgaggaggaggaggaggaggactatgatgaggaggaggaggagagcagcgaggccggcaaccagaggctgcagcaggtgatgcacgccgctgaccccctggagatccaggctgatgtgcactggacccacatccgggagcgggaggaggaggagaggatggccccagccagcgagagcagcgccagcggggcccccctggatgaaaatgacctggaggaggatgtggacagcgagcctgctgagattgaaggagaggccgcagaagatggagaccccggggacaccggggctgagctggatgatgaccagcactggagcgacagccccagtgatgctgaccgggagctgcggctgccctgcccagctgagggggaggccgagctggagctgcgggtgtctgaagatgaggagaagctgcctgccagccccaagcaccaggagcggggccccagccaggccaccagccccatccgcagcccccaggagagcgccctgctcttcatccctgtgcacagccccagcacagagggcccccagctgccccctgtgcctgctgccacccaggagaagagccctgaggagcggctcttccctgagcccctgctgcccaaggagaagcccaaggcagatgcccccagcgacctgaaggctgtgcacagccccatccgcagccagcctgtgaccctgcctgaggcccggacccctgtgtccccaggcagcccccagccccagccccctgtggccgccagcaccccaccacccagccccctgcccatctgcagccagccccagcccagcacagaggccaccgtgcccagccccacccagagccccatccgcttccagcctgccccagccaagaccagcacccccctggcccccctgcctgtgcagagccagagcgacaccaaggaccggctgggcagccccctggccgtggatgaggccctgcggcggagtgacctggtggaggagttctggatgaagtctgctgagatcagaagaagcctgggcctgacccctgtggacaggagcaaaggacctgagcccagcttccccaccccagccttccggcctgtgtccctgaagagctacagcgtggagaagagcccccaggatgagggcctgcacctgctgaagcccctgagcatccccaagaggctgggcctgcccaagccagagggggagcccctgagcctgcccacccccaggagccccagcgaccgggagctgcggagcgcccaggaggagcggcgggagctgagcagcagcagcggcctgggcctgcacggcagcagcagcaacatgaagaccctgggcagccagagcttcaacaccagtgacagcgccatgctgaccccacccagcagccccccacctcctcctcctcctggagaggagcccgccaccctgcggaggaagctgcgggaggccgagcccaatgcctctgtggtgcccccacccctgcctgccacctggatgaggcctccccgggagcccgcccagcccccccgggaggaggtgaggaagagctttgtggagagcgtggaggagatcccctttgctgatgatgtggaggacacctatgatgacaagacagaggacagcagcctgcaggagaagttcttcaccccacccagctgctggcccaggcctgagaagcccaggcacccccccctggccaaggaaaatggccgcctgcctgccctggagggcaccctgcagccccagaagaggggcctgcccctggtgtctgctgaggccaaggagctggccgaggagaggatgagggcccgggagaagtctgtgaagagccaggccctgagagatgccatggcccggcagctgagcaggatgcagcagatggagctggccagcggggccccccggcccaggaaggccagcagcgcccccagccagggcaaggagaggaggccagacagccccacccggcccaccctgcggggcagcgaggagcccaccctgaagcatgaggccaccagcgaggaggtgctgagccccccaagtgacagcggcggcccagatggcagcttcaccagcagcgagggcagcagcggcaagagcaagaagaggagcagcctcttcagccccaggaggaacaagaaggagaagaagagcaaaggagagggccggcccccagagaagcccagcagcaacctgctggaggaggccgccgccaagcccaagagcctgtggaagagcgtcttcagcggctacaagaaggacaagaagaagaaggcagatgacaagagctgccccagcacccccagcagcggggccaccgtggacagcggcaagcaccgggtgctgcctgtggtgcgggcagagctgcagctgcggcggcagctgtccttctctgaagattctgacctgagcagtgatgatgtgctggagaagagcagccagaagagcagaagagagcccaggacctacacagaggaggagctgaatgccaagctgacccggcgggtgcagaaggccgcccggcggcaggccaagcaggaggagctgaagaggctgcaccgggcccagatcatccagaggcagctgcagcaggtggaggagcggcagaggcggctggaggagcggggcgtggccgtggagaaggccctgcggggggaggccggcatgggcaagaaggatgaccccaagctgatgcaggagtggttcaagctggtgcaggagaagaatgccatggtgcgctatgagagcgagctgatgatctttgcccgggagctggagctggaggaccggcagagccggctgcagcaggagctgcgggagaggatggctgtggaggaccacctgaagacagaggaggagctgtctgaggagaagcagatcctgaatgagatgctggaggtggtggagcagagggacagcctggtggccctgctggaggagcagaggctgcgggagcgggaggaggacaaggacctggaggccgccatgctgagcaagggcttcagcctgaactggagctag

SEQ ID NO: 21389 - DNA, 540 bp, Artificial Sequence
  Description of Artificial Sequence: Synthetic coding sequence
atgagcagcaatgaatgcttcaagtgtggccgcagcggccactgggcccgggagtgccccactggaggcggccggggccggggcatgaggagccggggccggggcggcttcaccagtgaccggggcttccagtttgtgagcagcagcctgcctgacatctgctaccgctgtggggagagcggccacctggccaaggactgtgacctgcaggaggatgtggaggcctgctacaactgtggccggggcggccacatcgccaaggactgcaaggagcccaagcgggagcgggagcagtgctgctacaactgtgggaagccaggccacctggcccgggactgtgaccacgcagatgagcagaagtgctacagctgtggggagtttggccacatccagaaggactgcaccaaggtgaagtgctaccgctgtggggagactggacatgtggccatcaactgcagcaagaccagcgaggtgaactgctaccgctgtggggagagcggccacctggcccgggagtgcaccatcgaggccacagcctag

SEQ ID NO: 21390 - DNA, 1140 bp, Artificial Sequence
  Description of Artificial Sequence: Synthetic coding sequence
gcccgggctgtgcctgtgggcagcggcctgcggggcctgcagaggaccctgcccctggtggtgatcctgggcgccaccggcaccgggaagagcaccctggccctgcagctgggccagaggctgggcggggagatcgtgtctgctgacagcatgcagccccaggagatgggcacagagaaggtgattgacaggaaggtggagctggagaaggaggatggcctggtgctgcacaagaggctgagccaggtggaccctgagatggccgccaagctgcacccccatgacaagaggaaggtggcccggagcctgcaggtgtttgaggagaccggcatcagccacagcgagttcctgcaccggcagcacacagaggagggcggcggccccctgggcggccccctgaagttcagcaacccctgcatcctgtggctgcatgctgaccaggctgatgagcggctggacaagagggtggatgacatgctggccgccggcctgctggaggagctgcgggacttccaccggcgctacaaccagaagaatgtgtctgagaacagccaggactaccagcacggcatcttccagagcatcggcttcaaggagttccacgagtacctgatcacagagggcaagtgcaccctggagaccagcaaccagctgctgaagaagggcatcgaggccctgaagcaggtgaccaagagatatgccaggaagcagaaccgctgggtgaagaaccgcttcctgagcaggcctggccccatcgtgccccctgtgtatggcctggaggtgtctgatgtgtccaagtgggaggagagcgtgctggagcccgccctggagatcgtgcagagcttcatccagggccacaagcccacagccacccccatcaagatgccctacaatgaagctgagaacaagaggagctaccacctgtgtgacctgtgtgaccgcatcatcattggagaccgggagtgggccgcccacatcaagagcaagagccacctgaaccagctgaagaagagaagaaggctggacagtgatgctgtgaacaccatcgagagccagagcgtgtccccagaccacaacaaggagcccaaggagaagggcagccctggccagaatgaccaggagctgaagtgcagcgtgtag

SEQ ID NO: 21391 - DNA, 483 bp, Artificial Sequence; identical to SEQ ID NO: 20009
  Description of Artificial Sequence: Synthetic coding sequence

SEQ ID NO: 21392 - DNA, 816 bp, Artificial Sequence
  Description of Artificial Sequence: Synthetic coding sequence
atgaacctggagaagctgagcaagccagagctgctgaccctcttcagcatcctggagggggagctggaggcccgggacctggtgattgaggccctgaaggcccagcaccgggacaccttcatcgaggagagatatggcaagtacaacatcagtgaccccctgatggccctgcagagggactttgagaccctgaaggagaagaatgatggagagaagcagcctgtgtgcaccaaccccctgagcatcctgaaggtggtgatgaagcagtgcaagaacatgcaggagaggatgctgagccagctggccgctgctgagagccgccacaggaaggtgatcctggacctggaggaggagcggcagagacatgcccaggacacagcagaaggagatgatgtgacctacatgctggagaaggagcgggagcggctgacccagcagctggagtttgagaagagccaggtgaagaagtttgagaaggagcagaagaagctgagcagccagctggaggaggagaggagccgccacaagcagctgagctccatgctggtgctggagtgcaagaaggccaccaacaaggctgctgaggagggccagaaggccggggagctgagcctgaagctggagaaggagaagagccgggtgtccaagctggaggaggagctggccgctgagaggaagaggggcctgcagacagaggcccaggtggagaagcagctgtctgaatttgacatcgagcgggagcagctgcgggccaagctgaaccgggaggagaacagaaccaagaccctgaaggaggagatggagagcctgaagtag

SEQ ID NO: 21393 - DNA, 1482 bp, Artificial Sequence
  Description of Artificial Sequence: Synthetic coding sequence
atggaccaggactatgaaagaaggctgctgcggcagatcgtcatccagaatgaaaacaccatgccccgggtgacagagatgaggaggaccctgaccccagccagcagccctgtgagcagccccagcaagcacggggaccgcttcatccccagcagagctggggccaactggagcgtgaacttccaccgcatcaatgaaaatgagaagagccccagccagaacaggaaggccaaggatgccaccagtgacaacgggaaggatggcctggcctacagcgccctgctgaagaatgagctgctgggcgccggcatcgagaaggtgcaggacccccagacagaagatagaaggctgcagcccagcaccccagagaagaagggcctcttcacctacagcctgagcaccaagaggagcagcccagatgatggaaatgatgtgagcccctacagcctgagccctgtgagcaacaagagccagaagctgctgcggagccccaggaagcccaccaggaagatcagcaagatccccttcaaggtgctggatgcccctgagctgcaggatgacttctacctgaacctggtggactggagcagcctgaatgtgctgtctgtgggcctgggcacctgtgtgtacctgtggagcgcctgcaccagccaggtgacccggctgtgtgacctgtctgtggagggggacagcgtgacctctgtgggctggagcgagcggggcaacctggtggccgtgggcacccacaagggctttgtgcagatctgggatgctgctgctgggaagaagctgtccatgctggagggccacacagcccgggtgggcgccctggcctggaatgctgagcagctgagcagcggcagccgggacaggatgatcctgcagagggacatccgcaccccacccctgcagagcgagcggcggctgcagggccaccggcaggaggtgtgtggcctgaagtggagcacagaccaccagctgctggccagcggcggcaatgacaacaagctgctggtgtggaaccacagcagcctgagccctgtgcagcagtacacagagcacctggccgctgtgaaggccatcgcctggagcccccaccagcacggcctgctggccagcggcggcggcacagctgaccgctgcatccgcttctggaacaccctgaccggccagcccctgcagtgcatcgacaccggcagccaggtgtgcaacctggcctggagcaagcacgccaatgagctggtgtccacccacggctacagccagaaccagatcctggtgtggaagtaccccagcctgacccaggtggccaagctgaccggccacagctacagagtgctgtacctggccatgagcccagatggagaggccatcgtgactggagctggagatgagaccctgcgcttctggaatgtgttcagcaagaccaggagcaccaaggagagcgtgtctgtgctgaacctcttcacccgcatcagatag

SEQ ID NO: 21394 - DNA, 552 bp, Artificial Sequence
  Description of Artificial Sequence: Synthetic coding sequence
atgaagaaggagcacgtgctgcactgccagttcagcgcctggtaccccttcttccggggcgtgaccatcaagagcgtcatcctgcccctgccccagaatgtgaaggactacctgctggatgatggcaccctggtggtgtctggaagagatgacccccccacccacagccagcctgacagtgatgatgaggccgaggagatccagtggagcgatgatgaaaatacagccaccctgacagatgcctactggatcgccatgaacagcagcctgaagtgcaagaccctgagtgacatcttcctgctcttcaagagcagtgacttcatcacccgggacttcacccagcccttcatccactgcacagatgacagcccagacccctgcatcgagtatgagctggtgctgaggaagtggtgtgagctgatccctggagctgagttccgctgctttgtgaaggagaacaagctgattggcatcagccagagggactacacccagtactatgaccacatcagcaagcagaaggaggagatccgccgctgcatccaggactag

SEQ ID NO: 21395 - DNA, 672 bp, Artificial Sequence; identical to SEQ ID NO: 19405
  Description of Artificial Sequence: Synthetic coding sequence

SEQ ID NO: 21396 - DNA, 348 bp, Artificial Sequence
  Description of Artificial Sequence: Synthetic coding sequence
atgcccatcctgctcttcctgattgacaccagcgcctccatgaaccagaggagccacctgggcaccacctacctggacacagccaagggagctgtggagaccttcatgaagctgcgggcccgggaccctgccagcagaggagaccgctacatgctggtgacctttgaggagcccccctatgccatcaaggccggctggaaggagaaccacgccaccttcatgaatgagctgaagaacctgcaggccgagggcctgaccaccctgggccagagcctgaggacagcctttgacctgctgaacctgaaccggctggtgacaggcatcgacaactacggccaggtgggctag

SEQ ID NO: 21397 - DNA, 390 bp, Artificial Sequence; identical to SEQ ID NO: 19988
  Description of Artificial Sequence: Synthetic coding sequence

SEQ ID NO: 21398 - DNA, 2676 bp, Artificial Sequence
  Description of Artificial Sequence: Synthetic coding sequence
atggtggcccctgtgctggagaccagccacgtgttctgctgccccaacagagtgcggggcgtgctgaactggagcagcggcccccggggcctgctggccttcggcaccagctgcagcgtggtgctgtatgaccccctgaagagggtggtggtgaccaacctgaatggccacacagcccgggtgaactgcatccagtggatctgcaagcaggacggcagccccagcacagagctggtgtctgggggcagtgacaaccaggtgatccactgggagattgaggacaaccagctgctgaaggctgtgcacctgcagggccacgagggccctgtgtatgctgtgcatgctgtgtaccagaggaggaccagtgaccctgccctgtgcaccctcatcgtgtctgctgctgctgacagcgctgtgcggctgtggagcaagaagggccctgaggtgatgtgcctgcagaccctgaactttggaaatggatttgccctggccctgtgcctgtccttcctgcccaacacagatgtgacctggaagacaggccaggtggagcggggccgggcctggaagcccccagccagcctggccctgtgcagccgcagctgtgacagcatggtgtcctgctacgccagcatcctgtgcaaggccctgtggaaggagaagctgcacaccttctggcaccacaaccgcatctccttcctgcccagcgccttccggcccatccccatcctggcctgtggaaatgatgactgccgcatccacatctttgcccagcagaatgaccagttccagaaggtgctgagcctgtgtggccacgaggactggatccggggcgtggagtgggccgccttcggccgggacctcttcctggccagctgcagccaggactgcctgatccgcatctggaagctgtacatcaagagcaccagcctggagacccaggatgatgacaacatccggctgaaggagaacaccttcaccattgaaaatgaatctgtgaagatcgcctttgctgtgaccctggagaccgtgctggccggccacgagaactgggtgaatgctgtgcactggcagcccgtcttctacaaggatggagtgctgcagcagcctgtgcggctgctgagcgcctccatggacaagaccatgatcctgtgggccccagatgaggagagcggcgtgtggctggagcaggtgcgggtgggggaggtgggcggcaacaccctgggcttctatgactgccagttcaatgaagatggctccatgatcatcgcccacgccttccatggagccctgcacctgtggaagcagaacacagtgaacccccgggagtggaccccagaaattgtcatcagcggccactttgatggagtgcaggacctggtgtgggaccctgagggggagttcatcatcaccgtgggcacagaccagaccacccggctgtttgccccctggaagaggaaggaccagagccaggtgacctggcatgagatcgcccggccccagatccacggctatgacctgaagtgcctggccatgatcaaccgcttccagtttgtgtctggagcagatgagaaggtgctgcgggtcttcagcgcccccaggaactttgtggagaacttctgtgccatcaccggccagagcctgaaccacgtgctgtgcaaccaggacagcgacctgcctgagggcgccaccgtgcctgccctgggcctgagcaacaaggctgtgttccagggcgacatcgccagccagcccagtgatgaggaggagctgctgaccagcactggatttgagtaccagcaggtggccttccagcccagcatcctgacagagcccccaacagaggaccacctgctgcagaacaccctgtggccagaggtgcagaagctgtatggccacggctatgagatcttctgtgtgacctgcaacagcagcaagaccctgctggccagcgcctgcaaggccgccaagaaggagcacgccgccatcatcctgtggaacaccacctcctggaagcaggtgcagaacctggtgttccacagcctgactgtgacccagatggccttcagccccaatgagaagttcctgctggccgtgtcccgggacaggacctggagcctgtggaagaagcaggacaccatcagccctgagtttgagcccgtcttcagcctgtttgccttcaccaacaagatcacctctgtgcacagccgcatcatctggagctgtgactggagcccagacagcaagtacttcttcaccggcagccgggacaagaaggtggtggtgtggggagaatgtgacagcacagatgactgcatcgagcacaacatcggcccctgcagctctgtgctggatgtgggcggcgctgtgacagctgtgtctgtgtgccctgtgctgcaccccagccagagatatgtggtggccgtgggcctggagtgtgggaagatctgcctgtacacctggaagaagacagaccaggtgcctgagatcaatgactggacccactgtgtggagaccagccagagccagagccacaccctggccatcaggaagctgtgctggaagaactgcagcggcaagacagagcagaaggaggccgagggcgctgagtggctgcactttgccagctgtggggaggaccacacagtgaagatccaccgggtgaacaagtgtgccctgtag

SEQ ID NO: 21399 - DNA, 573 bp, Artificial Sequence
  Description of Artificial Sequence: Synthetic coding sequence
atgggccccctgcccaggacagtggagctgttctatgatgtgctgagcccctacagctggctgggctttgagatcctgtgccgctaccagaacatctggaacatcaacctgcagctgcggcccagcctcatcaccggcatcatgaaggacagcggcaacaagcccccaggcctgctgcccaggaagggcctgtacatggccaatgacctgaagctgctgcggcaccacctgcagatccccatccacttccccaaggacttcctgtctgtgatgctggagaagggcagcctgagcgccatgaggttcctgacagctgtgaacctggagcaccctgagatgctggagaaggccagccgggagctgtggatgagggtgtggagcagaaatgaagacatcacagagccccagagcatcctggccgctgctgagaaggccggcatgtctgctgagcaggcccagggcctgctggagaagatcgccacccccaaggtgaagaaccagctgaaggagaccacagaggccgcctgccgctacggggagaggagcggctgggccctgtacctgcagccctag

SEQ ID NO: 21400 - DNA, 1482 bp, Artificial Sequence
  Description of Artificial Sequence: Synthetic coding sequence
atgatgaagaggcagctgcacaggatgaggcagctggcccagacaggcagcctgggccgcaccccagagacagctgagttcctgggggaggacctgctgcaggtggagcagaggctggagcccgccaagagagctgcccacaacatccacaagaggctgcaggcctgcctgcagggccagagcggggctgacatggacaagagggtgaagaagctgcccctgatggccctgagcaccaccatggccgagagcttcaaggagctggaccctgacagctccatgggcaaggccctggagatgagctgtgccatccagaaccagctggcccgcatcctggccgagtttgagatgaccctggagagagatgtgctgcagcccctgagccggctgtctgaggaggagctgcctgccatcctgaagcacaagaagagcctgcagaagctggtgtctgactggaacaccctgaagagccggctgagccaggccaccaagaacagcggcagcagccagggcctgggcggcagccctggcagccacagccacaccaccatggccaacaaggtggagaccctgaaggaggaggaggaggagctgaagaggaaggtggagcagtgcagagatgagtacctggccgacctgtaccactttgtgaccaaggaggacagctatgccaactacttcatccggctgctggagatccaggccgactaccacagaagaagcctgagcagcctggacacagccctggccgagctgcgggagaaccacggccaggccgaccacagccccagcatgacagccacccacttcccccgggtgtatggagtgtccctggccacccacctgcaggagctgggccgggagatcgccctgcccatcgaggcctgtgtgatgatgctgctgtctgagggcatgaaggaggagggcctcttccggctggccgccggggcctctgtgctgaagaggctgaagcagaccatggccagtgacccccacagcctggaggagttctgcagcgacccccatgctgtggccggggccctgaagagctacctgcgggagctgcctgagcccctgatgacctttgacctgtatgatgactggatgagagctgccagcctgaaggagcccggggcccggctgcaggccctgcaggaggtgtgcagccggctgcccccagagaacctgagcaacctgcgctacctgatgaagttcctggcccggctggccgaggagcaggaggtgaacaagatgacccccagcaacatcgccatcgtgctgggccccaacctgctgtggcccccagagaaggagggcctggagtacagcggggccatcagcgcccactgcaacctgcggctgcccggcagcagtgacagcagcgccagcgcctgccaggtggccggcaccaccggcacccggcccagctggatgcagcccccctgcctgcccagccgctggtgggccagcagcagaagatag

SEQ ID NO: 21401 - DNA, 45 bp, Artificial Sequence; identical to SEQ ID NO: 12369
  Description of Artificial Sequence: Synthetic coding sequence

SEQ ID NO: 21402 - DNA, 828 bp, Artificial Sequence
  Description of Artificial Sequence: Synthetic coding sequence
atgtctgctgaggtgaaggtgacaggccagaaccaggagcagttcctgctgctggccaagagcgccaagggagctgccctggccaccctcatccaccaggtgctggaggcccctggggtgtatgtgtttggagagctgctggacatgcccaacgtgcgggagctggccgagagtgactttgccagcaccttccggctgctgactgtgtttgcctacggcacctacgccgactacctggccgaggccaggaacctgccccccctgacagaggcccagaagaacaagctgcggcacctgtctgtggtgaccctggccgccaaggtgaagtgcatcccctatgctgtgctgctggaggccctggccctgagaaatgtgcggcagctggaggacctggtgattgaagctgtgtatgcagatgtgctgcggggcagcctggaccagaggaaccagaggctggaggtggactacagcatcggccgggacatccagaggcaggacctgagcgccatcgcccggaccctgcaggagtggtgtgtgggctgtgaggtggtgctgagcggcatcgaggagcaggtgtcccgggccaaccagcacaaggagcagcagctgggcctgaagcagcagattgaaagtgaggtggccaacctgaagaagaccatcaaggtgaccacagctgctgctgctgctgccaccagccaggaccctgagcagcacctgacagagctgcgggagcccgcccctggcaccaaccagaggcagcccagcaagaaggccagcaagggcaagggcctgcggggcagcgccaagatctggagcaagagcaactag

SEQ ID NO: 21403 - DNA, 1506 bp, Artificial Sequence
  Description of Artificial Sequence: Synthetic coding sequence
atggccgcccctgagcccgccccccggcgggcccgggagcgggagcgggagagagaagatgaaagtgaagatgaaagtgacatcctggaggagagcccctgtggccgctggcagaagaggcgggagcaggtgaaccagggcaacatgcctggcctgcagagcaccttcctggccatggacacagaggagggcgtggaggtggtgtggaatgagctgcactttggagacaggaaggcctttgctgcccacgaggagaagatccagacagtgtttgagcagctggtgctggtggaccaccccaacatcgtgaagctgcacaagtactggctggacaccagcgaggcctgtgcccgggtcatcttcatcacagaatatgtgagcagcggcagcctgaagcagttcctgaagaagaccaagaagaaccacaaggccatgaatgcccgggcctggaagcgctggtgcacccagatcctgagcgccctgtccttcctgcacgcctgcagcccccccatcatccacggcaacctgaccagtgacaccatcttcatccagcacaacggcctcatcaagattggctctgtgtggcaccgcatcttcagcaatgccctgcctgatgacctgcggagccccatccgggcagagcgggaggagctgaggaacctgcacttcttccccccagaatatggagaggtggctgatggaacagctgtggacatcttctcctttggcatgtgtgccctggagatggctgtgctggagatccagaccaatggagacaccagggtgacagaggaggccatcgcccgggcccggcacagcctgagtgaccccaacatgagggagttcatcctgtgctgcctggcccgggaccctgcccggcggcccagcgcccacagcctgctcttccaccgggtgctgtttgaggtgcacagcctgaagctgctggccgcccactgcttcatccagcaccagtacctgatgccagaaaatgtggtggaggagaagaccaaggccatggacctgcatgctgtgctggccgagctgccccggccccggcggccccccctgcagtggagatacagcgaggtgtccttcatggagctggacaagttcctggaggatgtgagaaatggcatctaccccctgatgaactttgctgccacccggcccctgggcctgccccgggtgctggcccctcctcctgaggaggtgcagaaggccaagacccccaccccagagccctttgattctgagaccaggaaggtgatccagatgcagtgcaacctggagaggtctgaggacaaggcccgctggcacctgaccctgctgctggtgctggaggaccggctgcaccggcagctgacctatgacctgctgcccacagattctgcccaggacctggccagcgagctggtgcactacggcttcctgcatgaagatgacaggatgaagctggccgccttcctggagagcaccttcctgaagtaccggggcacccaggcctag

SEQ ID NO: 21404 - DNA, 36 bp, Artificial Sequence
  Description of Artificial Sequence: Synthetic coding sequence
atgacagcccccagctgtgccttccctgtgcagtag

SEQ ID NO: 21405 - DNA, 534 bp, Artificial Sequence
  Description of Artificial Sequence: Synthetic coding sequence
atgctgctggacaagaatgtgcccaacccccgcatcaagctgattgactttggaattgcccacaagattgaagctggaaatgagttcaagaacatcttcggcaccccagagtttgtggcccctgagatcgtgaactatgagcccctgggcctggaggccgacatgtggagcattggagtcatcacctacatcctgctgagcggggccagccccttcctgggggagaccaagcaggagaccctgaccaacatctctgctgtgaactatgactttgatgaggagtacttcagcaacaccagcgagctggccaaggacttcatccggcggctgctggtgaaggaccccaagaggaggatgaccatcgcccagagcctggagcacagctggatcaaggccatcagaagaagaaatgtgagaggagaagattctggcaggaagccagagcggcggcggctgaagaccacccggctgaaggagtacaccatcaagagccacagcagcgccagccccatcgtggcccctgtggatgcctag

SEQ ID NO: 21406 - DNA, 615 bp, Artificial Sequence
  Description of Artificial Sequence: Synthetic coding sequence
atgggagacaagaagagccccacccggcccaagaggcagcccaagcccagcagtgatgagggctactgggactgcagcgtgtgcaccttcagaaattctgctgaggccttcaagtgcatgatgtgtgatgtgaggaagggcaccagcaccaggagcaccctgtttgaagtcatcgtgtctgccagcaggaccaaggagcccctgaagttccccatcagcggcaggaagcccaggcctgtgtcccagctggtggcccagcaggtgacccagcagtttgtgccccccacccagagcaagaaggagaagaaggacaaggtggagaaggagaagtctgagaaggagaccaccagcaagaagaacagccacaagaagacccggccccggctgaagaatgtggacaggagcagcgcccagcacctggaggtgacagtgggggacctgaccgtcatcatcacagacttcaaggagaagaccaagagccccccagccagcagcgctgccagcgctgaccagcacagccagagcggcagcagcagtgacaacacagagcggggcatgagccgcagcagcagccccagaggagaggccagcagcctgaatggagagagccactag

SEQ ID NO: 21407 - DNA, 1350 bp, Artificial Sequence; identical to SEQ ID NO: 19455
  Description of Artificial Sequence: Synthetic coding sequence

SEQ ID NO: 21408 - DNA, 153 bp, Artificial Sequence
  Description of Artificial Sequence: Synthetic coding sequence
aagacaggcctgaccggcagccccagcagcctgtgggacctgctgcgggagatgtttgtggtgtgcagcaaggagcagctgcagagcggcggcaagtacagccaccaggtgtgggcccccttcagccccctggccagcggggccgccttctag

SEQ ID NO: 21409 - DNA, 4386 bp, Artificial Sequence
  Description of Artificial Sequence: Synthetic coding sequence
atgcagcgggagctggtgtatgcccggggagatggccctggggccccccggcccggcagcacagcccaccccccccacgccatccccaacagcccccccagcacccctgtgccccacagcatgccacccagccccagccgcatcccctacggcggcaccaggtccatggtggtgcctggaaatgccaccatcccccgggaccgcatcagcagcctgcctgtgtcccggcccatcagccccagccccagcgccatcctggagaggagagatgtgaagccagatgaggacatgtctgggaagaacatcgccatgtacagaaatgaaggcttctacgccgacccctacctgtaccacgagggccgcatgagcatcgccagcagccacggcggccaccccctggatgtgcctgaccacatcatcgcctaccacaggacagccatccgcagcgccagcgcctactgcaaccccagcatgcaggccgagatgcacatggagcagagcctgtaccggcagaagagcaggaagtacccagacagccacctgcccaccctgggcagcaagaccccaccagccagcccccaccgggtgtctgacctgaggatgattgacatgcacgcccactacaatgcccacggccccccccacaccatgcagcctgaccgggccagccccagccggcaggccttcaagaaggagcccggcaccctggtgtacatcgagaagcccaggtctgctgctggcctgagcagcctggtggacctgggcccccccctgatggagaagcaggtgtttgcctacagcacagccaccatccccaaggaccgggagaccagcgagaagatgatgaagaccacagccaacagaaaccacacagattctgctggcaccccccacgtgtctgggggcaagatgctgagcgccctggagagcacagtgccccccagccagcccccacctgtgggcaccagcgccatccacatgagcctgctggagatgagaagatctgtggccgagctgcggctgcagctgcagcagatgaggcagctgcagctgcagaaccaggagctgctgcgggccatgatgaagaaggccgagctggagatcagcggcaaggtgatggagaccatgaagaggctggaggaccctgtgcagaggcagagggtgctggtggagcaggagcggcagaagtacctgcacgaggaggagaagatcgtgaagaagctgtgtgagctggaggactttgtggaggacctgaagaaggacagcacagctgccagccggctggtgaccctgaaggatgtggaggatggagccttcctgctgcggcaggtgggggaggccgtggccaccctgaagggggagttccccaccctgcagaacaagatgagggccatcctgcgcatcgaggtggaggccgtgcgcttcctgaaggaggagccccacaagctggacagcctgctgaagagggtgcgctccatgacagatgtgctgaccatgctgcggagacatgtgacagatggcctgctgaagggcacagatgctgcccaggccgcccagtacatggccatggagaaggccacagctgctgaggtgctgaagagccaggaggaggccgcccacaccagcggccagcccttccacagcactggagcccctggagatgccaagtctgaggtggtgcccctgagcggcatgatggtgagacatgcccagagcagccctgtggtgatccagcccagccagcacagcgtggccctgctgaacccagcccagaacctgccccacgtggccagcagccctgctgtgccccaggaggccaccagcaccctgcagatgagccaggccccccagagcccccagatccccatgaatggcagcgccatgcagagcctcttcatcgaggagatccacagcgtgtctgccaagaacagagctgtgtccattgagaaggccgagaagaagtgggaggagaagaggcagaacctggaccactacaacgggaaggagtttgagaagctgctggaggaggcccaggccaacatcatgaagagcatccccaacctggagatgcccccagccaccggccccctgcccagaggagatgcccctgtggacaaggtggagctgtctgaggacagccccaacagcgagcaggacctggagaagctgggcggcaagagccccccacctcctcctcctccaccccggcgcagctacctgcccggcagcggcctgaccaccaccaggtctggagatgtggtgtacacaggcaggaaggagaacatcacagccaaggccagcagtgaagatgctggccccagcccccagacccgggccaccaagtacccagctgaggagcccgccagcgcctggacccccagccccccacctgtgaccaccagcagcagcaaggatgaggaggaggaggaggaggagggggacaagatcatggccgagctgcaggccttccagaagtgcagcttcatggatgtgaacagcaacagccatgctgagcccagcagagctgacagccacgtgaaggacaccaggtctggggccaccgtgccccccaaggagaagaagaacctggagttcttccatgaagatgtgaggaagagtgatgtggagtatgaaaatggcccccagatggagttccagaaggtgaccaccggggctgtgcggcccagcgacccccccaagtgggagcggggcatggagaacagcatcagtgatgccagcaggaccagcgagtacaagacagagatcatcatgaaggagaacagcatcagcaacatgagcctgctgcgggacagcaggaactacagccaggagaccgtgcccaaggccagctttggcttcagcggcatcagccccctggaggatgagatcaacaagggcagcaagatcagcggcctgcagtacagcatcccagacacagagaaccagaccctgaactacggcaagaccaaggagatggagaagcagaacacagacaagtgccacgtgagcagccacacccggctgacagagagctctgtgcatgacttcaagacagaggaccaggaggtgatcaccacagactttggccaggtggtgctgcggcccaaggaggcccggcatgccaacgtgaaccccaatgaagatggagagagcagcagcagcagccccacagaagaaaatgctgccacagacaacatcgccttcatgatcacagagaccaccgtgcaggtgctgagcagcggggaggtgcatgacatcgtgtcccagaagggggaggacatccagacagtgaacattgatgccaggaaggagatgaccccccggcaggagggcacagacaatgaagatcctgtggtgtgcctggacaagaagcctgtgatcatcatctttgatgagcccatggacatccgcagcgcctacaagaggctgagcaccatctttgaagaatgtgatgaggagctggagaggatgatgatggaggagaagattgaggaggaggaggaggaggagaatggagacagcgtggtgcagaacaacaacaccagccagatgagccacaagaaggtggcccctggcaacctgaggacaggccagcaggtggagaccaagagccagccccacagcctggccacagagaccaggaaccctgggggccaggagatgaacagaacagagctgaacaagttcagccacgtggacagccccaacagcgagtgcaagggggaggatgccacagatgaccagtttgagagccccaagaagaagttcaagttcaagttccccaagaagcagctggccgccctgacccaggccatcagaacaggcaccaagacaggcaagaagaccctgcaggtggtggtgtatgaggaggaggaggaggatggcaccctgaagcagcacaaggaggccaagagatttgagatcgcccggagccagcctgaggacaccccagagaacacagtgcggcggcaggagcagcccagcattgagagcaccagccccatcagcaggacagatgagatcaggaagaacacctaccgcaccctggacagcctggagcagaccatcaagcagctggagaacaccatcagcgagatgagccccaaggccctggtggacaccagctgcagcagcaacagagacagcgtggccagcagcagccacatcgcccaggaggccagcccccggcccctgctggtgcctgatgagggccccacagccctggagccccccaccagcatccccagcgccagcaggaagggcagcagcggggccccccagaccagcaggatgcctgtgcccatgtctgccaagaacagacctggcaccctggacaagccaggcaagcagagcaagctgcaggacccccggcagtaccggcagtag

SEQ ID NO: 21410 - DNA, 2118 bp, Artificial Sequence
  Description of Artificial Sequence: Synthetic coding sequence
atgctgaccctgctggctgaagatagagctgtgcccagcgcccccaccggccctggccccctgctggagtttgccctgcacgaggacctgctgaccagggtgctgacctggcagctgcagtgggatgagctgggagatggagtggaggagaggagagctgagcagctgaagctgtttgagatgctggtgtctgaggcccggcagcccctgctgcggcacggccctgtgcgggaggccctgctgaccctgctggatgcctgtggccggcctgtgcccagcagccctgccctggatgagggcctggtgctgctgctgagccagctgtgtgtgtgtgtggcccaggagcccagcctgctggagttcttcctgcagcccccacctgagcctggagctgccccccggctgctgctcttcagccggctggtgccctttgtgcaccgggagggcaccctgggccagcaggccagagatgccctgctgctgctgatggccctgtctgctggcagccccaccgtgggccgctacatcgctgaccacagctacttctgccctgtgctggccaccggcctgagcgccctgtacagcagcctgcccaggaagattgaggtgcctggagatgactggcactgcctgcggcgggaggactggctgggcgtgcctgccctggccctcttcatgagcagcctggagttctgcaatgctgtgatccaggtggcccaccccctggtgcagaagcagctggtggactacatccacaacggcttcctggtgcctgtgatgggccctgccctgcacaagacctctgtggaggagatgattgccagcacagcctacctggagctgttcctgcggagcatcagcgagcccgccctgctgcggaccttcctgcgcttcctgctgctgcacagacatgacacccacaccatcctggacaccctggtggccagaattggcagcaacagccggctgtgcatggtgtccctgagcctcttccgcaccctgctgaacctgagctgtgaagatgtgctgctgcagctggtgctgcgctacctggtgccctgcaaccacgtgatgctgagccagaagccagctgtgagagatgtggacctgtatggccgggctgctgacaagttcctgagcctcatcccccgctgctgccgccaccacgcccccagcccccccaggcctgagcacgcctcctgggcccggggccctggcagccccagcgtggacagcagctctgtgaccaccgtgccccggcccagcacccccagccggctggccctcttcctgcggcagcagagcctgggcggcagcgagagccctggccctgccccctgcagccctggcctgagcgccagccctgccagcagccctggaagaagacccaccccagctgaggagcctggagagctggaggacaactacctggagtacctgcgggaggcccggcggggcgtggacagatgtgtgcgggcctgcaggacctggagcgccccctatgatggagagcggcccagccctgagcccagccccttcggcagcaggaccaagaagaggagcctgctgcctgaggaggacaggaacaacgtgggggagggggaggaggaggagctgggcagaagaggccgggccggcggggccggggagggccctggccacctgcccccaccccagctgaatggagtgcccggctcctggccagagggcgccaagaaggtgcggctggtgcccaaggagggcgctggggagctgctggagggcatcagcgagggcatggccggcctggagggcttcggccaggagctgcgggagctggaggtggccctgagcaatggaggcactggaagtgagagccccctggagccccccctgcccctggaggaggaggaggcctatgagagcttcacctgccccccagagcccccaggccccttcctgagcagccccctgcggaccctgaaccagctgcccagccagcccttcaccggccccttcatggctgtgctgtttgccaagctggagaacatgctgcagaacagcgccctgagctgcagcacccccacctggagcagcagccctgtgagcagcccctgctgccgctgctgggccctgtag

SEQ ID NO: 21411 - DNA, 804 bp, Artificial Sequence
  Description of Artificial Sequence: Synthetic coding sequence
atgatgaggggctacatcaagaaggtgctgaagaacaccagctaccacgtgaaccagtacctgttcatccagcacggctggagcggcagcggggaccagagcgtgctgtacagctgcaacctgatgaggatggtgaccaggaccaagaagatctttgtgggcggcctgagcgccaacacagtggtggaggatgtgaagcagtactttgagcagtttgggaaggtggaggatgccatgctgatgtttgacaagaccaccaacagacaccggggcttcggctttgtgacctttgaaaatgaagatgtggtggagaaggtgtgtgagatccacttccacgagatcaacaacaagatggtggagtgcaagaaggcccagcccaaggaggtgatgttccccccaggcacccggggccgggcccggggcctgccctacaccatggatgccttcatgctgggcatgggcatgctgggctaccccaactttgtggccacctacggccggggctacccaggctttgcccccagctatggctaccagtttcctggcttccctgctgctgcctacggccctgtggccgctgctgctgtggccgccgcccggggcagcggcagcaacccagcccggcctgggggcttccctggggccaacagccctggccctgtggccgacctgtatggccctgccagccaggacagcggcgtgggcaactacatctctgctgccagcccccagcccggcagcggctttggacatggaattgctggccccctcatcgccacagccttcaccaacggctaccactag

SEQ ID NO: 21412 - DNA, 483 bp, Artificial Sequence
  Description of Artificial Sequence: Synthetic coding sequence
atgagcagccccctggccagcctgagcaagaccaggaaggtgcccctgcccagcgagcccatgaaccctggaagaagaggcatccgcatctatggagatgtgcctgccagccatgacagcgagctgatggccttcatgaccaggaagctgtgggacctggagcagcaggtgaaggcccagacagatgagatcctgagcaaggaccagaagattgctgccctggaggacctggtgcagaccctgcggccccaccctgctgaggccaccctgcagaggcaggaggagctggagaccatgtgtgtgcagctgcagaggcaggtgcgggagatggagcgcttcctgagtgactatggcctgcagtgggtgggggagcccatggaccaggaggacagcgagagcaagacagtgtctgaacatggagagcgggactggatgacagccaagaagttctggaagccaggcggcctgattggagccccctag

SEQ ID NO: 21413 - DNA, 462 bp, Artificial Sequence
  Description of Artificial Sequence: Synthetic coding sequence
tgaagcgtgcagagccctgcccagcagcaggtgcctgcccggcctggggcccccagcgtgcaggtgcccagccccttcctgctgcagaaccagtatgagcctgtgcagccccactggttctactgcaaggaggtggagtacaagcagctgtggatgcccttctctgtgtttgacagcctgaacctggaggagatctacaacagcgtgcagcctgaccctgagagcgtggtgctgggcacagatggcggccgctatgatgtgtacctgtatgaccgcatcaggaaggccgcctactgggaggaggagcctgctgaggtgcggcgctgcacctggttctacaagggggacacagacagccgcttcatcccctacacagaggagttcagcgagaagctggaggtgcgggtgctgtacttcttcatgtccttcttcaagaagtgccgcagctacatccactggtag

SEQ ID NO: 21414 - DNA, 1062 bp, Artificial Sequence
  Description of Artificial Sequence: Synthetic coding sequence
atggagcaggagctggagcagctggcccagctgcccagcagcaagaacagcctgctgaaggatgccatggcccctggcacccccaagagcctgctgctgagcgccagcatcaagcgggagggggagagccccacagccagcccccacagcagcgccacagatgacctgcaccacagcgaccgctaccagaccttcctgcgggtgcgggccaaccggcagacccggctgaatgcccgcatcggcaagatgaagaggaggaagcaggatgagggccaggtgtgccccctgtgcaaccggcccctggccggcagcgagcaggagatgagcagacatgtggagcactgcctgagcaagcgggagggcagctgcatggccgaggatgatgctgtggacatcgagcacgagaacaacaacagatttgaggagtatgagtggtgtggccagaagaggatccgggccaccaccctgctggagggcggcttccggggcagcggcttcatcatgtgcagcggcaaggaaaatccagacagtgatgctgacctggatgtggatggagatgacaccctggagtatggcaagccccagtacacagaagcagatgtgatcccctgcacaggagaggagcctggagaggccaaggagcgggaggccctgcggggagctgtgctgaatggaggcccccccagcacccgcatcaccccagagttcagcaagtgggccagtgatgagatgcccagcaccagcaatggagagagcagcaagcaggaggccatgcagaagacctgcaagaacagcgacatcgagaagatcacagaggacagcgctgtgaccacctttgaggccctgaaggcccgggtgcgggagctggagcggcagctgagcagaggagaccgctacaagtgcctgatctgcatggacagctacagcatgcccctgaccagcatccagtgctggcacgtgcactgtgaggagtgctggctgcggaccctgggcgccaagaagctgtgcccccagtgcaacaccatcacagcccctggggacctgcggcgcatctacctgtag

SEQ ID NO: 21415 - DNA, 1782 bp, Artificial Sequence; identical to SEQ ID NO: 19420
  Description of Artificial Sequence: Synthetic coding sequence

SEQ ID NO: 21416 - DNA, 363 bp, Artificial Sequence
  Description of Artificial Sequence: Synthetic coding sequence
ctggccctgcagatcagtgaaaatctcttcagcaacaaggtgctgaatgccctgaagccagagaaggatgtggatggagtgacagacatcaacctgggcaagctggtgagaggagatgcccacgagtgctttgtgtcccctgtggccaaggctgtgattgagctgctggagaagtctggagtgaacctggatggcaagaagatcctggtggtgggcgcccacggcagcctggaggccgccctgcagtgcctcttccagaggaagggctccatgaccatgagcatccagtggaagacccggcagctgcagagcaagacagagagccgctctgtgacccggctggagtgcagaagagtcatctag

SEQ ID NO: 21417 - DNA, 1167 bp, Artificial Sequence
  Description of Artificial Sequence: Synthetic coding sequence
atgagcggcaccttcctgatcaggaagccccagctgctgcagggcgtgtatgccatgggcttcaaccggcccagcaagatccaggagaatgccctgcccatgatgctggccgagcccccccagaacctgattgcccagagccagagcggcaccgggaagacagctgcctttgtgctggccatgctgagccgggtggagcccagcgaccgctacccccagtgcctgtgcctgagccccacctatgagctggccctgcagacaggcaaggtgattgagcagatgggcaagttctacccagagctgaagctggcctatgctgtgcggggcaacaagctggagcggggccagaagatcagcgagcagatcgtcatcggcaccccaggcaccgtgctggactggtgcagcaagctgaagttcatcgaccccaagaagatcaaggtgtttgtgctggatgaagcagatgtgatgattgccacccagggccaccaggaccagagcatccgcatccagaggatgctgcccaggaactgccagatgctgctcttcagcgccacctttgaagattctgtgtggaagtttgcccagaaggtggtgcctgaccccaacgtcatcaagctgaagcgggaggaggagaccctggacaccatcaagcagtactacgtgctgtgcagcagcagagatgagaagttccaggccctgtgcaacctgtatggagccatcaccatcgcccaggccatgatcttctgccacaccaggaagacagcctcctggctggccgctgagctgagcaaggagggccaccaggtggccctgctgtctggagagatgatggtggagcagagagctgctgtgattgagcgcttccgggagggcaaggagaaggtgctggtgaccaccaacgtgtgtgcccggggcattgatgtggagcaggtgtctgtggtgatcaactttgacctgcctgtggacaaggatggcaacccagacaatgagacctacctgcaccgcatcggccgcacaggccgctttgggaagaggggcctggccgtgaacatggtggacagcaagcacagcatgaacatcctgaaccgcatccaggagcacttcaacaagaagattgaaaggctggacacagatgacctggatgaaattgagaagatcgccaactag

SEQ ID NO: 21418 - DNA, 1821 bp, Artificial Sequence
  Description of Artificial Sequence: Synthetic coding sequence
ctgcggcagtgctacaactacaactgccccagcttcctggccgccgccctggcccgggccaccagtgatgaggtgctgcagagcgacctgagcgcccactacatccccaaggagacagatggaacagagggcaccgtggagattgagaccgtgaagctggcccggagcgtcttcagcaagctgcacgagatctgctgctcctgggtgaaggacttccccctgcggcggcggccccagctgtactatgagaccagcatccacgccatcaagaacatgaggaagctgttctacaagcacatcagcaagaagaagaagaagaggaagaagagggactgggaccaggaggagcaggcctactttgctgtgtttgatggccacggcggcgtggatgctgccatctatgccagcatccacctgcacgtgaacctggtgcggcaggagatgttcccccatgaccctgctgaggccctgtgccgggccttccgggtgacagatgaaagatttgtgcagaaggccgcccgggagagcctgcgctgtggcaccaccggggtggtgaccttcatccggggcaacatgctgcacgtggcctgggtgggggacagccaggtgatgctggtgaggaagggccaggccgtggagctgatgaagccccacaagccagacagagaagatgagaagcagagaattgaggccctgggcggctgtgtggtgtggtttggagcctggagggtgaatggcagcctgtctgtgtcccgggccatcggagatgctgagcacaagccctacatctgtggagatgctgacagcgccagcacagtgctggatggaacagaggactacctgatcctggcctgtgatggcttctatgacacagtgaacccagatgaagctgtgaaggtggtgtctgaccacctgaaggaaaataatggagacagctccatggtggcccacaagctggtggccagcgccagagatgctggcagcagtgacaacatcaccgtgattgtggtgttcctgcgggacatgaacaaggctgtgaatgtgtctgaggagagtgactggacagagaacagcttccagggcggccaggaggatggaggagatgacaaggaaaatcatggagagtgcaagaggccctggccccagcaccagtgcagcgccccagctgacctgggctatgatggccgggtggacagcttcacagacaggaccagcctgagccctggcagccagatcaacgtgctggaggaccccggctacctggacctgacccagatcgaggccagcaagccccacagcgcccagttcctgctgcctgtggagatgtttggacctggggcccccaagaaggccaacctgatcaatgagctgatgatggagaagaagtctgtgcagagcagcctgcctgagtggagcggggccggggagttccccacagccttcaacctgggcagcactggagagcagatctacaggatgcagagcctgagccctgtgtgcagcggcctggagaatgagcagttcaagagccctggcaacagagtgtcccggctgagccacctgcggcaccactacagcaagaagtggcaccgcttccgcttcaaccccaagttctacagcttcctgagcgcccaggagcccagccacaagattggcaccagcctgagcagcctgactggaagtggcaagaggaaccgcatccgcagcagcctgccctggaggcagaacagctggaagggctacagcgagaacatgaggaagctgaggaagacccatgacatcccctgcccagacctgccctggagctacaagattgaatag

SEQ ID NO: 21419 - DNA, 678 bp, Artificial Sequence
  Description of Artificial Sequence: Synthetic coding sequence
atggagaacctgctgcaggccaccaagagccacgtggacaaggtgatcatgaagctgggcaagaccaatgccaaggctgtgtctgagatgaggcagaagatctggaacaacatgcccaaggaccacccagaccacgagctgattgaccccttccctgtgcccctggtgatcatcggcagcaaatatgatgtgttccaggactttgagagcgagaagaggaaggtgatctgcaagaccctgcgctttgtggcccactactatggagccagcctgatgttcaccagcaagtctgaggccctgctgctgaagatccggggcgtcatcaaccagctggcctttggaattgacaagagcaagagcatctgtgtggaccagaacaagcccctcttcatcacagctggcctggacagctttggccagatcggcagcccccctgtgcctgaaaatgacatcggcaagctgcacgcccacagccccatggagctgtggaagaaggtgtatgagaagctgttcccccccaagagcatcaacaccctgaaggacatcaaggaccctgcccgggacccccagtatgcagaaaatgaggtggatgagatgaggatccagaaggacctggagctggagcagtacaagaggagcagcagcaagtcctggaagcagatcgagctggacagctag

SEQ ID NO: 21420 - DNA, 621 bp, Artificial Sequence
  Description of Artificial Sequence: Synthetic coding sequence
atgggcttcagcaacatggaggatgatggccctgaggaggaggagcgggtggccgagccccaggccaacttcaacaccccccaggccctgcgctttgaggagctgctggccaacctgctgaatgagcagcaccagatcgccaaggagctgtttgagcagctgaagatgaagaagcccagcgccaagcagcagaaggaggtggagaaggtgaagccccagtgcaaggaggtgcaccagaccctcatcctggaccctgcccagaggaagaggctgcagcagcagatgcagcagcacgtgcagctgctgacccagatccacctgctggccacctgcaaccccaacctgaaccctgaggccagcagcacccgcatctgcctgaaggagctgggcacctttgcccagagcagcatcgccctgcaccaccagtacaaccccaagttccagaccctcttccagccctgcaacctgatgggcgccatgcagctgattgaggacttcagcacccacgtgtccattgactgcagcccccacaagacagtgaagaagacagccaatgagttcccctgcctgcccaagcaggtggcctggatcctggccaccagcaaggtgttcatgtactag

SEQ ID NO: 21421 - DNA, 468 bp, Artificial Sequence
  Description of Artificial Sequence: Synthetic coding sequence
atgggcaaggactactacaagatcctgggcatccccagcggggccaatgaagatgagatcaagaaggcctacaggaagatggccctgaagtaccacccagacaagaacaaggagcccaatgctgaggagaagttcaaggagattgctgaggcctatgatgtgctgagtgaccccaagaagaggggcctgtatgaccagtatggagaggagggcctgaagacaggaggcggcaccagcggcggcagcagcggcagcttccactacaccttccatggagacccccacgccacctttgccagcttcttcggcggcagcaacccctttgacatcttctttgccagcagccgcagcacccggcccttcagcggctttgatcctgatgacatggatgtggatgaagatgaggacccctttggagccttcggccgcttcggcttcaacggcctgagccggggccccaggaggtag

SEQ ID NO: 21422 - DNA, 246 bp, Artificial Sequence
  Description of Artificial Sequence: Synthetic coding sequence
atgagcatcagcagtgatgaggtgaacttcctggtgtaccgctacctgcaggagagcggcttcagccacagcgccttcaccttcggcatcgagagccacatcagccagagcaacatcaacggggccctggtgcccccagctgccctgatcagcatcatccagaagggcctgcagtatgtggaggccgaggtgtccatcaatgaagatggcaccctgtttgatggccggcccatcgagagcctgtag

SEQ ID NO: 21423 - DNA, 1248 bp, Artificial Sequence
  Description of Artificial Sequence: Synthetic coding sequence
atggcccctgtgggcgtggagaagaagctgctgctgggccccaatggacctgctgtggccgccgccggggacctgaccagcgaggaggaggagggccagagcctgtggagcagcatcctgtctgaggtgtccacccgggcccggagcaagctgcccagcggcaagaacatcctggtgtttggagaagatggcagcggcaagaccaccctgatgaccaagctgcagggcgctgagcacggcaagaagggccggggcctggagtacctgtacctgtctgtgcatgatgaggacagagatgtggtgaaggacttccaggactacatggagcctgaggagggctgccagggcagcccccagaggcggggccccctgaccagcggcagtgatgaagaaaatgtggccctgcccctgggggacaacgtgctgacccacaacctgggcatccctgtgctggtggtgtgcaccaagtgtgatgctgtgtctgtgctggagaaggagcatgactacagagatgagcacctggacttcatccagagccacctgcggcgcttctgcctgcagtacggggccgccctgatctacacctctgtgaaggaggagaagaacctggacctgctgtacaagtacatcgtgcacaagacctacggcttccacttcaccaccccagccctggtggtggagaaggatgctgtgttcatcccagctggctgggacaatgagaagaagatcgccatcctgcacgagaacttcaccaccgtgaagccagaagatgcctatgaggacttcatcgtgaagccccctgtgaggaagctggtgcatgacaaggagctggccgcagaagatgagcaggtgttcctgatgaagcagcagagcctgctggccaagcagcctgccacccccacccgggccagcgagagccctgcccggggccccagcggcagccccaggacccagggccggggcggccctgcctctgtgcccagcagcagccctggcacctctgtgaagaagccagaccccaacatcaagaacaatgctgccagcgagggcgtgctggccagcttcttcaacagcctgctgagcaagaagacaggcagccctggcagccctggggccggcggcgtgcagagcacagccaagaagagcggccagaagacagtgctgagcaatgtgcaggaggagctggacaggatgaccaggaagccagacagcatggtgaccaacagcagcacagaaaatgaggcctag

SEQ ID NO: 21424 - DNA, 1929 bp, Artificial Sequence
  Description of Artificial Sequence: Synthetic coding sequence
atgaggagcatcacccagggcgcctgccgcttcatctgggaggacaagggctacatcagcggggaccacatcaacctggtgagcagcagcctgagcagcttccccatcctgcagaggagcagcgaggagaagatcctgtacagcgaccggctgagcctggagcggcagaagctgactgtgtgccccatcatcaatggagaggaccacctgcggctgctgaacttccagcacaacttcatcacccgcatccagaacatcagcaacctgcagaagctgatcagcctggacctgtatgacaaccagatcgaggagatcagcggcctgagcaccctgcgctgcctgcgggtgctgctgctgggcaagaaccgcatcaagaagatcagcaacctggagaacctgaagagcctggatgtgctggacctgcacggcaaccagatcaccaagattgagaacatcaaccacctgtgtgagctgcgggtgctgaacctggccaggaacttcctgagccacgtggacaacctgaatggcctggacagcctgacagagctgaacctgcggcacaaccagatcacctttgtgagagatgtggacaacctgccctgcctgcagcacctgttcctgtccttcaacaacatcagcagctttgattctgtgtcctgcctggccgacagcagcagcctgagtgacatcacctttgatggcaaccccatcgcccaggagagctggtacaagcacacagtgctgcagaacatgatgcagctgcggcagctggacatgaagaggatcacagaggaggagaggaggatggcctctgtgctggccaagaaggaggaggagaagaagcgggagagccacaagcagagcctgctgaaggagaagaagaggctgaccatcaacaacgtggcccggcagtgggacctgcagcagcagagggtggccaacatcgccaccaatgaagacaggaaggacagcgacagcccccaggacccctgccagattgatggcagcaccctgagcgccttccctgaggagaccggccccctggacagcggcctgaacaatgccctgcagggcctgagcgtcatcgacacctacctggtggaggtggatggagacaccctgagcctgtatggcagcggggccctggagagcctggacaggaactggagcgtgcagacagctggcatgatcaccaccgtgtccttcaccttcattgaatttgatgagatcgtgcaggtgctgcccaagctgaagatcaagttccccaacagcctgcacctgaagttcaaggagaccaacctggtgatgctgcagcagttcaatgccctggcccagctgcggagaattgaccagctgaccatcgacccccagggcaaccctgtggtgaacttcaccctgtggaagtactacgtgctcttccggctgagccacttctccatgcagaagatcaatggaacagaggtgacccagaatgacatgatcatggccgagcggctgtttggcatcctggcccacgtggccagcagcgagctgccccagtaccgcctcatcagcatcctgggagatgccaggaagaagcagttccgctacctgctggagagcaagggcaagaagccaggcatcatcaatgaagaaaataatgacagcaagaggctggtgggggagaacaccaacagagccaccctgaactacaccacccgggacttctacaatgagaagctggaggagatcaaggagaagaagaagttctgcaagacctacatcgaggacctggtgaaggaggccacagagatcaacatgaagaatgaggccctgcagaagctgtggccccagatgttcatcgagctggtgagagatgctgtgattgagatccggaacaagaacagctacatgaagctgtgcctgcagcagatcacagaccagaagtag

SEQ ID NO: 21425 - DNA, 432 bp, Artificial Sequence
  Description of Artificial Sequence: Synthetic coding sequence
cggctgggccgctatgaggtggagaagagatgtgctgtggagaaggaggactatgacctggccaaggagaagaagcagcagatggagcagtacagagctgaggtgtatgagcagctggagctgcacagcctgctggatgctgagctgcacagcgctgtggaccccctgctgcctgccacagacccccaccccaagatcaatgctgagagcctgccctatgatgagcggcccctgcctgccatcaggaagcactatggagaggccgtggtggagcctgagatgagcaatgctgacatcagtgatgccaggagaggaggcatgctgggggagcctgagcccctgacagagaaggccctgcgggaggccagcagcgccattgatgtgctgggggagaccctggtggccgaggcctactgcaagacctggagctag

SEQ ID NO: 21426 - DNA, 1842 bp, Artificial Sequence; identical to SEQ ID NO: 18580
  Description of Artificial Sequence: Synthetic coding sequence

SEQ ID NO: 21427 - DNA, 552 bp, Artificial Sequence
  Description of Artificial Sequence: Synthetic coding sequence
atgggccccctgcccaggacagtggagctgttctatgatgtgctgagcccctacagctggctgggctttgagatcctgtgccgctaccagaacatctggaacatcaacctgcagctgcggcccagcctcatcaccggcatcatgaaggacagcggcagcctgagcgccatgaggttcctgacagctgtgaacctggagcaccctgagatgctggagaaggccagccgggagctgtggatgagggtgtggagcagaaatgaagacatcacagagccccagagcatcctggccgctgctgagaaggccggcatgtctgctgagcaggcccagggcctgctggagaagatcgccacccccaaggtgaagaaccagctgaaggagaccacagaagctgcctgccgctatggagccttcggcctgcccatcaccgtggcccacgtggatggccagacccacatgctgtttggaagtgacaggatggagctgctggcccacctgctgggggagaagtggatgggccccatccccccagctgtgaatgcccggctgtag

SEQ ID NO: 21428 - DNA, 306 bp, Artificial Sequence
  Description of Artificial Sequence: Synthetic coding sequence
gagggcaccagcggcaagacagccctgcacctggccgtggagacccaggagcggggcctggtgcagttcctgctgcaggccggggcccaggtggatgccaggatgctgaatggctgcacccccctgcacctggccgccggccggggcctgatgggcatcagcagcaccctgtgcaaggccggggctgacagcctgctgagaaatgtggaggatgagaccccccaggacctgacagaggagagcctggtgctgctgccctttgatgacctgaagatcagcggcaagctgctgctgtgcacagactag

SEQ ID NO: 21429 - DNA, 14586 bp, Artificial Sequence
  Description of Artificial Sequence: Synthetic coding sequence
atggccaccatgatcccccctgtgaagctgaagtggctggagcacctgaacagctcctggatcacagaagattctgagagcatcgccacccgggagggcgtggccgtgctgtacagcaagctggtgagcaacaaggaggtggtgcccctgccccagcaggtgctgtgcctgaagggcccccagctgcctgactttgagcgggagagcctgagcagtgatgagcaggaccactacctggatgccctgctgagcagccagctggccctggccaagatggtgtgcagcgacagcccctttgctggggccctgaggaagaggctgctggtgctgcagagggtcttctacgccctgagcaacaagtaccatgacaagggcaaggtgaagcagcagcagcacagccctgagagcagcagcggcagcgcagatgtgcacagcgtgtctgagcggcccaggagcagcacagatgccctgattgagatgggcgtgaggacaggcctgagcctgctgtttgccctgctgcggcagagctggatgatgcctgtgtctggccctggcctgagcctgtgcaatgatgtgatccacacagccatcgaggtggtgagcagcctgccccccctgagcctggccaatgaaagcaagatcccccccatgggcctggactgcctgagccaggtgaccaccttcctgaagggcgtgaccatccccaacagcggggctgacaccctgggccggcggctggccagcgagctgctgctgggcctggccgcccagaggggcagcctgcgctacctgctggagtggattgagatggccctgggcgccagcgctgtggtgcacaccatggagaagggcaagctgctgagcagccaggagggcatgatcagctttgactgcttcatgaccatcctgatgcagatgagaagaagcctgggcagcagcgctgacaggagccagtggagggagcccaccaggaccagtgatggcctgtgcagcctgtatgaagctgccctgtgcctgtttgaggaggtgtgcaggatggccagtgactacagcaggacctgtgccagcccagacagcatccagacaggagatgcccccatcgtgtctgagacctgtgaggtgtatgtgtggggcagcaacagcagccaccagctggtggagggcacccaggagaagatcctgcagcccaagctggcccccagcttcagtgatgcccagaccatcgaggccggccagtactgcaccttcgtcatcagcacagatggctctgtgcgggcctgtgggaagggcagctatggccgcctgggcctgggggacagcaacaaccagagcaccctgaagaagctgacctttgagccccacaggagcatcaagaaggtgagcagcagcaagggcagtgatggccacaccctggccttcaccacagaaggagaggtgttctcctggggagatggagactatggcaagctgggccacggcaacagcagcacccagaagtaccccaagctgatccagggccccctgcagggcaaggtggtggtgtgtgtgtctgctggctaccgccacagcgctgctgtgacagaagatggagagctgtacacctggggcgagggggactttggccgcctgggccatggagacagcaacagcaggaacatccccaccctggtgaaggacatcagcaatgtgggggaggtgtcctgtggcagcagccacaccatcgccctgagcaaggatggccgcacagtgtggagctttggaggaggagacaatggcaagctgggccacggggacaccaacagagtgtacaagcccaaggtgattgaggccctgcagggcatgttcatcaggaaggtgtgtgccggcagccagagcagcctggccctgaccagcacaggccaggtgtatgcctggggctgtggggcctgcctgggctgcggcagcagcgaggccacagccctgcggcccaagctgattgaggagctggccgccaccagaattgtggatgtgtccatcggggacagccactgcctggccctgagccatgacaatgaggtgtatgcctggggcaacaacagcatgggccagtgtggccagggcaacagcacaggccccatcaccaagcccaagaaggtgtctggcctggatggcatcgccatccagcagatctctgctggcaccagccacagcctggcctggacagccctgccccgggaccggcaggtggtggcctggcaccggccctactgtgtggacctggaggagagcaccttcagccacctgcgctccttcctggagcgctactgtgacaagatcaacagcgagatcccccccctgcccttccccagcagccgggagcaccacagcttcctgaagctgtgcctgaagctgctgagcaaccacctggccctggccctggccggcggcgtggccaccagcatcctgggccggcaggccggccccctgaggaacctgctcttccggctgatggacagcacagtgcctgatgagatccaggaggtggtgattgagaccctgtctgtgggcgccaccatgctgctgccccccctgcgggagaggatggagctgctgcacagcctgctgccccagggccctgaccgctgggagagcctgagcaagggccagaggatgcagctggacatcatcctgaccagcctgcaggaccacacccacgtggccagcctgctgggctacagcagccccagtgatgctgctgacctgagctctgtgtgcaccggctacggcaacctgagtgaccagccctacggcacccagagctgccacccagacacccacctggccgagatcctgatgaagaccctgctgaggaacctgggcttctacacagaccaggccttcggggagctggagaagaacagcgacaagttcctgctgggcaccagcagcagcgagaacagccagcctgcccacctgcacgagctgctgtgcagcctgcagaagcagctgctggccttctgccacatcaacaacatcagcgagaacagcagctctgtggccctgctgcacaagcacctgcagctgctgctgccccacgccacagacatctacagccgcagcgccaacctgctgaaggagagcccctggaatggatctgtgggggagaagctgagagatgtgatctacgtgtctgctgctggctccatgctgtgccagatcgtgaacagcctgctgctgctgcctgtgtctgtggcccggcccctgctgagctacctgctggacctgctgccccccctggactgcctgaaccggctgctgcctgctgctgacctgctggaggaccaggagctgcagtggcccctgcatggaggccctgagctgattgatcctgctggcctgcccctgccccagcctgcccagagctgggtgtggctggtggacctggagaggaccatcgccctgctgattggccgctgcctgggcggcatgctgcagggcagccctgtgtccccagaggagcaggacacagcctactggatgaagacccccctcttcagtgatggagtggagatggacaccccccagctggacaagtgcatgagctgcctgctggaggtggccctgtctggaaatgaggagcagaagccctttgactacaagctgcggcctgagattgctgtgtatgtggacctggccctgggctgcagcaaggagcccgcccggagcctgtggatctccatgcaggactatgctgtgtccaaggactgggacagcgccaccctgagcaatgaaagcctgctggacacagtgtccagatttgtgctggccgccctgctgaagcacaccaacctgctgagccaggcctgtggggagagccgctaccagcccgggaagcacctgtctgaggtgtaccgctgtgtgtacaaggtgcgcagccggctgctggcctgcaagaacctggagctgatccagaccaggagcagcagccgggaccgctggatcagcgagaaccaggacagcgcagatgtggacccccaggagcacagcttcaccaggaccattgatgaggaggccgagatggaggagcaggccgagcgggaccgggaggagggccaccctgagccagaagatgaggaggaggagcgggagcacgaggtgatgacagctgggaagatcttccagtgcttcctgagcgcccgggaggtggcccggagccgggaccgggacaggatgaacagcggggccggcagcggggcccgggcagatgatcctccaccccagagccagcaggagaggagagtgtccacagacctgcctgagggccaggatgtgtacacagctgcctgcaacagcgtcatccaccgctgtgccctgctgatcctgggcgtgtcccctgtgattgatgagctgcagaagaggcgggaggagggccagctgcagcagcccagcaccagcgccagcgagggcggcggcctgatgaccaggtctgagagcctgacagctgagagccggctggtgcacaccagccccaactaccgcctcatcaagagccgctctgagagtgacctgagccagcctgagagtgatgaggagggctacgccctgtctggaagaagaaatgtggacctggacctggccgccagccacaggaagaggggccccatgcacagccagctggagagcctgagtgacagctgggcccggctgaagcacagccgggactggctgtgcaacagcagctacagctttgaaagtgactttgacctgaccaagagcctgggcgtgcacaccctgattgaaaatgtggtgtcctttgtgtctggagatgtgggcaatgcccctggcttcaaggagcctgaggagagcatgagcaccagcccccaggccagcatcatcgccatggagcagcagcagctgcgggcagagctgcggctggaggccctgcaccagatcctggtgctgctgagcggcatggaggagaagggcagcatcagcctggccggcagccggctgagcagcggcttccagagcagcaccctgctgacctctgtgcggctgcagttcctggccggctgcttcggcctgggcaccgtgggccacactggaggaaaaggagagagcggccgcctgcaccactaccaggacggcatccgggccgccaagaggaacatccagatcgagatccaggtggccgtgcacaagatctaccagcagctgagcgccaccctggagcgggccctgcaggccaacaagcaccacatcgaggcccagcagaggctgctgctggtgacagtgtttgccctgtctgtgcactaccagcctgtggatgtgtccctggccatcagcacaggcctgctgaatgtgctgagccagctgtgtggcacagacaccatgctgggccagcccctgcagctgctgcccaagacaggagtgtcccagctgagcacagccctgaaggtggccagcacccggctgctgcagatcctggccatcaccaccggcacctacgccgacaagctgagccccaaggtggtgcagagcctgctggacctgctgtgcagccagctgaagaacctgctgagccagacaggagtgctgcacatggccagctttggagagggggagcaggaggatggagaggaggaggagaagaaggtggacagcagcggggagacagagaagaaggacttccgggccgccctgaggaagcagcacgccgctgagctgcacctgggggacttcctggtgttcctgcggcgggtggtgagcagcaaggccatccagagcaagatggccagccccaagtggacagaggtgctgctgaacatcgccagccagaagtgcagcagcggcatccccctggtgggcaacctgcggacccggctgctggccctgcacgtgctggaggccgtgctgcctgcctgtgagagcggcgtggaggatgaccagatggcccagatcgtggagcggctcttcagcctgctgagtgactgcatgtgggagacccccatcgcccaggccaagcacgccatccagatcaaggagaaggagcaggagatcaagctgcagaagcagggcgagctggaggaggaggatgagaacctgcccatccaggaggtgtcctttgatcctgagaaggcccagtgctgcctggtggagaatggccagatcctgacccacggcagcggcggcaagggctacggcctggccagcactggagtgaccagcggctgctaccagtggaagttctacatcgtgaaggaaaatagaggaaatgaaggcacctgtgtgggcgtgagccgctggcctgtgcatgacttcaaccacaggaccaccagtgacatgtggctgtaccgggcctacagcggcaacctgtaccacaatggagagcagaccctgaccctgagcagcttcacccagggcgacttcatcacctgtgtgctggacatggaggcccggaccatcagctttgggaagaatggagaggagcccaagctggcctttgaagatgtggatgctgctgagctgtacccctgtgtgatgttctacagcagcaaccctggagagaaggtgaagatctgtgacatgcagatgaggggcaccccccgggacctgctgcccggggaccccatctgcagccctgtggccgctgtgctggccgaggccaccatccagctgatccgcatcctgcacaggacagaccgctggacctactgcatcaacaagaagatgatggagcggctgcacaagatcaagatctgcatcaaggagagcggccagaagctgaagaagagccgctctgtgcagagccgggaggagaatgagatgagggaggagaaggagagcaaggaggaggagaagggcaagcacaccaggcatggcctggccgacctgtctgagctgcagctgcggaccctgtgcatcgaggtgtggcctgtgctggccgtcatcggcggcgtggatgctggcctgcgggtgggcggccgctgtgtgcacaagcagacaggaagacatgccaccctgctgggcgtggtgaaggagggcagcaccagcgccaaggtgcagtgggatgaggccgagatcaccatctccttccccaccttctggagccccagcgacacccccctgtacaacctggagccctgtgagcccctgccctttgatgtggcccgcttccggggcctgacagcctctgtgctgctggacctgacctacctgactggagtgcatgaggacatgggcaagcagagcaccaagagacatgagaagaagcacagacatgagagcgaggagaagggagatgtggagcagaagccagagagcgagagcgccctggacatgaggacaggcctgaccagtgatgatgtgaagagccagagcaccaccagcagcaagtcagaaaatgaaattgccagcttcagcctggaccccaccctgcccagcgtggagagccagcaccagatcacagagggcaagaggaagaaccacgagcacatgagcaagaaccatgatgtggcccagagcgagatccgggctgtgcagctgagctacctgtacctgggcgccatgaagagcctgagcgccctgctgggctgcagcaaatatgcagagctgctgctgatccccaaggtgctggccgagaatggccacaacagcgactgtgccagcagccctgtggtgcatgaagatgtggagatgagagctgccctgcagttcctgatgaggcacatggtgaagagagctgtgatgaggagccccatcaagagggccctgggcctggccgacctggagcgggcccaggccatgatctacaagctggtggtgcacggcctgctggaggaccagtttggaggcaagatcaagcaggagattgaccagcaggccgaggagagtgaccctgcccagcaggcccagacccctgtgaccaccagccccagcgccagcagcaccaccagcttcatgagcagcagcctggaggacaccaccacagccaccacccctgtgacagacacagagaccgtgcctgccagcgagagccctggggtgatgcccctgagcctgctgcggcagatgttcagcagctaccccaccaccaccgtgctgcccacccggcgggcccagaccccacccatcagcagcctgcccaccagccccagtgatgaggtgggccggcggcagagcctgaccagcccagacagccagagcgcccggcctgccaacagaacagccctgagtgaccccagcagccggctgagcaccagccccccacctccagccatcgctgtgcccctgctggagatgggcttcagcctgcggcagatcgccaaggccatggaggccaccggggcccggggggaggctgatgcccagaacatcaccgtgctggccatgtggatgattgagcaccctggccatgaagatgaggaggagccccagagcggcagcacagctgacagcaggcctggagctgctgtgctgggcagcggcggcaagagcaatgacccctgctacctgcagagccctggggacatccccagcgcagatgctgctgagatggaggagggcttcagcgagagcccagacaacctggaccacacagaaaatgctgccagcggcagcggccccagcgcccggggccgctctgctgtgacccggcggcacaagtttgacctggccgcccggaccctgctggcccgggccgccggcctgtacagatctgtgcaggcccacaggaaccagagccggcgggagggcatcagcctgcagcaggaccccggggccctgtatgacttcaacctggatgaggagctggagattgacctggatgatgaggccatggaggccatgtttggccaggacctgaccagtgacaatgacatcctgggcatgtggatccctgaggtgctggactggcccacctggcacgtgtgtgagagtgaagatcgggaggaggtggtggtgtgtgagctgtgtgaatgttctgtggtgtccttcaaccagcacatgaagaggaaccaccctggctgcggccgcagcgccaaccggcagggctaccgcagcaatggcagctatgtggatggctggtttggaggagaatgtggcagcggcaacccctactacctgctgtgtggcacctgccgggagaagtacctggccatgaagaccaagagcaagagcaccagcagcgagcgctacaagggccaggccccagacctgattggcaagcaggacagcgtgtatgaggaggactgggacatgctggatgtggatgaagatgagaagctgactggagaggaggagtttgagctgctggccggccccctgggcctgaatgaccggcgcatcgtgcctgagcctgtgcagttcccagacagcgaccccctgggcgcctctgtggccatggtgacagccaccaacagcatggaggagaccctgatgcagatcggctgccacggctctgtggagaagagcagcagcggccgcatcaccctgggggagcaggccgccgccctggccaacccccatgacagagtggtggccctgcggcgggtgacagctgctgcccaggtgctgctggcccggaccatggtgatgagggccctgagcctgctgtctgtgtctggcagcagctgcagcctggccgccggcctggagagcctgggcctgacagacatccgcaccctggtgcggctgatgtgcctggccgccgccggccgggccggcctgagcaccagccccagcgccatggccagcaccagcgagaggagcagaggaggccacagcaaggccaacaagcccatcagctgcctggcctacctgagcacagctgtgggctgcctggccagcaatgcccccagcgctgccaagctgctggtgcagctgtgcacccagaacctgatctctgctgccactggagtgaacctgaccaccgtggatgacagcatccagaggaagttcctgcccagcttcctgcggggcattgctgaggagaacaagctggtgaccagccccaactttgtggtgacccaggccctggtggccctgctggccgacaagggggccaagctgcggcccaactatgacaagtctgaggtggagaagaagggccccctggagctggccaatgccctggccgcctgctgcctgagcagccggctgagcagccagcaccggcagtgggccgcccagcagctggtgaggaccctggccgcccatgaccgggacaaccagaccaccctgcagaccctggccgacatgggcggggacctgaggaagtgcagcttcatcaagctggaggcccaccagaacagagtgatgacctgtgtgtggtgcaacaagaagggcctgctggccaccagcggaaatgatggcaccatccgggtgtggaatgtgaccaagaagcagtacagcctgcagcagacctgtgtgttcaaccggctggagggagatgctgaggagagcctgggcagccccagcgaccccagcttcagccctgtgtcctggagcatcagcggcaagtacctggccggggccctggagaagatggtgaacatctggcaggtgaatggaggcaagggcctggtggacatccagccccactgggtgtctgccctggcctggccagaggagggccctgccacagcctggagcggggagagccctgagctgctgctggtgggccgcatggatggcagcctgggcctcatcgaggtggtggatgtgtccaccatgcaccggcgggagctggagcactgctacaggaaggatgtgtctgtgacctgcatcgcctggttctctgaagatcggccctttgctgtgggctactttgatggcaagctgctgctgggcaccaaggagcccctggagaagggcggcatcgtgctgattgatgcccacaaggacaccctcatctccatgaagtgggaccccaccggccacatcctgatgacctgtgccaaggaggacagcgtgaagctgtggggcagcatcagcggctgctggtgctgcctgcacagcctgtgccaccccagcatcgtgaatggaattgcctggtgccgcctgcccgggaagggcagcaagctgcagctgctgatggccaccggctgccagagcggcctggtgtgtgtgtggaggatcccccaggacaccacccagaccaacgtgaccagcgctgagggctggtgggagcaggagagcaactgccaggacggctacaggaagagcagcggggccaagtgtgtgtaccagctgcggggccacatcacccctgtgaggacagtggccttcagcagtgatggcctggccctggtgtctgggggcctgggcggcctgatgaacatctggagcctgagagatggctctgtgctgcagacagtggtgattggcagcggggccatccagaccaccgtgtggatccctgaggtgggcgtggccgcctgcagcaacagaagcaaggatgtgctggtggtgaactgcacagctgagtgggccgccgccaaccacgtgctggccacctgcaggacagccctgaagcagcagggcgtgctgggcctgaacatggccccctgcatgagggccttcctggagcggctgcccatgatgctgcaggagcagtatgcctatgagaagccccacgtggtgtgtggggaccagctggtgcacagcccctacatgcagtgcctggccagcctggccgtgggcctgcacctggaccagctgctgtgcaacccccctgtgcccccccaccaccagaactgcctgcctgaccctgcctcctggaaccccaatgagtgggcctggctggagtgcttcagcaccaccatcaaggctgctgaggccctgaccaacggggcccagtttcctgagagcttcaccgtgcctgacctggagcctgtgcctgaagatgagctggtgttcctgatggacaacagcaagtggatcaatggcatggatgagcagatcatgtcctgggccaccagcaggcctgaggactggcacctgggcggcaaatgtgatgtgtacctgtggggcgccggcagacatggccagctggccgaggccggcagaaatgtgatggtgcctgctgctgcccccagcttcagccaggcccagcaggtgatctgtggccagaactgcaccttcgtcatccaggccaatggaacagtgctggcctgtggggagggcagctatggccgcctgggccagggcaacagtgatgacctgcacgtgctgaccgtcatcagcgccctgcagggctttgtggtgacccagctggtgaccagctgtggcagtgatggccacagcatggccctgacagagagcggggaggtgttctcctggggagatggagactatggcaagctgggccacggcaacagcgaccggcagaggcggccccggcagatcgaggccctgcagggcgaggaggtggtgcagatgagctgtggcttcaagcacagcgctgtggtgaccagtgatggcaagctgttcacctttggaaatggagactatggccgcctgggcctgggcaacaccagcaacaagaagctgcctgagcgggtgacagccctggagggctaccagatcggccaggtggcctgtggcctgaaccacaccctggccgtgtctgcagatggctccatggtgtgggcctttggagatggagactatggcaagctgggcctgggcaacagcacagccaagagcagcccccagaagattgatgtgctgtgtggcatcggcatcaagaaggtggcctgtggcacccagttctctgtggccctgaccaaggatggccacgtgtacaccttcggccaggaccggctgattggcctgcctgagggccgggccaggaaccacaaccggccccagcagatccctgtgctggccggggtcatcattgaagatgtggccgtgggcgctgagcacaccctggccctggccagcaatggagatgtgtatgcctggggcagcaacagcgagggccagctgggcctgggccacaccaaccacgtgcgggagcccaccctggtgacaggcctgcagggcaagaatgtgcggcagatctctgctggccgctgccacagcgctgcctggacagcccctcctgtgcccccccgggcccctggggtgtctgtgcccctgcagctgggcctgcctgacacagtgcccccccagtacggggccctgcgggaggtgtccatccacacagtgcgggcccggctgcggctgctgtaccacttcagtgacctgatgtacagctcctggaggctgctgaacctgagccccaacaaccagaacagcaccagccactacaatgccggcacctggggcatcgtgcagggccagctgcggcccctgctggccccccgggtgtacaccctgcccatggtgcgcagcatcggcaagaccatggtgcagggcaagaactacggcccccagatcaccgtgaagaggatcagcacccggggcaggaagtgcaagcccatctttgtgcagatcgcccggcaggtggtgaagctgaatgccagtgacctgcggctgcccagccgggcctggaaggtgaagctggtgggggagggcgcagatgatgctgggggcgtgtttgatgacaccatcacagagatgtgccaggagctggagactggaattgtggacctgctgatccccagccccaatgccacagctgaggtgggctacaacagagaccgcttcctgttcaaccccagcgcctgcctggatgagcacctgatgcagttcaagttcctgggcatcctgatgggcgtggccatccgcaccaagaagcccctggacctgcacctggcccccctggtgtggaagcagctgtgctgcgtgcccctgaccctggaggacctggaggaggtggacctgctgtatgtgcagaccctgaacagcatcctgcacatcgaggacagcggcatcacagaggagagcttccacgagatgatccccctggacagctttgtgggccagagcgcagatggcaagatggtgcccatcatccctgggggcaacagcatccccctgaccttcagcaacaggaaggagtatgtggagcgggccatcgagtaccgcctgcacgagatggaccggcaggtggccgctgtgcgggagggcatgtcctggatcgtgcctgtgcccctgctgagcctgctgacagccaagcagctggagcagatggtgtgtggcatgcctgagatctctgtggaggtgctgaagaaggtggtgcgctaccgggaggtggatgagcagcaccagctggtgcagtggttctggcacaccctggaggagttcagcaatgaggagcgggtgctcttcatgagatttgtgtctggccgcagccggctgcctgccaacacagctgacatcagccagcgcttccagatcatgaaggtggaccggccctatgacagcctgcccaccagccagacctgcttcttccagctgcggctgcccccctacagcagccagctggtgatggccgagcggctgcgctatgccatcaacaactgccgcagcattgacatggacaactacatgctgagcagaaatgtggacaatgctgagggcagtgacacagactactag

SEQ ID NO: 21430 - DNA, 3633 bp, Artificial Sequence; identical to SEQ ID NO: 19771
  Description of Artificial Sequence: Synthetic coding sequence

SEQ ID NO: 21431 - DNA, 579 bp, Artificial Sequence; identical to SEQ ID NO: 20257
  Description of Artificial Sequence: Synthetic coding sequence

SEQ ID NO: 21432 - DNA, 1803 bp, Artificial Sequence; identical to SEQ ID NO: 20162
  Description of Artificial Sequence: Synthetic coding sequence

SEQ ID NO: 21433 - DNA, 1197 bp, Artificial Sequence
  Description of Artificial Sequence: Synthetic coding sequence
atgctgcggaggaagcccagcaatgccagcgagaaggagttcaacctggatgacaacatcccagaagatgattctggagtgcccaccccagaagatgctgggaagagcggcaagaagctgggcaagaagtggagggctgtgatcagcaggaccatgaacaggaagatgggcaagatgatggtgaaggccctgtctgaggagatggctgacaccctggaggagggcagcgccagccccaccagcccagactacagcctggacagccctggccctgagaagatggccctggccttcagcgagcaggaggagcacgagctgcctgtgctgagccggcaggccagcactggaagtgagctgtgcagccccagccctggcagcggcagctttggagaggagcccccagccccccagtacacaggccccttctgtggccgggcccgggtgcacacagacttcacccccagcccctatgaccatgacagcctgaagctgcaggtgcgcagcgccagcggcctgctgtggagcctggccggctgtgcccagaagggctcctggacagagcccggctatgacagcgtgtctgggggccagggccccccctaccccctgagcctggcccccttcagcagccccctgccccagcagaagggagatgtgatccagatcatcgagaagccccctgtgggcacctggctgggcctgctgaatggcaaggtgggcagcttcaagttcatctacgtggatgtgctgcctgaggaggccgtgggccacgcccggcccagccggcggcagagcaagggcaagaggcccaagcccaagaccctgcacgagctgctggagcgcatcggcctggaggagcacaccagcaccctgctgctgaatggctaccagaccctggaggacttcaaggagctgcgggagacccacctgaatgagctgaacatcatggacccccagcaccgggccaagctgctgacagctgctgagctgctgctggactatgacaccggcagcgaggaggccgaggagggcgctgagagcagccaggagcctgtggcccacacagtgtctgagcccaaggtggacatcccccgggacagcggctgctttgagggcagcgagagcggcagagatgatgctgagctggccggcacagaggagcagctgcagggcctgagcctggccggggccccctag

SEQ ID NO: 21434 - DNA, 1002 bp, Artificial Sequence
  Description of Artificial Sequence: Synthetic coding sequence
atgggcaccaggaagaaggtgcacgcctttgtgcgggtgaagcccacagatgactttgcccacgagatgatccgctatggagatgacaagaggagcattgacatccacctgaagaaggacatccggcggggcgtggtgaacaaccagcagacagactggagcttcaagctggatggagtgctgcatgatgccagccaggacctggtgtatgagaccgtggccaaggatgtggtgtcccaggccctggatggctacaacggcaccatcatgtgctacggccagacaggagctgggaagacctacaccatgatgggcgccacagagaactacaagcaccggggcatcctgccccgggccctgcagcaggtgttcaggatgattgaggagcggcccacccacgccatcaccgtgcgggtgtcctacctggagatctacaatgaaagcctgtttgacctgctgagcaccctgccctacgtgggccccagcgtgacccccatgaccatcgtggagaacccccagggcgtcttcatcaagggcctgtctgtgcacctgaccagccaggaggaggatgccttcagcctgctgtttgaaggagagaccaaccgcatcatcgccagccacaccatgaacaagaacagcagccgcagccactgcatcttcaccatctacctggaggcccacagcaggaccctgtctgaggagaagtacatcaccagcaagatcaacctggtggacctggccggcagcgagcggctgggcaagagcggcagcgagggccaggtgctgaaggaggccacctacatcaacaagagcctgtccttcctggagcaggccatcatcgccctgggggaccagaagagggaccacatccccttccggcagtgcaagctgacccacgccctgaaggacagcctgggcggcaactgcaacatggtgctggtgaccaacatctacggggaggccgcccagctggaggagaccggcagccggctgtggctgtag

SEQ ID NO: 21435 - DNA, 1248 bp, Artificial Sequence; identical to SEQ ID NO: 19216
  Description of Artificial Sequence: Synthetic coding sequence

SEQ ID NO: 21436 - DNA, 3108 bp, Artificial Sequence
  Description of Artificial Sequence: Synthetic coding sequence
atgtctgagcaggagcgcatccaggagtgcctgaggaaggagatccgcagcctgctgatcagcaccaaggatggcctgagcccccaggagctggagaaggagtacctgctgatggtgggcaaccacctgcccctgcgcatcctgggctaccgcagcaccatggagctggtgctggacatgccagatgtggtgcgggtgtgccctggggccggcggcaccgtcatcctgaaggccatcccagatgagagcaccaagggcatcgccagcctggtggccaagcagaggagcagccacaagctgagaaattccatgcacaagggccggcccagcatctacagcggccccaggagccacagaagagtgccctaccggggccgggtggcccccatcctgcctgctgtggtgaagtctgagctgaaggacctgctggccctgagccctgtgctgctgagtgactttgagaaggcctttgccaagagatttggccgctccttccagtacatgcagtatggcttcctgtccatgtttgaggtgctgaatgctgccagtgatgtgatctctgtggagcagaccagggctggcagcctgctgatgctgaagaagtctgtgacagaggagaagccccggggctgcccagctgggaagatcttcacccagcccttcaggatgaagcagggcagctacagcacaggcttccctgtggccaagccctgcttcagccagcccaccagcaacatggagccccccaagcagatcatgtccatggagaagaccagcaagctgaatgtggtggagaccagccggctgaaccacacagagaagctgaaccagctggagaacaccttcaagagcgtcatcgcccagatcggccctgggggcaccatcagcagcgagctgaagcacaagatcaagtttgtggtgtccaagtttcctgagggcctcttcatcagcaagctgctgggggagtatgaagtcatcttcaaggagcagctgagccccaagaagctgggcttcctgaatgtgacagagctggtgggcgccctgagtgacatcctgcacgtggagttcaggaagggccaccaggacctgctggtgtttgatgctgacaagaagcccctgccccctgtgcagagcgacaagaagattgaggccaaggcctgtgtgagcagccccccaagaaacagcctgagcacagctgctgtgaaggagaccgtgtggaactgccccagcaagaagcagaaggagccccagcagaagatctgcaagaagcccaacctggtggtgaagcccctgcagctgcaggtggagaccaacaagtctgagctgaacctggccatggccaaccacgacatccccccagatgctgtgcccaacaagaagctgtgccgcctgccccccctggacaccagcagcctgattggagtgtttgtggagtacatcatcagccccagccagttctacatccgcatctacagccgggacagcagcgagctgctggaggacatgatgattgagatgaggcgctgctacagcaaccagctggtgtctgacagatatgtgatgcctgagtgcttcatccagcccggccacctgtgctgcgtgcgcatcagcgaggacaagtggtggtacagagtcatcatccaccgggtgctggagaagcaggaggtggaggtgttctacccagactttggaaacatcggcatcgtgcagaagagcagcctgcgcttcctgaagtgctgctacaccaagctgcctgcccaggccatcccctgcagcctggcctgggtgcggcctgtggaggagcactggaccagcaaggccatcctgcagttccagaagctgtgtggcctgaagcccctggtgggcgtggtggatgaatatgtggatggcatcctgaacatcttcctgtgtgacaccagcagcaatgaagatgtgtacttccaccacgtgctgaggacagagggccacgccatcgtgtgccgggagaacatcagcagcaagggcttcagcgagctgaaccccctggccctgtacaccaccagcagcggcggccctgaggacatcgtgctgacagagctgggctaccccagccagcagcactacttcaatgaagacaggaagatcagcccccagagcaaggagagcgagctgcgcatcctgcaggacatcaatgatgagaagagcctgagccacctgaagtctgagagcaaggagcccctgaaggacagcgagtttgagagcctgaagacctgcaacaagagctttgaggaggaccccaagtggagcaaccctgagcccaatgacctgaaggaggagaatgaagatgagatccccaccggcatgccctgcctggagagcgtgaccatcggagatgacatctgggatgagaactggctgcccctgcaggccaagatgggcaaaggaggagatgctgccagccacctgttcaccgccagcctgggcggcaagaaccagtacagcagctgcaaggagatgccccagaaggactggtgcttcagcacccccaaggacacctgggatgacagctggcagcccagcggcctggtgaatggcaccaaggtggaggtgcacaagccagaggtgctgggcgcccaggagaagaacacaggcaccaacagaacccagaagcagctggacatcaatggcagcagtgacagcagcaccctgcccaagctggaggagttctgcaccagcctgacccagagcgagcagagcgcagatggcagccagagcgagcccaacaacagccagacccagcccaagcagatccagctgagcacagctgccccctgcagcaccacagctgtggatgacagcgctgagaagcccagcggctctgtggagagcagccctgagatcctgaagaatgaagacttcagcagcagccgggccatcaccctgtacaaggacaagaggcaggagagcgtggaccagctgagcctcatcctgtcctatgagtgccagatcagccagaagctgtacatccccaggagcacagccacagctgccctgggcgccgccgcccggctggccaccagccgcagcctgctgcactggtaccccagcgtgaagaggatggaggcctag

SEQ ID NO: 21437 - DNA, 660 bp, Artificial Sequence
  Description of Artificial Sequence: Synthetic coding sequence
atgggcggggcccagctggagctgcccagcggggcccggcctggggtgtgtgtgagaagaagcttccgggcccacgccggggaccagcccaggaggcctcctggccccatccctgtgcccggcaccatgaagcaggagagcgctgcccccaacaccccacccaccagccagagccccacccccagcgcccagttccccagaaatgatggagacccccaggccctgtggatcttcggctacggcagcctggtgtggaggccagactttgcctacagcgacagccgggtgggctttgtgcggggctacagccgccgcttctggcagggcgacaccttccaccggggcagtgacaagatgcctggccgggtggtgaccctgctggaggaccacgagggctgcacctggggcgtggcctaccaggtgcagggcgagcagaaccctggctacctgggccctgcccctgaggaggccatcgccacccagatcctggcctgccggggcttcagcggccacaacctggagtacctgctgcggctggccgacttcatgcagctgtgtggcccccaggcccaggatgagcacctggccgccatcgtggatgctgtgggcaccatgctgccctgcttctgccccacagagcaggccctggccctggtgtag

SEQ ID NO: 21438 - DNA, 2382 bp, Artificial Sequence; identical to SEQ ID NO: 19207
  Description of Artificial Sequence: Synthetic coding sequence

SEQ ID NO: 21439 - DNA, 1842 bp, Artificial Sequence; identical to SEQ ID NO: 18580
  Description of Artificial Sequence: Synthetic coding sequence

SEQ ID NO: 21440 - DNA, 582 bp, Artificial Sequence
  Description of Artificial Sequence: Synthetic coding sequence
atggcccgggccggcccccggctggtgctgtctgaggaggccgtgcgggccaagagcggcctgggcccccaccgggacctggccgagctgcagagcctgagcatccctggcacctaccaggagaagatcacccacctgggccacagcctgatgagcctgaccggcctgaagagcctggacctgagcaggaacagcctggtgtccctggagggcatccagtacctgacagccctggagagcctgaacctgtactacaactgcatcagcagcctggccgaggtgttccggctgcacgccctgacagagctggtggatgtggacttccggctgaaccctgtggtgaaggtggagccagactaccgcctgtttgtggtgcacctgctgcccaagctgcagcagctggatgacaggcctgtgcgggccagcgagaggaaggccagccggctgcactttgccagcgaggacagcctggacagcaaggagagcgtgcctgccagcctgaaggagggccgcatccagacctctgtggagcctgctgtgggcaccgtgcctgtgtggggcctgtgggaggccggcccctag

SEQ ID NO: 21441 - DNA, 177 bp, Artificial Sequence
  Description of Artificial Sequence: Synthetic coding sequence
atgtacttcaactacaagtctgtgtgtggcagctgtggcttcggcagctgctacggctgcggctacggctgcatccacagcacccactgcggctgcaatggctactacggctgctatgagaacaagtacagcgtgattgatgacctgatcttctttgccagcaagaagtgccactag

SEQ ID NO: 21442 - DNA, 585 bp, Artificial Sequence
  Description of Artificial Sequence: Synthetic coding sequence
atgaatggccgggctgacttccgggagcccaatgctgaggtgccccggcccatcccccacatcggccctgactacatccccacagaggaggagcggcgggtgtttgctgaatgtaatgatgagagcttctggttccgctctgtgcccctggccgccacctccatgctgatcacccagggcctcatcagcaagggcatcctgagcagccaccccaagtatggcagcatccccaagctgatcctggcctgcatcatgggctactttgctgggaagctgtcctatgtgaagacctgccaggagaagttcaagaagctggagaacagccccctgggggaggccctgcggagcggccaggcccggcgcagcagccccccaggccactactaccagaagagcaaatatgacagctctgtgtctggccagagcagctttgtgaccagccctgctgctgacaacatcgagatgctgccccactatgagcccatccccttcagcagctccatgaatgaaagtgcccccaccggcatcacagaccacatcgtgcaggtgaaggtgaacaagtacggggacacctgggatgaatag

SEQ ID NO: 21443 - DNA, 2421 bp, Artificial Sequence
  Description of Artificial Sequence: Synthetic coding sequence
atgagcagcagccctgtgaatgtgaagaagctgaaggtgtctgagctgaaggaggagctgaagaagaggcggctgagtgacaagggcctgaaggccgagctgatggagcggctgcaggccgccctggatgatgaggaggccggcggccgcccagccatggagcctggaaatggcagcctggacctgggcggggacagcgctggccgcagcggggccggcctggagcaggaggccgctgctggaggagatgaggaggaggaggaggaggaggaggaggaggagggcatcagcgccctggatggagaccagatggagctgggggaggagaatggagctgctggagctgctgacagcggccccatggaggaggaggaggccgcctctgaagatgaaaatggagatgaccagggcttccaggagggggaggatgagctgggagatgaggaggagggcgctggagatgaaaatggccacggggagcagcagccccagcccccagccacccagcagcagcagccccagcagcagagaggagctgccaaggaggccgccggcaagagcagcggccccaccagcctgtttgctgtgacagtggcccctcctggggcccggcagggccagcagcaggccggaggagatggcaagacagagcagaagggcggggacaagaagaggggcgtgaagaggccccgggaggaccacggccggggctactttgagtacatcgaggagaacaagtacagccgggccaagagcccccagccccctgtggaggaggaggatgagcactttgatgacacagtggtgtgcctggacacctacaactgtgacctgcacttcaagatcagccgggaccggctgagcgccagcagcctgaccatggagagctttgccttcctgtgggccggcggccgggccagctatggagtgtccaagggcaaggtgtgctttgagatgaaggtgacagagaagatccctgtgcgccacctgtacaccaaggacatcgacatccacgaggtgcgcatcggctggagcctgaccaccagcggcatgctgctgggggaggaggagttctcctatggctacagcctgaagggcatcaagacctgcaactgtgaaacagaagattatggagagaagtttgatgaaaatgatgtgatcacctgctttgccaactttgaaagtgatgaggtggagctgtcctatgccaagaatggccaggacctgggcgtggccttcaagatcagcaaggaggtgctggccggccggcccctcttcccccacgtgctgtgccacaactgtgctgtggagttcaactttggccagaaggagaagccctacttccccatccctgaggagtacaccttcatccagaatgtgcccctggaggacagagtgcggggccccaagggccctgaggagaagaaggactgtgaggtggtgatgatgattggcctgcctggagctgggaagaccacctgggtgaccaagcatgctgctgaaaatcctgggaagtacaacatcctgggcaccaacaccatcatggacaagatgatggtggccggcttcaagaagcagatggctgacaccgggaagctgaacaccctgctgcagagggccccccagtgcctgggcaagttcatcgagattgctgccaggaagaagaggaacttcatcctggaccagaccaacgtgtctgctgctgcccagaggaggaagatgtgcctgtttgctggcttccagaggaaggctgtggtggtgtgccccaaggatgaggactacaagcagaggacccagaagaaggccgaggtggagggcaaggacctgcctgagcacgctgtgctgaagatgaagggcaacttcaccctgcctgaggtggccgagtgctttgatgagatcacctacgtggagctgcagaaggaggaggcccagaagctgctggagcagtacaaggaggagagcaagaaggccctgcccccagagaagaagcagaacacaggcagcaagaagagcaacaagaacaagagcggcaagaaccagttcaacagaggaggcggccaccggggccggggcggcttcaacatgagaggaggcaacttccggggcggggcccctggcaacagaggaggctacaacagaagaggcaacatgccccagagaggaggcggcggcggcggcagcggcggcatcggctacccctacccccgggcccctgtgtttcctggccggggcagctacagcaacagaggcaactacaacagaggaggcatgcccaacagaggcaactacaaccagaacttccggggccggggcaacaacagaggctacaagaaccagagccagggctacaaccagtggcagcagggccagttctggggccagaagccctggagccagcactaccaccagggctactactag

SEQ ID NO: 21444 - DNA, 651 bp, Artificial Sequence
  Description of Artificial Sequence: Synthetic coding sequence
atgagcacagtggacctggcccgggtgggcgcctgcatcctgaagcatgctgtgactggagaggccgtggagctgcggagcctgtggagggagcacgcctgtgtggtggccggcctgcggcgcttcggctgtgtggtgtgccgctggatcgcccaggacctgagcagcctggccggcctgctggaccagcacggcgtgcggctggtgggcgtgggccctgaggccctgggcctgcaggagttcctggatggagactactttgctggggagctgtacctggatgagagcaagcagctgtacaaggagctgggcttcaagaggctgtggacccaggccagccctgagtttggccaggccacctggtgcctgcggcgctacaacagcctgagcatcctgcctgctgccctgggcaagcctgtgagagatgtggccgccaaggccaaggctgtgggcatccagggcaacctgagcggggacctgctgcagagcggcggcctgctggtggtgtccaaaggaggagacaaggtgctgctgcactttgtgcagaagagccctggggactatgtgcccaaggagcacatcctgcaggtgctgggcatctctgctgaggtgtgtgccagtgaccccccccagtgtgaccgggaggtgtag

SEQ ID NO: 21445 - DNA, 1191 bp, Artificial Sequence
  Description of Artificial Sequence: Synthetic coding sequence
atgttctggaagtttgacctgcacaccagcagccacctggacaccctgctggagcgggaggacctgagcctgcctgagctgctggatgaagaagatgtgctgcaggagtgcaaggtggtgaacaggaagctgctggacttcctgctgcagcccccccacctgcaggccatggtggcctgggtgacccaggagcccccagacagcggggaggagcggctgcgctacaagtaccccagcgtggcctgtgagatcctgaccagtgatgtgccccagatcaatgatgccctgggcgcagatgagagcctgctgaaccggctgtatggcttcctgcagagcacaggcagcctgaaccccctgctggccagcttcttcagcaaggtgatgggcatcctgatcaacaggaagacagaccagctggtgtccttcctgaggaagaaggatgactttgtggacctgctgctgcagcacatcggcaccagcgccatcatggacctgctgctgcggctgctgacctgtgtggagcggccccagctgcggcaggatgtggtgaactggctgaatgaggagaagatcgtgcagaggctcatcgagcagatccaccccagcaaggatgagaaccagcacagcaatgccagccagagcctgtgtgacatcatccggctgagccgggagcagatgatccaggtgcaggacagccctgtgcccacagatgcccccaccagcccccgggtgtctggagaggaggagctgcacacaggccccccagccccccagggccccctgtctgtgccccagggcctgcccacccagagcctggccagccccccagccagagatgccctgcagctgcggagccaggaccccaccccacccagcgccccccaggaggccacagagggcagcaaggtgacagagcccagcgccccctgccaggccctggtgtccatcggggacctgcaggccaccttccacggcatccgcagcgcccccagcagcagtgacagcgccacccgggaccccagcacctctgtgcctgccagcggggcccaccagcccccccagaccacagaaggagagaagagccctgagcccctgggcctgccccagagccagagcgcccaggccctgaccccaccacccatccccaatggaagtgcccctgagggccctgccagccctggcagccagtag

SEQ ID NO: 21446 - DNA, 2178 bp, Artificial Sequence
  Description of Artificial Sequence: Synthetic coding sequence
atgggcaccaggaagaaggtgcacgcctttgtgcgggtgaagcccacagatgactttgcccacgagatgatccgctatggagatgacaagaggagcattgacatccacctgaagaaggacatccggcggggcgtggtgaacaaccagcagacagactggagcttcaagctggatggagtgctgcatgatgccagccaggacctggtgtatgagaccgtggccaaggatgtggtgtcccaggccctggatggctacaacggcaccatcatgtgctacggccagacaggagctgggaagacctacaccatgatgggcgccacagagaactacaagcaccggggcatcctgccccgggccctgcagcaggtgttcaggatgattgaggagcggcccacccacgccatcaccgtgcgggtgtcctacctggagatctacaatgaaagcctgtttgacctgctgagcaccctgccctacgtgggccccagcgtgacccccatgaccatcgtggagaacccccagggcgtcttcatcaagggcctgtctgtgcacctgaccagccaggaggaggatgccttcagcctgctgtttgaaggagagaccaaccgcatcatcgccagccacaccatgaacaagaacagcagccgcagccactgcatcttcaccatctacctggaggcccacagcaggaccctgtctgaggagaagtacatcaccagcaagatcaacctggtggacctggccggcagcgagcggctgggcaagagcggcagcgagggccaggtgctgaaggaggccacctacatcaacaagagcctgtccttcctggagcaggccatcatcgccctgggggaccagaagagggaccacatccccttccggcagtgcaagctgacccacgccctgaaggacagcctgggcggcaactgcaacatggtgctggtgaccaacatctacggggaggccgcccagctggaggagaccctgagcagcctgcgctttgccagcaggatgaagctggtgaccacagagcccgccatcaatgagaagtatgatgctgagaggatggtgaagaacctggagaaggagctggccctgctgaagcaggagctggccatccatgacagcctgaccaacagaacatttgtgacctatgaccccatggatgagatccagattgctgagatcaacagccaggtgcggcgctacctggagggcaccctggatgaaattgacatcatcagcctgcggcagatcaaggaggtgttcaaccagttccgggtggtgctgagccagcaggagcaggaggtggagagcaccctgcggaggaagtacaccctgattgacagaaatgactttgctgccatcagcgccatccagaaggccggcctggtggatgtggatggccacctggtgggggagcctgagggccagaactttggcctgggcgtggcccccttcagcaccaagccaggcaagaaggccaagagcaagaagaccttcaaggagcccctgcggccagacaccccacccagcaagcctgtggcctttgaggagttcaagaatgagcagggcagcgagatcaaccgcatcttcaaggagaacaagagcatcctgaatgaaagaaggaagagggccagcgagaccacccagcacatcaatgccatcaagcgggagattgatgtgaccaaggaggccctgaacttccagaagagcctgcgggagaagcagggcaagtatgagaacaagggcctgatgatcattgatgaggaggagttcctgctgatcctgaagctgaaggacctgaagaagcagtacagaagtgagtaccaggacctgcgggacctgcgggcagagatccagtactgccagcacctggtggaccagtgccgccaccggctgctgatggagtttgacatctggtacaatgaaagctttgtgattcctgaggacatgcagatggccctgaagccaggcggcagcatccggcccggcatggtgcctgtgaacagaattgtgtccctgggggaggatgaccaggacaagttcagccagctgcagcagagggtgctgcctgagggccctgacagcatctccttctacaatgccaaggtgaagattgagcagaagcacaactacctgaagaccatgatgggcctgcagcaggcccacaggaagtag

SEQ ID NO: 21447 - DNA, 282 bp, Artificial Sequence
  Description of Artificial Sequence: Synthetic coding sequence
atggctgctgccactggagaccccggcctgagcaagctgcagtttgcccccttcagcagcgccctggatgtgggcttctggcatgagctgacccagaagaagctgaatgagtaccgcctggatgaggcccccaaggacatcaagggctactactacaatggagacagcgctggcctgcctgcccggctgaccctggagttcagcgcctttgacatgtctgcccccaccccagcccgctgctgcccagccatcggcaccctgtacaacaccaacaccctgtag

SEQ ID NO: 21448 - DNA, 333 bp, Artificial Sequence
  Description of Artificial Sequence: Synthetic coding sequence
atgggcaagaagcagaacaagaagaaggtggaggaggtgctggaggaggaggaggaggagtatgtggtggagaaggtgctggacagaagagtggtgaagggcaaggtggagtacctgctgaagtggaagggcttcagtgatgaggacaacacctgggagcctgaggagaacctggactgcccagacctgattgctgagttcctgcagagccagaagacagcccatgaaacagacaagtctgagggcggcaagaggaaggctgacagcgacagcgaggacaagggggaggagagcaagcccaagaagaagaaggaggagagcgagaagccctag

SEQ ID NO: 21449 - DNA, 270 bp, Artificial Sequence
  Description of Artificial Sequence: Synthetic coding sequence
atgagctactaccagaggcccttcagccccagcgcctacagcctgcctgccagcctgaacagcagcatcgtgatgcagcacggcaccagcctggacagcacagacacctacccccagcacgcccagagcctggatggcaccaccagcagcagcatccccctgtaccgcagcagcgaggaggagaagagggtgaccgtcatcaaggccccccactacccaggcatcggccctgtggatgaaagtggcatccccacagccatccgcacctag

SEQ ID NO: 21450 - DNA, 1269 bp, Artificial Sequence
  Description of Artificial Sequence: Synthetic coding sequence
atggagaggaaggactttgagacctggctggacaacatctctgtgaccttcctgagcctgacagacctgcagaagaatgagaccctggaccacctgatcagcctgagcggggctgtgcagctgcggcacctgagcaacaacctggagaccctgctgaagagggacttcctgaagctgctgcccctggagctgtccttctacctgctgaagtggctggacccccagaccctgctgacctgctgcctggtgtccaagcagtggaacaaggtgatcagcgcctgcacagaggtgtggcagacagcctgcaagaacctgggctggcagattgatgacagcgtgcaggatgccctgcactggaagaaggtgtacctgaaggccatcctgaggatgaagcagctggaggaccacgaggcctttgagaccagcagcctgattggccacagcgcccgggtgtatgccctgtactacaaggatggcctgctgtgcaccggcagtgatgacctgagcgccaagctgtgggatgtgtccacaggccagtgtgtgtatggcatccagacccacacctgtgccgctgtgaagtttgatgagcagaagctggtgacaggcagctttgacaacacagtggcctgctgggagtggagcagcggggcccggacccagcacttccggggccacactggagctgtgttttctgtggactacaatgatgagctggacatcctggtgtctggcagcgctgacttcaccgtgaaggtgtgggccctgtctgctggcacctgcctgaacaccctgaccggccacacagagtgggtgaccaaggtggtgctgcagaagtgcaaggtgaagagcctgctgcacagccctggggactacatcctgctgtctgctgacaagtatgagatcaagatctggcccatcggccgggagatcaactgcaagtgcctgaagaccctgtctgtgtctgaggacaggagcatctgcctgcagccccggctgcactttgatggcaagtacatcgtgtgcagcagcgccctgggcctgtaccagtgggactttgccagctatgacatcctgcgggtcatcaagaccccagagatcgccaacctggccctgctgggctttggagacatctttgccctgctgtttgacaaccgctacctgtacatcatggacctgaggacagagagcctcatcagccgctggcccctgcctgagtacaggaagagcaagaggggcagcagcttcctggccggggagcaccctggatag

SEQ ID NO: 21451 - DNA, 1179 bp, Artificial Sequence
  Description of Artificial Sequence: Synthetic coding sequence
atgtctgccctggccggagaagatgtgtggcgctgccccggctgtggggaccacatcgcccccagccagatctggtacagaacagtgaatgagacctggcacggcagctgcttcagaagaagcaacagcatcagcaagagccctggccccagcagccccaaggagcccctgctcttcagccgggacatcagccgctctgagagcctgcgctgcagcagcagctacagccagcagatcttccggccctgtgacctgattcatggagaggtgctgggcaagggcttcttcggccaggccatcaaggtgacccacaaggccaccgggaaggtgatggtgatgaaggagctgatccgctgtgatgaggagacccagaagaccttcctgacagaggtgaaggtgatgaggagcctggaccaccccaacgtgctgaagttcatcggcgtgctgtacaaggacaagaagctgaacctgctgacagagtacatcgagggcggcaccctgaaggacttcctgcgctccatggaccccttcccctggcagcagaaggtgcgctttgccaagggcatcgccagcggcatggcctacctgcacagcatgtgcatcatccaccgggacctgaacagccacaactgcctgatcaagctggacaagacagtggtggtggccgactttggcctgagccgcctcatcgtggaggagaggaagagggcccccatggagaaggccaccaccaagaagaggaccctgaggaagaatgacaggaagaagcgctacacagtggtgggcaacccctactggatggcccctgagatgctgaatggcaagagctatgatgagaccgtggacatcttctcctttggcatcgtgctgtgtgagatcatcggccaggtgtatgctgaccctgactgcctgcccaggaccctggactttggcctgaatgtgaagctgttctgggagaagtttgtgcccacagactgccccccagccttcttccccctggccgccatctgctgccgcctggagcctgagagcaggcctgccttcagcaagctggaggacagctttgaggccctgagcctgtacctgggggagctgggcatccccctgcctgctgagctggaggagctggaccacacagtgtccatgcagtatggcctgacccgggacagccccccatag

SEQ ID NO: 21452 - DNA, 480 bp, Artificial Sequence; identical to SEQ ID NO: 20848
  Description of Artificial Sequence: Synthetic coding sequence

SEQ ID NO: 21453 - DNA, 3585 bp, Artificial Sequence
  Description of Artificial Sequence: Synthetic coding sequence
atgttcagcctggacagcttcaggaaggaccgggcccagcaccggcagaggcagtgcaagctgcccccaccccggctgccccccatgtgtgtgaaccccaccccaggcggcaccatcagccgggccagccgggacctgctgaaggagttcccccagcccaagaacctgctgaacagcgtgattggccgggccctgggcatcagccacgccaaggacaagctggtgtatgtgcacaccaacggccccaagaagaagaaggtgaccctgcacatcaagtggcccaagtctgtggaggtggagggctacggcagcaagaagattgatgctgagcggcaggccgctgctgctgcctgccagctgttcaagggctggggcctgctgggccccagaaatgagctgtttgatgctgccaagtacagagtgctggccgaccgcttcggcagccctgctgacagctggtggaggcctgagcccaccatgccacccacctcctggaggcagctgaaccctgagagcatccggcctgggggccctgggggcctgagccgcagcctgggccgggaggaggaggaggatgaggaggaggagctggaggagggcaccattgatgtgacagacttcctgtccatgacccagcaggacagccacgcccccctgcgggacagccggggcagcagctttgagatgacagatgatgacagcgccatccgggccctgacccagttccccctgcccaagaacctgctggccaaggtgatccagatcgccaccagcagcagcacagccaagaacctgatgcagttccacacagtgggcaccaagaccaagctgagcaccctgaccctgctgtggccctgccccatgacctttgtggccaagggccgcaggaaggccgaggccgagaacaaggctgctgccctggcctgcaagaagctgaagagcctgggcctggtggacaggaacaatgagcccctgacccacgccatgtacaacctggccagcctgcgggagctgggggagacccagaggcggccctgcaccatccaggtgcctgagcccatcctgaggaagattgagaccttcctgaaccactaccctgtggagagctcctggatcgcccctgagctgcggctgcagagtgatgacatcctgcccctgggcaaggacagcggccccctgagtgaccccatcaccgggaagccctacgtgcccctgctggaggccgaggaggtgcggctgagccagagcctgctggagctgtggaggagaagaggccctgtgtggcaggaggccccccagctgcctgtggacccccaccgggacaccatcctgaatgccatcgagcagcaccctgtggtggtgatcagcggggacaccggctgcggcaagaccacccgcatcccccagctgctgctggagagatatgtgacagagggccgcggggcccgctgcaacgtcatcatcacccagccccggcgcatctctgctgtgtctgtggcccagagggtgtcccatgagctgggccccagcctgcggagaaatgtgggcttccaggtgcggctggagagcaagccacccagcagaggaggagccctgctcttctgcaccgtgggcatcctgctgaggaagctgcagagcaaccccagcctggagggcgtgagccacgtgattgtggatgaggtgcatgaaagagatgtgaacacagacttcctgctgatcctgctgaagggcctgcagaggctgaacccagccctgcggctggtgctgatgtctgccactggagacaatgaacgcttcagccgctactttggaggctgccctgtgatcaaggtgcccggcttcatgtaccctgtgaaggagcactacctggaggacatcctggccaagctgggcaagcaccagtacctgcaccgccaccgccaccacgagagtgaagatgaatgtgccctggacctggacctggtgacagacctggtgctgcacattgatgcccggggggagcccggcggcatcctgtgcttcctgcccggctggcaggagatcaagggcgtgcagcagaggctgcaggaggccctgggcatgcatgagagcaagtacctgatcctgcctgtgcacagcaacatccccatgatggaccagaaggccatcttccagcagccccctgtgggcgtgaggaagatcgtgctggccaccaacattgctgagaccagcatcaccatcaatgacatcgtgcacgtggtggacagcggcctgcacaaggaggagagatatgacctgaagaccaaggtgtcctgcctggagaccgtgtgggtgtcccgggccaacgtcatccagaggcggggccgggccggccgctgccagagcggctttgcctaccacctgttccccaggagccggctggagaagatggtgcccttccaggtgcctgagatcctgcggacccccctggagaacctggtgctgcaggccaagatccacatgcctgagaagacagctgtggagttcctgagcaaggctgtggacagccccaacatcaaggctgtggatgaagctgtgatcctgctgcaggagattggagtgctggaccagcgggagtacctgaccaccctgggccagaggctggcccacatcagcacagacccccggctggccaaggccatcgtgctggccgccatcttccgctgcctgcaccccctgctggtggtggtgtcctgcctgacccgggaccccttcagcagcagcctgcagaacagagctgaggtggacaaggtgaaggccctgctgagccatgacagcggcagtgaccacctggcctttgtgcgggctgtggccggctgggaggaggtgctgcgctggcaggacaggagcagccgggagaactacctggaggagaacctgctgtatgcccccagcctgcgcttcatccacggcctcatcaagcagttcagcgagaacatctatgaggccttcctggtgggcaagcccagcgactgcaccctggccagcgcccagtgcaatgagtacagcgaggaggaggagctggtgaagggcgtgctgatggccggcctgtaccccaacctgatccaggtgcggcagggcaaggtgacccggcagggcaagttcaagcccaacagcgtgacctaccgcaccaagagcggcaacatcctgctgcacaagagcaccatcaaccgggaggccacccggctgcggagccgctggctgacctacttcatggctgtgaagagcaatggatctgtgtttgtgcgggacagcagccaggtgcaccccctggccgtgctgctgctgacagatggagatgtgcacatcagagatgatggccggcgggccaccatcagcctgagtgacagcgacctgctgcggctggagggggacagcaggacagtgcggctgctgaaggagctgcggcgggccctgggccgcatggtggagaggagcctgcggtctgagctggccgccctgcccccatctgtgcaggaggagcacggccagctgctggccctgctggccgagctgctgcggggcccctgtggcagctttgatgtgaggaagacagcagatgactag

SEQ ID NO: 21454 - DNA, 207 bp, Artificial Sequence
  Description of Artificial Sequence: Synthetic coding sequence
atgagctactaccagaggcccttcagccccagcgcctacagcctgcctgccagcctgaacagcagcatcgtgatgcagcacggcaccagcctggacagcacagacacctacccccagcacgcccagagcctggatggcaccaccagcagcagcatccccctgtaccgcagcagcgaggaggagaagagggtgaccgtcatcaagtag

SEQ ID NO: 21455 - DNA, 1419 bp, Artificial Sequence
  Description of Artificial Sequence: Synthetic coding sequence
atgagcagaagagtggtgcggcagagcaagttcagacatgtgtttggccaggccgccaaggctgaccaggcctatgaggacatccgggtgtccaaggtgacctgggacagcagcttctgtgctgtgaaccccaagttcctggccatcatcgtggaggccggcggcggcggggccttcatcgtgctgcccctggccaagacaggccgggtggacaagaactaccccctggtgacaggccacacagcccctgtgctggacatcgactggtgcccccacaatgacaacgtgattgccagcgccagtgatgacaccaccatcatggtgtggcagatcccagactacacccccatgaggaacatcacagagcccatcatcaccctggagggccacagcaagagggtgggcatcctgtcctggcaccccacagccagaaatgtgctgctgtctgctggaggagacaacgtcatcatcatctggaatgtgggcactggagaggtgctgctgagcctggatgacatgcacccagatgtgatccacagcgtgtgctggaacagcaatggcagcctgctggccaccacctgcaaggacaagaccctgcgcatcatcgaccccaggaagggccaggtggtggccgagcaggcccggccccatgaaggagcccggcccctgcgggctgtgttcaccgcagatggcaagctgctgagcacaggcttcagcaggatgtctgagcggcagctggccctgtgggaccccaacaactttgaggagcctgtggccctgcaggagatggacaccagcaatggagtgctgctgcccttctatgaccctgacagcagcatcgtgtacctgtgtgggaagggggacagcagcatccgctactttgagatcacagatgagcccccatttgtgcactacctgaacaccttcagcagcaaggagccccagaggggcatgggcttcatgcccaagaggggcctggatgtgtccaaatgtgaaattgcccgcttctacaagctgcacgagaggaaatgtgagcccatcatcatgacagtgcccaggaagagtgacctcttccaggatgacctgtacccagacaccccaggccctgagcccgccctggaggctgatgagtggctgagcggccaggatgctgagcctgtgctgatcagcctgagagatggctacgtgccccccaagcaccgggagctgcgggtgaccaagaggaacatcctggatgtgcggcccccatctggcccccggcgcagccagagcgccagtgatgcccccctgagccagcagcacaccctggagaccctgctggaggagatcaaggccctgcgggagcgggtgcaggcccaggagcagaggatcacagccctggagaacatgctgtgtgagctggtggatggaacagactag

SEQ ID NO: 21456 - DNA, 390 bp, Artificial Sequence
  Description of Artificial Sequence: Synthetic coding sequence
atcctgcacagcctggtgcagacaggcatctgtgtgatcaccctggccgagagccaccctgtgctgcagagcggcaagaccatcaagagcatctcctaccagatcagcaccaactgcagccggctgcagaacaaggtgtctgggaagttcaagagaggagcccagttcctgacagagctggcccccctgtgcaagatctactgcagtgatggagaggagtacacagtgagcagctgtgtgcggggccgcctgatggaggtgaatgaaaacatcctgcacaagcccagcatcctgcaggagaagcccagcacagagggctacatcgctgtggtgctgcccaagtttgaggagagcaagagcatcacagagggcctgctgacccagaagtag

SEQ ID NO: 21457 - DNA, 735 bp, Artificial Sequence
  Description of Artificial Sequence: Synthetic coding sequence
atggtgcaccaggacaactgcagctaccaggcccagaagaatgaaagagagagcatccggcagaagctggccctgggcagcttctttgatgatggccctggcatctacaccagctgcagcaagagcggcaagcccagcctgagcagccggctgcagagcggcatgaacctgcagatctgctttgtgaatgattctggcagtgacaaggacagtgatgctgatgacagcaagacagagaccagcctggacacccccctgagccccatgagcaagcagagcagcagctacagcgaccgggacaccacagaggaggagagcgagagcctggatgacatggacttcctgacccggcagaagaagctgcaggccgaggccaagatggccctggccatggccaagcccatggccaagatgcaggtggaggtggagaagcagaacaggaagaagagccctgtggccgacctgctgccccacatgccccacatcagcgagtgcctgatgaagaggagcctgaagcccacagacctgcgggacatgaccatcggccagctgcaggtgattgtgaatgacctgcacagccagatcgagagcctgaatgaggagctggtgcagctgctgctgatcagagatgagctgcacacagagcaggatgccatgctggtggacatcgaggacctgaccaggcatgctgagagccagcagaagcacatggccgagaagatgcctgccaagtag

SEQ ID NO: 21458 - DNA, 1620 bp, Artificial Sequence; identical to SEQ ID NO: 19050
  Description of Artificial Sequence: Synthetic coding sequence

SEQ ID NO: 21459 - DNA, 441 bp, Artificial Sequence
  Description of Artificial Sequence: Synthetic coding sequence
atgtttgagatcctgaccagcgagttctcctaccagcacagcctgagcatcctggtggaggagttcctgcagagcaaggagctgcgggccaccgtgacccagatggagcaccaccacctgttcagcaacatcctggatgtgctgggcgccagccagcgcttctttgaggacctggagcagaggcacaaggcccaggtgctggtggaggacatcagtgacatcctggaggagcacgccgagaagcacttccacccctacatcgcctactgcagcaatgaggtgtaccagcagaggaccctgcagaagctgatcagcagcaatgctgccttccgggaggccctgcgggagattgaaagaagacctgcctgtggcggcctgcccatgctgtccttcctgatcctgcccatgcagagggtgacccggctgcccctgctgatgtag

SEQ ID NO: 21460 - DNA, 483 bp, Artificial Sequence; identical to SEQ ID NO: 20009
  Description of Artificial Sequence: Synthetic coding sequence

SEQ ID NO: 21461 - DNA, 303 bp, Artificial Sequence
  Description of Artificial Sequence: Synthetic coding sequence
atgagctactaccagaggcccttcagccccagcgcctacagcctgcctgccagcctgaacagcagcatcgtgatgcagcacggcaccagcctggacagcacagacacctacccccagcacgcccagagcctggatggcaccaccagcagcagcatccccctgtaccgcagcagcgaggaggagaagagggtgaccgtcatcaaggccccccactacccaggcatcggccctgtggatgaaagtggcatccccacagccatccgcaccaccgtggaccggcccaaggactggtacaagacctag

SEQ ID NO: 21462 - DNA, 369 bp, Artificial Sequence; identical to SEQ ID NO: 21112
  Description of Artificial Sequence: Synthetic coding sequence

SEQ ID NO: 21463 - DNA, 633 bp, Artificial Sequence
  Description of Artificial Sequence: Synthetic coding sequence
atggtgtccatgtctgtgcctgactgcctgagcatcatgacctacgtgtcccagtactacaaccacttctgcagccctggccaggccggcgtgtccccacccaggaagggcctggccccctgcagccccccatctgtggcccccacccctgtggagccagaagatgtggcccagggcgaggagctgagcagcggcagcctgtctgagcagggcaccggccagacccccagcagcacctgtgccgcctgccagcagcacgtgcacctggtgcagcgctacctggctgatggccgcctgtaccaccgccactgcttccgctgccgccgctgcagcagcaccctgctgcccggggcctatgaaaatggacctgaggagggcacctttgtgtgtgccgagcactgtgcccggctgggccctggcaccaggagcggcaccaggcctggccccttcagccagcccaagcagcagcaccagcagcagctggctgaagatgccaaggatgtgcctgggggcggccccagcagcagcgccccagctggagctgaggctgatggccccaaggccagccctgaggcccggccccagatccccaccaagccccgggtgcctgggaagctgcaggagctggcctag

SEQ ID NO: 21464 - DNA, 390 bp, Artificial Sequence; identical to SEQ ID NO: 19988
  Description of Artificial Sequence: Synthetic coding sequence

SEQ ID NO: 21465 - DNA, 621 bp, Artificial Sequence
  Description of Artificial Sequence: Synthetic coding sequence
atggccctgaatgtggcccctgtgcgggacaccaagtggctgaccctggaggtgtgccggcagttccagaggggcacctgcagcagaagtgatgaggagtgcaagtttgcccacccccccaagagctgccaggtggagaatggccgggtgattgcctgctttgacagcctgaagggccgctgcagccgggagaactgcaagtacctgcacccccccacccacctgaagacccagctggagatcaatggaagaaacaacctgatccagcagaagacagctgctgccatgctggcccagcagatgcagttcatgtttcctggcacccccctgcaccctgtggccttccccccaggggccctgcaccccctgcccaagaggcaggccctggagaagagcaatggcaccagcgctgtgttcaaccccagcgtgctgcactaccagcaggccctgaccagcgcccagctgcagcagcacgccgccttcatccccacagacaacagcgagatcatcagcagaaatggcatggagtgccaggagagcgccctgcgcatcaccaagcactgctactgcacctactaccctgtgagcagcagcattgagctgccccagacagcctgctag
